United States Patent 9,328,346 (POLYCOMB-ASSOCIATED NON-CODING RNAS) - sequence listing, part 19

SEQ ID NO: 3033 - RNA, 158051 nt, Mus musculus
cgaggaggggccuggccgcggggagccgaggagggagguggggauucugggagccgagcucauuuccuccucccggccgccccaggcccgcaccccaucuccacgugcggcgccuccggagcgcggccgagccacggaggaugcugggcauguacguaccagacagguucgcccugaagucgucccggguccaggacgggauggggcucuacacggcccgccgcgugcgcaaggugggugagcggcccgcucaggccgcgccacgucccagggccugcggggagaacgggccuguagggagcgggugucugguugucuuucgcggcuguggcgagaggcucccaugggcugcagucucccccagcccagcgccggacggcuccugaauucugaacaguuggcagccuggucauaccccucacugcuugugcagaugggcccuggcagcuugcagcccagugcaggcccgggagccacagaagcaggccuucccgacauugccauccugggggugguaucuggaucuucggccuauuuucuuugaguuuuugaauuuuauccuggcauuggaucaccuuccagaacggcacaggcaugggaucaaguuaagcgcagguuucccugucugugagaugacccacuauagauguugguuguucauuggagagauguagaagacaggaaaccagagcgcuccaaaucuuaaguuauaacuuuagaacaugguggcuugagcuauuguggguuagcagacuugaaauagaggagucagggcagagacaucuagaguaagcagauccaagguucacagagcagggccaaugcuugguacuuuguccauauauaucauuugacuuuaccccucaguacucuggggaacugucuuuuaguuaucauuuaagaggugagcauaggaaugcugcaguuaaccugccaaguuaacgaauuaagcuucaaacccaugguuucugaaaggaaaacauaugcucuuucuagaacauucuguuauggaacaacauguuuauaaaccuugccccugacacguucccggccucuccucgcuguuuugauuuugcccuguuagcagauacuuagaaaagcagagguucagaggguagugugugaauguagcucugggcucacaacaugaccuacaagaaguuaccauaggucaaguggucaaaacaaaacaaaacaacaacaaaaaacaacucacauauuaaauguagacaaacaaaacacaggaguuaauacuucauuccauuuagugaugaguuggauagauauugccacaugacgaaaugucaaaaucagcagucuugcaaagccaaguaucaccaucaucaaaugacucccaugucccauugacauaugcuucuguuuaggucuuacagcaugaaaaaccccuaaauggacuuuuccugaagguuucugguguaacuauaauuaagaauaauuuugugcucacgaauaguaggacaccagacagcuguccaaaaguaagaauuacugcacaauccuccuucugcuuuacucagaccauuuuuugguaguugagcagggcauucucuuugacauuuucauguccuuguguugggaguacucguuggugugggcugaagcaucuugagccauccuacugcagcauugguaggcauucaucuucugcugcugauaucacuuaaacaaaccaacagauuuucauccagauaacaucuagcaugaugaccacacacaauguggcuuacagaaacccagccuguuuuugacagaguuguuauucuaagauaugcaaucacaagcucacggagagcuucccugaugccuguacggcagcuguuuccuccccuguacuccaaggacaaagcugaagccucccaggcuugugagaagaagcugaguguucuuacacgccuuaccuaugucaccacaucucaucucuuaauuauuucccaagucacccauguacauaucuccugacuauauuucaagaggucugagaugacaacagcugugauuggagcuauguuaaggaccucaauuaaaaacuccucaugcucuucuaagcagauugugagguuuaccacuuuagaccauguguugccaacaacagaugucauagcauacuuuuauagcaggugugcuuauauaauucaucuguuuuacaaagugauugagauucaaguucuuuguugauuugaaaauucagacauuagaauccagaauaggcuuggggaaaucuuccaagagccccaagaaaauccauaccuguacuuucuauagguuguuugagguacuuuuucugaaggcaccccuuauuucucuagacccaccccuuuugaagcauuccuucaguggggcucugcaacuguaucuagauaaucuggaccauuguauacagagcaauuugagugacauuucaccauguccugguccuguaaagaugcacccuugcucaucauguacugguuaugcuuuacuuuguuugcaggaaucacggacacgugauuguugaacacgguaacaguccugcauuaaagccuggcugugcgccuuuagcagggggaagagaaaguguguuuuggaccaaauguaagacagacuaggauuuaauagguuacaaauaaugacauuuuaaagagcaucacgggugaucuguucuacacauugucaugguguggguggccgcaccagagauuuauagcugccucugaaguucccaugccucccccacuaucaacugucaacuccuugucucucagaccaaggagacacugcucaugaaaaacgguuagugaaaauaaguuuaaugcccaguuuguaaaaaauagaagaaaaauguaaagauaaguugaaagugugaaguuuggaggaaaauauaugauuaaaacaaaauaaaccaaccagccaaacaaacaaacaaacaugaaacccaaaagagaaaagcaggcagaggaaagauuaccauguuaauacuggaagaccagaauuuguguacuaauauguuuugcugauuacuguugaaggugaccccucuaaauggauuuuuaucuuagggcugaaacucugccaguagauguuuauuacauuuucuggcggcugaugguaagucacuaaucuggaaauagaaucacugcagugacacugucccccuguuuguacagucaggugucaccauggggacccagugaggccuuauauuuccugcugugaugacagacuuuuagagauacaucaaagaugcauuuaaaacgauguuuucacugaaacuuuguauuuugcuucuguguugauaacagcuaccaauaauuaauuuguuuauaauuuaauauagcuuggcuaaugaaacauuuaugaagcuauugcgauuguuaggaacuauccguguuaggagacagagggugaaugccagauagcgauugugcagcuuuucucaggucuuacugaagccauacagcaaaaaccugcuuccuaggugacacagaacugaugcuagggcaaggucuauccacacuaagacgguucaucagauuugaacucaggucauuccaugaauugggcauccuucauguaaaauuugaaguguccaaaaugugaaaauuuuuguauggcuaugugauaccagaaagggaacacaguucugaauguaugaacucaccuucagacuguguaaagugcuuaugaaacaugaauucucuauuuagcacacauuuauauaucuaucugucuguauaucuguaguuauagaauacccuccccugaacucuggaauccagaacacuuguuuauucauagaccagauuaggaauaguugguuggcuuauacucuuaucaaaaaggcauuuucucuguaaucauuaaauguuaaguuuguaaaugcacucaaacacaaagauuauuuuuauuguauuauuuuuuauaacauauaaaaauaugcaauauaugagaauauauaaaauauaaauauaugcaauauauaauauauaaauuuauagaaacuuaauacaauaauauaugauaauauauuauuauuuaucuuuaaaaugggacauuucucauucagcaguagugugaauaauuccucuaauuuaucuacauuggcucguauuacuauauuuuagcaguguuuuuuuuuuuuuuccuaacuaggccauguuaacuguguaaaauaauggguuuuauugugguauuuucaugcauggaugucauguacuuugacaacacucaucuccuuuguccucucuugacccugucuuuccucacugauuuucacuuuccuaaauaaaccugcuuuuauuuugaugucuuaguauuuuuuuuuaauauagacuuggcauaugaaagaacacaugugauacucaucuuuuggggcuuagcuuguuucauauagcacuauggccuccaaauuccauugauuugccuacagauuauauaauuucaauaugcauggcugaaugaaaaacuccauuguuuguguagauguguauaauuaauuaauuaauaugucaaauuuucaucauuuaugucucuuucuuuuaacaugcagacuggugccauaacuuggguaguaugaacaggucuuuuauggugauugaagauauuccauagugaagaugugcaauauuauuucuuuauggcauauugcacagucauuuaaucacuauaugccagggucuauccuagacacuugacuagaccagugaagaaaaugaauauucuggcucuugagcagcuucauuauccaguaggcaaauguuauuguauacuagaacuugauaaauacuauaggaaaacaguggggguagggcuggcucugguuggcugggaaaauaaugaggaauguuauaaauuagguauccuagcuaguuuucauuaaggcgagauuugaacaauggcaugaaggauuguaggaaaccagccaaauauauuuccaggggaagaacauucuugcuagggaacaaguuagucugaaauccugagacaggcaaacuugcuuugccuguugguuuccagggagauuaguauggcauuccaggagugagcuagggcagguccuccaauaccuuaagaaagggaggguauuugaaggagagccacauuuccuagagcauuucaugcagcugaagacuggcauugauuuaaauguauuggagaccuacuugucgaggagggcuguguguuuaucaaggauaacucuggcugcagcuuggaguauaacacugucaugggaaaacuguagaaacagugauuuacuaggauuuucuuggcuguaaccaaugggggcaaugagauucagacuaagugacagcucugacuguauuuugaaggcagaggggacagaauaugguagagugaaaaagaacaggaaggauaaaggaaguuuccaguggcuuagccugagaucuugaaaggacugaacuguuagucaauaacugagaugaggcauuuguguggagcaagguugaagagauggauggugaguugaguagcgugaguuccauucauuucaggcuuguuuauuuuuuucuuagguauuuucuuuauuuacauuuccagugcuaucccaaaagucccccauacccucccccaccacucuccuacccacccacucccacuucuuggcucuggcauuccccuguacugagacauauaaagguugcacaaucaaugggccucucuuuccacugauggccgacuaggccaucuucugauacauaugcagcuagagacacgagcucuggggggguggggguauggggaggaaggaggguacugguuaguucauauuguuguuccaccuauaggguugcagaucccuuuagcuccuuggauacuuucucuagcuacuccuuugggggcccugugauccauucaauagcugacugugagcauccacuuauguguuugcuaggcccaggcauagucucacaaaagacagcuauaucaggguccuuucagcaaaaucuugcuaguguaugcaauggugucaucauuuggaggcuaauuaugggauggaucucuggauauggcagucucuagaugguccauccuuuugucucagcuccaaacuuugucucuguaacuccuuccaugggugauuguuuccaauucuaagaaggggcaaaguguccacacuuuggucuucuuucuucuucaguuucauguguuuugcaaauuguaucuuauaucucagguauacuaaguuucugggcuaauauccacuuaucagugaguacauaucauuugaguucuuuuaugauuguguuaccucacucaggaugaugcccuccagguccauccauuugccuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccgguugggacaucuucuggauauaugcccaggagagguauugcgggauccuccggcaguacuauguccaauuuucugaggaaccgccagacugauuuccagagugguuguacaagcuugcaaucccaccaacaauggaggaguguuccucuuucuccacguccuugccagcaucugcugucaccuggauuuuugaucuuagccauucugacuggugugagguggaaucucaggguuguuuugauuugcauuucccugaugauuaaggauguugaacauuuuuucagguucuucucagccauucguuauuccucaggugagaauucuuuguuuagcucugugccccauuuuuuaaugggguuauuugauuuucuggaguccaccuucuugaauucuuuauauauuggauauuaguccccuaucugauuuaggauagguaaagauccuuucccaaucuguugguggccuuuuugucuuauugacaaugucuuuugccaaacagaagcuuugcaauuuuaugaagucccauuuguugauucuugaucuuacagcacaagccauugcuguucuauucaggaauuuuuccccugugcccauaucuucgaggcuuuuccccacuuucuccucuauaaguuucacugucucugguuuuauguggaguuccuugauccacuuagauuugaccuuaguacaaauagauaggaauggaucauuucgcaaucuucuacaugauaacugccaguugugccagcaccauuuguugaaaaugcugucuuuuuuccacuggaugguuuuagcuuucuugucaaagaucaagugaccauagguguguggguucauuucugggucuucaguucuauuccauuggucuacuugucuguugcuauaccaguaccaugcaguuuuuaucacaauugcucuguaguacagcuuuaggucuggcauggugauuccaccagagguucuuuuauccuugagaagaguuuuugcuauccuagguuuuuuguuauuccagaugaauuugcagauuccccuuucuaauucguugaagaauugaguuggaauuuugauggggauuucauugaaucuguagauugcuuuuggcaagauagccauuuuuacaauguugauccugccaauccaugagcaugagagaucuuuccaucuucugagauuuucuuuaauuucuuucuucagagacuugaaguucuugucauagagaucuuucacuuucuuacuuagagucacaccaagguauuuuauauuauuugugacuauugagaaggguguuguuucccuaauuucuuucucagccuguuuauccuuuguguaaagaaaagccauugacuuguuugaguuaauuuuauauccagcuacuucacugaagcuguuuaucagguuuaggagaugucuguuaaguaagugugacaugucagacgcauugagaugaaaauauacucgcccuguucucccuuuuagaacaauaaaaaacaaaaagggucauuguuauuuacucugcuaguuacuuuuuuuguuagaaaacaucaugugcaguagugacuuauggaaggaauuuauuuuggcuuauaguuccaaagauagaguucauaaugguggcaggcaaccagagcaguacacuuugagaugcacacgggaggcagagaaaguaaacuguaaguggaauaagacuauauauucucaaagcucacccucagugauggauuucuuauaccaaagcuacaccuccuagagguuccacagccuccucuaacauugccaccagcuggguaccaugagcucaaguacacgagucuaugggugauauuguuccuucaaguuaucacauuugacuccuuggcacccauaggcucauggccaucucauggugcaaaauggauuuaauugacugucaaauuucccauagucucuaacacucucaacauguucaagaguucaaagccuaaagauuccucugaaacucaaagcaaccucugaaccauggaucccuguuaaauuaaaaaaaaaaagaaguuauuuauuuccaauauauacugacagaaagaauaaugaagguauagugaggaaauacuggaauaaaguaagaccaaaauucaggagagcaaauaucaaauccuguagcucuaacuccacugucuaagacuuugguuuuaaagguguuagauggcucuaccccuuccagcuuugcugccugccgcaugcaucuuuucuugugcuuguuccacugaaacucaggcuuagccuucaugucuuuauguaauggcaucuuauggccuccuggguucugagagcguucuugaaaggacucugacccugucuagacucugaccucaucucaacagcucguuuaaaccauagaggucgaaucuccaaucccucccuuuugcauuuuucaugucuaccaagacauuuccucauaaacaauaagcuauuuuccuauagauaacaaugccauguuaucucuacuugggauggacguuggcucccuuaaacuuuacauuagugguagguuuugcaugguauaccaguuucugggaacauuaaaccucuuaggcuuucucuuuucauauguuauacagucaucugcaugggaucuugcccugugagcaccuuccuuuugaucuagugcagagcaggcuucuccuuaaugguacuaaucucuuuuaaccugcacagccucuucucaagcauaugucuaggguacagcauuaaucuuccuagugcuaauuuuuucucuacaaucuauauuugguauuuuucuuccccacuugcuccuuuucauuguaucagagcgaucaguaauauccauaccauagacuaaucaucauacugucuggaaauggcuuccaccaaagaaauaauccuuucaaauuuagcccuguucaaguucuuagggcauggggaaaggcagucauauucuuuacuaaaauauuaggacuggccuccaguuaagcugcuaauaugugauucugagauuucaugagccaggccacuacuguacacaugacucuaguacuaccauccuaguucaauuuaguuaauggauuuuuacaguuuuucuuauuaaacugugugugucauuuccccuuugaaucuguauauggaaguuguuguucuuuuaccuuggaugguuuaaaugacuuucaguguuuuuuauuuguuuuucuacuagguggauauuuuaucaagucucauuugauuguuuauauggauugaugcuguuuuauagaggacauuuuaauguaacuggaaaucuugccaggucucuugguuugucucuaaagcucagagaguuauuagaguaugucuaagcucuaaucccaccuugcugaauuacucuuaagucaccaagagugagugauucugaugacacuuaauuaauaugggaguaacuugauguuacuucauguagguaugagagauuccaaggucaccugacaaauugaguaccgcugagauuaccuagccuguuacucccucugggaaugaaugagaccauuugaucugcagaggcagauuuaucuucagcuuuagaaaaccaucuuccagaucacugucuuucaaccuccuuuuuaauauccccugaacuaucuagguuggagcugcccuucaucuauucuccauaaaucucauucuugccucuuuguuuuccuuugagauaugacuauaauuugauucuuguuucuuccuguguuucaauaaauuuucuaaaaauagacacugugaagucaucuuuuuuaauuauuaaaaguuuucauuaaugaugauggggagaugacugaguggauaaaacacuagagaagucgauuuuagauuuccagggucaaucuaaaauagcuggggggcuuuguaucuuaccuccaauccagaguucaggagaaggggguaggggauuaaucgagcaagcagcuugcugcacuagacaaauuggugagcucugaguuugcuaaggaacccuaaguaaauaugauguaaagugaucgaggaagacaucuguugucaaccucugaccuucacagacaugaccacacauguauagucuuacauaaguauaccuacacacaugggaaaguguauacauacauauuccuacaccacaaacccauauacauucuuaauuagaaaauuaauuuaaaaaaauaaaaaaucuucugagguguuguauuuugaugucucuaaguuccauuagacaauucaugcauucuuguuuaauuauaguuguuuuucuuguuuguuaugcugugcugugcaaagauugagucuaucacuaucuguaucucuuacaaucaaggacuccaucugccaaaggaauuugucugucuuucucuuuucaacuccacugaguugagguucauuuuucacuuugguuucacucucucugguggguauggggaguauucauuuaggccauuuuuuguggccaggucacuccugcaggugacaguaggcugcuaaguggauuagugaacucucugggcuucaugcacuuuucugcacaucaagggacaaugccuuauccauuucuggcuuugaaguucuuuuccuaacucucuaauuuucaguggcugucucaggccuuccuacuaucucucuuccuguucauuagcuucaugcugguucuuucugucucuagaacuuacaguuaugcaguuucucacagaugcuaguagcaguuguuugcugagaaaauuagguaucuaaaaaaguaaguuggagaggaaauauguugcuuucugguauauuucucuguauauuuaugucuauguauaucuagccaugucugccugccuguauauuuauauaugcuuguaucuauucucucucucucucucucucucuugcucucucuugcuguccuauuccaucuuccuaacucuguacugcuucuuuucuuuguauuuuauguucuacauuuacauagggcaccauugcauuucugcacugaugccugccauagcaacuguggcuaguagacacgccuacauuccagguggggagaaauagcaagcacacugcauauauuucauaguuggccucauuuaaggacuucugagguagucccacgugauguuuccauucaggucauuaguucucucaucaggauaaauucggauuuuuaccugguuacauugagauuuauaacaaggccaaaguuauaaaaguaaggugaauugauauaggcaggcaauuagacucugccuuaacauucacagcaaggagaaaagauugggugaucuucacacuaaaccuguuggaaauacauuuacuuggaggagaccuaauuauauuacaagagcguauuuaugcacaguaccuuaacagugagaccuagucauguucuacaggagacuucucuaacaauggaaaaaacaagaagaaaaugguagagcaauaccuuuccugcucucaaugagaucuguaggucuuuuauuuugaaaacuaaagccagucaugaucaagucuguucugaaggcuuuaagacaacugcuggaaauauaagaauugcuuucauauuauuaauuacuagcuauaguaauacuauacuauacuaacacacagcugcauaacuuauuuguaaugaguugugugcaaauugauuauuuuguagguugaaaauggucagauggcggcgauuuugugggauucaacgcaaaggaaaaacaguuauuucauugugggguuugcaccacuaauuuuccuuuucuacguaaacuuccaaccagauuuaaagucaagaaugaugggaaggcuucuauuuaaguuaggcugcacaggaaguuaaaaaaaaucaauuuuaagaaaaugcuguuuguauauuggggacagcagugaacaaaguuuggaaaacuggggaguccacagagccuugccugaggagacuguuccgugagucaguggagugcagucuccagcuaaaggcaaagccagcaaauccguggucuguuguaaauaucugccguguuucuacuauaaauaagguggacaguucagaguuggugcucuacaauuucauaaucgugcagcucacacaacuaccuuaucuaaucuaaucaucacgaugagcucgcuggggugcuugugcaaauguuaguuggaacugacaguuuuaaagagaccagucacugucaguuggcuuccuucuggggccauaaccacaagacauauuggccauaugaccagguugccaaagggagggaucuacaagguuacaccccaaugugaugcaaagaccuuucacuggguaccaucuuucuucuucuucuccuucuucuucuucuucuucuucuucuucuucuucuucuucuucuucuucuucuucuucuucuucuucuucuucuuccucuuccucuuccucuuccucuuccuccuccuccuccuccuccuccucaucaucaucaucaucucuggagcugugugucugucugaagggugcuugagguggaguaccuucuuauuuuagcaugaaguggaccagaaggaaugcucagacuuccaugacuccaaaacauguuuucuuaggaucagauuagggccuuugcauggcugcagucagcaauccucaguuuccucaaucguguuuagguuacucagaauguguucaauccucaggacccccaugguggaaggaaaguaguccucugaccaugacuugcgucuugugcuguaaaugugcguguguaaaguuaguaaguaaaugaaggaaacuuuccaggugauaaaggaacacucuuggcucuguaccauuugcggcucuccaggauguggcuucuucauguggaaguuacagggcuucauuuaucauuuguaguucuuuuuagcuauguuaaauuuuaauauucccagcaguuuuaagugcuuauuaaauaauucuuaaauuuuuuaauuuccuuucgaccuugaguagaguuauuuucccaguagcaaaguuaaucaauaagccccucuuagguuuugauccuuuuauauaucucuacucccacacaaagggaagauucuccuggaaaauguuuacagauagauuggaagggaggaccccguagcacgagugacuguugcuucacugcauacuaugccacagaauuucugguaaaugggacacacuaaugauguuuuugacacagccccaguacuagggguguaccacggaucuaagccuggguucagcccccucuacugucuaaaauuggauuuggaagcccacauguguaacuccaccacaguagugcaagagggugagaaucucagcagcucauugucaucuucagcuauauguggguuuggaggccagccuggggcacgcaagaccauggauaaaacacaaacaaacaaacaaacaugaaauuggaggccugucuggaaugagaccacaccucaacacugccacaauuuccccacuucucccccccuccccccacuaacacauauuuugaguaggagguuaaccugggauacaugaggccacaccucagaacacauaugcacacaugaacaaauagaagagucccuuacuauuaaauauggccuuauaaguccccauaccuuuagaugcuauuccucacagcuggcacagcagagguucuguguucugcugcuuccucuugcaggguguccuggcugcacacuuggcaagaaaggaugaagcagaguguggaacaauggaugagucagcaggaucucaggccugucuggcugggagugugggagugggagugugggagucggguaugggggaguagacuucauuuugugaucuuuacuggcguaaauaagggcuguauaaaccuuagagauugggaagggauaucucuuaugguaaauauacauuggcugaggcuuaagguacuaggaaugccuuauuugcauggagagguacucuagguguuugccagacaggaaaggaagaugaaccuguaaucucuccaaggacuaucugacauaccuuaggucaggcuccccagguaaggucaggcagagaagagggagcucugcuggggaagggcuccauuuugugcuaaacuugugggagcuguccagucaugguagacuacgacuuuaauagcagacucuuccaacagucuacaccucacaguugauagccacagagucuacaccucacaguggacagaucaggaaugcauaucuauccaugugaucuuuuccuugcgguuuauaggaccuuugaucuccacagaguccuugucagaauuuugucccccacccuucauuuccagauaucaauuuuaaugaaaucuaagauucaguauuugaaaugacaggcccagugauucucauguagagggcuucaaagcgcacguuucgagauucgcauagaucaagaaugagcaucaggcugcuggaaagauuggcaggcaauuuuaaaucguauuuaugaauagccuucuuuagaaacugguaagcauacuucuuucauuugcaaauagggaugcauuuaggaucuuuaugggaaccaggugauguucuggcuggugggcuugucucucaagucagccauaacuugugcuuuucauuugaaagccccugccagagguugugaggaggauggaaacagagcacagccuucagaacuugucagaauuugaaaguggagcaguuuaacccuuuuauguuggcuucuguguuguggguugaagcuuuuagacugaaacagauuaagcuguacuuuaaaaaaauagggaaacaucuuguguuacuacuguaguucauauuaaauaaauaauauuuaaaaugaagauguggaugaaauaaauuccaaaaagaugaacugguuuaauuucauagcugauuauuacauugauucuuuuucaauguaaucauugcuauacagggugaaaaauuuggacccuucgcuggggagaagcgaaugccugaagacuuggaugaaaauauggacuacagacugaugugggagguaagggugcccaauuacacaugaggagugcgcuccuuuuuuaugauacugaggguguaaggccauugaaucaguacuagcuccagucccaucuuagguacugaaaauucuuauuguuuuuaaagauuuuauuuuuuaaauuuugugugugugugugugugugugugugugugugugugugugugaguguguggguguggguguguuucggugugugugugugugugugugaguguguggguguggguguguuucggugugugugugcauguaauugaggguggauguugaguccagaagagaguaugaaauccuccugccugaccugugguagagcagccuuggcauuuugcuguggagccaucuuuccugaccaggaaugucuucauuuuguaguacagcauuaaaaauauuagacugaugaaauagucugcuauaaaauucuuugaaaacucugaaauuuaaauauuaucaucugaaaugauauuuucuguguuuaagguuuagauuucaaaguaaacuugcaauugaauuuaaaauugcauucuuguaaaugaaauugcgcuuaacuuuuagccuuuauucuccacuaagguucuaaucauauaaguaacuuugcauuacuuguucaacccaaacuucaaaguuaaacuguacuuaucuuuaggauguacauguuaguaauuaagaugugguaaacugucuuuaccauaugaaguuucucuucugugggauuugcauaugugaguguguguuauuauacagauuucacauccuaguuuuaauuacuuuuguggccucuaguuguuagaacaggggccugaauaucaggacaagggaaucagagucuuggagacaguugaaagggguauuugaagaugccagcagcaagaaauccauuaguugggcaggcgaugaggcauguguagauggcuugaaaguuauaagucagaaaauguauuuuuguuuuguagguuuccuuuugcgacagaaucucgugcaucucaggcuggcuuagaacauauuaaaagagacuuauuucaaaguuuacaucaugcacucacgggaccuaaauguguagaggugguuugaugagaaugucacccaugguaccagauguuugaauauuugguccccaguuggugcuacuguuuggguggguuccuugcuggaggaagugugucauuuggugugggcuuugaaguuuuaaaagcuauagccauuuccaguucacucucuuugcacccuguuugcuguuccagugucugugucugccaucugcugccagcauuuccugccauggugaacccuuuucccucuggaacugcaagccccccuaaacacuuccuucugcaaauugcuuuggucacggugugauagcacagcaauagaauagugacuaacauagaggugagguccaugggcucgaaguucagaugaaggcuaaugcuguagucuugaggcagaucugcuuuuggaaaccugagauucuacucuuaaacaaauagaccaguuaaguaagaguuccacucuuuaaguaaucucuuugauuuaaagugaacuuauuguacagaaugucauguuaggguuugguucauucacuuaauauggcaacuuagcuggcugacauauaaauuuaucacagcauguugucugcaagcaaaauauacauauaugcaucccacuguuacugacacuguuggugaggaaugcaguuaaaugaaagaaggauuccaaaagguuuuugcaacacaggaguggggagcaaaaccuagcaacagccuacacuguaauucaaguggaaaauguuauuaauacugucuuauuuuagcaugcuguuuuaauugcuuauuuuuaugaaccuaaaauguuuuuauggcuuauaacauguuucuguagggucuuaauuuucuaagcaguucauucuuuugccauaacguuuucagaaauuaaaugugacaaaugaacuccuucccccccccccgccccccaaaaaaaaacccauacaauauuuaacaaguugcuaauggcuuuugauauuuuuuguuuggaaacuuuuguuauaaaacaauguuuuauacagguagggcauuuuaaagcagauagggacuaauuuuacucagaaaagaaaauuuuugagaagcuauuguaagggucuaugauugcugaagaaugacacccuggacucaaguaguguucuauucugcagaagcccagcauccugggguuucccauuaccaugauagacaagcaagucagcuuaaaggccugguuuaaaacguacuaggagaaucugugguaggugaccuucaucuuacuccaucucuuuauuggggcaugaagguuggaaacugaggucuggaaacuguugcugaggaagucuggaaagugcugcugacccauuguucuugccucgggccagguguggggcagcuucugaggccugggcuugccugggcuugcccaguccugaauugcccauuugaagccugucauggagucagccucgccuucucacuaagugcaugccaugcuucugcuuuauauaugguauuuuggcagcaguuuguuggcuccuauggcccuuugaugucuucacuauuuuaguuucacacaguagcaucuccacuguucuuacucugcugcuuacagaacuuuauguacuuuuauucuuggugauguuagagucccaugaugacugguguauuaucuuuauuuuacuuuguaccuaauauuaaugcuuugaaugaguuacaguuuguaaggucuaaaggauacagcuaccuguuucaagcuuagcccuucuuccagaauauuugcuguauuuaguccuuucuuucccuucuuuuccuuuccuucucucuuuauuauuauuaauuuauuuguugacaguuuuugguccucuacucucauuuaucccccuucuaaaccuguucucccuucucccuccaaguucccauuccaccuuuuuuaaaguuuggucuguugcuauauauuguaaugcuaaauucuauacuucaagguauuggccuaggaguaucuucuauuguuuacaagcuuuuguugugcaaacguuguucccugauuuaaaacuauuguuaaauaacauugacuacagccaauuguuggagggauuagcaguagugaaccugaagggagaaggaagaacuagagagggagaaagcugcaaucaggggagcggaaccaugaggucauguccaagagaaacagcaaguaucugggguacaccucuggggugguagccaggccugcaguuccaggaguagauuaguaauugugacccuuuaguaauugucaaagccaaauaaaauaaccauagucugagucucauuuauuugugaucuagucagggacaaacuugaauagauuguaauacauaccuucauauguuuacccagggcugccugugugggaaugggucuuggaacuaugcacuaaauagcuagccaguggcuauauaaccuacacaaugacuucucucaccugacagaucuuaccaacuauuaacucucccagauaggcaucagcccaugcgccucucuucuauauaucacugaauuuugaugggcugucuugugcaaacucuaugcacuguagcugcugugaauucaugacuuccacagucuuuacauaccccuagggcagaauuucauugcccauuucccaucggcuauauuccuucugcucccuuuuacugaugugccuugggaacugauuuacauaucccauauaaggcugaacauucugcagucauuucuuuuuagcugucuugaacagcuacaacucugcauuaacugcuguucacugcaaauacaaguguauuugauugagccugggaucuucguuaguguagggcauaaaccuaaguacuuagaagguaucuugacauguccauuuaguaaacaaaagaaguaguuucaucucuagugcauguaaucuccccaaaucugagucuuugacuagcuucauaguacugguguugaauuacuuccuguggagcaggccacugauccaaucagaagucaguugguuauacccauaacaguuaugccacuauaauagcaauaggccccguuuguuugggaaguugguauuacaauauacuaugcuuagagccgagaaagaccagugcugccuucucccuaacagccaccacagcaacugcugucaccacgaagucuaaccagcugcaaggcagcugccaguauaauuccagccuuguuugcugaacuguguaaccaacauguaucagcaggcucuuuugggaacccaugagacuuucucuccaguaacucauauggagauaucccacacuugucacugggauuaauaacacauggcuucugagauuguccuuauguaggcauggaugguacccuguucaaacuccaccuuuucccuucccuccccuuuccucccucuuuucuucuuuugucuuuucuuuuuucccuucucuucccuccuuucccuaacccuccccuucgcuuccuucuuauguauucuacccucccaucuuuuccucuccuucaucugauguucauuuauugucaucugguuucugcaucguccaguuguacgguuggcagagggaaucaaguuugucaguggucagucuucugagggaauauuuaaaaacaaaacaaaacaagcaaucaaacaaaaauacagagaacaccuuuugagugcauagauuuccugaucucucuggucuaaucguccccauuauuaugguagauaagcugcuucauagugugcaguuauccuugguagaccccuuuacucauuuaguguuggcagcaccaggauccagaaagagcagaaaggagaaugacuagcuuuccaacuggguccuuccaggaacucguaauuaguuucaaaggagguaacaauaccuugcucugggggucaaauccaccaguuauugagaauaugucuaauaugcccucucucuccaucauuuacaacugugcuguuccucaaugaauaauccuacucugauuguagcuauuccacaugagacaggugcuggugauaguaucugaaaacaauguccaacaagacagccugaggcacaguucauauuuguauuguguuaauggugacagugauucuccuggacaagccaggagcuccugauggccaguuuauaugaaagcauuggaggcauuagccacugugccuacugauacaugucagcuucuggcagcauggucaggucacaaagggaucgugugagcuagugggagugcagccauggcugggagcucuuccuuccuuucaugaugccacugcuucugugcauuucauagaaugucagcguuaucauguacucaccauggggauuugaacuucugucugucuguaaugcuuuuugauaacuucagauuuuuacucuuauuuugugguucuguuuaccgcuucuucccuugggguguccaggcauugcuguacaccagguggggaaggauguaucaaagucgggaauggcgggggggggggggguuagcagaggauagucaacucucucagaugguauucaacaaaacagcuuguguucuuuauucaagcugaaaagggacuauauaaaccuuggaaaaugggaagggguucuucgggugaacuuucuuuggcagaggcuuaagauacagaggacuccucaucagaauggcaaggcauucagaaguugaaccuguaauuuccuaagaauuuugugcugaggaggugaguccucccuuuugcucucagcucagggagcuguggggacauggaagacuauaaccucuaaauaacagcaucucccacauuauuuuaaaaucuauccaggaggauguuacauuuccuaggcuuuacacucaccuuuaagacuaaaauacgcccauguacuauugccaaaacucccagcaaugcuuuguuucgaacccugcaucauucaguccucugauacuuucuuaaacauuucaccucacaguucaguucucucucucuagcacauaccuugacacagcuugugcauucacuggccacuugcccuugaccauuugcagauguucugaaguaggcacuguaguaucuccugugugaaucuuucauauagauauucucugcaggcuauggguuucccuucuucucaaaaaaagaaaagaaaagaaaaaagaacaaggaaagaaaaaaaaucuaguccugccucauuuugugucaaaauuauucuguuauguccaaguguucuuaaaacuugauauuuggcucuaacucuuccaguagcaccauuuccucuuaagcuuugccucugugcugagaugacagaggucucagugugucccucucuucucacuucccaugcucgcuaugcucauuguuugcccuucagcuguugaacaacucacaguacagcugaguguccaguggugauuccaucugcacagagcagaugucauguccagaucuauaacuuuggguggccccucuugagaaggaauccauuguauagacaauuaagaacucacguucagauucuaagaaucaaguaaaaacuggauuucaaugaaauauccaaauuuuaguguuauuaccaugaaaaaacucuuuuacuuagauucagaucaauuuuuuguuauuauaucaucaaacuuaaagaaaaaguaugugucaacccaaggaauguuagaaacaaagcaaauagaccuuaaacuuugauuuugaaacagcaccucucuccaguuguaaaacaaaguugggauagcaaaguacugagaagcaaucuuuuuuacuuguuggaaacugaggcaggcgccagagguggacaaacccugcaucuugcuagcagucccaagcuagccaggcuucucauucccagauaccaauuacagagacaaguaaugguaaaagcagagggagguuuuaucagcacauugguaagagaagacuauaaaggggugccaggcauucauucacugauaggaacuuuagauuuagacagaggaagaauagaggcaguaguaugaaguacccauagguaagcagucuugcucacagugugguuuugcccaccauugucucuuccugggucuugcaaaguagugcaauaaaucauuaaacugucaaucaugucauccaugagagaacccaauccuuuacuacaauccacaccagcaugacgucugccuagcauagauguuuauuuucaccuuaaggugaucuguuuuuggcaucuaagaugacugcagguuuaggacugugccuucagccuaaaaugggaaagagacaggguagguagacagacaucccagugauuuccguggccaugcagggucaagagaaguacagacaaaauggagacagaaguggaaaguuuucacuguguuuaacuguggcuccaauugaagagucacugccuuucaguaaggacacuuacaauuuaacauucuuuacuuuccuaaauucauugacuggaggagcagugaagaaaaccuuuuucuuaagcucaaggugauugggauugccagaaucauuaaucauuaccguccacuagauauucucauaugauaagauauggcagguuaaacugcuggaaugguacucaguuuagucugaagaaaagaguaaauauuauuguuauuauuauuauaauuauuauauaaauguuuucaaaauauuccuguuuaaauauuugagguuuaugaauacuuuuguguagauuguagauuuccuguagauaugacauugagaauaacagugcucacuagugaugugagugagcccuaugcuguaacugauggcuuuucaaaaagcuauugauaguaguuauuguagacugcuuuuggaauuucauucucagcuucuaguccauacaucucuuuacacuggaugguccuuacaucucucugucauugauucuacuccaucaagaacacacaggagccacaugaagagaaaaaucucuacauuauuaaugaguggguaauaacucugaaguuuaugucuccagauaauuuacacagaguaugugacugagaccucagccaagaguagggacacuaugguguuucuuacauuuugauauuagauccacuuguggcaagaauuaggucuacaauguggauucuggaugcguuucugaccaaucuccuuggagacucagucucaggcuacgacuggauggauggcggucagagaagggagagagguuugguguugugucucucacucuucaggaccuccgauagauaaaacagcgccuuggcuaugccucagaaaagaaugucaagacagagggaagcacggaggcuuuguuaagauaaggcaggguacauaauguagacugauucgugggcuuucagaaagaggacauucuuacgugccuccauaguggcuauguguauuuuaaaguuauuuuguucaaaggaugagauuugcaaccagguuuaaagguuaauuaagcaaguuuuaaaauuauguaaaacaaaaccaaccaaccagccaaccaaccaaccaacuaaccaaauaaaaaccaaagcaugagaaaaguggguuuacuugccuggaagaguaauggagaaaaauccuucuuaacgaauguccuguugugccugaaguguuuggugguuuuaugagguacugugguuagcuuuacggaugauagaggaugccaguacuguuaaaugcaaggccacauucugucucuguguaaacaagcauaauuaguugauuuuaaugucucugagauguguuuuggaagauacacaaucccuuuuuaucagcuauguuaaaauuuuagauuuguagccugucccagcucaauucucucuguauguuucuauagaggguuaaagauguaaugacguuucagauugcaagguuucuucugcuggagaaaggagucauaaggaaguuuaaguuguagaauaguguagucugaugcaugcugcaggaagugacugccuuugaaacacaggcugccgugagguaggaacagcccuauccugagugaggugagggagccauauccugacuccugugguccaguauugauuuccucaugcuuaggacuuggguuuuggggauggagucagugagaugugauuggaaguaaccaacacggagaggguuugcugcugcugcuguguugaaagacaagaauuaagagugacuuugcgauguucguuuugaguguguucugggaauaaugugguugugaucuuuagugaugauuguuagcuugaaggaccugaguaaugcugaaggcaagcuuucaggguucucuagauuagguuauccucuggaccugcugcugaaggauuguguugacuguuaauaaaggugggaagacucauucuaauagugagugacacauaugccugggcuuggcccugugagucauggaaaggacagugaacaaagccauuccuuugcuuccugacacacaggcucauauggucuagauagaaccuugaacuaggagccaaaacaaaagcaacaaacaguugcuuuuggcaggagauuugaucauagcaauagaacaaauaaccaaaauggugauaccuuuaaugaaagggcacuuggucagagaugggaugacaggauggacucaguuuccaaaccugaagagacaucuuguuuucuuaucuagcuaugauauuuacucaguauauacuaaaacauaaauauacuugaauacauguuuauuucauagucaauauuuaguaaagacauugaauacauauauaaccugugauuuuaauuuagcauucuuagaaaauaugugauuuggcaguuaaaaaacaaacaaacaacuuauugauugucuuauuugcuugccuauguuguagacaucuuuguuuccuuuuucaugaagaggagauugaacugaaucucagucuauaaagaugcuccugguuggauauugaaguagacauuuuauuuguauguuuuuucuuucaugguuguuuucuauugguuacagcuacucugcuguugggaacuucauucaguaccaguuuuacaauauguuuuaguuuuugcaaaaaaaaaaaauguuuucaacuguuugaaaucuuuuauguuuuuauuguuuauagaaauccuuuuagguguuuggagcaaagaagguucuuuaugaaauguuuuucuuuugcagaugguaacaguuuucgguuccaaauggaaccacuuaguggagacauuaguggaaaaauaccaccuaugaagccuugagaaugcuagagccagugacacaaauguugucauguagggccucccuccugacucuggccuuucagcuagagaggcaggcuagggaauauuaguuccuuuuggaagguuuguaguagacuguggcuaucuguuuuccuuucuuccacauuggcuccuaucuaaguauaucagccaacucuuggccauucaaccaaaccucacauaggaucaaaauaaacaaaacagauuacuuuauuuguggaguauaccugugaucauuguggucugauccugcuaaagcauggcagaaauuuuaucugacagaugcaguuguucacaauuauaagcaacuucaacuuguuaaauaauaaaguccaugaugugaaagaagacacucaguuguugaucccaguguagggauguucgauaaccaguuugcggacgaaguucaguuucuaccaaucucacuuuuccuuugguagugacuuagucuuacugcugucagauaccguggaggauuuuauuuucauguuccuaugcuacaugacauacaauuuaucugaguaauuuccuaagcacauaaaggcauuaugguaaaacuuuaguugauuuuccauaagaauuuuccauaagaaaaacucuugagaaagcauuucagauccuuaaaaaguccucugacagaugaauguaugcauuuauggaaguagcacuuuaguaguauaguaaaauugagggauucauaucaguuuuaguggguuuuuuguuuguuuguuuuaaacagaaguaaaaacaaaagaacuuaaaaaauuaauggcuaacagauuuuccaagugcucuuuuagauuucuaguuauauauuacaaaagagcauggccuuaagaaaacgugauacuaggaggauauucuaguuuucuucuuguauucauuauuuuucuauuacuuugagaaaacaccauagccaaaguagcuuguagaaggaauggucuauuugugcuuaugguugcagcaccauugugcagcaaagugucucaauugcuaugauaaaauaaaacaauaaagucaaaggaaggguguauuugaguuuaugaaacuagaugagauaagauacgacaagacaagauuccauuaccaucuuagcagggaagcaugccagcaaacggucauaguagcuggcagcaaucagguaugguggcuggagcaacaagcugaaaagaucucucacaucuuaaaaccucuugcaugagagagagagagagagagagagagagagagagagagagagagagagagaguagucuuuaagcucucaauguuccucuccaacauggacacagaacucaagcauccccaacaagcuccacauauucaagaccaaguauugaaauggcagagaauaugggaaacuuauucaaugcuacaguacuaccccagcgagcacugaagacagcuaacuuuauagcaagaaagguucauuuggcuuacaguuggaggauuuuaaacucacgacugaaugcuauugcuuucgucucuggugaggaaauggcuggugucacauuaucauaggaacaauuguaugugucaguggucaugccuugagacaguagcagagaauggggaaggccagguuuucugcauuuauaaguuuucuuauaauaauuuuggauagcaauagaacuaugaggaggucaucuguaaauuaucuucuuaguuuuuuauuaaacucauguguguguguguguguguguguggcacccauucuacaaaaaagaugauuagcacugaagagccuccauauggagucacuuccauguggcaagcuagcgucuuggcaaggaacugcccuuucuuaaacucuugacaguauucugcccaaacuggacaaaugggaugcagggaagucaacugccaagcuuugcaaggacaagguaggcaaguccuucaaaauuccuucuucauaaaaagucuguuaaauauucugggccagaaggcugacaaugaugcuccaaggacucagagaacccuugagugaugauccaggcagccagcaaccccugucauuuguauaguuuggaagcugcuugcucuggacuuucuacaacucagguaguauuuaugccuucucaguucucuaaugaggcugaggauuagaacgcuagaaucucacaguuaagcuuaaguuguuuaguauuuaagaaaaugucuuaaaaucuaaaaagauaauacaaguuaucuuuuuuuagguuggcaauacaaauuaugauagaaagugauuuagguacagcuaauuggagaacaaacucaaacuuauggcuuaggcacuuauucauacauaaagagccuccaagucauuaauggagaauuggguccuugguggaagaggcugcaguuacagcuuccaagucuaauuagcuggguuccaucccugggaccuacaugggagaaggagagaaccugcuucuuuaaguuguccuuuaaucuguacguauccuacacacacacacacacacacacacacacacacacacacacacacaaucacaauguuguagcaaaauguaaccuuaaauuuguaucuauauacaaaguccauacauauguaaaguauuugguuuguugauguucuuuggucuaaaaggauauucaguaaucuauucuuuuaucucagauuccuauaucccccuuuuucuuuucaucaccuuucaccccccauuaccauuucuccuaccauuagacaggagagaaagaaggauaggaaaaagaaagagagugaaucuaaccucucuuacuuuguuuccuucuugaccaacaucauuaacaacucacccacuugaaucaccaaaaaacacccacuccaccacuugggaauggaguauuguucucuuaaaauugcuuucugauaucugggucauuaauuucuuuuuuuuaaacaaaauuggccagucuuaagaaagcuagcuguaucauuucuucagucucugcuccauccccugugccuacaucaggguuccugccuuggccauaggaggcagcuuucccaggcuccauaucucagugcugugagucauuguaaggauauccucauugauuuuuuuggggggggcaccucccccaucucaguucucugugucuuacuggaaauguccccuaucuuccuccaccccuagcaguuguggauuucuguucauucucauggccaucuggccaucuucccuauuuaucaccacccacuccucuccuaauccccucuuccacccaguucccucccuccuucugccuuccauaaccuuuccauucccacuuccaagugaggcucaggcauccuuguuugugaccucccuucuguccagccuucuugggucuucuuggguuuguggaguauagcauggguauccuguauuugauggcuaauauuuacuuaaaugugaguuccuugguccaggauuuucugugaaguggacuagguacugagcagggaacaaggucaggggcuguauguagauaagggaugggauguuggaauucuggaaagguuuggguaauuacauuugguggauuuuggaguucuuuguggccccaguuucuaaacugaaggguauauuuauggauugaauuauuuaugaaguaucaguauuaauagagacaggacuggauucugcucuuucauaucuuaguguggguugaaguaugguauucuuugcuuacaucuaaaaaaauaauuccagagaacuauccaaagucuuuuguuuauaauaaccuuuuaaauaaguuucauggcaaccauagcauuguauaacacauucaacuacuuuggauaacugcagguagcauggccagcuggucaugcagagaaagcauguuugaaacuaccaaagugucuuguagacagugugccauucacuuccauccagccgcgaaugaacaucucugucacucugucacccucucagcaucuguuggauggagguauggcaucucucuuguuuuaauuuccaguuuccgaauggugcaugaugaugaacauucuucauaggcuugcuugccaucugcauaucauuuugguuuugcagucuucuuaucuuuuacauauucacaaauuagauugauguuuucuguaguuuugggauaguagcaaacauuuucuauuaauaugugccuugccuuuucauuuacuuuguagaauuucucauggaauacuugcuuuaauuuuuaugaaaucuaaguuaucaauuuuuuucucauggaucacugcuuuuggguuuguauuuuaacagucauuaucaaacauaaggauacuuuuuuuuuuucuguucuauaggaguuugccuuugggucaucauuguugugauaaaacagcauggccaacaccaacuugggaaggaaaggauuuaucuggcuuacacuugcacaucuuaguccauuagugaagaaagucaggacaugaacucaaauaggguaggaaccuagcuagagguaggagugaaugcagaggccauggaaggaugcugcuagcugcauugcucuucaugauuugcacagccugcuuuuuuauagaauccaggacuaccagcucagggauggcaccaccuaccaugagccaggaccuuccacaucaaucacugauuaagaaaauguccuacuuucucuagcuccuccauugggggcccagugauccauucaauagcugacugugagcauccacuucuguguuugccaggcaccggcauagccucacaagagacagcuauaucaggguccuuucagcaaaaucuugcuggcuuaugcguuuggaggcugauuaugggauggguccccgggugcagcagucucuagaugguccaucuuuucgucucagcucuaaacuuugucucuguaacuccuuccauggauguuuuguucccaguucuaagaaggggcaaagugaccacacuuuggucuucguucuucuugaguuucauguguuuugcaacuuguaucuuggguauucuaaguuuccgggcuacccaaggagcuaaaggggucugcaacccuauagguggaacaacaauaugaacuaaucaguacccccggagcucgugucucuaacugcaucuguaacagaagauggccuaauuggccaucaguggaaagagaggccccuuggucuugcaaacuuuauaugccucaauacaggggaacgccaggggcaagaagugggaguggguagguaggggagugggggggggggggaggauaugggggacuuuugggauaguauuggaaauguaaaugaagaauauaccuaauaaaaaauaauucacaugaaagaaagaaagaaagaaagaaagaaagaaagaaagaaagaaagaaaaagaaaaugucccacaaguguaaaaguauuucuuauucuccugccucagucugcuaaccuaggccuggaagcuucuccccucuguacaaucuuauccaggccuagaauggucucagccuuugaaacuuaacuucugaaugcacucccccuuccuaguucugaauucugguuggcugguucaacucagcuguucuggcucagaacuucucucuacugcaacugauucaaucuggcuguucucugagcuucugacuuuguacucugcuuggucuuuacuaacuuugguugcuacaaguaacuuugacaaucuucuggcacauucucauucucuggguuguucugucaccugugucuagucuguucauucucugcaaccuguuucuauauaauccugguaaaacugccucccuccuuccuuccauucucccucccuuuuccucucucucccucacuuccucucucccccaucucuuuuucuuucucucuccucucucugcucucuuaaauagcugccuuuuccucucucuucucuuugagaguuaggcauauucuauucugucaaaucuuucucugauuccucacuuugacauucaauuacacaucauuuucaaacauggcugcuuucuucuaccaacuaacuuuaucuucauuguuugugauuaaagguaugugaagggcuaagauacaguguuuuaauauucuuauuuuuauuggucuuuuacauuguugcucucuucgacaauuuaaauuuuguuggcucagcugugucuagaaacucaucuuuuauuuuagguuuucagguuuaauugacguagaguuuuuaaacuagucccuuaaaacuuucugaauuuuuugaugucuauuauaaugcuuccuuauuuaucaucuaauuuuauuaauuuaugucucucuuucuuuugguuaauucagcuaaggggcuggcaauuauuuguuucucaaagaaccaggucuuagacucauugguucuuuauauuauguuuuuuuuguuuuguuuuguuuuuuuguuuuuuuuguguguguguuuguuucauuaauucuguccuagauuuuauuauuuuccuaucuacugaauuuggauuugguuuguucuuuaaaaaaaaaaaaacucuugagauacaccauuaugcuauucauuugugccuuuucuaauuuuuuuaauauagccacuuaaagagauaugaaguuccugccuacuuuuaauaugucccaggggacuuucuauguuguauuuuuauuuucuuuuauuuccaggauuuuuccuuuuguuucuccuuuaacugauucaucauucaguggugggcuguuuaauuuccaugaguuuguguaauuucuagaaauucuuuuguucuugauuuugaguuuuauugcauugugaucaaagagaauacauggaauuauuucaaugucauauacauauauuuuuagauuuauacugugucccaaaauguggccuguuuuagauaaauuugggugugcuguugaguagaaugugaauucuuuggaguuuagguacaauauucuguagguaucuguuaggguauacauucauuuugcauuaagaaaucaacaaaauacgcuucuuuuuggaguaguuuagacugagaacaagccugcauuugaauuuuccaucugucucugugucuuucaucugucuguaguuuguugucuguggccugucuauugcaugugucugaucucugucucccucucuguugccugugcauguugucugucucuaacaaugggcuuugcucuguguuuauugaccagugcagaaaacauaguaugggaaaggaaugaagaaugcuuuuguuuauuuaguuuuuaaaagacauuuuuaacagaguuuuuacucgggaauaaggugcuuuagugaccccagcugauccagaauagcacuuagaacuucgcacagcuguuaccaaauuauauccacauguuucuuugaaauauuuauuggauauuuauuguuuaaggcugcuuuuaaagcauucccuguuggcugcuuucaucaaaugauuacuacaacacauauauacauacauucauuauucugggucaggggcaugggaaaguauauaacuuaagauuuagagguggacauuuagcuuaggucguaaaagcugauuacuugggaaauugaagguauagaaagguuggguacauugguuuccuaaaaggucgguuaaaacuaaacagucugagcacauaguaggagagcagauuaaguacauaguuuuaaaugaucucacugcauauuuuuaacuuuugcaaaguguggcaagaguucagccucuuccaagucaaaauaguuauucaagguuguucagcgaaugaggucaacuaauucugauguuucucuguuuauuugugcagaugaccuguccuuagaaaauguggauauuaaugucaccgauuaacacugggugggaguuauguugguauuaugcuuuuuaugagauuggguucaucagaguucuugggauauauguuugggacuguaauaucuucuugguuuuuguucucuggaucagaaugcaguuuccuucugccugucuucagauuaacuuuggguugaggauuguguucucagauauuuggauaguggugcaugcuuguguccugcuuccauuugcucccgcauuuaccuauccucaaagguaaaugugucuuuuguaagcaaaaaacucuuuuuugugaaucuauucaguuuaugucugccuuuugauuggggaguuaaggccauuaauauuuaaaauuacuacugaaaggcgugagugugauugugaucaauauguggaucuuauuguuguguguuaguagcuuuagucuacacuccggcuauuagaacuuugcguguuuccucugagucuccuggcucugcuuauuuucucuucaguccaacguauuguuuccaguguucuccgcaggguugauuugguugacaugaaucuuuuaaacugcuuguaucugaaaaaguuuucuuucuucuucuucuucuucuucuucuucuucuucuucuucuucuucuucuucuucuucuucuucuucuucuuccuucuuccuccuccuccuccuccuccuccuccuccuccuccuccuucuucuucuucuucuucuucuucuucuuccuaauucuucuuucuucuucuucuucuucuucuucuucuucuucuucuucuucuucuucuucuucuucuucuucuucuucuucuucuuccuccuccuccuccuccuccuccuccuccuccuccuccuccuccuucuucuucuucagcaguagcagaguagcuauggucuuaggcucaggcuaaaggcccagaugcuuccaaaugacauaagcgauauccugcaaacaucuucuucuucuucuucuucuucuucuucuucuucuucuucuucuucuucuucuucuucuucuucuucuucuucuucuucuucuucuucuucuucuucagcaguagcagaguagcuauggucuuaggcucaggcuaaaggcccagaugcuuccaaaugacauaagcgauauccugcaaacaaugcccgcugccucggucuaccuccagugucagugcuggcacugcaaaccucuccuccuaccauggcgacaguguucucaggacacguuaauauuugugcaaccaauauacacuuuguuuucaucuugauucugaugucaguaccuguggaugucaccaugaaguggcgagccuuugauuuaguugacuuguuuucauuuaaaauaaucuuuuguacuuagugauuucaagguuuuuuguuuuuuuaaaccagaaauauugagggaucuaaaagucucgucaucuguagguaagccaauguuugguuuuaagaagaaauuccucaugccauucuaaugcugagaucucauuugaagguuuacauauuuccaauaauuggggaaaaacagaaagaaaaccuuuaacuuccuuuucuuccuauaccaucuaugcucugcuaacccacuguuacagccuuuguuucagauugccaguuuucuguuuaauaauggaaaguuuuuacucuugaaauuuuuuaggugcugauuuugacuacuugaacaauugacugaaaaucauuauuaauagauauaacaauaaaaugaauaaacauuugaaaaagugugauccaacaugcaagagaagcuacugaaaagcaccuauuaaaaauaguuccuaucucuaguaccagaaaaguuaaauauuucgauauaaaaaauauuaaccaaaauaucuacucuaaaaauuauucuguuauuuucuggggaaucaugacuaauuagggaaaugaaguacucagcuggagaaaagcagguuucuaaaaucguuacguuucagccaggguguuuggaaugaacuugcagccggugucagaaaguauccagugcacuggcaagcacuagacaucuguaaaguauacagaauuucaauuauaccaaacaugauuuuaaugaguuauaacucagggcacuccaguagacauaacagcuuuggucugaguggaacauuuaacuguggguguccugguaacuuuuuguggggaggagaaaugugggcugaguuacaacaacuuagaaggacugggagcugcuuacugcuuaaagacaguguuagaaaaucuggaaacaacccagauguccuucaacagaggagugaauacagaaaaugugguucauuuacacaauggaguacuacucagcuauuaaaaacaaugaauucaugaaauucuuaggcaaauggaugaaacuagaagauaccauccugagugagguaacccaaucacaaaagaacacauaugguaugcacucacugauaaguagauauuagccaaaaagcuuggaauauccaagauacaauucauagagcacaugaagcucaagaaaaaggaagaccaaacuguggauacuuugguccuucuuagaagggggaacaaaauacacaugggaggagauacagagacaaaguguggaguagagacugaaggaaaggccauccagagacugccccaccuggggauccauccuauauacaguuaccaaaccuagacauuauuguggagaccaacaagacugugcugacaggagccugauauagcuguccccugagagacucugccagagucugacaaauauagaggcacaugcucccagccaaccauuggacugagcaaggaguccccaauggaggaguuagagaaaggucugaaggagcugaagggguuugcaaccccauagaaagaagaacaacaauaucaaccaaccagaacccccugagcucccaggcacuaaaucaccaacccauggcuccaguugcauauguagcagagaauggcauugugggacauuaaugagaggagaggcccuugguccuuuuaaggcacgaugccccaguguaggggaaugccaggcugggggagcaggagugagugggugggugggggaacacccucaucgaagcagagggaggggaaauggaauggggcguuuuugaaggggaaaacaaggaaaggggauaacauuugaacuguaaauaaagaaacuaucuaauaaaaaaagaugguauuaauggauuuuaauuaaaagacaagggcugggugauaucucagggguuaucagcacuggcugcucuugcagaggacuggguuugauucccagcauccacauggugguucauaacugacaggaaguccagccagcucaaagacauggcucuagcaggcuugcuuuuuccuuuuuuucuuuuuuuuuuuccuucugcuuuucuaaaaacagguuauauucuaaaagcuagcccccaaggucuauuuccuuauuuguccacuuacuccuccugcugcugacuaccaaggaucagcuaucuauuaaaguccagcaaucaaaagucgguuuggcuacccuaauuaacaugucuaauuaaaauugaguaccuuguccuaacacugauuuccccuuuucccuuuuuaaacuuccauuugccucugugcugucuaucuccuuucuuuccagaaauagucuuuuguccccauuuugauauaaauauucccccaccccuguguucccucccucuucaaaucuucuaucuccugucacugucucuuauuuccugcccuuugccaaucuggggaaagucucuuuugugcugagaacuugaccuuggguguccugagcugauauagaucccuucaauaaccacccguaacuccaguuucaggggauccaaugcccucuugugaccuucucugucccuaagcaugcacacaguguacaagcauacacguaagccaaacacucacagaagaaacaggaugaguaaaucugauuaaagaguuaaaagcuaaggucuguuuugcuccugccuguucaacauuucugacaaggagcauccuuggcugcauuaucucugacugagaaugaggguuggagauggagaggcuuccuccuucuuuuacggcuuuaacacuugugaauaaucaaugacauuuauuuguuuguuuguuuguuguugagacggggucucacuauauaguucuggaucacuuggaaaucaccauguagaccagaccaauugucuucaaacucacagagauuugccugccucugacaguugagugcugggauuaaaggcguacuacacaaagacuauccuaaacuuacuauaguaauuguaccacuuaucuaucaucuggcuaucuucuuucuucuuucuucuuucuucuucuccuccuccuccuucuuucuucuucuucuucuuuguccugggaauccaaccaagggcucaauuucucagcccuuuacacuuaacauacaguucaauguagugguaaaguuauauacauugcuguggaauauaucuccuuagcuuuuuauguuacaaaucuagcacuauguaccauuaguacuuuuccauuuuccccaaacccagcccaugguucuacuuucaauuucugugacuuugauugauaacucaaauaagugaacuuggacaguauuucuucauuguuguuguucuaauagucaccuuauuuccuuaaccaugguuucaagguucaguguguugcagcaagugggagaauuucuuuccuagugaaggcuaagugagaugucauuguuaguuuguauaacaucuucagcaccaguuaucuauugauagguauugugaccgcuucugcuucucagcuguucugaaugacauaggaauacgugucuguagaugacucucugaagagucugauuccaagucuuagguuuauacauagaaaauaguacuaguuuugauuucccaagggagcucugcguuuuucacccaucaacauuauuuagaaguucuccugucucgccuuucucacugacauugcuguuuauuguuuguuauugguauuaguuguagucucuuaauggguaugagagaugaguaauauuuguauauuuuaaauuuuauuacauuuuuaaaaaauuguguauguuuguaugcaugccauauuauaugagugcaggucagaggacaacucguacggauauuuucuuuccuuccaccgugugaaucccaggaguugaauucaagucaucaggcuuggcaacaggugccuuuuuuugcugagccaucucacaggccuaauagauuauaggauauuuauuuacuucaugaauuucuaauaggcagcguaauagagcaaaugcaaaugcugaaauucagcuuagguagguuuuaguuagaauggaggguauagacuuaauacuuauuguaugcaaaugaguucaguguaaacuugacuuaugcguauaaguuauggguauuauggguauuauuuagcagacagaacaaaacccagacuguaacaaaagaagaacuucugugaaugguagagaaucaggcuguagcacugugucuccuguugguaggaguguuauagacuuagaaauugguagagccggcauugcaagcucaugagcuacacaaggagaagaucugaagcuuuugaccugucagucagcgaggagacuugaagaacagaaagcaacaauaguuauaaucaugugauucacugugaugucaugugggaaaugcugaaacuuagcuguuaggcagaccuaaaacaagacaaaaugcugugauuggaauuggagaagcauguuucugaucaacaucaggaaaaccuuuugucaacgagaagcaucccccagaaaccuucagcuucacaggcugggaugcugacaggauccugcacagaaaggauacuccuccaacaggcagaaccuggcaaaagcaagccauacacagacuguuccuccccaccaucuguucauaccaguuugagaaaauagacaaaugauuucuauacacaaucacccuaaugcauuguaguagcugacuuugcuugcagaggcacagccuacccagauguuaaauggaauaaaucucccccuuaggaagaaucuagaaucuuugauucuccugacuaaugaaaaggugggugguacucuuuuuucauauugcacaagagccauguggaagccccgucucucuguucucuuuguuccucagcacuuccugucgcucuguucuucauucuugucccucuguucucuaucaugguuccuugguauuuccugccucuguguucuuuguuccugucccucaguacuuccuacccacguguugaugcuucauguaguccaucccaucuauguguuguuggucuugucuuuauuugaccugugcuugcucauggcccacucuuuccucacugaaggccaguuuucagcaccugugauguuugccuuugccuuuucucaagagcucugagcucuuucauagcaguaacuacauauucuugaucuuugauuucuuugugcaaaccuccaauauuuauuggaugaaaggaauuuauuauaagucuuguaggugugaggugauuuggggcucauagcagagccagcuguauguguuucuuucaguuagggcccuggguguaguuggaaugugcauggguaguaaaaucagaggcaagcugcccugacccuucucucauucuccugcuugcacucuugcuucgacuuccucucucccaguucuucccaucaccuauucuggaagccugauuucgcccaccuuccucugcucacccguuucuuacauuguuugucuuccuccccugguacuuuuaacacugcacuuccuuuuuauugcuuacacucacagguuuggcaggcuauuauuagcauugaucccugugcuuagaugagguuagaacaucucuuacugguuucuguacauuuucuugucucaguacuucucuuccuagucuuucuauacuuguguagucccuugguguuggcauuguugguugguuacuauuugagcagcacaggugcuguuuguguucugguuacuuugcauuuuuguguccaucaagggcauuugccauuauccugggcaauuaaaugagaauuguagcccacaagucuccuugagaacagugcugauuuucuuuguaugaguuguugugagguugcuuacuuuuggccuguguaguuucaaagugaagcucugaucuauguguuacaauaaaaaaugggucuaggggcuggagagauggcgcagaguuuacaagcauuagcugcucuuccagaggacacagguucaauugccagcuucugcauugcagcucauaacugccuguaacuccaguucccgguuaucugacaccucccacagagauauauguaggcaaaacaccaguacacauacuuauacacauguaggcaaaugccaauguacauaaaaaacaucaaguguuuaaaaagugagucuaaagaauuuuucauaaaguuaguaauauuauuuuuugcaacucaaaaacaccagcacacauauaaaccuucaacacacagccaaagcuugccagacaggguucaacauuugcuugaaacuaccugacaaucuuuguuugcuuugcauauaaagaagauuaauguucaugaacuugaauaaauuucauuuaaugacuagcccaguaauuucuucaguguaugauaaaugacuguucugaauuacuuuuguucucugcagaauuuuuagagaagcuuagcuuauuaauauuuugauguauguauuuucuguuuucuaaguuuugauuuaaugagccacagcuuuaaagauaucuucccaucugccaaacucucgagauugauugaaauucauguauguucuuuacuuugcauuuggcuagucuuguauuuucuuacuauuggaagguucagagacuaggggaggacuauguucauuugucugggucucccagauuuucucuaguuuguaugugaauuugauuauuguaggugaucuggaaaggaacuaccuaaguguagaagaggcugcagacuucaguacugcguggacuguuuuuaaccucugggcuccacacucgggcucagaggugggagaguauauaguucccuugaagaaagucucggaaaccauggugcagagucguccugugguuacugcaucucaaguugccuucugcaaacucaucaaacaugcagcucuguccccaggcaaacugacaugcuuuuccuuaacucuggcauucuacuuucucucaguagcagugcagaaccgaaggugcuaucucaucuugcuggagguaaagaacuccacuagcuuguccaacugcuuguuuuagccccuagguccauagaccuucuuuuggaauuaauuaaauucaaagaguaaguaauauguaagcauauguccuauguuaccuuucuaaagaucacuuuaaaauucagcuuuaaaaaaccaccugcuuuaaggaauugcaguguuuuagaggaacaucuuuaguuuacauagaugcuaaagcccaaguuuuguagcuauuucugcagaaauaucaaauugucugacuguguaugaucagacagcagaugcuagagucagggaggccuggugaugauggcagagcaguaaauauucucaggagaacagguuguauuuagaagcuguuugucuugaagcguucaaccuaacaacccugugauguucccugacgcucagugugggugagagcagcuugcugggcauucacuccaguuucauguuaggccuucugugugugugcacacagggcaccuuuucucuggugauuugagauugcucuggacaaagaaaggguuuugucacuuugcuauuuuuggugacuuauguuaaagaguagguaguugcaaaaugaaaaacauucucuucuagaaagccuuagauuaaaaaaauauauauacuuuaaaacuucaaacuaaggucacauaguacugguugagcacagaguucucugauuucucuuuauugcguuccucaccuaucuuuuuaaguguuuauuauaugucagagggaaaaggcuguagaaaacauucucagucagcaguugcuuugcuguugagcuauugacaccuacuagaauccauccauagaaguccuuagacagauuuuauguaaguuguguaaauaccaaccacguaagcauuuaguauuuggagauggcuaaugagauggcaaguguagaauguggauuaauuauuuucaaaauaggaagaauugauuauagucuaagagcuagcauuaaaauguaugaugaaugcauaauaguucucucuucuuucugucccagucuccucccuucaucucuagaagacuaguuuccuuacauuaaaccaugcuugugcugguuuuaaaggcauuuauacuguuguuauacaagcagaaacauuuggagaucucaagccauuauuuauuagcugggauaaaauaaaagaagcuugagaagaccucagucccauagcuuuggucaucugguagcuggcugaguguggauguagaauguuuuagacucacccacaggcucuaacacagcauccggguaagccauuccagaagugugaccuagugucugucagguaaaaguaguccuuuaugcuaauguugucauaaugagguaguuagaauauagugccaggauugaaaacaggaaucuugguucuaggaaugagagauucauuuucuauuauuguguaacaauuaccaugaauuugcagaggcuuaaaaaagcuaccuuuuuguuauuuuagaguuuugaagguggagaagcccucauguaacucugcuuacagcucucaccaugccagucuagauguaagagcuaggaggacugggcucuuauucauucauucauucacucacucacucauucauucauuuauucauuuguguauuuauguguaugugugaauacuuacauguaaauguguguaccaugugagugcccaaggccugcauagaagauugaagaggcuguugguucacauggaacuggaguuacagacaguugugacagacaguugugaguggccauguggaugcuaggaacugcaucuguguccucuucaaguacagcaaguucucuacugagccaucucucuuuuuggagcugguaaccauuugguuguguccaagcuuguucaguaugacugcauuuuguucuccuaaucaaguaguacucagccuggaggggccacaacccuuucacaccuaagacaauuggaaaacagauauuagguuacaauucauaacaguaguaaaauuacaguuaugaaguagaaacaaaaauaauucuaugguuggggucacauacuaauauaacaacauuacauuaggaacuguauuagaggguugcagcauuagaaagguugaagauuacugccauagacucuuaaggguaugguucucauuucauuccugacuacuggcuagagacauguuucaauucuuagcucccuuagugacauuugucaagccaccuuuggaauccucugucucagcacuauuucuacucuaacuucacuccuuaagaggaagugagaauucuacaguuuaaaaaacaaacuaacaaaauacccuuaaugagucuguuuuuuugucuauucacucucuauuuauuuauuugaauuaauuauuuuauuuacaucccaaauggugcccucccuccugguucccccuccccgucaccucugagagaguuuaucuauuuuuuuuuuuuguuuuuguuuuuuuuuuuacauaacaggacccuggaaggaaucccuuuucuacauaaguuuuaaguuuuaggaauucuuacaugcuaggacaguuuucuauggugggcauuguaaaaaguuauucuuagaauucugugcaguuguuggcaacuggugacaagauuguacacauacuaauauaacguaacaaggugguaugguaauuggcugggcauacuguaagcccuggucccaugaauagcugugaaggcauuuuucccccuacuauauauucucucaguuugucccuuaguuuuuuagaggaucugccuucauagaacaguuuugagaacugaauaaauuauauauuuuuuauauuguguuacuaugugcuucacacauaauaaaaacuacauaacuauuaauugcuauuacuauuauuuguccuucaaaguagaauucuuuccaggcauguuuuaguuuucauguaaugaacuugacucuaaaauccaaagcacauguucaguaaaaauaacaaauguuaaacaaaaagguuuucaucauugugguaucuacucuugagcaucugucucauucaugcauucucuugcuauagguagaacauugugcuuuuacauggcugaggucagguguguguggccaaguuuauguuggaaaugaaguggaagaaagguagagagaccuggggugagaaggcaagucagccugggaauagagcagagggugaucuuuaaauggccauugguaugaagggauagacaguuauaaaauauguaaaauacagauuugaggauagauuuuaagugaauaugggaaaaauucaguuaugaaaagauaguuuguauucuuuuuuuuuaaacuuuugaaaagagcauuuuauuuugaaugcuguauuuuuucccaagaugacaugacaccgaagacgagaucuguacguuuucugcacauguucuauuuuuaauccauccuugguucucaaugaccucauaacuaggcuuucgacuucuuuuuuuuuauuagguauuuuccuuguuuacauuuucaaugcuaucccaaaggucccccauacccacccccccaauccccuacccacccacucccccuuuuuggcccuggcguuccccuguacuggggcaucuaaaguuggcaaguccaaugggccucucuuugcagugauggccgacuaggccaucuuuugaugcauaugcagcuagagacaagagcucugggguacugguuaguucauauuguuguuccaccuauaggguugcaguucccuuuagcuccuuggguaauaucucuagcuccugcauugggggccgugugacccauccaauagcugacugugaucauccacuucuguauuugcuaggccccggcauagucucacaagagagagcuauaucuggguccuuucagcaaaauuuugcuagugugugcaauggugucaguguuuggaagcugauuaugggauggaucccugcauauggcaaucacuagaugguccaucuuuuugucacagcuccaaauuuugucucuguaacuccuuccauggguguuuuguucccauuucuaggaagggguaaaguguccacacuuuggucuuccuucuucuugaauuucaugcguuuagcaaguuguaucuuauaucuuggguauccuaaguuucugaguuuguauucuuauaaugggccauuguuagaguaugccuccaaaccaagaaugauucauucuuaccaagaaaaguuguggcaguccugauggaguugaagugggucagacuggagcaguguggcucuggauguccugguagcuugucuuggucaagaagaggugagaagacauccuaggaggacuccugggaccuaagccucauuguucuuugcauacgauucuuuacagugaugucagaacaagguauugccagauguugagagaaaaggagcagguggggugaggagaggugcaccuccaguuuucaucccuccucugaggaucucuaggaguaaagauucaguuacacccguccacgucucuguauccagaacccaugagugguuuuacuggguguguagacacuuuuaggggcuuuucacaaugcucuuccugcucugggguuuauguuucucacuccaccucaugcucuguaugugcuuuauagccauauauacuagauguuuuucauaaugcaguucauauguauauugacuauauuugccccgaacaauacuuuaugaccuuaaacaaaguuucauguuuucuuaauacuacucaaaaugcuaaauaaacaauaaggcuauguucuaaaauuuuuccaaaaccuuuuucuugcacaucuucgaguuaucaguguuagguacagucaguguuuuguacuuauaaggggaacaacuuuucuaguaguuuagcauaguguuaugauuacuaaaugauuauaagaauuaguaauuggguaauauuugauugacagggauguguuucuauucucagaucauaaaucaguuuacugaacugacacaaaguaagaaucaaugcccccuagcucugacugucgccuuuacacccaguccaaaccugcaccuuuucccugaaccaguacugccccccaugggguucuaccacacccaucuggaccuauuuuuuaaaagagacaacagaaucaagaucacuuagcagugugcugagcuacaaugugagcccacauuuccaguuuccuaaauucuuaacuccuguagagauacuguugguguuuauaagcacccaccuuaaauugguauucuuugaaaaauuucuaagggaaaccacacucugcuuagaaaccauaaaucaucacuuugcuagugaugacccuccugauuucuguucucucucucucucucucucucucucugugugugugugugcgugugugugugugugugugugugugugugugugugugugugugugagagagagagagggggggggaaggggaucuuacugcaauaucucuugccuuuuagcacugauaaaguaucuugacauuugacuaauuaaacucugaaggcaaggcauauggcuuccuucagcuaaaaaaaaucacagaaaagcacuugaaauuuaaauuagaagaugacauuuuauacacuaaagacauucaugcugucaguuuuaguguucaaccauuguugugcaaagccucgugagaagacacaugccuucucugguacgucaugcucugugacaucuagucucucgucaaggacgugugcaccucugcugcucauguggaccauguugcgacuucuucugcagggaaauuuggcugaauaguuuugcuuuuggagucuugcuggcauguuuguagguugggaguuagaaaagccucagcauuugaaaugacuguagaacaugaugacgaaugaaugguuucagagccuucucuuaacagugaacaucccaauaauaaagaaacuucccuguccagagcugauguaauuuaaccaggaagaaugugaacuugaagggaagcugacuuucucuuaccuccugauuccuaguuuucuacucacugcucaacuuuucacugagagaccugaauuuuugucugccuucaaaaggagcuguguuggaagaugacgugacugugacuuuucuuugguuucacgagucuugagucuggaagaagauacauaccugugguaacaagaauacacauaucaucccccccgcccccccccaccccccccgccuugguuauuugaaaagcaaugucaguauugagcagggcuggaaacuggagcauuccugucuggagacaguuuucaccaacugagagcuaagcacagagagauguaaagcagccagauguugucuucuguuucacagagggcguuucccugugacuuugggcaacugcuucauguugcuaguguaggaaagcuguguaagucaacaggauuuugaacugcaaugauuuuacuaugaaaacauugacuucauuaugggacccaguguuguauaccgacccacggccuacuugaaccgggcacaccugggaggcaggcuggggcugaaaaagacuuagauggugggagauucuuggagaccaagacacgauucuguucaaggccugccaguuuacuaagagagugugcuuauaagggggaaggcccaucccucaccaguccauucuuggugucuggagccagccuguaggcgacauacaggauaggauguuccuccagaauaucucaggggccucucagcagguagcagugucuucagagagcaguggcagugacagagcaaaagcgcaaucuaggucagaaggcuccacacuagguaaucuccuucuuaguggcagcaaggucaaagucuagaucagccugcuucagucuggagcaugaaaacauugacuucauuaugggacccaguuuguagaagacugucucagugggacaauaguaaguuguuuuacuuccuucaaacuucaagcaaaaggagauggucuuucggagacuaaucuugugcuuuggcugcaaaacucaugagauguuaggaugugauacuaagaagaauuuccuguccuuguuagauagcaaagauguugaaugcauuaucucaggguucacuaucaaauuagauaguuaaauggagucuuuaaugguagauaucugucugggguugucuuaguugacuggugcugaaaagaucaaggauguccucuuuggagaauguaugaacaaauguacugugacaauggcaggaagaugaagucuuacaaauagguaacaaaacagcuuuacaggagccauaggcugcaggccaaggcauagcucaauaaagaaccaagccgagguacuuaaugauuugugagugcauguaauagcaaugagaugggcauugacuauguuaaugagcaaaaguaggucuucauauaugaagaauuguacagugcacaguaauuucuuaccguuauuuuuguuacaagaauauaaauaacaguguuauuuaauuuguauuaaaauauuuuuguuaauuaaaaaugcaauaaaacaaugguuaauuaaaaguagcacauuucugaagaauuucagcaugauguuaaauuguacauuuuucuuaagcuggaauauugucugagguuaacagucagcuggaaaaugucuacaucugaugaaccaaaaauguaagcaagcugcuaauacugaguguguuaguuucuuuuccuguugcugugaaagaauacccuauugaaaauaacguaaggagggagggcuuuuuauuggcucaaagcucagaguacaguucauuguggcaggaaagauguaaacauggcagccacagucaguaacagagugaugggcaaauucugccagugcccaucuccacuucuauugaccaggaucccagcucagggaauggugcuacccacaauggaugggguucccccgucaguuauuguaaucaauauaaucauccauaggcaugcucagcagccaucuccaagauaauuauagguucuguaaaguugacaguuaauauuaaucaauccacugaaaauaguuggagucaagggccugagacaaaacuuaagacaaugcauaaagaacuaacagcuuuccucccuacaugugcuuacugugguaagccucagaaacuuuuguuaaugucuaacaucuuugaauugaguucaaaugucaaguacaucugcucccaugguaugcaauacugaguaaagggcuuaucaccaauaggucccacucacauuccugacuugggacuuaugagccauugacaaacacaucuucucucucguugacaggucauguggauuuccauaauaguugugguuuuaaauuacauuacaguucucuugagaauagaauuauuuuccaguucuacugagaugacuaguugcuaggauuaauuuagcuguuuguaauauaaagcuuuuuucccccuguagauaugaugguaccugaaaagaaggacuuuauugccaaacaucuaaaauugcuaaauggaauuucucuuugugugauagggguacugugugcuuuagauccagaagaacaguguugguggugcuuaguuuucuguuucuuuguauucuucauggaucaaugagguuugaaguaaggaggcagggcaauugcaauacaagcuuguuauuuaauuggagguauaacuaguucucacagcucuacaccuaaguauaugagacauacuugaggcuuuuaccguucucaguuucucuuuuagcaguuuuaauacugaagauuaaauuucugcucuccagugaauguuaugaaucucauuagagacacugcaaaaggaugauugaaaacugcuuggcuuuugagagaaagcucuuugaggaaacagcagagagccaauaguggggaaaggcuaacugguuuuuuuccuguucaaugcauguugaaaucuugaaauggcaccuuuuaucaugcauucaacccaugacuuuguaacagauuuguggguggaaaucauugcacauaccuccgugugucuguguguuugugagugucuugucgucugccagcugacaucaaugucugucacuuuccuagcuguggucauuguauccucuucaaccuucucccuguucugugugcacaucaggcuaauuuucagaacucaaagcuggucugcugcugcugcuugcucuucucucuguuugaagucugucuuuaacuccuuuaccccuuuaaagagcuugaguucaagccacuucaacauagaugcucccuggccuuuaccccauuacucgguuuucuggagucugucauauuuaucuucauaaucuucaucuucauguucauaugaaguaccauuguauguuuguuuucucugaaguguugugaggccaaagacuuaauauuacucugccuuguucacugaagcagccuuaguccugggcaguguagaacucagcagcaguuuguggaauaagugaauguaccaugaaaauacgugccacauggauuuguuguccuugaaguuuuuucuuacuucaaguuugaaaaggugaauuucuagaauuuacauuuguauuacguggguugcauguuuggagugaaaaccauccauccugucacaucucugcuggauuaauauauauauuuuuaguuuuaguuuaugguuguuuugcuugcaugugugucuuuguaucacuagugugcagugccuggagaggccagaaggcauaucagaccuuccaguacuggagccacagagaauugcaaggcacucuguugaugcugaauugaaccugugucuucugcacuaguacgaggcucugaagugcugagcauccuuccaucucuccucuggugcauuucagugaugcauaaacacaaguagagauuggugccugugucuuauuacaaugugccagugucaaguaaccaauaaugaaggaguuuuggagacacuagauuccaacuaucuugaauucaagauuguucaauggacugauucccuccccuccccuccccuucccuucccuucccuucccuuuccuuugcuuucccuuccucccuguuacuucuuuccauguuaaaauauugauuauuuuugacaaugacuuaugucuagagacuacauaaaauaaaauauuuuaaaaauauuguccccagaaauucauggauaauuuguaagaagacaaaaugaaguguauuucauuuauccccuagaaaacacguuucaugagcugucaccucccucuaguuagauuggccaggucucccuucugaagauaauucaccaagcauauggaagagaauugggagagacugccccgacuccgcuccucucacuugggagacagugcugcuuucuuugguggagaaaugagauggguugcguugugauuaucucccaaacaauugugauuguuaccauguauucaaagacaugugcaaaaagaacacagaaaacaugaaguaucuguuauuugaggacaguugugagucaugcaguuauuugccaaauuaaauaguaggcuucuguagacauaaguuuaagccaugaguguuguuaacauuuauucaaugcuuaucaauaaaaaaggugcauauuucagaaaauauguaauguucuacucuugguaaguuuaguaugauuaauauggauuucuguggaaacuggagucuuuuuguuuuguuuuagguacgugggagcaagggagaaguucuguauauuuuggaugcuaccaacccaagacacuccaacuggcuucgcuuuguucacgaggcaccaucucaggagcggaagaaccuggcugccauucaagugagccuguuggcuucauauuuguacaaugcacugugagaguaauggauuaauuuauaacucugcuccaugucuucaauuuauuucccugugaucagcuucacauaacaguaucuaacucauaaaagcaaagaaaucauguagucggcauaugcaggaaaacgcaacugaacugucagcuaaaaccagacuucuggcuuuauuggaauucuugggggaaugaauuacacggucugauacugugcuuggcagagcuugccuucaaguacuuugauuuccuucagugaauguuuuuugauagcaguuugguuugcuaguugcuuuggaucgucuuacucugcuguggguuauucuuugagaaaggccucauggagacaacuugcucauguguguuucccuacagucaggcugagccucguggggaucaugugcuuuugagauuucuucagauaaacagauccagugggauaccuuuaaguaucugucuaugcagaccuaguaucaacauuuggcucaugaaauaguggacacuggcaaauucaaaaucugcagagcugauagcucaguuugaauccaagaaccaaaagcucuuguagagccagguagucugcuuugagcaaacucaagagauuaugauucucuuaugcugaacaaucuuggagggcagcuuuguguucuguuagaccuucaacugauugaaugaguuccacccccaauaugguagucaguacuccuugcucaagcccacugauuuaaauguuacuuuuauccaaagccauuuucacagaagcacacaacacacaguuuaacaagcuuuccaucacugcuugcuuggguaagcugcccuauaaaauugauugccacaaguagaaaccaugucucagggaacggauucacuguacccucauauacugccacauaccucauuugguuccuguauagaucgugaguugaacuuagcaauugcucaguggaaguaaaggcaaaggaaaagaggugggucuagagugguccuauacauaaaagcucaaucagaugccaagaaaucacgggggccacuauagggugaugggaaacugucucaguaguguaaagcuucccaucccgacucuaaagugcagaagaagucaaggagccauggcugacauaaacaugaagggaagcacagaacaacugccuacacuguucuagauugcucaucucuaugugauaauugcuuuuaggaacuuauaauguagaaauuuucugacuaguauacugauuucacuuaagucucaaggaacuauagugaggaaacaucacagcauuaaguuuaauccaacaauaauacaguugucugcuauguaauuuucuauccucagcuaaguaauuucucuguuaauacaaguguuauagccggguggugguggugcgcgccuuuaaucucagcacuugggagacagaggcaggcggauuucugaguucgaggccagccuggucuacaaagugaguuccaggacagccagcagggcuauaccaagaaacccugucuugaaaaaccaaaaaaaaaaaaaaaaaaaaaaaccaaacuaaaccaaaccaaaccaaaaaaccaaaauaaguguuguaaaaauaauguauuucuuuauauggaaacacaaaccugacucuuaaaauagcuaagauauaauauggaucuuuuauaggagggauugucaaaacacaaagaucuaaacacaauugaaacagauucaucuuuauucauguguaaucaucaauuucuuuuccaaguauauuuauauuuuuuucauguuccugaucaaaguagucccaugguaucuguaguaauaaauucaaucgccauguucaguuacuuccuuugucaauguuacuguuguuagaacuauuuauggaauuuauuuuaagccacuuauuucuccuuacugugcuuuagacauauaugggaaagacacacgcuuacaucccccuuguuuugaacuauggguuuaaaauuuucccaaauuuucuuuaccugagaacguccuucuuaccgcuugauauuuaugaaacucgguucuuuuucuuauuugcuucaaccuucauguuguguguucggagcucugcacuggccuuggacucccucaguaacucuuguuaaagauguccuaucuguucuauuuuaaucucccuuuaguuaauggagcccauggugauuguguugaucuggaucuccucccaucugugugcuacucuacugagccucgugguuuuuccacauuugggacauugcacgucuuguuuuuaguaaucagucuucccaaggcacaguuaucacucucacuuggaacacucagugacuacauuucuucucuuaugucaacucuguuccuuuccuugagagagaauagcagucucuagaagaaaacaguggcaguuguggucccucaggacauaacuggugacuucagaagggaaucaauguaagggcaagauuagaagaugacaagagcgucugugaaauuucacucuuuauuuaauuaggaucuaagucuguucagcagucacuguagggccuuuucuuaaugggaaugaaugcauguugccuugcuuuggucacgguauacauaggaacccuauuagcuccccugagguaacaucuuucucacuugaacaguagcugaaguaacagauugcugaaguuucagaaucgcacuggagcaaggggcaaagagcauaaugguugggucuccugacugaaaacaaagccaacccucuaauugguuaggaugcucuccugagagccacauuccagagacacugagugggaaaaacaagagcauaauguuucccgcauuacauuaugaaucacuugcauuccaaauugcaucugaaauuugggguauucaggaaauuuuuuauuugagcuguaugccccagggguagaguaaaugagaaacauuuguggcuauguggcuugcgugguggaaaacgucaauacuuggguccaacucuuucagaaaagggauuaagaauuucagaucuguuuuggcagauggcuggagcuccuucauggagacucaauuauauuugcaguucugggauuuauuugauauuugugaauuugauuuggaaaugaugauuagaaauaugaauugcugaagaaggaucuagcaagcuaauagcccuucccauauguacccuucucagaacgucaguuaaguguguacuuagacuuuggaggcaucuucaacuuagacuagaaaguucuaaauaugaaggauagucuguuaguggugcagaagcacuccuaagcgucugaaucguggugacacuuuucaaaguuaaccgugugucacuaaaugacaacauguguacaguaugugaaaaaaauauaagucagugauuucuaggcuccgaguucuuucucuuuuucuuucccuuuuuaaaauagacaacuauuaagcuaaaacuacucaguuaaaguagucaguuaucauccuguuuggaaaagaaacuaaauguuuuagaauauccaagguagcauuacaucucauguacuucagggcccauuucuaaacuugucuuccccaggucuguuggcugcaugcuauuaucuaagagugacccugguauuuauggagccuuggcacaugaaggaagccucuggauucucauccauaucaugaggauggcaggggcugggcuaugaagcuguucuaaauggagaggaguuagacacugagcucaaauagcaacacaaguacacucuacuucugaccucaguucagaguccugcagccaccugcuccacuauagcauggacuaucagcucuuccuucugagcuguguacaguugcagagucagccuacuagguugcuuuaggaguguucaaggguugcugggcuuuaguaugaguuuuauuaguaauuaaccacaagcaaaucacuugucuuaaaaauaguaguuaauauacaaaucucuccccccaaaaucaagauucucccugugaaagugucucuauuaaccuaaacauuucagguauuuggcauaaccuuaacucaaagauugggaaagaaaaauuggaaaauuuguccuuuaugcaucauuuacagaccuuaaauuuuucauccucacagaacaaaagguauuaauagacauuagugaugaagaaaagucuccccuaagacacucugaaauagcuuuuuguacaaagagcauggccugucacaucauugauagcaaauggaacaaaauuuguccuuaggcaacuugaagcuuccuuuaaaggagaguauauggcuaagacagauaucuuaugucaauaaaaagaaugguaagcacaugguuuuauagacucugcaaauagccauucaaagugaugaauaaaacauuacugggggagcucuuuuuuuuuuuuuuuuggaaggggcgaguuuugaugagaagaucuuuuguaucucugacuccagaaaccauugcaguaguuaacucuaccuccacugaaggcgguucuacuuuauagcaugugugucucucauaucaguuaagagcauguuauuaaugccgugccacccguucauagauucuaggagugauuuucaagaauauggauuuuuaauuguuuuugaaugaccuugguuuauagugcucaucuguaugcaucuguaacucuguugguuaccuguuugucacaagcuugcccuaaguuuaacagcaugaagaaguaagcauguaucuuuucacauauuuuugaggguaaaauucacaagcagcuuaguuuaagaugauagguuugggaccucuggacugugauggguuugcaaucaaccaggcggccagagaagucuuucuuaauugaagucacugaagacuucugugggucugcaccgugugccuccagccucacucacaaggcugucaguauggugaucauuuacuuuauggaaggauugggaugagauuaauuaauggcaaaagcaaauacaugacuggaucagaaagaaauacagaauauagaaccauuugaauaaugcuaagaaaaaugguugaaaguacuagaaagaacagcagcuuucuuguuugaagggguuguucuagguuccuggaccugcucucugguggcugagcagcugccucauucaaccucauuacugagcacaugugcuaugcugagccccguccugaucacuggggguacugggaugcucuaacuccugcauucuuuguauaaaaaaaaaucuuuaaaguuuugcuccuuuucauguaagucaguugucauucauaucuguuuggauucuugugcagauugaauacauacaguagcaucuugaagagaguagagacuuguuaagauggcagaugcuaggcagguaugguacgcuagaauccccauggaaugaacuggguauguuggauaacaguuauuagaagagguaggagacugcugagacucucuagcugcuagcagaggaaacuagaaacagaauggggaaaagugacucaggguccauccuacagggauuggugcaucugaggaguccccuguuccagugggacggggugaccaaaacuaugcuugagaugcacagagucagaaaugugacagugaagaaacagauauuccaaaaagggaagaaggcagaagagauuuacuggacaaugauagggaagagcagaaaaacauguucuucuugguacucaaccaaagcugagacaccauuaaaaaaagagccugcuaaguaugugacgugguggcgcuagaaccucuauaauugacacucuuagcugaucagagcaagugccaagaaacuauaacuauauaccaaaacacugucagcagauacggaguacuguuagacuguauggaagauacugagucagaccuguguuagauccagugagguauaaauugcaaggaaggugaugugggucccaagcuucacagccugcucuggcaagggcagucuagggccagucaaggccaacacuuaugacugacuggguuugugaagaacuucccagagguuuaacaggcaucuaugacauaaccuaugaaugaaugccagcugaugcaagcaucauuuguaccccaaguuugccaaagacuuccuagagaacagagcaacagucauucacauucagaaaacagacugaguacagaaaaggcagcauguaugcacugaguugugaagaccacucauagauuggaucaacaucugugacccgaccucugaauuucaaaggacagcuuaaaggucugacagccauguaggagccuaggaaagaaugacaagggaguugaaauuggaacuagcaggaagguaguauguauccuauucucuggagaguauuagagauugagccuguuguguaccuaaugaaaaaagacacugucacuaagacaaaaaggccaccaacagauugggaaaggaucuuuaccuauccuaaaucagauaggggacuaauauccaauauauauaaagaacucaagaaaguggacuacagaaaaucaaauaacaccauuaaaaaaugggacucagagcuaaacaaagaauucucacccgaggaauaacgaauggcugagaagcaccugaaaaaauguucagcauccuuaaucaucagggaaaugcaaaacaaaacaacccugagauuccaccucacaccagucagaauggcuaagaucaaaaauucaggugacagcagaugcugucaaggauguggagaaagaggaacacuccuccauuguuggugggauugcaauuuguacaaccacucuggaaaucagucuggcgguuccucagaaaauuggacauaguacuacuggaggaucccacaauaccucuccuggguauauauccagaagaugucccaaccaguaagaaggacacaugcuccaccauguucauagcagccuuauuuauaauagccagaagcuggaaagaacccagaugcccucaucagaggaauggauaaagaaaaugugguacauuuacacaauggaguacuacucagcaauuaaaaagaaugaacuuaugaaauuccuaggcaaauggauggaccuggagggcaucauccugagugagguaacccaauaacaaaagaacucacaugauauguaaucacugauaaguggauguuagcccagaaacuuagaauaccuaagauauaagauacaacuugcaaaacacaugaaacucaagaagaacgaagaccaaaguguggacaauuugccuucuuaaaauugggaacaaaacacccauggaaggaguuacagagacaaaguuuggagcugagacgaaaggauggaccaucuagagacugccauaucuggggauccaucccauaaucagccuccaaacgcugacaccauugcauacccuagcaagauuuuguugaaaggacccugauauaggugucuuuugugaggcuaugcuggggccuagcaaacacagaaguggauguucacagucagcuauuggauggaucacagggcccccaauggaggagcuagagaaaguacccaaguagcuaaagggaucugcaacccuauagguggaacaacaauaugaacuaaccacuacccccaggagcucgugucucuagcugcauauguaucagaagauggccuagucggccaucaguggaaagagaggcccauuggucuagcaaacuuuauaugccuuaguacagggggaagucagggccaagaagugggagugggugguuaggggaggguggggagggugugggagacuuuugggauagcauuggaaauguaaauaaugaaaauaucuaauaaaaaaugcaaaaaaaaagaaaagaaaagaaaugacaucacaacuccagugcaaacugauugguuuugaauacugugaucauuuccaguaaaagacaaagugugauuaaaaauaucuagcaaaguugcacaacuccuggugguaaaucaaaggaaacaugaaaaaucaagccaacgugacugcccuaaaucaccaauuucauaguaaugauguucagugcgaaugaguuacauauaguccuaccccccccaaaaaaaaaucagaggaacaauuauaugcaaagaaaucaaaagacaaacuuacaaggguuuuuaacgauguauuuuaaucucugaaagacaacaggcaauauaaagacaacucuauaguguuauacccagcaauccuaucuaucacacuugaagaaaaguggaaagcaagcuaaagaaauucuugacaucucagccaauucuccagaaacugcuuggagaaguccaugugacugaagggaaaggaccauggccaugaggagggagggaagaaacgaugcugugacaacacugaguacacuggaauaggagagcagcaagcaugaaggaaucagcaaaggcaagacuuaaaacacaccuugcaaucaaaacuccggauuuaagauucgaaauucuucaauaaaagacagaaucuaagggauuugaaugaaaagcaggcucuaucucuucaucaccuucaagaaacgccugcaaugcagacacaacuuuaaggaugaaggagaaacaggcaaguacugauguuccacugcaccagcucagucagaagagagaaggcagucacuucauucauucauacaucuuccaaacgguagaacuguuaauuccaauacucuacagauuaucagcuauugcauucugaaauaacucugagagcugugaggaagguagugaaguuuagguuugcugugaaggaauaugggauugcaaaucauauuuacuaauguaauaaugaauauuuguauucaagaaccugugaacauugcauuagguauagaaaaauaccacuuuuacuacuguguaacauuuaagagcugugauaagaaugaaagaggacguuuacaaauucuuaccuguuacagaguguaggacaagagucauuuauuguugaugcauugaagccaaaauggccaauaaguccacuuagcagagagaaaauuaaaacuaacaauccuaugcauguuuauguaaguguguacuuguucugacacuagaauccaggcucuacuauuagcuugcuugcuacuugcugcugggugcuggauuuugugugaacauaaagaaggaaauggcuuuguuguauuuuucaaaauuggagguacagcuauuguuauugauuguaacuaagauaguaagcagauguauaugaaguaaauggaauacauuuacuaacugaacacuagagcuagguguaguuacuuuuuuguuagugguguuugguuuucuagggaaguuucuaaucaacgauaacuacuacucaaggacaugucucacuucuuagaaagugauccuaauaggaaggccugcguuucaucagugaauuacaaaauauuuuuuaaaagcuuugugauuuauguuacucaauguauauucuggggacucuguacucuacugauucacaaggcagagagacgagagggucuuagaacccuaaucggcuugccuugauuaucuuuauuaucuguugaaaucggacaugauuuacaaagacagcuugagaucagagauguguguaaagaggcuucuauuuaguugugggcuugguugaagguuuguaacaucaagaagguguggacuccagagacagggcauuguaagauucaagcauggaguccucuuuuuacugggagcuuuguucacaaacaucuaggaaggaguuaugucuaaucauuugguugauuuaugccacaaccaugugcgcugucucauguuuaauuaauugggcauuugucugacuggcaugccuauaauuucuucaccuagcuuaaggugaucacauuauuuagcauccuugcaugcacaaagaugauagcauugucuucugacaucuuucccugugguccuugaaaugagucuucaugcaucucucgguuguauuauuuuuuaauuuggaggcaaguacagaaaguggaguggucauuuuuccugaggguuauuccaguacuuccccuaucugugcuuugagaggguuccccaacuucauugcauuccauuucuauauuuuggaauauaauauaauuuuauagaucuuacuuuucaaaccaacauagauagauaugcuuuggauaauacacauauuauccaggaagacuaaugccaugcauauaacauuggcccagaaucauccuuucaaacacuuugcuccauguuaaagaauaaaauuugugcuuuuuaaaauugguuuaguuuaacaucauuaaauggugcucaugauaauguuuuauuucuagaaagugauuugguaaccaaagcagacaagcacaaagacuugauuguccauaaauuucugguacuucaaguuauugucaaaauguaucacauuaucagauuuuucuucagagcauacaaagaucuaauauauuucuuuacuguuaauuguuuaaaacaaacgaaccaaaguccuguaguagauuuguaaacaaaccuaaagcuacacuaaaugauggucacauggcagaacaguuagaggcccuguucaucugaagauuucucuaugugcaauauuggacgcuguccauuuuucugccugucugacuuauaggaaauaggaauagcugagaggcuguuugagaucugugguaccuauuugggaauuugcuuauuagggugacgcugcuauggaaaaauauuaagcugugugcuuuaauguuugaaagcacacuucaguuuaaacacagcucuaaaaacacacaucucuauuuuguagauguuaagaagggauacaaauaacacucuugaggccauaucuugaccucaugacaucccauaucacauuacauugcaaacacuaacuguucucuuuuccuuucucagcuuagagaaugcuauccuccgcuucuugaaagagcucugccucuagguguaagcgaagcuuguugaugcccugucucguggcauguuugccaacccuuccucugcuaugcccacauccuucucuccuggguacuguucuccccacgcuccucugaccucuuccuccaucuguaguucgugguauuccuaggucagaguagacugugucaugaagccaguggauaccaccuuuggcuggauuucucagcaaccuccaucaccauuccaccucugucuugauucuucauaacaucacuaaagcuaggccacacccaacuauugcauuauuauuauuuagaauuuguuaaaaacagaaaauugugccacaacccauuuuuguauuuccuauuuuccugaauggcauuauugauuuuuguugucuuaauaguuuaaaacaaagaugcauaugguaagugguauguaaaauauacccgcaagccuaaguguuucaacccuuggucccagcaggagucagacccuaacugcagcuuacgugaaggaaguaggcaaguggggaccuuccuuaaaggcaucccuacuuccucauuucucugucuuuugaugccaaaggcgauaugaauagcagcucacucuccugccaccguacuugccucccacauuuggcugugccaccuugaacuagaagccagaauaaacucuucauaaguuauuuuguaucagaaauuuggccacagcagugagaaauguaacuaauucaagaacagaagagacagaggaaggagaaaccuguauuuugguaacucuaauacagugucgaauagucaauauauuguuacugauaauuuuagguguaaucccuucccuaauggaggauuagggaaaaccaaggauucugguaaauacauuuagauguaguaagagagagguuugagcagucugggaccugaugccuccgccucuagcaugauuauguaguugcaaugcuucuuuccugaugugauaugggcuaauauuugaucaguuaugcaaagcuagcccaguugggaagcuaugcaauuuacauuugagauacuuuguuuuagcuuaaaaaaauucugcauuucuuuaacaaaaauuugauucaugaccaaagccuuuuuuauucugaguguaguuuuucacuuuacuacuggucagaacauaaugugacaaccagauaagccccuucugccuggaugaacaucccaaugacacuuagccagagcucuagucacauccaggagccagcuguggggucagcuaaaagaguuuuugaugcuggaaugugugcauagggcagugccaucugcccuggcugguauauauauggcauggcuccccgagcuuccucucccugugcacuauuuuacucuaaaguuccuugguuauagacagauuauaugcaagcaagagauguacuguaauuuuauuuauguguuuuaauauuccucuaagcagaaccaugguuuguuuccuugcuuuugccuuuugauaaucucaucuagugugucucaaagaagggggucagcauuugcuuagggagcugcaacugacaaauguuuguucucaagcuugauuuauuauuauuguuguuguuauuauuauuauuuuccuuuuuuuacacuccagauuuuauucgccuccugauccauccucugacuauuccacauuccauaccaccucccugcccccuaucuccaugaagauguccuuagccccccaccucaccccaccagacuucuaaacucccuggggccuccagucucuugaggauugggugcaucuucucugacugaacccagacuugccagucaucuucuguauauguguugggggccuuauaucaguugguguaugcugccugguuggugauccagugucugagagcucucagggguccagguuaguugaaacugcuggucuuuuuacagggucacccccuucuccaauucuuccagcuuuucccuaauucaaagacagaguucaguggcgucuguuuauuguuugggugcaaauaucugcaucugacacuuuuaacuccuuguugggucuuucagagggcagucaugauagguccauuuuuuugugagcauuccauagccucaguaauagugucagaccuuagggcauccccuugagcuagaucccacuuugguccugucacuggaccuucuuuuccuuaagcucuucuccauuuccaucccuacaguucucucagacaggaacaauuaugggucaaaaguuuugacugugggauaacaaccccaucccucacuugaugcccuguucuuucuguuggaggugggcucuacaaauucccucuccccacuauaaggaauuuuauguaugguuccuuucuuugaguccugagagucucugaacucccaggucucugguacagcccggagggcuccccccauccccucaacauccuaccugcagagguugccugauuucauucuuucugcuggccaucagggcuucaguccuuuucccccacccaauaauagaucauguugcccuccccccccucccauccccuuucccucucaggucucucccucccucccuuccucccucccgguugcuuucuucucccucccaagugggacugaggaguccucacuugggcccuucagcuuguugaccuuuuugaguucuguggacuguaucuugggauauucuguacuuuuucuuuuucuuuuuuuggcuaauauccacuuauuaaugaauacauacaaugcauauccuuuugggucugaguuaccucacucaggaugauauuuucuaguuccauccauuugccugcaaaacuuaugauguccucguucuuaauagcugaguaguauuucauguuuaaaugaaccacauuuucuguauccuuucuacugucuugggacaucugaguuguuuccagcuucuggcuaucacaaauaaggccacuaugaacauaguggaacacaggccccuguggcacgauggggcaucuuuuggguauauuuuaagauucaagcauggaauguuggguguuccaguagaucuauuuccaauuuucugaggaaccuccagauucauuuccagagugguuauacaaguuuucaaucccaccugcaaugggggaguauuccucuuucuccauauccucuccaacauauguugucaccugagguuuugaucuuagccauucugauuuguguaagguagaauuucauggucauuuugauuugcguuccucugaucauuaaggacuuugaacauuucuuuagaugcuucucagccauucgagcuucuucuguugugaauucucgauauaguucuguaucccauuuuuugauuggguuguuugguuuuuugguggcuagcuucuuuaguucuuuauguauuuuggauauuagcccuugaucagauauggaguuaguaaagauuuuuuucccuauguguagguugcugauuuguuuuauugacuauguccuuugcuuuccaguuucaugaggucccauuuaucaauuguugaucuuagagcaugagccauuggaguucuguuuaggaaauuuccucuugugccaaugaguucaaggugcucucccacuuucucuucuauuagauucaguguaucuaguuuucuauugagguccuugauccauuuggacuugagcuuuguacaaggugacaaauauggaucuauuuucauucuucuacauacaaacagccaguuagaccagcaccauuuauugaagaugcuuucuuuuuuuccauuguauauuuuugacgucuuagucaaagaucaagugacccuaagugugugguuuuauuucugggucuucaauucuaucccauugaucaacgugucugucucuguaccaguaccauucaguuuuuaucacuauuguucuguaguaaaccuugaggucagggauggugauucccccagauguucuuuuaugguuaagaauuguuuucgcuagucuggguuuuucuugccuuuccagaugaauuugacaguugcucuuuccgugucuuagaagaauuguucuggaauuuuuaugggaauugccuugaauuaccuuugguaagauggccauuuuuaauguguuaauuaugccaguccaugagcaugggagagcucucccauuuucugagcucuucuucgauuucuuucuugagagacuugaaguuauugucauacagguccuuucccuuguuugguuauaguuaccccaagauauuuuauauuauuuguggcuauugugaaggguguuauuuuccuaauuucucuuucagcuuguuuauccuuuuuauaaaggaaggcuacuaauuuauuagaguuaauuuuaaaucuggccacuuugcugaaguuguuugucuucuucuggagaaguucucugguagaguuuuggggguggcuuauguauacuaucaugucaucuacaaauaaugauaccuuuauuucuucuuugccacuuuguaucuucuugaccucuuuuuguugucuuauuguucuagcuaguacuuugaguacucuauugaauagagauaggguuagugguccuugucuuagcccugauuuuaguaggauugauucaaguaucucuccauuaaccacaugccaaagguaagagcagguugaucuaaacaggcccauauccuguaaggaaauagaagaacucauuaagaaccuuccaaccaaaaaaguucagggccagauggauuuagugcagaauucuaccaaaccuucaaauaagaccugauaucaauauuccucaaaguauuccacaaaauagaagcaaaaagaacacuacuuaauucauucuaugaagccacaauuacucugauaucuaaacuacacaaggacccaaccaaaaaagagaacgcuagaucaagcuugcuuaugaauaucggugcaaaauacucaauuaaauucuuguaaaccgaauccaagaacacaucaaaacuaucauucaccaugaucaaguaggauucaucccagggaugcaagguugguuuaauauuugaaaauccauuaauguaauccacuauauaaacagacuaaaaaaauaucacauaaccaucuccuuagaugcagaaaaagcauuugacaaaauacaacacaccucauguuaaaaguauuggagagaucaggaauugaaggccuauaccuaaacauaaaagaggcaauuacuguaaacuaacagccaguaucacaggcuuaauuuuuaagauugcaucuauucucugggauagggugaacuguucccugcugugugcuugaucacagaccaugauucuaaaggagguggauuucuuugcacuuuaacaacacaaagcugggccucucugccuuuuucauuauuuuaaacucaacuuguccuuuucuuaccuuacaucgguuuugguguuuucagagguuuucuuuuugaucugaaaguuuugacaacuaucuguugacaacuauuaaucaaucuguuauugugucaguaauuuucaccgugaagaccacugcaacagacagcucaaacuuuguuugcuuguuuguuuguuuuugccacaaggucucauaaguagcccaugcugaccucuaacagacauuguuccuuccccuucagugucucagguauagcccaggcuggccucuaacagacauuguucccuccucuucagugucucagguauagcccaggcuggccucugacagauauuguucccuccccuucagugucucagguauagcccaggcuggccucugacagacauuguucccuccccuucaaugucucagguauagcucaggcuggccucuaacagacacuguucccuccccuucagugucucagguauagcccaggcuggccucuaacagacauuguucccuccccuucagugucucagguauagcucaggcuggccucugacagacauuguucccuccucuucaguguuucagguauagcccaggcuggccucugacagacauuguucccuccccuucagugucugagguauagcccaggcuggccucugacagacauuguucccuccccuucagugucugagguauagcccaggcuggccucugacagacauuguuccuuccccuucagugucugagguauagcccaggcuggccucugacagacauuauucccuccccuucagugucugagguauagcccaggcuggccucugacagacauuguucccuccccuucagugucugagguauagcccaggcuggccucugacagacauuguucccuccccuucagugucugagguauagcccaggcuggccucugacagacauuguucccuccccuucagugucugagguauagcccaggcuggccucugacagacauuguucccuccccuucagugucugagguauagcccaggcuggccucugacagacauuguucccuccccuucagugucucaaguauagccuaggcuggccucugacagacauuguucccuccccuucagugucugagguauagcccaggcuggccucugacagacauuguucccuccccuucagugucucagguauagcccaggcuggccucugacagacauuguucccuccccuucagugucucagguauagcccaggcuggccucugacagacauuguucccuccccuucagugucucagguauagcccaggcuggccucugacaggagaugcuucuucccuuucagugcuucagucccccauccccggagugcagugacuuaaggugcgaaucaccagcucugugugcuuucuuugucuguaucuuuccacauaaggugcugcuuuguagcugacacuagauuugaauuucugacuuuuuccuacugccccaugggggcugggauuacaguaucaccaucaugucuggcaaaagcucuaugaagucuuauucuuguuuaauaugcauggcugccagguuggaugcuucacccacaugguaucccauggaaagguuugcagcuguguguuuuauuggcaggaagaguaguacugaggacuuucaaagcuuuuguuuggaugggacuccugguguuaccauuggaaugcaugcaucccauggucggugcaugccaucugcucagacaugcuuagagagcagggacaccgggggagauggagccaugugccugugcuagagugcaugacagaagcaagcagggugaagugcuuccgccagaaacguuaugucucacuguaaacauauuuuguuugauugauuaauauuauagaugucauugauuuuacugcugaaauguuuccuggugucucucaucuugcagaaaucauguuuauaugcugcuugagacuuauucaugggcuuaguaaagaagguucaagugagaugauaguaccuauuaauuaucuuauuugcuuuguuuuaaacuuucaucuuuuuauguaaauaacuauugaguagaaaaaugguucaaaaaauuucccaacucuuauauaaauuacuaauuugucaccccaagguuugcuuuggagcugaguuuucuugccuuuggauuaccugcuggucuuuucagcuggaugauguggauuuucacagccuauugccuuuucaauagaauaauugugccucugccaaguguauaaucauguguuuucccuuauaucauccacauguggacagcagccugccaacacauaaacaagaaccagguuacgucacaaacagaugcugcucaaauaccaaagcaccgugcccuccucucgaguuauguuuauuugugcacaguggggauuaauauuuuuuuugugugugaaagaagauagaguuacuuuugcuguuuucaaauagcagaagugaaugucccaugcaugaguucaugaaaucugugcccacaaggccugauacuuuaauagggaugauagacaaauugucugggaaaguugagcuuuguaagucguguugguauugaaaggagguagggaaauugaaaggaugauucuuuuuuaaacuauugucuaucuaucuaucuaucuaucuaucuaucuaucuaucuaucuaucuaucugucugucugucugucugguuugaugugugccuguguucgugcaugugcaugcaccuuguuucuauauggacaccugagguggccaggagagagggcuggauucugugcaagcagaguuacauaaaguuaugagcugccugauaaugggcaccggaaacagaauuuuggcauuugaaagagcagcagcugccuauccacugagccauaugccuagccuuguaagucagauuuacccgccuaacucccaggaaagaguucaugcaguaagugauagaguaggaaacaaugcagcaggauggcaggcaucuugaguugauuugguccuaaccagugucauaguauaguagucacuguuaaaaaaaaaacuuaucaaaugauggcuuaaauuacuauguauagcuuuuaaaaauaggacucuuugaugauucaaaaggaaaaaaaaucuacaguugcuuuuuguuuguaaacuuguuaagaacagccgggcggugguggugaacaccuucaaucccagcacuugggaggcagaggcagacggauuuucgaguucgaggccagccuggucuacaaagugaguuccaggacagccaaggauauacagagaaacccuggcuaaaaaagccaaaccaaaaaaaaaaaaaauccccaaaacaaaaaacaaaagacaaaacaaaacaaaaaacuuguuaagaacagaaaagugagccacaacucauuuuuguagcuccuucuauuuccccgaaugacauuaucgcuuuuguugucuuauuaguucaaaacaaagaugaccaacugugugguaugugaaauauauccuccaguuccagucuuucaaccuuugaucccauugaaaaucaggcccaaccugggcauagggggagguaguggaucacugggggccuuccuugagguaccuuauccuaucucuacuuccuguauucucugucucuucauagcaggauuuagguuuuuguuuuuguuuuuuuucagaaguauacuuggggacugagaaaagaaggguccuucauucguaagagcuucuagggaccaggaaaauaaguagguucagguuaugauuguccauuugguaaacccuaagacguuuggggauaaagauuauuucugagugcugaguguucuuguacuucuaguuuuugucaaaaugacagaaacuagauucaucugggaagaggaaacuucuauugaaaaauuauuuccaucauauuggccuguaggccuggcuguaggguguguuucuucauuaauuauugauguggaauggcccagcccacagucccaucuccagucaaauuguuccagguuguauaagaaagcaggcugaacaaaccacgggaagcaagccaauaagcagcauuucuccguagugucugccucaguucgucccuucagguuuugccuugaguuccaugacauaacccauaaguaaaacaaaucugguucuccuauaaauauucaguguuugucaucauaagggagaugcaaacuagccuaguuaauucauauuugauccaggaaaucaaucaccaugugaaacauagagccaaccaguaaccuugauagauaaaacuagguugaguaugugaccuuggagaacaucuugaguguguaguuagguagaccgaaaacucccccggacugaaaacuuccugcucagagagauuucucaugguugauaaaucuuuaaaaacuaguuguuagacacuuaacucuauacagguuggguauuuaggauguuucaaaauuuugauauucuagauagccaaaugcagaagccauuugccaaacuucaaaugggacuauagucaacaaaaaugagaguagacacaggcacaaugaguaacaguuaagagcuccaugacauaucuauaagcucaugaaagcuaaugguuugggaguacuuacuuuugagaagaauauggucuuguagaacuuuauaaaucuccagauaaucacccaaaaccuuaggucaaccauaaacacuaucauagcacuaaguuugagguccagggaagugaauuccuaagauauaaauagcuggaaggauuccugcaaggaggggcugugcacauguaacuaggucaccagauaaauaaugaguguaauaaagagaaacaaauaugagaaucaggaugucaaaaugggccuaccgauaagagggaggugauguugaguccuuacguauuagaaccauacucacuuuguaaaauaaguuuuuauuauuuuucauuauguauagguacauuuaucugaguguaagccugugcuaacgugugugcaauugccugugguggccaaagguauuacuuagauccucuagauuuggagauacagguagguauagccaccauguguaugagcagcucaauucagguccucuggaagagcaguaugugaccuuaacuguugaauaaucucucuagcuccucgaucugugcucucucuuuauagcauuccuacuacaaugaaagggaugauaaggcaguuagugaaucuacacaucaggaaaacagauccacagggcucuagacauuaguaacguggcagguucugacagaguuuuguguuacaugugcacagucccucccauggggaaaaucccauggggaaaauuauaggaauuaugaugagauaaaaaauuagugcaguguagcuauuugguuuguuugauuuacaaguucaguuucugauugguugacuuuuucuauggucaggaaaaaugugguaaggaacuuguagaagcaaaagaagggacuggaagggucuagaguccaggugaucccuuugaggacauacucauaaucaacuuuauacgacuagcuagcuuuuaucuccuaaaggauccacccucucucaguagcauaacauguuggagacuaagccuucaacacaugggccuuggggagauauucaauguccucauuguaucaauuggcaaaaaagagaguuaagagugugauuuucaaaccauggucacagaugcagaggaugagacuauaggucuuaaaaauggucugaguuauacgcagagggauuuuccccacuucuucaacagauguaugcuacccccguagcuucauuucucuuuguauuauaauauggccaagaacuucggauugugaaauacugccauugcuuuuauuaaaagucuaguaaauauuaaacccugccuucauuacagagccucucaauaaacaugcauccuucaaaguuauaguuuaauauaauguuaucauguuuuaaaauuaaagauuaucuacugcuaugcaaaccaucacaaaaugacugaugugccagaaagcaguuucaauuaguuuucauggauguugaucagauaagcacuaagauuuaugguuguguuugggacuuccaucaggggaguccucaaguguuuagagaaaccaaccaugagagggcugguucugauuuagucucuucuacugacuguauccuuuuguuucuuuauucuuguuacaucacgaguaguaguuuauauagauugcuucauuuuuccuaauuauaaauaacccuuuuucuggagguauggauguucugaaacaugguuucaucaaaugugucugaacacagauugaaccuuugaguuuucucucucucauuguuggugaauaaugaucaucauuucuguuuuucuccagggagcuguaaaauaaauauuuggauuuauuuuuuaaauuacaaaauacacuuaaaaacaaagacaauuggacuuggugguguaccccucucugcacuuggaaagcauggacaagagaguugucacaagucccagccuauccuugaauguauagcuuguguauguaacauuaggugagcuaggacuauacagugagaccuuucucaaguguuaugcuuauuaacauuguugucaacaugacaggauacucaaccgcauagaaaggcaccuuugcacacgucugugugaguacuccagagagcuuuaacugacucccaugggaaaacccacucugaaugugggcaggcaccaucucacagucugguuccccagacuuaaugaaaacaagacacggagcugagcacagucucucucugucucagucagucagucagucagucugucugucugucugucugucugucugucugucucugucuuugucucucucugucucugucucucucucucugacugucucugucucucucucucucucucucucucucugucucucugucucucucucucugucugucucugucuuucccagagacuuaccauauccugauggaucagacucaaacugccacaauaaaccuucccucuuuaaguugcucugcuacguauuuugucacagcagccgaauugcagagguaguuggggagcucaagugaagugauagagaguagcucucuucuauuccugacaaugcuuugugugggaauguuucaauaguuccugggguuucugcuuguguagacugcacacaugcaucgaaacagcuguuguuggcccucucugcuccuucccucccccuuugccucuuucuugcugugcauuucaacaucaguguagaacgcauugucaaacuaaugaggguuucucucuguacuuuguacuucauugaauucuacucuucaguggaacuuaauuuccuugcucuuuuuguucauuugguucagaaggaaguuucagugaauuuauuuuguguauucuauuuaucuucugcaaccaaacucggaacuaucucagggaagcuccacagcuaugggaggaaacccacccgggacaauucuccugcaacagccagcccugcagccccaggacuggcuugcuuaaagauuuaaccaaggcucagggaggcauuuucuuccaauuuuauuccaagagugaacauucucugggaauuucuuagguucugcgauguuccuccugugugucugcuacuggcagaagggcugccagaguaauuaucauuucagcucuuacugacuccuugccugccagaauuuccuuuaauaagucugcgaugguugccuuuauucuucuccuuugccuucaguaaucuccauagacuaagccaggccugagagaugagacgcacgggaucacucacacagcccuuacacuuccugugucuagugucuuugguauuucugauucaacucuuuggaaauuauuucugaaacacauuuguuuauauuuaguuugugucagaauuugaaacuuuucuccuuuaauuuuauauguaauagcaaucagaacaaaauccuuaagauauacuuacauauuuauaaauauaauucauaugauaugauucaucuucauaauuuguauaaauuuauagaaaauaguuuuauuuuauaugagagguagucugaauaccuuucaauauccagaucaacuagaaauaaagaaaaauuaauacuaacuucauaggcacaugagcuucaguuauuucauuauaguauuuauuuauuuauuugcuugucuguauuuaagacaagaucucuuauagccuaggcuggccuugaguuuacauuguaucugaguauaaccuuuaauccccgaucauuuuuuuccauucucaagugcuaacagcuauauugucaauaucacauacuaaauuaauauaucuuaaagugauaucagaagcuaacaugccuuagcauuuuuuuaacuuuauuccaggaaggagaaaauauuuucuacuuggcaguugaugauauagaaacagauacagagcuuuugauuggcuaccuggacagugauguggaggcagaggaggaggagcaacaagcucugaccaugaccaaagaaggcaaaguugaccacucuaagggacaguuggcagcuggaaguaaagguacugcaucuucguuuggugaucugaaggaagagacauugaagaggaagguagcuugaauuauuugaauuauacuuguguguuaugaugugguauuguuaaaagaguguuugucaaaacuauucuuuuccucugaauaccaggaaaagauuguuugggguaauuccuguaggguggccaggguaaggccacucugguucuuguugucacugugguaugauacacugucuguccccuccugcacugguucugacaguggccaguaagaaggucacucaggcucugaagauuucaucccauguacaugugaggaggccagaucuguaggguggcccugcuguguccuagagaucugucuucugagaucuucugagaagcuggacauuagggaaaucuuucuagucuggucacaggagcugguaggauuguuaauuuguccuugucuggggaucaaaaacuuuaggugaucauagaugauaccugcagucuaggagagggaugacaguugguugucaacuggugugaaauaaccauuuauuuuuggucccguguuuuauuccugcagaaaacuugagggaaagugcuguguuguagcaccauguaucuuuguccauuuggccaaaaggaaugcuuuuaaacagucagaaguuucuuguucacaguucugucugcaguucucauugaacugagggacuagcacacguggugucugacuccuuuccuuauuuacagaaguuaaacauacaagacacaaacgugaccccagcaagagaaaugaagacaucagucacauguuuaccaguguaguguuugauuacaugaauguggcaccuuaaauaugugaaugacugaguuagaaauggggaaaagagccguaugggagagugcaccugagauuuacugcagacauugcacuucacagauggaacacauauggcuuugguaugcaccagcugcaucuucaggguggcauuauuaguuaacuuuuucauauuuaauauauuuuaacucuaaagauauguaacuuuaaugguacccggaagaagguggguggagcucugucagugguggggaauagggugccucaccuaccgcaucugcguagacagcaguguuuucaugcugugccucuacugugagauccccuuuggcaguucacaguagucuaugucuguuggguucuucuccuggucaagcucagagugagcugacgacgauccauuuucuaggaaaagacuugcuuugcaauucagaacuuauuguuacuucugaucugaagcauuaccauucaaaggaaaacugcagauugaauuugauuuuguaacuacugugaagcauaauaaaaugauuuaaaaaaguuuuucugauaacauuuuugguuucuguuuaauauggacaauguuaauguuuguuagagaagacaaaaaaaauggacuguaucagacacaacuaguuuauuuugaagugggggccaaagcucguuccuugcuugugaacuccuguguuguacauugcacaggucaccuuggcugugaagaggacuuugccuguccacagugugaaucgagcuuucccagugaggaaguccuuacugagcaccuucagagcuugcaccagaagcccacaggggagaaagaguucaaaugcgagaacugcgggaagaaauucccugugaggcaggccuugcagagacagugcguaugcucagggugguucagcuuguguuugaacagucagauuauuuacugugcuugcuauguauaucugugucugugagcaugcgccaaagcauaugugggaaaguggcagguagccuacugugcuaugagcucaucuuuuccgagaggagcgugcugaguuucaaaugcucugagcaugagguuuacaggucaacaucauuccugcuaagcccuuuuggugcauuucauacuugccauuaaauaucaugcuuaaugguuuaauaaugguuuauguaugcauaauuuagccagugcuugagguuauucaccaaguuucacuuauuugcccucuaauuugcuuaaaacuguuuaacugauaaagaauucaguguauugauaauggaaggcugggaagcagcaccuguuucccagugaguuggaagacuaguuugaagaugagugggucaguguguggcagugaggugaaguacaugaauuacccauuaccuuauuccuaaucacuugugucuacaacauaaaauuagcuucuauuuuaacauuuuguaagaucagagcuaccaaaagugagagaauauacagacuccaaaauucuacacuuagcaaacugucaccuuacaugaguaaaacagcuuccagaauauuuaauguuuccauuuuguuguguuuaacuccaaaguaugccauuucauuccuuucuaucuaucuaucuaucuaucuaucuaucuaucuaucuaucuaucuaucuaucuauuaucuaucaaucuaucuaucuaucuaucaucuaucuaccuaccuaccuaucaucuaucugucauuuauagagaugacauuucuauauauuauaugcaucagguuuugcuuaugaaauauaaaaauaauuuuauuuacaaguaacaaaucuuucaaaaauugauaccuuuaggaugacuuaaacauuuagggauuuuuacuaacuucuucaaauaaagccaagcaaaaguuauaauacuuuuuaacaaguuaacuuuagcuugcauuuuagucagcuuuuauauguauuuauugcacugucagauuuugaacuauaucuuagagcuaauaggcuaccauuaaaauguagaagaccacacagggcagcacaaggcugggagcauauccuggcacucuggcuucuucacccguucuccucacugcacuuuucugcacagccagaagcagcuugaaaaauucuucaucgaguguucagugugcucuuugcaauucucuuuucaguucagcacugagguuuagcgucugguuaugaaauggcuuucacaagucugcaggucauuuucucgugcauaauucaugcuuggagcaagucagcacugcacuaaguaaacuggaggauuuggauacaucuuucuuaccaacauaauuaaugcaugaaaugaccuccagacuccugcaggaaggaaguccggggaggcauggguugcagaaaccuugugugauguuugcguguguaggcauaccuucaucauuucuucugccgccuugcugcuugucuuauaguuuugagcagcaccggaaggcuugccgaggggaggccagguuugugugcaaagccgacagcugcgggaagaggcugaaaagcaaggaugcccugcgaaggcaccaggaaaauguccacaccggugaggagacacugcacaguccuuccaaacucgccccguucccuaggccaugggaucugcuucgaauucucuuuugugaggagggggcuggcuuccguugugcgccacacagacacacaucuuacccguuuccuaguugauuucagcagcauuuaucauuuuccccaugucugaauuaaucauuacuguaaaccaggcucacacuuaacuguucuugccucucagguauacuuuucaaucauuucacuguuuuagucuauaaacuugauauuucacacacuguugaaauugaucauuuguagguauccuuugaaacuaggaagugauguacuucugccuucauauuuuuacaagaauguucagugccuuaagugcuuacauuucuucuguacuggagaaaauuccuaauuaucuuuugccuuggaguugaaaauauuugaaauuugagcagaucauuuccuuaagcccuuguaaucccuagcuaaagaauaaagcaaauaaaagauuugcuugucaccuaggauuuuuuuccuuaauucuuucuugccuaccaauaaauauauucuggguugugguaccuuuugcucuguggggccuuuucucuucuuugcugucuguuugguuagagagugugagaccuaaagaaacucuccuguccuucugcacaugucuuuucucaugaguuugcuuuuacucuccgcuucugggaagugaacagaaaugugucuuugcauagauaggcaggacacucuuuucuuccgucuugguucauucucacaauuaggugaagagagugacugauaccuggcaucaggaccucuguggccugaaaauaacugacuucaguaacacagugagagguuacuuaccaugagugugacugcaggccucccuuccucacugccugagccugcacacugugagccauccacagugcucugggggcacaaggugaagcuuuuaagcuaaccuucagggggugccaaucaucaagacuucccagcauuguuuuguggcuuucuuugugaagaacauauggcugguauauggaaaaugacuuccccugcugaauuuaaaauauacuggugccuuucauaugauggcagaagcaggcauaacuuuuugauagauuugcuuucguagguuuuuauuuuuuuuuaaaugcuguuuuggcuaaaaugcuguucuuaauuuucuccuucuuugucugcaacguauuuuaaucaaacuuuuaugucaguuuuaaagucaacuuugcugaacuaaguaaaaagccagauggaugcuacaacucuggaaacuuuuccguccgcaucacuaggcauaugguccuccugcugugcuuauaguguaguuuuugagucuucugguaauuggccuuggguugcuuacuguugcagcucuggggcauucauggugauuuugcaggaaacaagucauacaugaagaguuuguuucaucaucauuaucccauguugcagguugggauaagaugugaacguugcuguauuuuagcaaaggucucuguacacaccucucaguugguuuggcacgugguaucauuuucuaauccuuagccugcuuauacuucuuuuuuuucuccuuaaaguagggaugauggggagaauacuuccuguuagagccaggagagcaccacuaagguauggcugaggacucucuguauagaacacaagguguuuaaggagcuaggaaaccaaguuccuuuuguauugauugaugaggaagcauguccuguuagaugauaugaccaguagcagguaaaagaagggaagcugaauauuuaaacucaggucagacauuuuuauguagauacaauaggggaugauggauagguuuguaggugaguagaguuguauggcuuccuugaccguugcuugcuucuguaacuguuaguauaauauuuuugcuguuguuugauuuguuuuucugauccugaugauuuaacccagggccucaaaccaccccugaacuuuaucagaguacucccaacuccugagaguuaaacaccaugcaaaccugaguauaggaagccaaaauucuauggauucuguggcugcuaagaaaaagguuguguuuaugagaaauaacauuucauaagcucuuucuauauugcucugcguaaaucuaguuuuccaauuguaagaugaaagagaugugaagaagagaugguagggaugggagauugguacugaagcagaaucagcagugaaaugaaugguuggagaugucaacuucuuucucucuucucccauccuuaugggaaaaccaggggcuggucucaacagagaacuaugccaaucacaaauaauuggaguuagaaaaauggaauguuguuuuucucgguggucuuucuagaguucauguauagacugaugaacaaguccaugcaagaugauguccauuuuguugugugaagauguuucucuuuugaaucccuagugucaccaccaaacauauuuucauggcuguguagucgguagagugcuuuaaacaauuaaauguaccugcucuugcugugacuaucuuaggaucuugaaaaccagaaugaaaauuccuaccuuucuucuccuaaauguuuguuucccuuuuauaaacauagcucugcaucaugaucacacaacacugcaguauuacuucugcuugucaggguuuccuuguuguugagguuagagcaaggaugggcauggguuucaccuaguuugggggaagugaugggcacagggugcuacauuauguuaauauuuacuuuaggagcuuucaaauauuuuuuaauuauaaaauaucauuuugaggaaauuugugcugguacagauaaugcaguuauggcaucacauuuugaaauuauuuugagugucuaauuacugugaaguuugaaauaugauaugaguuucuauuguuacuguaaaagaagaugaauuuuaguucugguuggguuuucuaacaguguagguugccaguauaauacauuauugugguugauuuuaugauuuuacauuauacuaugcauuaacaguuauuuaguaagguaugggcucaaauucuacaggaauuuaguucuggaggaauagucugacuaacgauagcaagaaaucacuugaugaaaggucaaggaaauaggguaaucaaguuaugaguuaacauggucauucuuuucccuauaaaaagaacauuugauuuacuuaaauuuuguucugacuuuuuguggaaacuuucucucuagagacuauuuuaacagauggaauagagaaaaguuuauuugauauauguggaaacugaugagcugggaacucucaaguuugaaaagaaagacuugaauauaaccucguagaauucucaauuacuaccaugaaaugguguggaagggauccugggucaaccucaguuaauuugugauggucuuucaucccuguccuaggugauccuaagagaaaacucauaugcucggugugcaauagaaaauguaccucagugucaagccugcaggagcacaggaaggugggugagagccugucuguuggcuggaaggccuucugucaccaucugccgcagucacuugguggauguuauaccaagacagggcuuagcuaguggggacgacauguuccacaguacagaagagugagcuaagaguaguuugaguuguguuguuucaucauuagcuaacagauucuuuaaugccaggugucaugucuagcugagucccacagagcacccaccacauuuucaagauuuuuuucaguugguguuugcucaggaaacauacaucagugauaugaaaacagacauuuuugugcggagagcuugccuuuuuuauuaacaugaguacauuugugguucaguuugguacagaaugagagcuagaagaugauuuuuaaaagacuagagcugaguugauaacaaugagaccgauuggcacugggaugucucagggcuccucuuagcuuauucuacucuugacaggaaagugcauaucgauagcuuuguguaucccugugucauuggagaaauaaaugaucauaaucauagaaaauguauuuaacacuuugugguaaguaugaaaauuacuguuaucuuuguauguaagucuaaugugaaaauuaagcaucaagucuagcaauuaguaaauaguugauagagaauacaguggaaucaaaauaaaauuuggauuuuguuuguguuguaauagagugcacaaaauuucccaauuuuacaugcuagauauuuaguauaucugagaacaugaaaaaacuuucaguaacuuguuaucuagaagagauauugccgaugaguguaaaaauuuuauuuuucuugugauuuguaaaaugcuuuuuacguauuuguaugcauguagauuuauuacauaguaauuuggcaggacuuaaagcugauaccaccuuuuauguauuagucccaaguuuauggauuuaaauuaugacacaugaaauagcuacugacaugugugaagcugucuccuggauauagagcgauuuuuauuaucuuugggagaaauaacaauuugcaaauaaaggcuguuccuuugcuuucaguaguuccccauuuaacauugggcuggauuucuccucucugaacaaggauauuaaauugauuagaauucucugcuuauucucuuaguuuuuguaguuuccagcuggugacuuuauggggccuauugaagauguacuaugcgucucagauuuggguguccuucuuggacaggggccaggauauucugcccaguaauguucagacuugugcaugugugcugaaauugcagaacgccagucuagacacuuaccuucuagcuccaacccuuaaauuguguauauauguguguguacaugcguauucaugugagugccgagcacagauguggagaccagaagacagucuccauuguuggucugagagagacucuuguucucugaugcauacacaagacugacucaugagcuccugagucaucuccuuucucugccuuuugugcugucauaggaacuuagggguugcagacaaacuguuauguggguucugggaaauugaacuuagaacuucccacuugcacagaacauguguuacccacugaguaucucaagguccuguagcccccuuuuuuucuuccuuauaaaugcuaggacuuggagaguagacuuaguuugaggcaaaaauauuaagucuuuugaaguuuguaauucuaaacacccuaauuggaaugccuauugaaugguuauuuccuggaucuauuuaaucuuagauuaugauguuuaagauauuugaacagaguauuuuagcaaacuuagucauggagucuuuuucugaauaaugccuuauuuuccauuuauuuacuaauauagauaccuucuccauuaaacaaaauuaauuugguaguaaaaaaaaagguguaacuguugguggaaugcagaaggaacaguugcucuuucauguugugaacauuugcagaauguuaaaaaauucguagugcaaauagacuugcauucuagagcaacccuucaaagucguucucaauacaaaggaaaguaucguaacuccaacugucaaucauuuuaguugguccgcucuaacgucuaguagaguuuaguugcaguauuucaucuugacagcagauggugcuuuaugacaauacuaaauuacagcauaguguguauagucuuuuauauuacaguauacuacuuuauguuguaacaaaguaucuuaugauuuuuaucuaaaguuguuucauuucagacuuaaaguaguaaauuaucaccugaaaacaagcauggaaaauuguaaauuuaacaaaacauguuuucuuaacacuaggcaugauuaaauaaugccugucauuugucaguuaaguuuuguuaaaaguuuuaaaaauauccaugacccuguuuccucuauaagagaguuaauucuaaaaagcuuuugugugcuguaaaugacuuauuucauuaauucaaccuaaaaaaugucucauguuucaaaaauacugaauaaauaagaguaucuuuuaauauuuuaacaauuauuuuguccauagaucaauuuuuaacauuuucuauaccaauaaaauuuggauauuacaaauaaagucuucauuucuauauuacaccaaauauuugucauuugcacuagcuugucaucguuauaaaauuauauauugcauauuuuuacaugcaguauuuaagacuguaaaucugcacuuauuagcuuuaaauacacguuucaugucccgugcuuaguggcugaagcccccauagcuguuugauggggaggggcugcauggccuuccuaaaugccgccugggacuuguguucguaguucucccacucguagcuccccagucuccacacugaaacucauccuguucagaaguggacguugcugaaucucugcauugauacacuccagaggcuugaugucugucagggacugucugcuuuaugccuuuccagguucucgcagugaguucugacucacuaaagaguaaagucuuuagaggagggcuuucaagcuuugcucuagcauggcauggcauggagucaggccagccggcaggccugggaucuguuggccuugcugccuccagcuuuucucugucuuuucacucuucuugccguggccacuuggaucccaagaaaaccucauccuccacucaugcacuguaucagucaugcugaucuuucccucuguggcaucuaguuauuuuucaguaacagagaaagucuuggcucuaagaagaagaauuugcuugccuaagguuaauuauuguuccuucaacagaacuaguuuugcaucuuaguccaauaguuugaugcccuugcuaauuggcuggugucuuagucaggguuucuauuccugcacaaacaucaugaccaagaagcaaguuggggaggaaagaguuuauuuggcuuauacuuccauacugcuguucaucaccaaaggaagucaggacuggaacucaagcagggcaggaagcaggagcugaugcagaggccauggagggauguucuguacuggcuugccucaccugucuugcucagccugcucucuuauagaacccagcccagagaugguuccacccacaaggggccuuucccccuugaucacuaauugagaaaaugccuuacaguuggaucucauggaggcauuuccucaacugaagauccuuucucugugauaacuccagcugugucaaguugacacaaaacuagccaguacaauugaccccuugucaacuugacacacaaaaacaucacuaguaagccucaaccauuacaaucuuauucauccccaagaucuaaauaacuuuaaaagucccacagacuuuacauauucuuaaauuuucaaucucuuuaaaauauccaucucuuuuaaaauccaaagucuuuuuacaauuaaaagucucuuaacugugggcuccacuaaaacaguuucuuccuucaagagggaaaauaucagggcacagucacaagcaaaagcaaaagucaaucuccaaccguccaaugucugggauccaacucaagaucuucugggcuccuccaagggcuugggucacuucuccagccaugcccuuuguagcacacgcaucauccucuaggcuccagaugccuguacuccacugcugcugcuacucuucguggucaucucaugguacuggcaucuccaaaacacugcaugaccccuucaguccugggccuucaauugcaacugaggcugcaccuucaccaauggccuuccauggccucucacagugccgagccucagcugcuuugcgugaccccuucaugccuucaaaaccaguaccaccugggugacccuuacauauuaccaagucccgcugcagcaggaguacaaccuuggccaucucuggaacacagccucuuugugcuuucagaaaacacuucccagaagaugucaccucaaugaugcuggucucuucuuagucaccgcuaauuucuuaguuacagauaaccagcaucaauagucccaguaaugcaaaguuuuugcuuugguaguucugguaucuuguuaaucacagcugauucuucagccccagcuaaccagaacuacagaaucuucauaaucaaaacagcaauggcccugaaaagagucuuuaauuuucccucugaaauuucacaaaccagaccuccaucuucuacaguguucucaacauuaucuuacaagcuccuacacaacauccgacagagcucuuaacaacagauggaucuucaagcccaaaguuccaaaguccuuccacaguccuccccaaaacauggucagguugucacaggaauaccccacucugcugguaccaauuugucuuagucaggguuucuauuccugcacaaacaucaugaccaagaagcaaguuggggaggaaaggguuuauucggcuuacacuuccaugcugcuguucaucaccaaaggaagucaggacugaaacucaagcaggucagaaagcaggaacugaugcagaggccauggagggauguucuguacuggcuugccucaccugucuugcucagccugcucucuuauagaacccaagacuaccagcccagagaugguuccacccacaaggggccuuuuccccuugaucacuaauugagaaaaugccuuacaguuggaucucauggaggcauuuccucaacugaagauccuuucucugugauaacuccagcugugucaaguugacacaaaacuagccaguacagcuggccagcauuuuucaaggcagacuucaugccaucuuccucuuacaacugaauaccuuccacaucaugauaaacugagauucuauuuucccauacuaaguacuuuaugguuugagauagaaagaacuaauauaguaccugauuauaacauuuuuauuaacuuguguguuaaagcuguacucugaauagauuuuauauaaauaaauaaaaaacauuuuauauaaauauauaauaaaauauauuuuauucaucuauauuuaaacuauacaacaugcaaugagauauaauuguguuagaauaguuacaauagugaacugauuucacauucacaucucacaauauucauccaaucccuacccuaugucagagauccuguaaucuguucauucauucaaccaagauuuccugaccacaccauuguuaauguaauuggccauauugcuuauguuuaagauuagaucuucagacucagucauuguauguauaggcuauuuuauauauuccaucauuuuuauugugguccuccuguccugugaagcuucauugugaacuuagugcauucagaacagagcuguacugaccuugcuugcucugcaguugauaguuuacauuugaagcguuaaugccuauuguaaaaggaaaauuauaucucagguagcauauggcccacaauaaauuuuauguauaacgcaaguuaauauguuagcugcgaagguuuuuuauuuuuuuuuaacaguucguauauuuacuacauacaaauaaggcaggaauacugcaugcuuuccugugaggauuuucugaugauacauuagcuauauaguaugucauggcauuuccaauguacaugaaggaaacuuggcccaauacuagcaacuguccacauguuuauauuuuuugcuucaucuguguauaauucauuauuuuccaacacuugguuuaacugucaguuuaaucuuuuuuucagauucaugagauauuugauugucaagaauguaugaaaaaguuuauuucugcuaaucagcugaagcgucacaugauuacccacucaggugaauugcauacuucguauacagacugaaaucgcugcagaagaauuacuucaccuugcugaagaaauugaugaguaaucagaagcccucgcuauaaguucuagcuuagucaaaugauuuuuaaauucuucauuuucuagaguuggguuuguuuaugaagcaaagguuguuuggcugaggcauaggaaaggucuuccagaaucaccaucuaauucgggaccuugguuucuuuauucuugacacgauacccuggcacugauuauuaaguuaacuuauguaauacacuagcauagugccuggcuauuauuggagaaucaacuuuuguguuuguuauguuucuagauacuugugcauucuaucuaugguacccauaaaauaaagaauuauguuaauauuugggggaaauuucuuaagguauaaguucacuuaaacaauuuugaguaauaggcuuuuuuuuuucuuauaacgugucucuucugaagaugggaagcucugucacauggcgccugccuggugcucucugauagcuucuaucacuggcagaacucucagcauuaaggacuugauugacauaaacacaccuuuauuuuucauauagaaauagaauuuaugcuuugaauuuaaacuuuuuuuaaguuguuuauuuauuauauguaaguacacuauaggugucuucagacaccccagaagagggugucagaucucauuacagaugguugugagccaccaugugguugcugggauuugaacucaggaccuuuggaagagcagucagugcucuuaaccgcugagccaucucaccagccccaaacuuuuuaauuucaaaggcuuaacugauaaaauagaucuauagaaaauaagcauuugcauguuaauuugugaaugcacacaugucuaacacagaugaauuacauggaaggcauuuuugugcuuggcugaccgugcuuuaguuaguuuaugcauacgacaaaaguacaggaaaggauggauccccugacccuuggcuuucauuucugcaugcuauugucucugcucauucuuccuagaaaagcggccuuauaacugugagaucuguaacaaguccuucaagaggcucgaucaagugggcgcccacaaagugauccacagugaggacaaacccuaccagugcaagcucuguggcaagggcuuugcucacagaaacguuuacaagaaccacaagaagguaaagaugcuuauuggcaucuguuauuuauuguuucacugcuaggguuuuaguugguccuuaaccagauuuggcacaucuguggcauucggcaugaagggaccaguguaguuagagaugauccugcuucuacuuuguuaacacucaguccauugaucucugccuucucuucuugucuccagucugaaaacuacucucucagacaaaauguccacugugugagugggucgauuaaauaguucucagcuucuaaccagcuccaagaaccggccguuguagcggaugauauuuguauucuccucucuguguauuucaaugcuuugcucacaucaccgucucuccggguuucuuguagugcacuuugcuaggucuguccuuuccuccgaauguguuuuaagcuauguuagcuuccuguggucuaaaucaaucugcuuacugaguggaaagguuuauugggcuugguuaaaaggcuugaguccaugguuuguuuguuuuuuuauacucgugguaaagcagagccucagggugcagaaugcacaggagaaugcagguaaaaccaagucacugcccucacuguguccaggacgccaaaggggaugggggcuccaguaccuacuuagaugauauucuuucuaguauaucucucgugaacccucacccccuaaagggccccacuaucuuccaauaagcacuuucagugcuuuagcauggcuucgccaugugaguauuuagaguugacagugugugugugugugugugugugugugugugugugugugugugcgcgcgcgcgcaugcguguaugcagugcauguguagagcucagaggucauugguucucuccuuccaugugaauuccuggauuccgguccaggcugucaggcguggguaaugaggcuuuccucugcuuagcugcugugacaguagcuaccugcuuuucuguagaugcucuuuaacuccuuucucuucagguuauauggucuuaguucuucucuggauuuauguuuaugguuuucacauuguaccuuugcauauuagcuuuaaucuuaccuuguuuauuuugcaaauaauucaugaucaaauuuaggaaauuuguucugaccauugaacaucauagaaaaucaugugaaaacacacacacaaugucagaaauguuuguuuauuggguuuaagggaaagauuuuacuauuuugaaagguaauuauuuauuuauccuuaauauauuuuguagguguuguagugacuuuacuauuaauggggaauuuuaggaaaccucuagcucuugugaaaacauucaaaaugauaucaauuuuaguuucuguccaagaagaaaaagaaaugacaaauauaucaaaaacugagcagggccaguugauagcgccucauacgccucugccugauuucuuccuuccuacccuuuaaacuuccuacccuacguuaaacugaaggacagcaucagggcagggcuguagucacugcuguuccuuuggaauuacacgacuguaaaaaguaucuggcaaguuuccuguucagucucugcaacccucuuaaucccuucuuugaugaaacugaucugcccacauuuaugaguuuuucacaguuuggcuuguguuauacuccauaugggaauuuggcagaggaucuuugcucuaucccucauccuuuucagccauaaaucauaugaaaguaauaaugaugucuucaggaggacagaaacggugauggcugggauuuccaaaguggaaagcaugcucuguccuucugccccccacacauguguuucugcauugugguccuacgugugguagugugguuaugugaaaaugccuaaaauauucaagaaugauaugaaaaacuaagucaaccuguugguccauaauuacucauuaacagucaguuaggaaacuacagacuaauggugugccaggaaagucagaaaaugcuucagggucagucuggucuccauuguuagcaaauccaagugcuccuuuaaauaaaugagauauuucuuuggcucuuugcauuuguucauuugcccacuuaucugauuccggauggacuuggugcuguaggauugcacuguuaucagguucaucaucaguucuguggguccagucaccauuaggcuuucauuuccucgucccccuguacuccuuuuauuugauucagacuuguauuauaaggucagacuaaaauaagagucagcuuucuggguccaguuagauuuggguuauuugaaucauaauuggucaggcacacaggagacaggaauugugaaugaaucaucuuucucccuuuguucccugucaaacuuacugcagcacacaacuuuggugaaagucuauggugauccuucucugagagauggaugucugucugccugauggcagaaauaaguccacaguggcugguaaagcccccaaagaagucauugcgagcuucuugaugucaaaugugugucugcucauuaaaaauauuuuguguaauuuuccagggauggaacuguagaaucuacugacaaucuagucacaacuuuuggaacaauucuguuggacucuuacagucauguuuuauucauuuguagccaaacucugagcaaugugcaguuucuuagcuuuuaauccuauuuacagggacaugaauagaagcuuaaguuuaagagagauuuaaugaaauauagacuugugcguguaaucuguucauuuuauuuuacuguuuauaacauuuauuuauuuaccuacuugcauuggaguguccaugccauggcaugcacauagaguucaggggacagcuuuguugugguuggucuuuuccaucuaucaaguguguuccagagauugcuucuaggcugucaggaaugguaaugccugccuuuaucugcugggucuucuugauggucucugauugguuuuuauauaagaaauaugucuugggucaugguccaaccauuugaaagacacuguaguucaaacuuuguuguguuaaacauuuguuaggcaucaaaggaaagcauaccucuaaaagauuauaaauccauuuauaaaaccagggcaaaaggaguuaauuuaaccaugagcagcaaaagucuuuaaacuguuaagcaggagcugaaagacagccacucaguaaauauaccacagcugccugucuuucgagccaggcagcuuuucuucaggccugcccaggguagucaugcgccuccauuuguauaaaaccaucucuaguucccaggaugauagcgauugcaguuugaugcucacaguuaugagugccagcuagaauuuuaaauaauaguguccauugugagugccaggcaguauucuaaauaauaguguccagcaggcgcugaucaucagcuggggcuugcuguucuucaguggguggagaaauaacaaugugcagccugcuuuucaauuaacuaucuucaugauggcggcauaugugccaaaauuuguacaugcuaucaauguauauugugaucuuuuaauuccgcaaacacagaaacaaucaccacaguuaaucuaaucaacauaucugucaccugacauaacauaucgaucuccuaacaugguuuucuauuucuaucucauguagcaagaauauguaggauauacuuuuaugcuuuuauauauucucacuacaagacaaaaaggacaauauacaugagaugaugguauguuaauaaaucgcccuuuccauaugccaaaguauucucucauguuaaaugcaaagaauuaauuuuuaugaaagagaauuaaaaguuacaaaucuauucuuuuaucaauuuuaaguauauacaguucaguauugcaggcagcuuacugucuguuuccaggauuuacucauugguaucggaacugugcaucuuuuuaucaccaucaccccacuuuccuuccuuuauugccguuucuuccagccacacuccugucaaccaccauguucucucugcuuuaugaguuugauauuuuuauauucugcacaguaauucuuuuccauggcuuauuuaauuuagaauaauguuccaaucuuucugaacuuuuuccuuacucugaugacuauuuggaucacagcacacugggaagucagugaugcccuuuuauucuuggacuuuaauugagaaacucuuccucaucuuuucucauuugugugacuaaguuugugaccuaaccuuuccacaaccacaagagagaaauaguggggaaaaaaggagagaaggacgugguuucuuuuguuguaaaacuuuaaacuuuccuugucacuuuuucaucuuuaguagaaaugagaauagauccugaaaucauucgugaauguuugguaauacagcauagguuguauuuacccuccccacucccaagaauaaaaccacacacacacacacacacacacacacacacacacacacacacacacagagucuccaagucuuuuccuagcugauaaccuucuggguucuugccaacuaauuauaauauauaguauauauuuuucuaaaaaauaguuaguuacuguaggugaaggucugcaaucuuuauaacccaaauagaucuuguuggcagaguuaaaaucuaucuuauucuuuauguaaaauccuugacauacccuuggccccagucuguaaagaguuuguguauagaaaacuaaagaugagcaggugagugucuuagcuuggcugcucaauucuaugacauucuggaugggugccuccuguauggccuacucuuuucugaguggagucaacugugaacuuguaggcauaacucuaguuucaguguauuuccuaaggaggaggagggagaggaagaagaggagaaggaggaagaagcccuuuaaagaagccaguaggccuggcuguucaaguuuagucaacagaccuuguagacaucuagguaguuaaaacauacuauuacaguuucagguuucucauauagcucacaagguuagcaugcccuuaugagagacuaggguauguguagcagacucuuccuuucuucuuuuuucuguuccucuacacucauucuaucuuuaauuaguuuuaauauuuuucuuauuuuuauuuuuucuuuguccuugagaauuuccuauaauguacuuuuaucauauuuucccccuuacccagaauauccuaaauccacucccacucuucccuacacucaacuuuguguccuuucacuuucuguaaaccaucaaguaugauuuauuacucccuauagguucuuggaugcauggccuuccacuggagugcuggugacuuaccaggggucacacacuguccuccugcuaucaccuaccaguaacgccuuagcuagguggggcuucaugguuaccuccucucuccaugcugugauuuuugucuggcuugaacuugugcagaucuuauacaaacuuucauaaccgugauuccagaugugcagcucugcugcuacaucuggaaaacaauuuccuugucgucauugucuacugccucuggcucuuacagucuuuccacugcuucugcaguggucccugaacuuuggaaggcaaaaguaugauauagauuuaauguucuuguaugguauaugucccaaagguaaaauaccaucugcaguaaguacuguuauuaagaggcaauacagacuauugaaagucaaaguuauaaauuuuagcuguaaauugccuugaugaaaauuuuauucuguuacaauuaaauuaaucuuugaucuauguggcuagacuuauacaaauuuuguauuuuacuggauauagucccacccaccugaggaauuuuugagaauucuaaauggauaguguagauaguauagcacgucuuuucuacaucuguaaugaaagauuggacuugguccauaaaaaugugucuaaaaagauaauucaugcuguuuauucaggacaacuucaucuauuacauuagcagauguugaugacaucagugccuuggcaccuggagaaagaauaucauguagcucaaggaucaauuauuaaaucaguaaaaauuuuaauggcauaaugccuuuuuagaagcuuccaucugauacuuggaaagaguaucaugaacacaagccuucuaucuacaagaugugagcacuuaacccucauuucuugugugacuuggcgucuuccugucaagucagcacaggacucacugcugguguuuguaacaauagagaugguaaagguauuuaccugccuggcuauguccuucuacuacaagccaaucugggauuauuuuugucugagauacugaaaaaaauuauaaaugauugaauauaggcuuuuuggaaaacuaaagaaauuaucuggucaaauuuguaaggucuuaaacaaaguagcucuuguaguauaauaaaagucuauucacugaguaaaguucaaauaacaaagaaagagccaagaaagcaaacaugcuguccaguucucccacuuuccuauggagccucuccucagcagauuguuuuuagacuagcuugccagauucuguugugugugaguaaauguauauggcaaaaugguuuucuauacacagugugacacucuaaaacuuauaaaagacuuuccuuguuaaauaaaguaaacaaaugaauguaaauguaauuauaaugucuaguaugcuuuaauuaacccauuuucuaucuuuucuauaauuauucaugaguuuucuuuugucuucauuucguucuuaaaccuuucauaugcauuuuguaaaggaagucugucagaccaggggugugcacauuugcagucucaggagugugccgaaaugccacccagaaaguuuauguuccuggacacaguaugcuaucuugccuuccucuuccuucucuagcuaacacugaauaauacauauuuucuuuucgugggacagucucauggguaagagauuaaagacaaauucuuugaauuugucauuaauuagauauuaaugccauacgcagcacugauaccuuauaauauucauucaguauacuguacuccaggcuucaauuguuuuacuaauuauggugucuuuaaaagggacuugaaccucaugugucauacccaagcuuguucucccuugacuugccaugccacuggucugcaggccaugauugcuucuuuccuagcucacacuauagaugcaagccggugcgcaagaccuggauuuuucccugugggacaccaguuguccuaguacuucuuuucuccaagaaagccucugcagccucuaaccucuugccugguguauuucuacagcuucucaaaucaacacagucuuagacaggcuacucacuugccaaaaaccauaucucagaauaauugacaacacuuaaggccacccuggacuucaugauuaugucuucuccuuugcuucucccaugccuguauguucaucuucccacuucucuguucauuuauaucuuuccaaccacaugggcugaagcauagcugucuuaucaugguuaggugugauugcugcgaacuugaagcagagcagcuauuaacacauauauguaacccuaagugugcaagacuuuccuucuuaaauaaaggaaaggaaacaaaugaauguaacugcacuuauaacucuaggaugcuuuaauuaacccauuuucucucuuuuuuauaauuauucaagaguuuucuuuccguucuuaaaccuuucagguguauuuuauaaaggaaauuggucagaguagggguacacauucucuuagucgaggccuucaguggguucucugagagugcccugaaauuccagucacugcuaaguaagagacaaacagccuucuugguaggaucuauaguuaguguugccuccucaagucauccagaggacucaggaggcguaugccugaggugccugugcugcugcaagccaccccaguaucucacagagucaccaagcagcacuuagaccaaaaccuuucucuguucugcuauuacccucucugaggagcaucaguaacuucuauauggccuuaggaaaaaauaaagcaaucuggccuuuuauccugaucucugacuuugucacccuggcuucuguccauuguucccucagaacagcaggcuucucucagaugucaccucagcuagaauucuuuaaucuauucuccgcagcacucugcuccuucucauuuuucuccacagcucauaucacuuccuaauguagaaugugugucuaucauacacacaggauaauaucccugugagguuuuuacauuugugguuuuucuuccugaguccuuacaaucugacauaggauugacccauaaaagcaaaauguauucuguagaccugacacaaaaaacccugucagaugaaauugacagaggucucuuccauuaguuuucuuuuggcauuuuccauguuuaaaauuaacuuuauauuagcuauguuaaacuguuauuugaugucacaaauauauucuuuggugauuagaaaacauuuugucuuuauaguugucuuaguuagacuuuccauugcugugaagagacgccaugaccaaggcaacucuuacaaaggacaacauuuaauuggggcuuacaguuucagaggcucaguccauuaucaucauagcaggaagcauggcagccuucaggcagauauguugcuggagaagaagcugagaguucuacaucuugaaccaaaugcaggcagaaggggaccgucuuccauaggcagccaggaggagguucucuucagcacugggcagagcuggagcacuaggagaccucaaagcccaucuacacagugacacacuuccuccaacaaagccacaccuaauccaacaagaccucaccuccaacagugcaacuucccaaaggccaagcguauucaaaccaccacaacaauuuaaaaauuuuuuaaaaaucugaauaucuagucuuuuauuauacuuagaaaacuuuuuccacucaaaaauuguuuaaaaauuacucacauuuucuuuuaugacauuucauguuuuauucuucacuuaaaaaaaauagcugaagccagauguggugguguguuucuagacucagcauuugugagguuuguauacaaaggccugauagaagcucaaggucaaccugagcugcacagcaagauugucucagagaagcaagauauggauaaauaaauacuaaauucauauagcuucucuccuauuguaggaagugauggcccaacuuuaguugcaucagaauuucaguaaacacugcaugcuucugucagccaguuuagaaugcccuguucauaaugauauuugauguuauauaaugaaagaaauguucuccuauucuguuuuuauucaucuagaaugccuguggccaaauagcauacuuaaauaugucagauucauccugacuuuuaauaucuguuucccuuaccuuuuagguuuugacaauggaagagucauaauauucaugucauagcauaguucuccaugaagcuccuugcucuugaauauugaaaugcucauaaaauugugaaauccuauucaguaugauaugaaaaaagagauauccuuuaguagcccugucauaaaacccaucauucgugugugugugugugugcacgcacacacacacacacacacacacacacacacacaaacaucuuauuuucuuguaaugaaagaauacuguucaaauucugagaguuuucaaaacgguuuguaauccuuauuaaauuuugcuaucugggguuggagagauggcucagcaguuaaaagaacuuuuuauuccugcaggcaagaccuagguucguuuugcagaaccuacaugguaguucauaaccaucugcaacuccaguugcaggagaucugaucucugcaggcaucagggagcacagguaguacacauacaggcagaacacagauacacauaaaauaugaaaacccaaaauaaaugcuuaaaucuugccauccacaggauagaauaagaguuuauucacaguuucuuuuccaaaguggcuucaacuucugugugaucauuucagaguaugucuguuugucgcguaccauagacauuaauaacacccacaucuuuggcaagucuucauuuuuuuucaucuuaaaauggugacaguaauagcauuuuaaucaagagcuuggcucuuggaauucaucagucacuguauggagcauggcacuugauauaaaucaaguguuuagcaaaugcuaccucaggcuaaccauaugaauccauacucuguuguaauuuaagugcaaagcagcccugaagauucaaaucacuuucagugccucagugaaguuuuagggaaaggcagagagccugccacuuugaacuguuucccuugccugacaggaauuugaucaagccuggcaaggacuauguaguguuaaguauuuuagacaaacuauauaccauguugguguacaaaguagaucuggaaaagucuccaugguguuuaguuuagcaauuugauauaguaaauuucuaaugaauccaaggauuuacgagaacaaauauuuucccugugaaugauugcaguuaugcuccuucucaguagcagggaauuauggggagaagcagugugccaucugcuuucugcagugaugagcucaguccccccuuucucacucaguaucuuccuucugcagacccacuccgaggagagaccuuuccagugugaugcauguaaagccuuguuccgcacgcccuuuucucugcagagacaccuguuaauccacaacaguaagucacagccaaagacagcugaggaccgagagaguuaucgccaguguguucuuagaugcuuuaagaauagacauaucagaagugcauggugaauuguuagauaaucuguuuaaaacauaaagaagauagauuggcuuguuuuccuacaguaccauuaagcaguuuaugagauauauuuuacaucuucucuuuccagcauuuguaauuaguauauuaaaagauacccuauguucaguaugcuuugaacauuguuuugaaacaucaccuuccauucacuuuuaacuaugaugauuaagggaacaugucuaccucuguaaaacauggcucuaucucccaggucagaguuuuauuagcucaaagguuuuaacaguagcggugagucagaaugcacaucuaauucaacgucuuuuuaaagagaaauugaaaauauuaagucugacaggagaauaauuauuuaaguaguggaucccauacugccuccaggugucuaauuggcaggcagcauucccauuuuauguaaaauuuuugauucucugcuuauuuggggagguaaacuuuuuauuauguuacaaacagacaucuaccuuuugagaaauuguaaauguaaagccccugcugccauuggaauauuacauuccaaaucccagacacugugacgguuggauguacaggguggugacuuagaagagaguuucucuguucaaacuagguuucuaauaugaaaacguaagaucguaauguuuauacauguugguggugaugcugagaaagggagcugccuccuguaugaaaagaugggguuuauucccagugcaggucagucacugcagcucuggaaaguguucggccuaacuuuccacuuccuuauaaagaacaacuugguaacuaaagagugaaauuuguuguaccacaagggggacuuauuauauuagacagcuuaagacauggaugaauuuuagaguaggcauuuauauaggugaucuccauucauccucuuaagccuuauguggcuuacuucgucaagcucagaaaauuuuuucuugggaaaaauacaauuuuauuucacaugacagcaaggaauuuguaacaucagggaucugauacuuucaaugucagcuacuugguucucagcagcugaaaguaaggacugaaguggcguauaggcuguguugugugcucuguggcuaaaaugaugcugagcaacacuagaagcuuucugaagcuauagugugguaucuggccagaaaagucaaccuccaaaauuuaaggacuaaguaagcaacguaaggugcagacaggcauaaaugaagacccgugggugaauuuagcagggaaaccagauuggcuaaagcacagagagcaaagaacuaggucuuguuucauacagugcuaacauuacagcuaguuaaacuucaagauaugaaggcuauuauuacaaacacacaucuuuuccauggagugaaaugucagcaauuugucggcuucuuuccuuguacaaugacaaaccaaggcaggucuuuggcuagcuucuaaguauuaagguugaaaaaguucugaugaaguuaagacagaaugugauagaagcaacaucagaauuaggaaauucuggucuuugcccaaucuacuuucgagaaugaugaccauucucagcagccagacuggucaacauuccagaaaaugucaacaucacucugaaggggcacauaguccuugugaagggccccaggggaucucgguggagggacuucaaucacaugaaugcggagcugagucuucuuggaaagaaaaagaaaaggcuccagguugacaaauggugggguaacagaaaggaucuggccaaugucagauccaacugcugucauguucagaacaugaucaaggguauuacacugggcuucuauuacaagacaaggucuguguaugcucccuuccccaucaacauccuuauucaggagaaugggucuuugguugaauccgaaauuucuuggguaagaaauacaucugcagguuucggaugaggacagguguugcuuauucugucucucaagcccaaaaggaugaauuaauccuugaaggaaaugauagugaacuuguuucaaauucagcagcucuuauucugcaagccacaauaguuaaaaaaaagcauaucagaaaguuuugugucugagaagggaaccgugcagcaggcugacaagugagaaagccuccguuuccuagcucaagaaacaagauccugaucacaaguaaaaugugggaucuuugaggacaauaaaggacuuauauauugaaagaaaaaggaauuaggaaauucugguauuuuaggacaacgaaacaugaaauccaguggugugacuugacuguugacuuguauucuaaggugagaggacuuuuaagugucaccacugugaugccacauuuaaaaggaaggauacauuaaacguucauguccaggugguccaugaaagacacaagaaguaccgaugugagcugugcaauaaggccuuugucacaccuucagugcuuaggagucauaagaagguaaguggggacuucagccagacagacugcauugugggcuuauauacugacuaucaugugacaguuuauauuaauuuaugacaugcuuuacggacaaugaaaaauaugggucauacugacuauccaagaaauggccuuuuucccuguuuuuuagaaaagacauuuuucccaucaaaugaaaugucaacguuaccuguauaguuuguguauaccuuagcuuuacugauagguagacuugggaaauacucaguaagacugucaaauuucaaaaauuuucgcuuaauagggaugguuucuugugaguaugaguagcaccucagguagguuguuccagggcccagaggagucccugcuguagagcugggcuuugacagauaaugguucaguuuacaugaaauaguuucauuugugaucuugagauuaucuuuuucuauugugcuuguuauaucaugcaucaagcaaauugaguuuacuuuuguauuucauaaauaaauuuacagcauuacaauaaaugcauuuuaaaucucuuuaaaauggcaaaguuuuaagauagacagcuaaagauuccaaaguggugaaagcaagugggaccuaaaaccuguucacgucacuguggacagaaaaaaggaagguaaaauacaugaagagccugggcaagauacauuccuaaggacaaacccccuagugucacucuugugcaaggccccaccuccuaccuuuccccacuaauaaggccgucagauuugaauccauuacuggauugugucaaaggauucaugaucugacugucuggaaaugccauacauacauccaaugaggucuuuaucacuaauucccuaggcaacucuuuccccauagcaguuucccuucccucuucuccuccuagucccucccagccaccucucccucccuacccacuccucuguuucccuucagaaaagggcagaccucucaggaacuuuaaccuaaaguggcagcauugucaaguuacuguaagacuaggcaccucccccauaucaaggcuggaugaggcagcccagcaaggguccccaagacagguacaagugucagaaauagcccucuuaagcacccacacccuuucucuguuaggagucucucaagauaccaagcuauuuaacuauacuggagaagaccuagaacagagcuaggcaaguucccugacggaucagucucugugagccacugugagcugacuuguugauucugugguuucuguuccuauggucccucuucugcuucuccugcagcauucacugaguuccuaagaaacucuuaaaacaacuaaucgauggucauaaucagcuaguaucagacaccaccugcuuuuuauuaauuuugggguuauuauuggaaaacauucucaaagcaaccuuauaaagaacauggagaaacuuuucccugcugguccccugcaacagugcucaguccccaacuuuccucuuaguucuaaauuucagugucccucauacuucacagcuugcuuuggcuccucauucacuggaaugauggauuugguuuuguuuuuuuuuuuuuuuuuuuuuuuuugcuuuguuuguguugguggaaaaauuagucuccuguugagucucugaggccuuaaccuacucugucuaccccaccuucuagaguugucagcaguuuuguuuugcaguuucauuaguuuguuuauuuaguggcuauagaacccagagccucccgcgugguaggcaagcaucuuagcacugggguguguguauucccaguccuagucacugaugucauuaaagugcauuuuacugguguucuuucuuuuucugguaugauuauuuuaugccugcaaaauaaauauguggagggcagaaauucucuuuccaacagaauguucaauuaacaccugcuggaucucaaagucaaccuagauguauaugcuuccuguuuuguuguaaaaucuauucugacaagcacugcauagguaacagaugacuuucuugagauuaauucugcccuuuagagugaaauaugcacaaagaauuuggaaaaagauucaaaggaaaugucucuuggcaacagucaagggcagcucuggccccauuuugauuaugugguuuugcuccaugcacugguuuuauauaacuuaaucauguuuagucagacaaggacuacauaaaggcuuaagcaguagacggcagaauuauuuucaaauuaacacuaaugcaugcuucuaagcaaucuuugaacccaugggauuauccaugauaaauuguuuaaagucacauugugacauuaaaucauuuuaaugaaacauaauccuggaaaauacagauucacuguugucagagguaguuuaucaucuuuaccaaagccuuuguauuuaucaugaaccauuuuuauuccuguuuagacacacacaggagaaaaggagaaagucugcccauauuguggccagaaauuugccagcagugggacccugagaguucacauccggagccacacagguaugaaaagugaccuugggugaaagacuggaagucacuguuaggacagagucuacuguccaaagaguuuccaaaccagugagccuucuuaggaggauugucaaaaccaguucuuuacuuaagaagacuuucagaugcacaauuuacuccaaaacugaauaaaauacuuggguguaaagacuuuacuuuucauuugaaauaugagugugauauacagaauuuggcuggacagagcagguccacugccucacuucucauggagacagaggcauccuuuccacccaccuguagcuuacgccaaagcugccuuucuuaauuucaaaacucccugcccuucugaucacuucugucauguuuuaccucaccuaguaugaggagacugcgauaccuacugauucuuaggggccuacacucuacucuuuuacuuuuccaaugcacuuucuucaaugaaagagaaugugaccacuggaccauggugaauagcuaaauauucuugagagaaacuugacugcaguuucucaauugaguaaacaaaaugauuuuuauacucuuauugcuuucaaaauaguuuuacacuugugugaauuaucuucccacuaagcaaaaugcauuuaauugaauuuuguagcugaagcuuucugcucaaaggucauagaauggauuaaaaacugucuagaguagucacuauuuuguggaugaagaaauauuaguuugagcagaugaaagaauugacacugugacuuuaggaauacauugaggacauuagagcauaauuugaaaauuuuguggacaaagcuaaaagacuugcaucuaauuuagaaccuuagaauaguaacucgcaacuuguaagugacacacauaaccaguaacaaaccaagcacgguguguaaacacuauggauaccugaaagcuaucuagagaaagcaagacuuuuaggacaaaguucaagauggaucaaacaauuagaagauggcaaaaagcuaagagaagccaaagagaaagagcagaagagagccacugggggacaggugucauaaugcaaagugccugcagcugucugcacugugucacuggccucugauagcaaggcauggacagcucuaguggggagcauggauguucuuggccaucucucucuacuguguaacuggggccauguggaguugggucugcugacggcagcaaugaaaacaaugucuucucugugccagucauccuuagacauugcugugccacucugaggaaauuguucuagcuuuaugucugcauagauguaucccuguguuauuuguagauagaaggagagcaggacguuuguagagaaagugaguuauguuugcauaucagaguaauauaccuacaguaaaugaucucaaagucaugcugugugacugaaucaagcuuggugccauguguuuaaaaguagagacuugggcuggugagauggcucaguggguaagagcacugacugcuuuucugaagguccugaguucaaaucccagcaaccacaugguggcucacaaccacccauaaugagauccugaugcccucuucuggugugucugaagauagcuacaguguacuuguauauaauaauaaaaaauaaaucuuaaaaaaacaaaaaguagagauuuauauaguucagaagacauuaaggcauagguuccagcacagaaaauauagaccuugaauauucauaaugacuccauccuugugaacucaugcacuuucaucugacuuuacuuguaggaagagugaacagcagagaagcacaaacgacuaauguuacucauuacuuugaauguuugagguauuaugucaugcuuguccuauugucuaauauaauucaauacagauaguauguaguauaaauauauaaaaugauauauaaaugcaaauuuauauuuauguaauauauuacauauaaauauauaaaauauauaauauauuauauaaguauuuauaaauauguauaguaugcauuauauguaaauaaauauauuaaauacauacaaauuaguaaauauacaaauaaauaauaaauauuucuuauuuauaaauaaacauguuuauauaaagagauauauuuaaauauauagugaaagaauauucuaaaauuuccaguuauucuacauuguugcaguuuaccauauaucugacucugggccaaauugaggcauagugagccaaugcauuuuuguagauagauuuuucuuuuuagacacauucagggcaaggaaaaggaguagaguuaaguguguauuugugcaaauaauuguauaacugcuuauuuguguuguucuuuucuuaucaccauguuuuucuguuuaaacucagaccccuuucagagucccaguuuccaacccugcuuugucuacuuugaaagacaagugucuuuagagauaaccuccugcaguguggcuggugcaguguggcagagcugaggaugucuggcugcuggcugguugcugcagcagcaaucuugagauggguuucucuuccaugugugaauaaacaggguuuugucucauccucagaagaugagcauccacuuaccccuaagggcuaacaccaggcucacugacuucuguggcuacuuugugcucagucagaggagcagcugagcuucuacuguuugugguuuugcuauaugacuuuucucuuugaguucauuuuuauuuuccucugugaaaugguaugaguucacuccucucuuuuuuauguuguuuugcaauuucugguugccuuugagcuugccugcugccaagaguuccauguuguuuaugggcuguucagugaaacaacaguaccccaagggacauggauccugaucacagugggcacccacacaguucuguggguguggugcuuggcuaggcacacacugggcacacacugcugccucaauaccuuaugcuugacaguucaggagggccccagggagcucuucuuucucucuacagcuguugacuucauuagcaauguaagcaaugcgccuuauuagaaaauguaaaaauauucauuuugcugaaauaugccauaggaaguucauuccagguuggcaugcuuuuauagaaaguaacuauguuuuccaaccacaagccaucagugaaaaugaagacguugucugacuugacugucugguuuuugaggagacagcuacauuuucauaucuguuucuucacucauccugugauguguaguuggaguugcagaauaugcagcaauccuccagaguauuuuaauaaucuugaucaaauaauuugggauauuauuugcuccuagacugaaaaccaagaaucagacuuugagcaaaggauugcuguugugugcaaccugaaaauacuucagugacccuuuucuguucuaucacuuuaaaauccaucacucuguguuguguuuggcaugaaccuuucacgcaugaaggauucuguaacaggaugcacaggucauacgggaaccaucuuuuugaggccugcagaucuccacauuuguuaaugccacccagagcucaucagcauacccauucagaaguccccuuucuugccuguuucccuucugaaauuuuguaagaaauauugcuugcuacacugucauuucugccuccuuucuuuccuuguguauuaaaaaauauucuccaaauagccauucucaaugcacacucuuguggucaguccuuuugcuuuauauaagcauaauguuccaugacaaaagcuggaagcucaguucuaccgaacaggggcuuucugagacuacuaucaugugcauugcuagagcucccccauccaauucccauauuaaaaagaugauacucaaugguuagguuuagguuuaauacaaucagucauuuuguauuccagggaacauauucccaaguggaaacagcauuuauuucuagugcguauagcuguggugaauguaguggcuuguguagaguuugagaacguugcucagaucuauagcacuagauuagcaguuuccccauggugacauugcaccauucauguaaaugucaacgugguccaaaggaagauuauacaguagcuuuagaaagagaguguuccugaccuccuauggaauagucuuagagaucccugggaauggacaugcccccaguuugacauuuuggaaacaguggcucuuccugacauggaagccugugccacucguuucugagggauguugauguuaggcuuuucauuuaucccacuagccauccuucuguuuacccaggagucgagacucucauuuaagacauugugggcugccauuuuggggggcccacuuuggaccuaacaguuaccauaagcauugucuugaauauucuauugccauacuggcaccaaaauuaagauuccuuucccaaagucaaaugaguuuuauucaucgaauauuagguugaaugauaucuuacuuaucauuuuauuuaguaucuguuuauagcaguuuacgagaauuuucuaaaaauaaagaauuuucaagcucauauaauuucuuccaauuuuaucaaaaucugaaauuuggcauauauuaggauucuccauaaacaucuuuguugaaugcugauaaaaaauuaguuugauaucauacuuaaauaauuaaaauuucucuguguuaacuuuaacaaaaugcauuuuaaauggcuauauuccugauuaagacuuuuaaacgaauguuuagacaauucaguuuaaaaacugugcuuugaauccugaauugugggugcugacucuucccugacauuaaaucauggaaaccuccaaaauacuuuuaaaauguaguuuguuuaggaaucuguagguucuugccaccuugaaaucacgucuaacugauaucucauucaaguauucuugagaacacuccuugacaaugugaaagaaaacaaaaacaaacaaaaccuuaggaguaguuauugaguaaagagaagccgggcgugguggugcacgccuuuaaucccagcacucgggaggcagaggcaggcagauuucugaguucaaggccagccuggucuacaaagugaguuccaggacagccagggcuacacagagaaacccugucuugaaaaacaaacaaacaaaaaacaaaacaaaacaaaacaaacaaacaaacagacaaacaaaaagagaaagaccuucuuuguucagagauaugacaagaguuaggaagcacugggcuugcuguucuaauccagucccucuccuauacccacguccuuugcuuuccccuucauuaucauucccauugcuuuauccuguaguuggugggaaacagacucuagaacaaugagggagcacaugguugaagauccagcucaccaguauccacagguuuuggcuaacuauucccaaacuuacuguaacugauucuggcuaggacuguuuaguuuaaaguuuuucuuuuauguuuuuguuuuucuuauuagaagaaugguagagaaucuugauacucacagguguuccauuuacuguuaaucuugaacuuagcauauauucuacuuggugauauuuucuucuuaauauaucaguuguuugagaauagugaucauaaauggaaaugugcaggucugcauucugucaccuguggcuaaacaacucccuguaugaaaagccuuucccacuuaaaucagauauaauaucugguucauacccagaguaugggucacugagguaggagaccucaagaucaauuuaauugcucgucuguggcccuuuaacaagcugccaucccccuaaaucauuaucuccacugaaacacugggugugaucaggcagugugauggugauguuuguuguuugguauuucugcaggcauuuacucacaggagcuccaacccgauggugcccucuccgccccuccauucccaagucaucuuccuuauuuagccauucguggucauugaagauacagagaauguauaggcuacagacuggguuugcugucaaauggguguuggccugggaugauugaaaagccacacucacuguaagugaaggcgagccuuuagcucugcauuuggugggcagcucuguaauuuaucauccaguuuccuaugaggggaccauagagaugauacucugcaggucagcaggaaugguggagcccuuucuccaguaaguuucuugcuucucagggucagugaaagcugaagcccauucagcaagggaauccacagacugacauaaauuccauuaguucauaaauuagaaaagagauuuuaggaguuucuuuugguuuuuaaagcuuuaggccaggagguuaauuaugugccuagaguuaacuuucuggguuaauagagagcggcuguguuggacauucuggcucuggcugugugcacacuguuauuugagugugguaauaaaucacugucuucggaagaacuuuuuuuuuucuuucaguaaauaccugugaucagcuuagaauuaaaggauuguuguauuguuguuggauuaugccugguauccucacacuguuuuucucucuuccuuaauaccucucuaaagaaauuaauucauuguguuuaaaauguuugcucaaauauuauaaaaccaguagcuauguauaguuauaaauaauauaagggaauaaugaacaaaugacaaacacaugaaacuuagacuugucuuuuaugucuuuguagguaguaaaugaccuuaucugcugagaaggcuuuuguucagcuuugguuuccuaagugauuccuuauugacucgggcccagucagagguugacuccauuuuuacuuucauuaauaaugucuuuaucuauauugucacuuaaagacuuuuaaagacccuaauuuuuuaaaaauguauuuauguauguaugugugugugcgcguguguguguguguguguguguguguaucagucugugucuguaucugaguguauuuccaugccucugcauucacagaggucagaagagaguuccaagauccucugagauggaguuagaggauucagaaggugucagcuuauuauuuggucaccgggaagugaacucuaguugucaugauuaugugauaagugcucucaagcacugagaugacucucuaaccccaagacccuaacuuuuuuguugaauuucuuuuuaguauuauuuuuuuaauuagguauuuuccucauuuacauuuccaaugcuaucccaaaagucccccauacccuccccagacccuaacuuuuaagguccacuauuagcccuuauuaaaucaagauuuaguacaggcuagaaaaaaagagacacaaugagauuaauggagugaccuuugucuaguauguaguguuaugaauuaccaccaaguaaguuaguaauaguuacagagacucaauuagguggaucaacuacaguauucuaccaaucauguaaguuuuauuuccaucaccucuuccucuuuuuccuuuccuuucuuuaugcagauaccccgaaaacuggcaguaucuuaggccacaauguuugaucagcacugucacagagcuucaucuauuuuuuuaucacuagauaauaucagggcuggagagaugguucagcuauugaaguccaggcucacaaccagaauauaagauaaugucaggacugugccuguacuucacuuaauuuguuaacaucacuuuuggcuagggugaaaaugguuguccuagaguuucauguguguuguaaguguacauccccgcugagcuacacaccccagugcucucuccucauggcuuucagugaggcugauuucuuuaaugcuuucucugccauucuuacaaucaucccuuaagaaccauuccccauauuguuuccugcaguuccuguccucuguuucagggaucagggagguguuauacagauuuauaggagagaugaauucugaguuucuuacuguuugaaagugauaugcuuguaauucuuccuugcugguacuauuuguaaaagguccucuguguguaggcaucugagauguaacugcuauucaaucuaucacugcuguggugcucaucagaaccauuuuaaagaaaacugguugaaauuuuccgaaauggaaaacuacuaggugaaaagauuaaugauuuccaugccaauagcgauuucuagaaauaaaacuaaaccaggaaccagggacacuacucuacauucauugccccucacuggagccguguggaacugugacagcucagaacauuucagacuuuggcacuugcugugcaguucucuguugugaagcagucccugagcacucaugccgggacugcauuaagacauuuuguucccuccagaccaauccagaugggucauguauauagaagcuuggagagauccagagcaugcugaauggaaauggucacgucuccuccuuaccuaauguuaguuagcaucauucauuagcuccuccuccuccuucuuucccucauccuagucuuuuuuauuuuacauuugcuaccuccuuguauugcugguguugguuuuguaagucaguaacuuugagguuuugauccacuucuuuacuauuacgacuucagaguggaaaguuagaguuucuucucccuguuuuccagugaaucccacuugcuucaauaacaaggaugauucagcuucuagaagauucuguaaaacaaaacacaucuucuaaggaagaaagugcaggaauuuuauuuuauuuuauuuuauuuuauuuuauuuuuguuaugacaaagaucuauuuggcuuuauuggugugguauaugacuuuuaugugcugaaggucauauuugguguuaacauuuuauugcccaauuuaguaacagugucuuuguaaccaucuaaggaguaaaugucacagagccacacugucuuuccuucagaugugucuguccauugacuuguuagauccagcauucuagcagauuugauuaauggagucauucuaagauuaacaaggugggacucagcaagggcaguggguuuccugauucuucgcugaaggauaagaaaguuuuucaguucacaggaggugccaagaaugaacuccagcagcuccgacuugucaggguagcauuucaucucgcagcucugcucaucuaauuuauuaguuauuccauagauauaacauuaaaugcuagaguugaaaaaaugauuggguagugcuuccaaaauuauauauauauauauuggcuuuaacacucuuugggaaugauucaguguguguuuuauaaccauuuccuucuucaaaaguaaaaugaucccaugugccgauccuuguggaagacgaaugugaaguucuuauaaagcugugaugucacacagauuccaaacucacccauggggacccaucucaggggugauccccccacccccgaaccucucauaaccuugaaagguuuguuuuucacauagaaaguauuuccauguccaaaaacuauuuuuauuuuaaaaauccaaaugaaagguaaaacuguggcccaagaauauuuaugucucacuucacugaauucauucaauccuauuucaguugguuguuuugaaaacacaugacucugacuucauuguuuuagguuggcuuuucuuugugugcucacuuaucauuuuuuaaaaauacuuaggaguuauuaaauuuggcauagacuuuucuuuuuagcuauucugagugaccaaauacaggauuugaaauccuugaaaugaacuuccggaaaugauguaaucuuaccuuaugaaaaaauuucuucagacuuguauauauacacuguauaaguuuuaauagauuaguauagauaagugauauuauccaucuagcccucuguaguccauagucauuuuccagcaguuaucagcuuccuccuucgagcugcugcugcuucugcugccgcuauugcugcugcuguaguguggcacacuugcaacugaguuagaucucugauucugacaagcuacaugcucuacucauagccccagucacuccauugacugcagcgggcuguugaagguguuugccucuugggggacaaucuccacccuuaguuuacuuguuuugaaugaagaaaaagcccauagcauacuccggagggcauaauugccaaccccuuggacuagcuuaacuuauuuugccuauauuaauuuguuauuucuaacuuuuaugagcuuaggucacaaagcuuuccaaaaguuguguagcacagcauuuagauauuaacuguuuuuuacccuaggaaugcugaccugauagagauaguaccacaucagucuucaagugaccuggggagaccuguuccuuugccuugcucuucuucacugucuugauuacuucagcacuuuacaugcaugcuacuuuaaucauguagcucugccagaauuaaaaauuauguguauguauaugcaucauugcauaccuggugccugugacauucagaaguggaucucagauacucuggaacuggaguuucaaaugauugugaaccaccaugcuggugcugugagccaaauccaaguccucuggaagagcuacaguaauguuaaccucuaagccauugcuucuacccuuaacccuuuuguuuuuaucauuuauccgucauauaguuuuaauuuccugauaaauucaguuauuagcagaaaaagaugaaaaagcauuccuuaguaucaggaaaguaauaauugaaauaaauguacuuuucagaaucuacacauuagcuggguaucguaaugcaugccuauaauccuagcauauggcagaggcaggaggauugacugugaauuagaggcgagaguagucuauaauguaaguugcagacccucuauggucauagagugaaagugucuuaaaaacaaaagcuaaauccaccaaaaacuguuacauugcuuuuaagacuuuaugagaaagaaccugaaaucguuugaauuuuucugcugcaggaaugaauauguccacuagugugagugugugcucuuuucuccaguauaguuuuuauacuuguguggaugauuaugucaaaugcuuaacaacucgauagauggcagguucugcugcaccccaggcccugcugcagacucuacugcaaaucccaaucagugcacugccguuacuguccucaugucccaggcgcaucccggcgcucaggaagccacagucuuaggacuggagcaucccggcgcucaggaagccacagucuuaggacuggagcaucccggcgcucaggaagccacagucuuaugacaggagcaucccggcgcucaggaagccacagucuuaggacuggagcaucccggcgcucaggaagccacagucuuaggacuggagcaucccggcgcucaggaagccacagucuuaggacuggagcaucccggcgcucaggaagccacagucuuaugacaggagcaucccggcgcucaggaagccacagccuuaggacuggagcaucccggcgcucaggaagccacagccuuaggacuggagcaucccggcgcucaggaagccacagucuuaggacuggagcaucccggcgcucaggaagccacagucuuaugacaggagcaucccggcgcucaggaagccacagccuuaggacuggagcaucccggcgcucaggaagccacagccuuaggacuggagcaucccggcgcucaggaagccacagucuuaggacuggagcaucccggcgcucaggaagccacagccuuaggacuggagcaucccggcgcucaggaagccacagucuuaggacuggagcaucccggcgcucaggaagccacagucuuaggacugcagagacuggaucuuugcagaacagagucaaaaggacaguucuccaguuucuccuuaccaaaaaaauuguuguguuuguuuaaaccauuaauucucuuaugagacauacaaugauaauaguaauaacaauaaaauaauaaauaauuaucaagauaaaucaaaugaaccuaugacaucacuuagcuacacauauuuuuuguucacuuuuauggcaagaguaauucacagcuuauuuaggguuugcuguacaguacagauguaugggaguuuuguuguuugauaacugaauaaaucuacacagcuaaucaguacacuguaaucugagcacaugagaacagaagauaggaucauaaauuuagagugauaggugcagaauuugaguugcugugagacauaaaauguuagacagaugggcaucuguccaacaauagauauaagaagcacgaugagcacaugauuguuaucuuuuaaaaauuuuaucuauucucaaauauauuauuaaauccagaccacaguuguccucccuccuccuccuccuccucccacccccagucuacuccuccucuauuucucuucagaaaagaauaggccuccuagggauaucaaccaaacauggcaugucaaguugcaauaaaaauacuaaagcuagacaaggcaacccaauaggauaaaaagagucuucaaagcaggcaagagcaucagagacaguccccacucccacuguuagaaauccaacaagaauaccaauuacacaacuauaacauacaugcagagaaccuaggccagacccaugcagcgucccugauuguuggucagucucugugagcccagaugauccuagguuaguugagguuuugggcuuuguucugguacccuuggccccucuguccccuauaacccuuccucuccgucuuccucaggauucacugagcuccaucuaaugccuggcuguguaucucuguuuccaucaguugcuggguggauccucucugcugaugauuaugcuaacuccuguuuaugaguauaaaagaauaucauuacaaaucauuugguggggcauguuugauucuacccuaaaucuuuggaccccucaggcaguguuagaggugugcucccucuucuggcaugggucucaagcuggaccagucacugguuagccacucccauacuuucuguuccaacuuuaccugagcacaucauaaaggcaggacaaauuguagguccaagguuuugugguugcauugauaucacaugguaaccaggcauguccuuccccugggagacauaccugguuagcagagauggcuaguucagauccauuauucccuauuacuaggagucuuagcuagggucacuuucauauauuccugggaguuuccauugcuuaagguuucuaccucacccacaaaaugcuccaaaaauuccagaugucuuuuuuacuacucuucucccucuguucccccugccaugcagucucuccuguuccuucccuacucacuaucccauguggguuguagcaugauaauccuuuacuucauagcaaauacccgcuuauaagugacuacauaccauguuuuucuuucugggucuggauuaccucacucaagauuauuucuuuucucauuuuauccauuugccugcauuuuaacagcugagcaauaauauuccauuguguaaauguacuauauauucuuuauuuuuacuuuaguugagggacauuugguuguuuucaauuuuuggcuauuaugaauaaagcugcuaugaacauaguucauacccuuaugguaggaugacauguccuugagauauaugcucaggagugggucuugagguagaugaauucccaauuuccuauugauuuucaaaguggcuagacaaauuuucauucccaccauuaauggaggaguguuccccuugcuccacauucuugucaacuugaguugucacuaguguuuugaccuuagccauucugacagauauaugauggaauuucagaguuguuuugauuuucauuucccuguugguuaaggauguugacauuuuuucaaguacuucuuggucauuugagauuccuuuuuuugagaauucgauguuuagaucuguaccccauuggauuauuugguuugcugaugccuaguuucuucuuuauguacuucugaaauuagccuucguucagaacugaaguugaugaaaaucuuuucccacucugggggcugccguuuuguccuauugacaguguccuuugccuuacagaagguuuucaguuucaugaggucccauuuauuaauuguuaaucuuaaugccuguguuauugguguucuguccaggaaguugucuccugugccaauguauucaaagcuauuccccacuuacuuuucuaucaggcucaguguaauugguuuuuuguugaagaaugcaaauagauucuuaucuauuacccugcacaaaacucaaguccaauugaaucaaagaccugauugagucaacaugauuauaacuuaauguaaaaauuagaaguuauaauucuuuauuuugucaugcaaagccaaauguucuacagucauaauuauuacuucauguauucuagguauacuggcuaguguaaaaggucuauuucuuuuacagugguugguaaccuagaaaguucuuuaaagauaccuguucuugcuuuggcugauacugagauggcugcaacccuuuuaugguaccagucaaaccauacuuugaucuuuacuuugauccugucauucugagguuguaauuuaaccaaugccuaaggugaucuacuuaaaauggaaaaugcuccucugccggugcuuccagcacauggucauuccagguguaaguuagaucagucuugagucucaucucaugaaacagugaagagacuggggagaugaaguagagccucuucugggaaaaaggugagguugaacaacagagagcauguugcuguccgagugaggccauuggaauaaaucauacgaugcucaaguugaaucagaaaaagaggaggacucuuacauauaggccuggcccuguggcaaggaaagacagaauuuuguaguugcugaggacauuaaucuuuaaacuucauuuuacugaucuuagacuguagcaagugucuagcaucuuguaauguuugucauguuugucuauuguucaaggaaaaauaaagaaagcuggugaucuagaccuauguuauuauugcaaauaaugaugcuuugaugaguacagccuugaauucuuuuuauauauuaggcuuugucacauuuuaucauuuuccaguaggaguuuuguuuuuuucugggaagggguauaugcaugcauggucuuccuugucuugaaaaacauccuuucaauuuucuaaauuacagccucaauuuagagcuauuuggcuauauauaaaacguguguaucaguuguuguguagcuaacauugguuaaauaccaaugauucuguuuaacaugcuuuauaggcuauuucugaaaugcauagauauaauccaauuucauuuauaugaaacuuuuauuaauugaagcuauuuaaaaaaacaaguuaaagaccuuuauaaugaggagaauggucauaaaacagauugauacaaaauaguuuuacaaggucugauaauuagugcauuuaauuggauucauggauuugaaggacaugcagcaaccccugggcuccauggugguuuugggguguuggcccuguugggcucgagggcauacccuaguaugugcuuccuguacuauggugcuccuccugcccaacugugccuguaccaccuuuguagcugugagcccuggugagaagcaguggcucugaagguguccugcuguguuacauuuuucugacaugggcauuuucuuuauuuguaggugagcgccccuaucaaugcccguacugugaaaaagguuucaguaaaaaugacggacugaagaugcacauucguacucacaccaggguaagacccauauucugucucauuucuguuggucaaaaggaagccauaucuauucuaaaggaaacauauuuaauaucacaugagaaaauugcuauaacugaaguuaugucaaugucuagcuuaaaaucugaagguaaacuuuuaaaagaaaagucaauggaaaacaacucaaaccccaaaguguccugacuuuccaauuuugagucaauaugcaaggugccaaacugccaguauguuaguccuagaaaaugucucuuguagagaacauggugaguguaggugaaugaguuccgggguguaccacaugcaaugugucauuucucucugagcuguuacagcaucucacugccuuguucucuucuguauaccuguuccacaugcaaguuucaggcucauguguuuuaaaaguguuaugugccagcuguccugugaucacacauguuccccugcuuacugcccagcacaagugccuacaacccuagaacuaagcaggggguggcugcagaagaaggauuucaaguccauuggcagcuacauagggaccuggaggccagcuugaccuugucuacucaagaccuuaucuagcucaaggagagagagagagaaagagagagagggagagagagagagagagagagagagagagagagagagagagagagagagagagagagagagagagagagaggauaacuauaaauuauaagcuguaagagauuaaauagguauuauaauauuauuuaaauacauacuauucaaaauacuuauuuucacagugagcauuaauaaagaggcuuaagucaauucuaaaccauuugaagaauuauucuaggauuugugaaauggcucagcagguaugggcacaugcugaggagacggaugacuugauguguguacccaggacccacauguugaaaacugaucauauguaaaagcaaaaauuuaacaacaguuuuuggauauuguuuacaaaguaaguuauguucagagaaucaaugugaugguuuguuuuugucaacuugacacaaaccuagacauauuucgggagagggaauuugaauuggggaaucgccuccaucaaauuggccuguugccgugucuaugggauguuuucuccacuguugauuaauguaggaggacugauugcacuguggacauugucaucccaaggcaggugagcugggcuguuagagaaagguacucaagcaagccagccggggagagccaguuccagaucuuagauuuaguuccugcuuccagguuccugccuugagcucuugagcugguuucccuugauggacuguaaugaaauaaagccucccucccccaagaaagaaaguuuaaauugacuucagcaguuguucuccaccuuguacauguaugcuacaugacucgugugaauauauuaauauuauuaauaguaauaauaauauuaacagcagcaaccauaauaauaauaguuacuuuuuauaugaguagcccuaaaauuacaauaaugcauuuauauuaacgaugccaguaucuaagcaaaaagcaucugguugucuacauuagaaagaagugcuguugaccacaguguacauuguaauauuucacugauuauuggagacagaaaggccacaccauugaagaagcucuguaaauugcuacaggggaaaaagcauacuguuuugguugcucucaagaaaauaauaauaaugucuaacuuggugaccuuggcucuuuacuuuaauauaaguuauuacugagaaugcuagcaguuaaguacaaguaaauacauaugccaaccaugccaggucacacaucucagugaugauuucaugcucagacuuauuaacuugucauucauuuaaguguccuagaagcugagagccaugauccuuuuugaaaaugugagaaaccaaggcacagacauucaucauguaaggcugccuauagaagcgucuuccuaaccuccugugcuccuucccgucuucccaucacugugaugcaguucuugagauacauaauuuaagagaggcaaaacauagugucacuccuagucucauaguuuccgucuaagguuaguggaaccugcuauaucaagcuugaggcaaagcaacaacauuguaguggaagggacaggaaaaaaagaaaggcuuuucaugucauggcagcaagagagaggaggcaggcaaaggaggcuggggacucauccccacagguauguccuaagucaccuaccauagcuuguugaacugugaacucccccauggguuucccccgcuccugaaauuaauguuccuguaaccuggucccuuaucaucacugcccucuauggacuaugccuucaacacaugagacuuuggagcuccuagcuaaacuguaacaacuaauauauuucuuccuggauuuacuaaauuaaguuuuuaauuuguggaauuggauaauauuuuaccaaauuaaacaaauuauaaagacacuaaaagugucucacauuuuuuuagaguuuaaaacaggcauuaugauugaugucaggaggcagcaccaugcaugccaagaguucucaaggacuuagagcaaaacaaaguaaaucccauccacugaccgaaaagaaacacccaguuuagagagaaucuaacauuaucucuuuauggguuuuucauuccauguaugugaugucucaggcaacuuugcuuuaaaauccugugaaagcauugaauaacuauaaauauucuuuacacacaaauccaguuucuauacagcacacuaagauuaucaccaagaacagucaaaccauugucagaaaccaaaaaacauuuuucaaaagcuauagagggguggucuccacaagcauauuuucugacaguuauuugcaccuuuuaggcucaacucagagacaggaaaaauuaugggucagaguugugacuguggaaugauccccucucccucauuugauguccuguauuccugcuggaggugggcuuuuacauaccccuacuguugggcauuucaucuaaggucccucccugugaguccugagagucucuuaccucccaggucucuggugcauucugcagggucccccaaaccuccuaucucccaagguuaccuguuucccuucuuucuucuggcccucagggcuucaguauucuucccucacccaauaccagaucaaaccccccccccucccgcaauccuucuuccacuuuaccucccagauuccucccuuccucccaacuuguaauugcauucuucucccucccaagugggacugaggcaucuucucuugagcacuuaguuuguugaccuuuuugaguacuguggcuaaaauccacuuauuagugaguacauaccaugcauguauguacuuuggggucugaguaaccucacucaggauaauauuuucuaguuccauccauuugccugcaaaacucuugguaaauuuuucccuugaugaauaugaaguguccaucaugcuugauaacuuuugguugaaagucuauuuuauuggauauuaggauggcaacuccugcuugauuccuggguccauuuccuuggaagaccuuuuuccauccuuuuacuuaaacugagaugguuucugccuuuauuauugaggucuguuucuuguaugcagcaaaaugcuggaucuucuuugcuauccagucuguuagcuuaugucuuuuuauaggugaguugaguccauugauauugagagauaguaaagacagaugacugauaguuucugauacguuuguuucuguagguggcuuuaugugcuugugguucucuccuuuuggcuuuguuguaagaugcuuaauauccuguccuuucuuuggugcagguaucuuccuuguguuggaguuuuccuucuaggauccucugaaggguuggauugguagauagauacuguuugaauucaguuuugcccuggaauauuuugguuucuccaucuacguugauugagaguuuugcuggguauaguagccuggcuggcauuuguguucucauagagugugcaugaccucugacuaggcuuuucuuguuuuuauagucucuguugagaagccugaugcaauucugauaggucuaccuugguauguuacuuggcccuuuucccuugcagcuuuuaauauucuuucuuuguucugugcauuuaguguuuugauuauuaugugacaaaaggauuuuguuuucuggucccauuuauuugguguuauauaggcuucuuguaucuuuaugggcaucucuuuuuuuuuagguugcgggaguuuucuucuacgacuuucuugaagacuuuuuugggucuuuugaacuggaaucuaacaugugaugugguaaccauuagaaguuuaaggagcaaacauuuaauccuccugagucaauuacuacacugugaggaugcuccaguggagggaaugauugaccaacaugcucauugggcuaggcagaugugucuaggugagcaaagggaaaguucccuauagguuugucuugagugaccucuucacugucaccacaaaggcugaggaugagugcugaaguaugacauauugagacaagcugggccauaggugaucaugcuuauaguugcauuuugaguggaggaguagcauagucuuuuuuuuuuuccucucaggaaggucgggaagucaugcuuugauugggacugaagacagcagucugaaggucgugaacugagauaguuguaaaauuguuuuuaauauaaauguaaccaaugaauuagucuggcagcugugcuucuuaccuaccuaauuccccuugccaugagccaaauacugagcaauuauuauucuauccugaaccuguaggcuacuuggguuucuuaccagacaacauucccacccuacuugaaucuugucauccuuucuugauccagcucucuucuacugguguuuucugaccccuuccccugguucccuccuucacuucuuucuccaucccggaaucagaaaaucccacuuacucucucuaaagcucuguacuggcucauuggcuuucauuggcaaggcagagaaugaaugaggagcaauguuuauauaaacuugagaaaggaccaucuucuaagaacaaacauaacaaagccauguccggauuguaauaagauaugaggacacagaagucagcacaugaauaacuuuacacaguguacaaagacaugccuacagacagugaccuccacugggugccugugggauuugaaaauagagaaaagauauggaguaucugaaauaaguguuaccaaaaguguuuauacauuauauuauauggguggagcuggaagagucacaaaugaaccugggaaacccagaagagauguuuugagagguuguggugcucugcauagacagaguugguuuagcuaguagacuuaaaggaaaaggagagauuaggaaggaugugagauagguucacuauuguaugcaauaagaaacuaagaaugucacuguuuuuauauguagaaaggauaaaguguacacauuuaauaaauuauauguucaccaugaauuuagagaaauuuauguuuuuuaauuucucuucuuuguuaucuccuauguuauagauguguugguuuuuguuguuguuguuuugguuuuguuuguuuguuuacuacuauuugaaaacauguauaauuugauugaauuaguauaguucuuaaguuucuaguguccuaauuuuucacagauaaauuuuuuauuccuugcuauuuccuugaaaauaacugaguuuauaauguugugcuuucuggcuuggaaucuauguguacauggaacugggcauuuuuaucucaucaccuaagcuacuuuuuucuuacaaagcugggacugauagcuccacuccgaaucaucagcucacuuggccaaucaucccucacaacuucuguguaaccuguguuugcaaacuaguuggcucuuuuuaaaaucacaaaaaagacaguuuuaaggguucuaguuuagaguagcuuuugcgugucacaugauguuccuaaagaaaagacuccaguccaggcauucuagaugccauaggcguugaauauagcaggcgaacuuuaacagaaagggggaaacuuuugacaaauuuacaggguagccuuaugaucccacgggcaaagaaacuuuaguuuuugucugguucucaugaauucuacuaccacagugcauaucauagcuacgacccauccaaucaucucaggagaauaugauguguguuuuaccuaguuacagcuucauaugauuucaucugcaaccagaagacugcaauaucaaacaaugcaacuccagaaagaaccacgucagagccacaucagcagacucagccugagaaauagcaguaagcuaucauaggucacuaaguagguaaaccaaauaauaaacauuagaaguaaaaccaaagacacauuagacaauaaaaagguguauuaacuuggaugcuguauuaugcuagcuagagcagguauuaaauaguacacagugcugaguaugcccaauagugaaaaugugcagcuuaguucugcugauuguuucucugucuuuaaaaagauuuguuuguugauguauuuauuucuuuauuuuguucuuuuacagcagggcuuuucuaccuacuccugucuguccuagaacuugcuauguaauccacacuagccucaaacucagggaucuaucugucucuugccucccacaugcugagauuaaaaccaugcacuaagccuggcaacguuccuuuuaaagauuguuuuaagaauuacauagaugaccugggcgugggacgcacgccuuuaaucccaguaccugggaggcagaggcaggcggauuucugaguucgaggcuagccuggucuacagagugaguuccaggacggccagggcuauacagagaaacccugucuugaaaaacuaaaacaaaaacaaaaacaaaaaagaauuacguacaugagucacuauuguauuuacauauuucuacccauuucuuucccuguuuagcuccucuccuagguuccccauaaaguugcucacuuacauaguuauauuguugagugugugugugugugugugugugugugugugugugugugugugugugugcaugcgcgugcguguguaagacuuacugagucuauuuaguguagcuccuaugugcauguguuuaaggcagaccacuagggacugaauaaccucucagugagcuugcccacccucugagagaucuuccugucucagcaaucauugauugccuguaaucugagaguaaugcuuuuugaaauuucucaaguugauguuagcaugucagcuggugcuccuauuaugcaagcauaguggggagaguuuguggguguaguucuccugucaugucuagaagauaauuacucagagcagguguucugguccucuggcucuugcagucuuucugaccuaucuucuacuguuuuuccuaagucuuggguguaggaaauguggucuagaugaaucagaugggguugaacaccccaagaucacucaguguaagaauuuugaacaguugugaaucacuguugcaaaagaagcuuuuaugaugaggugugaaagcuauacuuaccugugggucuaugaauauguuacucagaauagguaauuagaaacuauugauaaaguucuuugcugaaaacuuuguaggaauuuaaagcuaaagauuucacucauaagacugcuuucaaucuuuuaaucugcuagagaucuguggcuuuguuugugccugggcauuaguuuuuuaaucaggauuucuguaacuguuuuggucucuuuauuugccaugggucuauuuaaguugauguuuucuucauucuuuaacuuugguuuuuccccugaucaaguguuggguuugaacuaaagcugagaaaggugccacaaaaauuguuaaaggagaaaggcaggcagcacccaguccuaaccagcuguuaaucccagggaccacagcaagaugcauaucgucaguuaagucacaacaagcaacacauuuaugaccugugugcccuacuuuacaugauaggauaacagcaucuuuuccuuuagagaaaaguaaagcuuucccuuuccuccuucucccagugcuucagaacugguggugaauacuugagccuacaaccuaaagacucugcucacaucuacugauacaguaacagaaaggcaagaguaaauguuauugcacccaccccacaucugccaaauggcuucuauggacuguugccacagcugaaaugggcccaauguuuuaacuaaaggauuggugggacuuagaauuuuuuauaauuugaacauagaaauaaugaaaaguacacagaauuuaauuucaagggacuauuuauagaacauuuugaagaugaacagcaauaugauaggaaugcaucuguuauaaguuggaaauacuuaugguggcucauauuugccuauuuguuuguuaauucugaucaucucacaguuccuuaaaaacucauagcaaaaucccucaucuuggggaucucugacaguuucuauuuaauuuuguuuagcaauaacuucaaacacuuaguuguuagcaacuaggaacucaaagacacuccuuugacaaauguguuuccaauggaaucuuuuuaagauuugaaagaauauaauguccaugucacauguuguauauagaaggaaagguuaggggaaauuaaagcagccagaucaggagagggauggugaaacugguacaggaaauggugagaaaagucuccuugucaggaacauaagaggaagguacuucaagacaaggucagaaaaagaaaagagaaagcuugguagagauagcugcacaggaugacaagaaaagaacagauuaguuggcuuuucugggcugaaacucagagauugugagaccaacagaaaugauauagcaccacggcaaauggacagcaggccaguuguuaacaucucuagggaaaagcccacccaugcuuugcuuacuucuggaguuuuagaguauauguaaccauauuaaaguucugauuugugcaagauacauuugauuguaguuugcuuaacuacaguagucuuugccuggaagagcauaagagggaguacaacaugagcaacccaggaagagaguaaaaguuuaagucaauuggaauaguaacaucucaaugacccuuggaaggucuaugaacugcaguuuaggaaauucuggucugccuaacccagacauagcaauacuugugaagaucaacuuggaucaugaaucugcuaauaaauuaaagccaaaacaaauaagggcagucaguccuguuagcugcccacugcccauaguuuagaguucagugguugccuccaaguaagcuauagacuucccaccaucucaucucuucgcacaccuucuuuccuaaguacacggguucaguuggcuucagccaggcaugacuacauucuuuucgccaaaucgaccguguuugcaaagucuguaggacuauguaaagauaaaauugaagcaaugcaagcgguacagaucuuauuuccuuaccugcucucucccaggagaauucucuuuuccuuaaagcuauuagcagacauuacuuucuaagcagcuaucucucuguguaccccuggugcuuuugauuacacucuauuggcccaaacucuccaccuuuauaucauucuuuuucaugacuucauucuuaguuuccucacucacuccuccauacacacuugucagaugguuuuauauuuuguucuuaugcaauuuuuuucuguaaaaagaauggagacucucugcauagauuuucaucaacuuugaaaggaccaaauuuuacugccuggucucaacugccaagaauccaggucuagauaugccuagaugcaaggcaauaccuguuuuggacaguuggauacuccacagagaaaacacaguguacuugaugugaacuuaacaguguaaaagaugaagcagcuaacuuaucccuaugaaaaccaagcagaguccagccaggaagucugaauggaccacaaaccaugauugugagcauucaagaaaaagucauagagguggguaggccaugcuauaugacugagugcuacgugcagggauguuaaguugugcaggccaugcuacaugagcuaacagccaugcaacaaaacaauuaugcaacaaaacacaaguuaaguguuuuguuggauaaaggaaagcccaaacuaggagagggcauggcgugcucgggggaaguagagcacagggcguggggcuaggcagguucugcaggauuggagaagcuuucuguaccaaggcaggaagacaagauugagcccacuguauuguaaguccacagaagauguuauugguuucccagugaaggaaugaagcaauaagauaagccauaagccuuaggauucccuugcuuauuagaaauaaaagucuauaaaauaaaaacagauguucacuccaaaucacucuccuuuucuugaacucuuuaaauuuuuuauauugcauuauuuuuuuuauauuacaaaaguggucucacagguugaaacuaauaacguuguaacucaguuucuaaggcuguaguuauugguaguacuacaagaacaagauuauaggguguguguuagucaauuuuauuuuuuuaucauugugacaaaaucccugagauaagcaacugaaaaggagaaagauuacuccuggcuagugagagacuagacuagagccagugguggugugggccuguuguaggucuguggaggggcaggacauuacaguggggaacaugaccaguggggagagagagaggaaguguggggacugccaucuuaauuaagggcagugauuuuuguuucuuucacuagggaacaaucucuuaguuguaguagaagccagaaauccaauccuuuuaaacacugccuuugagggcauuuacaauucaaucagcacacagcauuucuacaacuuuuaaaaauacacugggacuugaucaugacguaguucaagcugaagucauuggaagcaugugaguugacagcugauccugucccugacuuuagugagaacuuaauggaaaaugugucagugacaugauguaccuaacuauauuaagaaacuugcuuucggucagcuugucuuuggccuuauuuuguuugaaauaaacagaagcugaguaaaagcguaagggagagcaggcguauuauaccauuaccuagcuguuugguauuucacacagugacgucauuuuuaaaugucucacuuugaguuuaccacauguuauuuugcacuuacuuuccucagaaaucaauguuccuuuugaauaaggaaucugguuccuuaauuuaagguauuggauacauaggaucuauuuaauagcuaggaauuaguauuuaguaauacuaugacaauugcuccccuuggucuuugaagauuaaagacuuuauaacucuuuauuaaucuagaaaagauaaaauugcaagaauacacaaaucauaaaucaacucauauuauuuaauguuagagguaaauaaguauauuuuaaaaugaauauacagauacuuacuauuaaaugugucaauaaugcacccaguuguacuuacauguccaagccaaaucaggaaaucacaacagucauaugaacuacauaugcaguauuaggaacagaaaaauaaaacaauaaaucauuuaaaacugacuuuuuaauguugaacuacuaaucauucagacaacuuccaucuugucaucaagaauagaguuguuccucuuuaaaguuuaaaauaaaauuacauaauuuuacaccuuccaacaugucccaugguuccaaccuccccacuccaauucauggcuuuuaaaaaaauuauuauuauuacuacauauaugcaaauaaauacauacaaguacccuaaaagucuguuuaguguuacuuguguguaugcuuuuaggcccaacuacuugguaauggaugaccacuuacagggaucacuuaaaagacugcuucgcccuuugucagcaucacuaauuggugguagcucuucaccuaggcguuucuccaucuguuuuggaaugucagcuaauguuguuauuauuuaagucuuguuuaagaagcucuauuguugauauuauauagguauagauuccuugucauaucuagaagacaaucuuguagaagacuucuucuuccucugacucucacaaucuucuggcccuauuuucugugauauucucugagccuuagguauaaagguuguguuguauaucucuccacuggggacagacuucucaugguuaguuaguuguucucuacauuugacuaaucauggcuugcuguaaugauuucuuucugcugcaaaaggaagcuauuuaaauaaggaugagagggauaaauaacaugaagggauuugaaacagcuauaaggagucauuauuuuauguuuaccuaaaauuauaugacauguguguucaugugugugugugacucuaaguguacauucuauauuuuuaaugaaguuaugccacuugcgaugauucugccucucccaagaggaaccuaacaaaaacccaguacuaggcaugaaaaaccucuauuugaguuguuguucaggggaguccaagagacuccuaaaucaauauaggcuauuacuguuucacucaguugccuuucagaaguugaaggucucuauugcugaagacaucacacuccuugaacagaggaccaggagauuugagcugaaugugaucccaaagccuccuucugaaggaugaguuuucauuauaccaggaggugcugugcaagcuaccaagggaaaaacgcaaucaauaguccaacccaguugugaccccuaugaaacgcaacgguaaccagaauggaaagagauccuggcaggugcauagugauguuuauacuuggcuuucagguccuuaaaaggauggaaaaaaggccugguaggauaaacccaggcaaguuccaaugcuagccagaucacagaucuuagagaagaacacacacugcuauguuacugaaacaguguaauuccuaaggacgaucuaaauucuuguccauauuuccauaaguacgcguagcucucucccccaucacacuuguucuacuuaauccacuuaacugcuauccucaccucaagacaggacaagaucaguuugaaggucuccucagaaccauuaaaguuagcugguuccuguccucacuacugugaccauuccuuccugucauucuugguuugucaaaaugacagaaagucuagguuucuauuguuaaagggaagagaauaaauauuuacguuugccaaauuugccuacgccagcucucuagaccuaugcagguuuucuuguuaacugaaauguccuguauuauguugcuagcuagcaucuccauauggaaauaaaaauuuaaaaacaaagcccagugcuuacuuaaaucauguucucccuuauuuaccaaucauugaguccuuggucaaggacuuugucuaugaaugguuacuguauauugcacauuuuacugaacggaccucagcaggucgcugucucuuucacauuacagaauccuggagcaaaaaggggcugcuguuuaguuccaggccuagcugucuccucagugcacugcgggaacucacuaagcaucuauugggcuggcugcaaagcacggaaaucuaaauuugggugucaggaauauauuuggguguuuccaguucagggacacuccagcagcuccaggucugacccaaauucguccuuuuaagggccuguguagcucagugccauagaacaacuucaugucccucuguagucccaugucguaauuuaucagcuguuucagggaugcauacuaaguccugugaagcugguacaggaacaaagaauccuugcagagcagcuuggcgauuuagcucaaaucaauucuauaaauauuuagcauuuaugcugauugcugccuuccuaccaccauauuaucuuuagacuuuaauaauauacugcaagauuaaauggaaagugcagcccaugaugucugaauuucccuuuguuuuaugaaaggcaguauacagcuaauuuuaaaagaaauagacauuauucuuaggaaaauaauaugauuuucuauacuauuuccuuucuaaacagaauuuuacuuauuuuucacucuauucagagagcucuaauuacuaaagcaucauaggaaucuugaaauaaagacaucuauuuauauaaauccccauucauuaauagauuccagaaggaaggguacacugcaugaagcucauacacaauuucucucucucucucucucucucucucucucucucucuuucuuucuuucuuucuuucucuuuuuuucuuuuuuguaaaguuaucuaauuacauuguuuuaaaucugugcggcuuuuuucacuuuagaauugugguauuuauuacuaugcacauuguggauuacaaagagauaaaaguuguuuaagguaagauauagauaaccuuccaggggucuucuugugagccauuuguaaaggugagaaggcacagguauacuauuaaaauucauguuaaaauucaaagcucagugaaguauaugguuuauucggagucacccagaaguaaucagcaucaagaguaaaaauuagauaucuuugugauauuaauuuuuuauuuuaucucuauguagcgugaaauauuaaaaaacaauccacacuuugccggaaggcaccaguggacaggccguccuggccuguuuucaccuuucugcccccgaccuccgaaaucucuacacccagcuugcuaagcucucacuggcaggucaucgccucgccagccccacgcuuccaaauucucacggccuuuuggggugcauuucuugcaaacccacacuuugcagccggccuguaccuuucucgcuggaacccaguugagcugcucuguaaaggaaaacaccacacaaacuuaguucagaaucaacagguaaucaaucucugaaugcagcaacuagcauccuaauuuuguaagcuauucuaaguauucgccuccuguggcgaauccugacagaucuacaucgaaacaagggccucuuguuagcuacauuuugaccucuaagcucucucuuuuuccugccucucuacuuccguucucagaccuggaagucuugcucacuccuuacccagggaguagaaaucguuauucauuaggggaagguucacagcauaucaccugaguaagggauucucuucucauaccaggcagccccucuaggggaaguggaauuagcaucauaauaaaaacagcaccagggcuagccacacguccauacaguuaucacacuauuauacuguacugcauucuguaguauauaaaccaguuucuuagaauuagcgucaguuucuccuucagcuccauaaccacaguaggucaaaggucaaguugauauaaaagucagaaaauggcccugugauccagccucugaaggaacucuuggacccauuugucacucucaugucaauauuuuagaauuuggaaagugccuggauuuuauuauugguaguauuccaguuccaugaagaaaauuggaaccuuaagaguuuagguucucaaccuuccuaauucugcaacccuauaauacacuucauguuguggguauuauaacuccccaaccauaaaauuauuuuguugcuacuucauaacuauaauuuugcuacugauaugaaucauaauauaaauacagauaugcaggauauuuugauauguggcacacauguugagaaccucugauuugggccaucuauuugggcuuccucguaaaauguaaauauggaugucuucauuugcucugcaaaagaagccacuaguuauucagcguuuaccuguuccuaugaugaagucagaucugguccugagcagaccagaucuaggacucuugcuuuguauuucuuuacuugauggauagaucaaaucuaugugcucugugauagucaucuuuuauaaccaaggaaacugcuuccugcugugguccuagauucaaacauuucugugcaggcuuggguuccccuacuucugaggaguauauaaauacgaugcucagaaaaguaauugucugucuagccagcucugcucucaauuauagauugccuuuuauaaucauacacaugagacuucccagucaaauuauauacacuagauaaauguccuauauggcaugucucccuaauaggaauuauaaaguucagaugucauguguucaugugauauuaguuccucucuagagaauacucaaauguagauauuaaaagucuccuagagacauccaagguaaaucuaguagaacauuagguaaauggacaagaauuuacaccauacacucacaucuguaaucccagcacccaggauguuaaggcaagaggacugcugcuaguucaaggccagcuuggcuuaccuaguaaauucgauguuagccugaacuauaguguaggguacugacucaaaaauaugugcauacauucauguacacagagagacaggggaggagaggggaaggauggagggacggagaggagagaauuggauacaagagagcauucacugaaagaagccaagaagccuguuuuauaucaugaagauuugauacuaguaaguguauguggagucaauaauguaugcaugugcaauuuaacuucuuauaucagugcauguucaaggcugugcauggaaauaauagaaaccaggacugaggacagauuuccaaacacauuuucaucaccaaaugguguuugucuauauuucaaggucauaucagacagaugcacuguuuuccuaaggauuuuuuaauggaauuaugauuuacagugauuaugauggaacugauugcucgauugcucguguccuugaugcuggauuguaacaugcauagauugcugguuucagauuugcuguucuggaaaccauaaaguggggagcaggauggcagggagcacucuggagauucgcaaucagaucugaagucauuuaccccuggcucagugguugacauagggcaaauugcuagugacauaaaccauuuaaucaaggacuaguugucgccaagucagauacuucucggugauucuuuucugcuuugcucagaaaugccagacuucuaagaagcuccuuaaacaucaggacugccuugagauuuaccuguccauacugaccccuaaugucuaugacccuagacauggcccaaguuccugacuacccaacauauuaguacacagcaggcugcauguuguagcagugaaucuaaaaccacucucuguuacauuggauuaguuucauuagagcuaaaacuuugcuguugcuacacccauaacuguuuguauccauguauuuaugagcguaaguacauaugcaccuucaccuuccugcgaugcccauuuccugcugcugccucccuuuagugaaugaauauacuuggcucuccaugauagaguacgucuaguuuaauacuuugcugcauuguacuuauugugccuauuuggcuguguagagggaccagucuaaaggaucaaaccaugcgucuuuagacguguaagcagagaucaugucaaugccaaaaaaaaaugacauuccaccuagaaacagucuuuaacauccaaggcaauuuaucaccaggaaauauauuacucauagacugaauuuugaauuuuuaaaguauucauuucuaucuuuauuuccccauuggcuagacaugacugagcccucgaccucugucuuuugcugaggcucccaaaugcuaaauguuccuuuuccauguaauacugaauuucaagucucaagggucugcugauuccccucauaguucucauuugggaccuauagauauauauccuguuuuggaaguugaugguguauaauaucuugagauaugagauacaugcucacugaauucucggaguuccugagccucaccguagcuucuuucucugugcaaaaucaaaauuauauuaauuggaucuucugcugaguguguuguuuaugaggacuugccaugagaauaccugguugcuaguaaaacaacaaucccaaccccagcuaugaaaaaagagagacuggggacaggugaugcauguggucauuccaaauuagggguauuuggacauugucuugcucuauaaucaugaccauucuguuuuucugaaaaauaagcuuucuuaaauauaggacucucagagucaaauccaggcuaguccuggacaaauaugcagaguuggucacaucuaugguaguuuuugaaaugaauuaacaagugucuucacaaggagacagagacaaccuaaagcagguuggaagaaagugcuagaucuuaauuuuccagaacugaaauuaggagguugaugagaaaugaaauauauaccugcuuggugaguuugguguaauaucccuagauauaauguaaaguuuccacaaauccccauuugugaaacaacaucacaacaucagaggacucugaguucgaggccagccuauucuacagagggaguuucaggacaaccaggcuacacaaagaaacacugucucuaaaaacaaaugaaauaaaacaaaagagaagggacagugaccaggagauggggauggcaagguggcagcucuucuuacauguuaguguucccugugcagagauggucucucuaaaccaagcaccagacagagcuaaagcaacacaucuguguauacaaaagugguucaaauuugagguggcauuccaugggauuuucugugccuuguaucuuaauaaaaauuaacacauuggcuuaagccagucuuauaccuaacacauucugaaagaauuagacaguuucuaagagccuggagaguucauaaauagugugugucaaauuuucuuccuuaaacaaaagaaaccagagacacacacuacuacggaaaugcauuuugucugcauaagagugacugacucuucacuuguccuguuucuucccugugcuucccgugccaagauccaugucaauuggacugugaagcuucaucuucauucuuuggggaaagagcuaacuaaacaucuccugagugcugaucuuagauuacuuaaguuccuucugucauuaagauuacaggcuguaaacugacuucagauggguuaaaggauugaggaaugggagggguuauaguaacagaaucuuuucuguuuagaaagcuguuccuuccgaguggcagcugagggaaacccagagacgaugccuaccaucccuaggcugagucccaucuaaguggaacguugcuugagccugucauucccgaguuaggggaauucagaggguaucugaacauugucuugcuauauuaucaugacccuucuguuuuucugaaaaauaaacuuucuuaaauauaggacugucagggucaaaucuaggcuaguucuggacaaauaugcagaguugaucacaccugugguaguucuugaagugaauuaaugagugccuucauaaggagacuaagacagccugaagcaggcuagaagaaaguauuacuccuuaauuucccagaacugaaauuagaaaugugaugagaagugaaauacccacccuuuuggugaauuuuguguaauaucccuagauaugauggaaaguuuccacaaauccgcauuugugaaacaacagugagcucaaauuuacuuacaguuaaaaaaaaaaauguuggguaaacacaguaaaaagugaacucauuaauucucugaauuuaaauuguuguaauguugccuucagacuuuaaaaauguuauuuucagaugauauaugaaaauaccuucacuuauuacaguaaucuuacuuauucuuuuuuaagacauuuaugauuuuuuaaaaggauuuuuugaccuugaguuaauucagaucuaguaagaucucuaccagguuagcucugaacccucaccugugcaaacagacaugcuaguugggguuuuuccuccgcagaacuuucugaacuugaaagaaaugcauuucugcuacuagcucccugccaucugugcagaguguuaacucuagauauaguuuauaucaguaugacuuccucugacuuuugcccacugcugauggcuucguuuuaccuguugacaugaacuuggcugcuuugaauacccugcuggucauggaggaauuuagucacaugugcaauagcagcuuugugcuaugcucauauuauuuucagaguggaguaaucggagaaguauguuauuucuuuagaauuagguauuccucuuguaaggauuugcauuuacauagucuccuucuccuacagaccucugaauaaacuguaugguuuuauggagaaauggauuccacuugccaucaucacaugucagaccugugcuuguuaauuuuggaagcaagcagaaugaauuaauucauuucucuggguacaaguuggauauggcucuuaaauaugagauuuggugacuguguugaauucuauuuucugucauuuguacauuucagcaaugcuccucacuuaugggagugugugugauuuguuguguacuaucuccucgaacucagaaccacggucacuucucaugcacccaaggaaagccuuaccugcaacagcagagucaaugccaucuugacauuguucagacauucccaaacaugucuacuagguagagucauuaagaguccuugaaaagugccaaagccagacauacaaccccaguaugaagccuccuaucucuggggaugggcuacaggcaucagugauuuuggagaucuucuguugauuccagcuuuuaaacaggcaugggcuuaggcuuagccugaaccagcugucauaacugagcuggggaccauccuucucuuucagaguagugaaggaaauuuugaagugaacauucaacagaauugggcuucccugccaaggacagaaggaaggggaagugcuuuguaggcagcccccugucauggucaugcagugcuuuggggucuuggacuacagcuuguugugaauucuguucuuucuaccuggcagugugaccuuuggcauauuuuuaaaccauuucuucaucuguaaaguaaggguaacacagaaaauuacuagcaucgcguaacagauuaauggaaaggagauauguaaguguuucuaccucugugccagcuagcacaaagcaggcagcccaaaaagauggcagcagugcagugggagggaaguaucagagcaggaggagcaaacaggccuggccaucacugcugcugcugcaguuaacagcucaggaugcuugucuuagagaaacauggaccacauuguugguucucccuguggcugcacuugauaucaccuugggaacuuugaaagcaccagugcauggcuaugucuaauucagugaauggggcuuucuaggagugggcuccaggcaucuguaguuaugaaauagauucccaggcaagugggucaucaggcugggugaagugcuuuggucuuccaucgguacagacugagggcaguguuuacucugcuccugguugucuuguugcuccaaugacugacuggagucaugcauguagcucuagcaaagcucauuuugaacuaguuuggauggcccuugccuguuuuaugccugauaagcuccuguacacccucagugcauacaaauggacuuccugguuaccuacucauuuuacaaaugacuucauggaccucaagauacaaugagucaggaagugaccagguaucuccuuacaauacuuuuauauaaaaguuugauuccauucacugugcuuaguuuuaguuuccuacauguagauugugcaguucauucucuugguuuauaagaaguguguuuuccauuagcuacaaugcagaagcaauuacagacaugcuguguagaaaccugcuuuagauauucuccuagcuuucaaaggcuucccuaugaguuguaauuuuuaggugcuuuguuuacuaguccaaggguguguuuugucauauguugaaagaccacacuggcuauaaaaauaagacggugaagaaaaacccagagaagcuguaaacaucugugagagcuugcucggcagggcugcuuguuagggggaggcucagaacacauucauugugugcagcuggugauacaugcgcucucacaaauggggccauuaagaggagcuguuagauauauggccagcuguccuaugggcuauagaucugccccauuagcuguguguaauagaaacuagaagggccacacucacaaacccuucucuaaauuguagcucggauucuucacagacuugauauuuugcagaacacacuaguuaucugaggacccaaacuuugauccacaugucucucuuuagaaacuggaguuggagucugccaugcuaagagcauuggucagagcuggccuguggucaguggucaaggauacuacaggucaugaaaaaguugaggugccaugggagacccaggcacuagucuugcugcagacaccucaaauaacccugcagaagaaucggcagacaggucuugacugugguccagguggaaaagucaaccugguuacauguggugugcacacuguaggcuccguauuucacccuggaaauacaggcucagguguuggaaaugaacagcuuaccaggcuaacuacagugugaaaccaucucuaagcagcuagcaugucaagauguuuuacagugacuauccuccugauauccaaaaugguucuccucaauaaaaaaaaggcaugaucuuggaaaaaggaugguuguguuguuucaaguuuuauaauaacauaaaagcaguauuuuaagucuuuuaauuuuuauaaggaaauuuugacuuuuagaaacagaaucaugucaugaacccucggugugucuuugguuaauaaauggccaguccguugaaaaaaaauggggaaguuuuucaaauuuucuguguauauagcaguuuccuguuuaagaaaucugcauugaguucaugguacaggaauuuucaggugacauuuguguguaugugugaaugcuugcacaugugugugagcagagguggagguauugugggaauguguucuggagguugccagcuuaauggcaagucccuuuacccacugagccaucccacuagccuauauaguuggcaugaaguuuuugugccacuuuaaaaauuguuuuguuuauuugacuauuuguuaauuuaauuuuuauucacuuuauuuugucuucacacaaucucaagcaguccaagcuggccuucaacuucaauuguagcugagaaugaccuucacacugguccuccugcuucugccucucgugugcuggaauuacagcugugcaccacuauacccagccaggauuuaagaugauauuuuacauuuagagauaagaauguggacugggagaugacucaguauauaaagcauuugaugugcacauguaaggaucaaaguuuggauccucagcagccacagagaagaucagacaguccuaggagccaguuuauaaucuuagcacugggcaagaugacuagccugaaucugugaacuccugaccaaggguggauccuuccugaguaaauagagaacaaucaaagaccuccacacaugugcgccuacacgcaagcaaucagagacuacccccaauaguaguaagacaugauuaucuggaaaauucaucacuuuucuauacucuauacagggaaaguguuaauacauauaaaauacuguaaucuagaaaagaaaauuaaaugaaauuaauuugaagcaaaagacaacuuuuauguccuaacauaacuuuguguuuguuugugugagugugugcuugugugugagagagagagagaaagagagagaggaucgagagagagagagacagagagagagagagagagagagagagagagagagagagagagcacucuauaaacuuuuuucucaaaggaauuugcaacaaggauuaucaacacacagcuguuaugccacagccuuccuaagugucauugaggguuguuuaaagaacuuuacauguuaaguugcugcuccucuguauagaagagcaccaaggacucagaacuggcguuguguugucuauaagcaagguacuaggcacaaagcuccauaaagccaccuucugaaugagcucugccaaauggugcucugauuagaguaaacuaauuagauggcuaauuaauucugccacucacagauugcagaguuuaauugauaaaauagauugccuccaguuaguauugauucccaggucacaaaggacaagcuauuucucaauuagacuggguaaucauucugaaacagcauaaaucaagaaccuaaccauuuaauguuaauuaaugucuaguuaaauucagcuaaugagucagagugugugauucauucuacauauuccucuaugaggacauuagaaucaacucgcagauuguguucuuagucaagauacuugcaguggcccacagaagaacgccagggagauuauuaugagaugaaugcugagggugagaucuuaucuaagaguggcaaggcauucacaagcacaacaguauuccuguuacuguaacaaaugucugagauaaucagccucaaggaaggcucauuucaagguucauuucggcucacacuauuagagcuuuuagucacuugacccugcauguucugauccugucaccuggagcaccuggugaagucaccucauaguggcuaggguagcaaaaaggaagaagauagcagagcccuacaguucauuucagggaauaccccucccuccaaaaaagugagcuaaucuucucccagcuuaaguaucuuauaauuuccuacguuuucacuauaauaggguuccuuguugacagucuguacugucuuagacaccaugguccucagugaaccuaaggggaagugaaucagagagggaaauuaaauugccuuguagccuuggucccuaugcauggauucuugcugcacaggaaggggauuccagggacaaugaaggcuucacaguucucaaagagcagguuggaacaugccuauccugccaucuccugugguaccucgcaguaugagccuggccacuugucuaucugugcuugacuagugagggcagauguuuugcaaugaggcagguuaguaguaaugagauguuagcaaguagaaugagggguacugggucugguucgcuguagccacuugcugaaucaggagucuccaguaugcacucuccugcucuuccuacucuucuguagauccaauccuuuccaaggggagcauccggugacuaggaaaucugggcacuuugcucccuugucagaggcauacuuaggagucuauaggagaaaaacaagagaagucucacuuagaaauauuuuuuauauauauuuaguaaaaagaacucuauacuaggaaggaaaauguuugguaaucaagauuaaaaacauaucaacccaaggugaauucuagcuuuuuaaauuuaucuucaaaucuacauagaaaguuagguucugaaauauucaaucuggagauuauaauaauugcaccauuuaggugagggggcccucagcucucuuaggugauaauacccaaaaugccauaguaaaauucgauggugcuucuaggcucaaagaaauaauuaaagcuggaucacagcaccggaagaauuagcagaggccaggcccugggucguccuugucaggcacuuucaacuaguagauuagaguguccagauuugauaugugugucucuugaugccuugggcugcuccuaacucuggguugcauacucuuugcauucauauucuacucaucaugguuuucuagcagcaaacaaauugugauuuucuucaggauaucuuccaguaucugauuccaugugcucauugguauuucuugugagguuuugaaacagcucaucucacccugcgcauuugcugcagcgcgcugcacaccuagaggagggcaucuucccccucagcagccacucacuuuucuguggagguucagcacucagccaaucagccaucuuuccauggaggcucagcacacagccaauccgcagucaccuuuccauggaggcucagcacacagcuacuaggucucugaccuucuuggugcucucuucccuuuaccugcaggagaagcccuaccagugcucagagugcagcaaggccuucagccagaagcggggccucgaugaacacaagaggacacacacaggagaaaagccuuuucagugugacgugaguugggaaucuccuuuucuucccugguauuccgugguaaccaguagggaugucuuugucuguguaugcguuugauuuguguagccugcuccuaacucuggguugcauacucuuugcauucauauucuacucaucaugguuuucuagcagcaaaaaaaaaaaaaaaugugauuuucuucaggauaucuuccaguaucugauuccaugaagcuguucuuccaggguguaaauuuggcagaguuugagacaauucaguuagacccaagucuuugacaaguuagugacaguugaaucaguaaaaugauuaugaccaaaauauaaugcaugugugccugaaauucuuuuuaaaauuacaauguaaaaacuauauuuaacuaaucauagauguuaaauacaaacugaguuuucagaauaugcauauaaauuaguuuaaacaaaaugcuacuuaggacaucuucuaucuaggauauuugaauugaaacaaaauaaguugacauugcuguuuacacuauuuuugaagggaaaaaguacuacugugcuugguaaacuuaauaagagcauugauugggggaaaugguuucaucaccagugguuauugguuauaucaguggaucaacccaaauguuaaagaagacaccagggugcauguccuucacacacacacagacacacacacacacacacacacacacacacuaaauaaauaaauaaaaauaaaauauauauguguaucagaguaucaguggaauuuaauuaaaauugugauguaugaaauagcucagcacaacaaagucauuguaaaugcugaguuuacugaagagcauaaucccaucagcauguuccagaggagaacaguggugcaaggcgucccugugaaggaaaauucacaacugcaggcaggacucuuucccugcccuaugaagugucaagcaggcuaaagcagcaguauguucuuacuccuagauaccuucaccccuggcacacuguaagcaaucucaccuguagcgaaagaagugcaugcauauagaacgugguccugagauggagcagcuuaguaacuucauuugucuugauucuuuuuauagggacagaagcaauucaagugacuugaauguacaacuacacaaauaaccuuuucaggccugaaguacucugccaguugcauguggcacuuugcuuccaucauagucaaccuaccucugacacccccagaacaguucuguugagcauuucccugggugaacuguauuagaaccuacuucuucaggauuccaaucuagacugaaaacuaggaaacuggcagccuucugggacuuccuuuaacucucacaucaaauugggucugcucagagaggcaagccuugaccuuuccauaggggagggccacucuuggacuaagccacuauaauaaaucguguguguguguguguguguguguaugugugugugugugcgcgcgcgcgcgcgcgugcauaaauuuagauguauauaacauuugcauaaacauaguuauauaacauacauacauacauguagauauauauaacauauauguuauauguuuguuaauccuaucagcucuguuucuucagagaauucuaauugagacaguccuugggauggagcucaaaucauaacgcuuugcagcaaggacugcugaagcauuacgugcugugacguguuuacuuaacauaaaauuauuagccaauuauaaauuuuuggaguucgguggaauuuaguacauuauccuuguuguguaaucacauuuauguggcuucaaagcauuuuucuuuaaccaaaaaaaaaagaaagaaagaaagaaaggaaggaaaggaaaggaaaggaaaggaaaggaaaggaaaggaaaggaaaggaaaggaaaggaaaggaaagaaaagaaaagaaaagaaaagaaaagaaaagaaaagaaaagaaaagaaaagaaaagcccacuucauuaagcugcuucuaugcccugaaaaccauuacucuguuucauuuuuauggauuucuuuuuccuguguauuuccuauaaaugaauuuauacaguagcugacauuugagacugacuucugucucagugaggcaagcaucugcacgcuauuccuuuccaugcugaggauacccuguuguguuaauaucaaucuguccauugauagucauuugauguuucugcuuuugcuguuuguacuaauuggcuguggcaggcauggguguacguaaaauuguugggguaccuguuuucauuucuuuggggauggaacaucugaguucuauaguaauucuguguuuauucuuuuuuauugaaaauauuuuuuccuacagauuacugaaaucaaggcuuccccucugucaugucucagguccuuaccgccuuccuacucguguaauuccaugccuucuuucucucucuuuagaaaacaaagaagccaauaaaaaacaaaaauauaaauaccacacacacacacacaaacacgcacaugcaaacacaaaaccccacaaaauugaaaagauaauauauaagcaaaacacaaguaacaaauuauuaggagauaaagucucucaaaauaucacugaguuccuuuuguguuagccuuuuacugcuggcuggguguggggccuccacugagaauggguuguauauccagcuagccacuggagcagaaccauguuguaguccugccagcacuguguaaggacucuggguuuuccccacccuugcacauccuugugaguuuuuaguaaucaccuuugguuauguugaugaaguuuucugaacggccauuuguuuucaaaccaaauacuucugaauuuuaucaaguucuuuuucaaccuccauaugaccauguuugucuuuuacuuugcucuaguaaugugaaguggcccuguggguuuucuuauuugaucauccuccauugcaaucuuuaaaugaucccuacuuggucauggcucagaauucauucaauacaguuuuguuaacugugauuguuucauuuguguguggcacaugugcgcacaugugugaguguuuguggaugcaugcauuucaauccauaagaguuaaucucuauuuuucuuuguuuuaaaugucuucaccuggcuuuaguaacaaggcugugcugacgccagguaauccauuuuaaaagugcccuucucacuuuaggaaagagacauugcucuaacucugaauauuugguagauuucauccuuuaguccuagacuuuauuauuauuauuauuugauuugauucaaugccuugauguuucauagaacaguugagcuguuguugugcuuauuuuuuuaagcaaguggcaaauuguaaaauaaaauucauuuaccuccuggacuacaggccucugucuucguaugaccccucaucugucaauucucuuguacauuugucucuauaccccuguugccgcuuccaucuuucucucguagccaucaucugaugaggcagcagauccauucagcuuuccucgugacucuacagacucacuguacaucaugcaaccacccuguuagucucugggaugcagaaggagccucucucucucuguuggcagcuuugcugcuaacaaucugcaaagacuugccaccccgagucaucugccugggaguugcacuugacucuguaugaaaauccuucagugaccaugaugucauuuaacacagaaucuccaggaucugcacccuugcccuccuccccacucucugugcucauggccccuccaacccuggccuuucuggugugcucaaccccaucucucucacugugcucaccagugugcccucauagcugcugcuuucucugcuugaacaccuuucucuuuggguaucauauuguuuuguuguuuucuuauuugucuguuguuuaauucuuuccuuguuguuuugagacaaaaauuauacucuguagcccagguuguuccaguguuuuguagccacucccuugccucugccacaaagugcuggcaucuugugcuccaacaugcuuggcccuuggagcaucuuccuggccugcuccugcacucucuucugguccugcuacaauuacuuccucuuguauuuuuaucaugugccagcccucaccucauagucucuuccauguuccuucuaccuauccaaaauaguacguauuucuuuaguuauuuguuuuauuacauugcauuguucuucucuuuguuuauuacuagagugugcacauuugaagugacuugguucucucuuucuaauaccuguguccuggugaucaaacucugguuguuggguuugcuagccuauccacugugcccucuugacugccuuuauauucuuuuuuauguagaacgggucuaugaaaguaggagagagauuuuuuuuucauuuuuguuuuuuuguuuguugguugguuuuuuuuguuuuuuuuaauuauugguuuguauguuugcaagcauagaacuaaaccucauauauaaaaaggauguuguaaguauuuuuaaaaaugaacacuuaaaugagugaacuacaguuuguaagccaugucuaaaucuagcugagaaaggagcauggaauaggccucccuaacaguaguguuugaacuucugggugccaacuaaauggcauuucucuuauucucugcuagaaugcuucuacaacuucccacccauccaugacauauuaccacucuguuuuaggauuagucagauccucagaguucaucuccaacuggcaacuucuuuucaagucuuucuuauacugaccucuaagccauacuuacuucaaauaaacaguguuugcacauccucagcucucugguuuucuucucucccugcagucuuguccucucccaggagauaauucuccuccaucacugccaugggcuuccuuccacaucuccaucuugugagcccucuucuuagugcuugccccagucucuuccaggcauugaguaagcucacaucugugccucucuugguacagaguuaaugucccuacgagucuuagacuacugacucuagaaauagauaguauaugcuuugccauuuuauuacuaagucuaguggugauugcacucauuaaauauuaacugaaguuuauauagaauucccacucccaacuauggaaguacuuucauuucaacaucuuuuuucauuuuauucuaaaacaaaaucaguccacuuuucucuuagaguaacaaagcuuuaccacucggucuuugaauuggaacuaagccaggacaggguuaggaaucccugguggaggagaagaaaaggaggugccccugcugugcaguuuuaacucucccuuguuuucagugugacucuaaauggcuaggcaugcagcugauuuaccgugaccauccucagaguucuuuaauggcuauacuuaagcuaaugaaugcaaaucuuuuugcaucucaguaguacauuucaagugugcucuccaaggacaaguaaugcucugcucaggcucacacugaacagugccuguuggauuguuccugucuucucugcuguguggauucucucgacauccuucguucucuuagccauuaccaauaacuucagcaucuugcucagcuuccuuuacauccucucugguugucauuucugugauuuucccauggagacuaaggacauggacuuguaguuaguaugccucccuucacaacaaugcaccaaaauaucuggaaacuguauuuuuauuaucaaagccacuuuuauuccuuaaaugguaugagccagacaaagaggaggaagaacagccaguucacauaucucaauuuaaagugagaaccuccagcugaaaccaggaucugcccuggggaagagguauaggcugagugcagauagccuggccuuuauucuagaaaucacuuucuauugcuugggaaucggguuaaccugcacaucucccuggaaaugagacuaucuauucagaaguacaggaaugggaacugaaucaagcaauguacaggcaucacuaagagggcaucuggacaauaaugaaagccaugcuuggcacaaaagugacaagggaacaaggucacaccuccucagucauuauagagaucauguaaggcauauaauguuagauaaauaaacacugauaaauaccuaauuaccauuuaugauaaagauugaaaagggaagauacaaauaccaggcagaucuaaaggacuaauuaggaaagaauuaccuguguuugugugccucuguuuauuuauguuuaagcuuggaagaugagaagucagcuauggcgguaagagcauuuuagaagagcaaacagcaugguuggagcugauaggggguaaggaauccuggggagaaggggugaaacauggucaaagagaaggaguggagugcagggugacauuggcuagccaaggaucggaucgcaagguuuccaccacugaaaggaauugacucacuguaauaucugcaagaagacacuacaagugcugugagcagugucgacuuuggcacaggguucagaggaauaggacauguaaaugugaacacauauaaaacaauuugguacuucuuuuacaugaagauacguucuauaaaaacacacuuuaaguuccuugaaauuauucauaguuuuugagguauuuauaucgcucauaagagcccccuuauacauacacauauguauauauagauauagacagauacaugauagauagauauaaauauguagauagguauguguaucuuucuuccccucuuucuucugucaucgaucaucauuuccuuuuuguaaauucauauauauuuauggauuaaugcccugagcauucaaguuccauaugauaauacagagauaccuucagaaaaaccacccagaucaguccuuaagcugaggaugcacacugcgaagggaaaguuaaggcuguuugaggacacugggcagcgaccagcaccuggcaggcauagccaacccuccaauagcugagccucaguccuccauugugacagcucccuccuuagucucugccugcucccagccacauucaggccugauuccuuucuguguuuguugcuguuacaguaaacucucuguccuucauaaaggacagagcacacagcucucauuugccacacucgcuucacaacccucauucagagcgccaccuuucuuuaguguuuccuucaucaguauuuauuaugguucuauuugucucuaaauuauuucuucauuauuggaguagauauuauuuucaaacaaauuucacuuaguuucucucuaugacuuaaguuauugugccucacuuacauguugcuacuguauacuuuuuuauuaccagguuguuugauggcgauguuaagccaggcugccaggcugugaaauaaacugcuuauaugccuuaguuaaacaacauuauacaacaagaaagaaggaaauggaauccuggauaauaaauuugaguuguaaugcuuauagcauuguuaaccagucacaccacaaguggcuauaaugcuuaaauaucauuaaccaaucaaaccacaagugcuuuaaacucuuaacgccuugauagccagucacaucucaaguggggcuaaauugaaaacauuacaguaaaauaugucuuguguauuuaugcccuguggagagaugucaucuaggcuguaaaucacagcacuuaaggaguuguuaugaacuauaaauauauuuuauuaugcucaggaagguguauguuccuaggaaauuguuucucaagucuggagcuggagagaggaaagagugcuugaggguggugcaagccgugcaauuaaaugcaagagaugcuugagacuacaacuaacuucuuugucugggugugaaauuccauuuauucugagagcaguauuuguucuuagacccacuagcacauacuugauagaaggaauuuucauaacguauauuguguauaugacagagugguuugucaccaaaugugguguuucugguucuuuucuagguaugugacuuggcuuuuagccugaagaaaaugcuuauucgacacaagaugacacacaauccuaaccguccgauggcagagugccauuucugccauaagaaguuuacaagaaaugacuaccucaaagugcacauggacaacauccaugggguagcugacagcuaagaggagcggcaaggaaccacaccaugugaaagagcuucuacuaugaaucccagauucuucucaccugaucggcuuaacagaaauagccacaaaggauucauugaucugacaguguuuaugugccuaucuuuguaaucuauagaugcaaaaaaaauccuuuuaccaaaaauaaauucaaaauagaaaacaauaauacuuuguagauuacagaguauucuggcugauuaaaaauuaaauacagaguacggcucuugacuuucuuuuaugaaguuuauuaauauguacccauuaggccuuuauguuguuauucaugugugugaauauugcagcuaguucucacuaauucaggaagaaaucaagacaccugaguacuucuuuacagauacuacuaguaagaccauguguuuuuaaagucucaagcaugaaaauauuugauaaauagacaaggauuucaucguauuuaacaauuaccuuaaaauaaagagauauuugagaacuaaaguuucuuuuaaaauagugcucacuuuauagauuucugagaacacacuauuuuuaugcaucguucugaugcuuguauccauguuguagaacugcuuuauauaguagaaacaaguauaacggcuauauuuuauuuuuaucagacugaucuuggugaguuuuaauguccauucugagaaauuagcaguaguaaacacuccaagcuagaaauagaaaguuauuucccgccaucacaucaguuacauggagauggccccggcaugcaggaguuguccauacagguacaacaguucucagagccuugucuuacugaugugauucucaucacacuuuugaauuauccucaaucaucucaugcaguuagaaaucuagaauacca

SEQ ID NO: 3034 - RNA, 1446 nt, Mus musculus
caugcguauccugccucccuccgccaccggccuuccaacacugucuucaguugguucucucuugagucugccaccuccugcugagcugggccucagaggugguggcucaggauagguguccucuacacuaauuggucuuccuggguguagucugagagccuguggucugagaagucccaggcgcuuugugcaguagcaaaaacauccuaggcaauggcugccauccggaagaaacuggugaucgugggagauggagcuuguggaaaaacauguuugcucaucgucuucagcaaggaccaguuuccugagguuuacgugcccacaguauuugagaacuauguggcugauaucgaaguggauggaaaacagguggaguuggcccugugggauacagcuggacaagaagauuaugaucgccugaggccacucuccuaucccgacacugauguucucuuguuauguuucuccauuggcaacccugauagcuuugggaacaucccacauaaauggauuccagaagucaagcauuucugucccaacgugcccaucauccugguugggaguaagaaggaucuucggaaugacuucuacacgauacaagaguuagccaagaggaagcaagcgccugugagaccugaacaaggccaaggguuggcgaacagcauuggcgcuuucgaguauguggaguguucagcgaagaccaaagauggagugaggagggucuuugaaaaggccacaagggcugcucugcaaacgaaucgagugaagaaaaagacugguugcuuugucuuuugaaguauuugugcaaacacagucccgguacaguuaauuuucaagugcuauuuacaaauguuaugguguaauugcuagccuuuuuguuuguuuguauguccgagauuacaaaucagaagucaucuugcugucaauguuuagaaagcaaccaugauuacuaaugacauccucuaggucugaccugccaggguccugacucuucugucacagcccauucugcacuccaccugaaacaucaggcacuaauugaagaauuuauuaucucuagaaagagaaacgguaacuuugucguuuagaauguaacucuuucugaccugcccaaccuaccaucugugagcugggaagaacgcaguugagucaccacuuaagaguuuacucccuaacaacuuucacugccaucuuuauucucuuggaaaucucucuccaggcagcugugguagaguaacagcucugugguuuccugugaguuaccuuauaguuacuguguaaguagugccacuuaguguaugucaccagaaugaagaagaucuaccccagacuagauguagcauuuuugguauauuuguauucucugauacugauauuugucauucucacagcaagcauacugguugaaagaaagaauuuggaaauaaagucauauggaaaauuaac

SEQ ID NO: 3035 - RNA, 539 nt, Mus musculus
ccauagguauauaaacuauuuauuaacagcaaaggcccagagacuuauuucuucuuggauacacccacaguucggccccuguggccaguggucuuggugugcugaccgggggcacgaaggccccaaaaguggcacagcccucuaugggcucgaauuuucuucagccgcuccagguccucacgcagcuuguugucuggacuguuggccagaaccuggcuguacuucccauccuucacauccuucugucuguucaggaaccagucuggaaucuuguacugucauggguucugcaugauggugaucacucgcuccaccucauccuccgugaguucuccagcccucuuggugaggucgaugucugcuuuccucaacaccagaugagcauagcucugccccacgcccuuaauggcagugauggcgaaggcuauuuucugcugcccauugauguugguguuaaguacucguaaaaugugcuggaacuucucaggaaucacuagagacauggcggcggcacagacggcagcguguaggccuccugu

SEQ ID NO: 3036 - RNA, 547 nt, Mus musculus
gaguucuguaggcuuuuuuuuuuuuucagagcagagacuuuaaugaauauauuuuacaaauacacuggagaaucaugcaaugcugccugcguuggaugcaauucugggccacaagucugcacacuccuuugccacuggaccugugauagcagagccuuucaucucuccuuuauuguuuacuaugaccccugcguuaucuucaaaguaaagaaacaccccaucuuuucuucgauaugacuuucauugucgaauuaccacugcuggauguaccuuuuuccuuaguucugguuugccuuucuuaacuguggccaucaccauguccccaacaccagcagcaggaagucuguucagccgucccuugauucccuucacagagaugauauacaaguuuuuagcuccuguguugucugcacaguugaucacagcuccgaccggaagacccagggaaauccggaauuucgccccggaggacccaccgcguccucgcuucgacaucuugaacgcccggaaagggucagaaagucuguaggcuucuuguauguucaua

SEQ ID NO: 3037 - RNA, 26861 nt, Mus musculus
uacuuauuuaugacagacucaauuuuauuuucaaauacuuucaaucuguaguugaauuugaggaugcagaccccuguggguauaaaugauuaacuguauuuuauuguuaauuuguugcaggcugacauuuuaguacagaaaagaaauaaaaaaugaauaaugugugaggggagauaaaauaaaagaccauauuucaaacaacuugaugcaauagacaauuucugcacaaguuuguacaugauacuggauuucuguucucuccauaugcagauaacuguuuaaagacuaaucgguggauacaauuugagaagccagacauucuucaacgagccacuuugcuuguuuuugccacagauuagugagagaaaaauuaaaaguacaugaaguacuuaacugggcuauauaaugauccagagguggaaaucacaaccauaauaguccauucuugugucuggccauucuguuuagggugcaucuucaaacugucacgaucugaaucagccaaguguuuccuaacacuguagaaaguaggaaauaaaaggcaggcugugguuuguaccucaacaagaacauccucuggaggcugcucagaccacacuggccaagcaaggcauucuugaguaagagugcaaacaggagugaauuuaaagccuucagugggauucaguaccuagaucccagcauccccaagacccacucaacagugcauccucauccaaugcuaguacuuauuuauuucuguuugaucuuuuaaauaauauauuuuauuuauucuuugacaauuucauacagguauccugaucacacccaacuuccccuccuacucugccacccccaacccccaacauguuucccucccaccguccuuccuuccccuuccuuccuuccuuccuuccuuccuuccuuccuuccuuccuuccuuccuuccuuccuuccuuccuucccucccucccucccucccucccucccucccucccucccucccucccucccuuccuuggcacugaguccaauuacugaccccugcucucacccaauaguagcaucauuuuaaaaagagaucacgaugauuauuagugacucacaccuuggaguacucuagccaacugcugaguguuaccauuucuguacauccaucucuacaggacuuaagcaagucccccucagguugaugguaucuccuaucacauuuagcauaaugcuugaccccacacaacaggugcuucguuuuguugaauggcuguaagcagcuuuuguggaagcaaaacuagcccuucaaccugccaaacucuaaaugcuuacaaaacaaaacaaaacaaaacaaaacaaaaaaacaaccuguccaauuaauuuauuaugcaguacucuguccggucugggacauucaauaaucuggcuuuaccuccauuucugggaaacaaccucccuguugccccagaguccuuuaaauaugacgguggccguuuccucagaccuuucuggaucagagccccacuuuugugugggguuuggcagagcucaucuucgcagccuggggacugcggugugugguccugguggugauguauggugguggccucgcgugguugcccgggcccaccgcaccgcagcgagcugcaccaacccagccgcgggcacgcguguccugacccccgacggccgcaguugggcgcggcgaccacgucccaugcccgugggccagagcggaggggguggcggcgacagccccgcccaccgggccgugcgccccgcccacgcgcgaggggaggagcuggagcggaguagggaggagaggucgggcggucccgggagcgcggagagccggacucccaggcggcggcagcagcggcggcggcggcgacgacggcgaagagugagugccaagguagcgccgggaccggacggggcggggcggucgccgcuacuucggggccgccugugggucccgcgggcuggcagcgggcuggagcuagggagcggaggaaggaagcgcgugcugcgggcgcucugggccgcggaaggggagugggagcgaggccagccggggcccacagacgcgagagcccgcuggggcgcgaguggccccugaggcugggucuccguagcugccucgcucggccucgccccgccggaggaaggcccgggaaaagccgccaggucgcgguggugcgggaggagccggucggagccgccacgcacgccccuccuccgaucucuagacgcgcguggguuggcagccucgguacugggucuucacagggggguggcggcggguaaggagcugaucguggagagaauucgggugacacuucacgagggacccugcggcggugacuggaacaggaaggucggaguucaaacuugagccuugugugcuuuuuuuauauuuuuuuuuaaauguagcgccugaagcuuagcccguggguuuaaaaaacuccucuuuauuuuaguuagggccugucaauuaaacuucauuuuaagacgccauugcuagugucuccugacacucguuuauccuuuuaagucuguggaugccuuguaaacuugacuuaacuuucacaaagggagccgugauucuuguuaaacuuuaagcaacuggaaaucagcuggaaggaucugccgaggccuguggucucgugguccuccugugcgggcguggcugugcacaaacaaguggguaggaaaggacgcagccccacgcuugagcuggaggggagaucugugcccaugugccagggcacguuuaaacgcagcuccaaguggaaacacuggggaugucuuaggccuuguuggacggacuucacaugauucgucucauuccggucaguuauuuccucuccccacugcucuuuagacacuguuuauauuuccuggggcgaucguagcgucuccugaauagauugucuauaaugaaucuuuuggauguugucagagccaggcucugugucuguguguucucaauguuuaaagcaauagcuuggcuguguuuugagagugcuggucacccugcugcaccauugcuuggcacuucaaaccauggauguaaauuaccuccggauuccagcccuuccccagggaagcugggaaagcagucacuggagaacaguaagguuaaauuuacuaugaucaagcagucacuuucaagaaaggagggccacccuccccuuuuagaacaaaaauguauaugucagcagggucauuuuccaauaaauaagcauaugguccucacauauuuuuauauuuucucuauauuuugucuguuucguacacguguacccccuuacccucucuuucaagccccucccacugaucaccucuuuccuccccaccacauuuuaaaaagcaaucaauuguagauugcuaagugggcguuuagauaaaauauucagauccuuugccucucuuaacagucagccagcaccauaaaguccugggugaaguccagugaaugcugaacacuaaguacaaugcagcuggauugagcacaagcacguuacuguguagaacccagcacagugugcagcucuuagauuuguauagaacccuauaagaauaaggaucugugcuucucaggagacgacaagugugguauacagaggaggugcagaaagcucugagcuuauuugaaagacaaaucucuugacaguuggguugcuguugucauagguuacagaacacacauggcguucaggugaugagagcaaagggccccacaguaaaaaaaaaaauuuuucagaaaaaaguuagcuaaugcccaauaauuuuuauuccaaaccucucucuaguaggaaaaaaaagucagaacgaucucacuuacuacgcuguguuuuaacuagcuuuugcuguuguuuguuucauuuuaguguaagccuuauaggaaggugaaguucuagaaguaguuuucugagcuugacugagaggggaagguacuuaacagugguuugcuguguaggcuuucuugucagacacuccaggaugagaauguuauuuagcccuuuucaauccgauuuguaagcaggaguaacaguggucucuacuuguaguguuuugaugaaaguguaucaauuagucuuugaaaaaaacagacugaaacuaaccuacauaaagggcuuagaaugaucacuuuucuuuuuaaucuaguuuacacagcagguuacuugauaaaugauaauagguagaaccuucuggaaaugcaagaugccaccauuuuaaguuccaaagagugaugagugcuggcaggguaacucacaccuguaaucucagcaguuggcaaagccgagacaggagaauugcucugaguucaaagccaguuuggacaacauaauaaguucuaaacuagcguauauuagagugauaucuugcuuuaaaaaaaaaaacaaaaaaacuaaagguugagcagauuguguguguguauguaugugugaauguauguaugugaauaaguguguauaagcuuguauguccuguuuuacccauggcaguaugaaaaugauugaugggccaauaauuuuaauaaugcuuuugauguuguuaaauacauaguauuuaaugcuaggcaauuaggaacauaaguugcuuuuuaaguuuaaaaagaauuuuuauuuuaaauaguuacauuuauuaaccuuggauaggaaauuaaauaaauaaauaagcccagaaguaacauuugucuuuaaucaagaacgacuguuaaaguuugaaaagaugugauccaagagugugaagugguuggcucuugugugccuggcuguccaaggccagcagauaagccauaaaaguggggacuaauuguguuuauuuugaaaauuuugugagaguagaugguuaauucaggaaaugaacucacagaaucacugacuuauuugcuaaaguuugcgaaauugaaaaaaaaaaacuuuuuacucuaaaaaacaaaccccuuugagcaucugcuucuucauuaaugcauaucagaugcaucugaugaaccaagucggugacacaggagugcuagcuuaccacgauuucaaguauaaaggguacaguguucauuaugaauuguuuugagccugugacauuguguucuacuguacugaaagacuugauugacuaaaucauugccugcuuuuacuccuggaaugucacagcauaauguuggcuuacuggcuugugucccuaggugugugaaucagaugacuuaguuauuucucugugccuuauugagguugugaggaauaaaugaauuugcuagguagaccacguuggacauugccuaccauguauucaguauucaguaaguauuaacauuaagauaucuuuguacagauaaugaguaugcauuacuuuuaaaacagaaaaauggccacacaaaauuuucauauuucucucaagucaaaaaggcuauuauuauuuuuaaaauucugccaaauuguacuuacaaaguaagaaacuaugcagugauuaggcaauaacauuuugucuuuuaaauaugaaacagguuuugguuaucaacuuacucaacgaauuaauucuagaucuuaauuucaucuuccuuucuaaucgguaacucugagaagagguuuguuuuagguuacacaguugaaagacagauucagauauagugcauuauuacaauuacagcuagcucugaaguuuuuuuuuaaaggcuugaaggaagauacagaugggugccuccauuuucucccaguuucccuaguaagcguguacauauaacagaucauucauaauaguuacucaaaauaaguucugguuuauaacugcacauagcaggauuuuguugccuugggaaagaaaaaaacaccaacuuuugugacacaugaaugccaucaaauuaagggcccaugccuuccuaguaaaugagaagcccuucagaaguuuuuagguuuaucuuuguaagagauauuuagugugcauuuggugugugugugguuguguguguguguguuuuacuggcaguugaaucuaggugcuuguacaugcuacaugguucuauacacugcuacccaaucaggccuugaacguaugggccuugcauugccacuucaggugcuggggaugaucucugcuaccacagagauacuagaaguaacauagucaauaauaaagagcuacauauaagccaguccaggucuaaugccuugacaagaugcauuuauagaagagcaccuguggucuguccuggaugacagaauugaggaacaaaugggugcagugaagcucacagcaaugaccgauaagacgugauagcaguacaauugacugauucuaaucaccagacugccauccaaccugagccuuccuaagccuuuuuuaguuuaggucuugcccaguucucaacaaggcccccaugaaacuaauguuucuuaagcauucaaaccucaagggauauaaaaaaauuucccccagaguaucuguaauucuauaguugauuuagcacucuaccaagaaucacaggaggggcccauacagucagaggagaaaaaauagagggcuuaaugggagcauaugcuuugaaaagcuguaaaucaagucaagagacacauaaauagggcuucuuauguaagugagauaaguaaccagaagagaauuaugggggccucuccuuuggagcucaucucauccucagccauugcaguuggugccccuaucacaucugagacccaacaggcgugagauacauucacagaccagucuuucagagaccugugaagcuguccuuccauaggaagccucgguuggguagaagagaaaauuggcuugcaaaguucuguuccagcauagcuccuaccaguaggugcagggugcccuacauuuucucucaagggcagggguaagcagccuggagcuggggagaagguagaaaugauugagcugaagauggcuuccagcugaguuacuccauuugcugccaaaucucuuuugaaaaaucauuucucgugucacuuaaauguuucguuugucauggcagguuuuauugggugucauaaaaaugcuuagcugcgagugucugguucguauccuggcacagggaggguuuuugucuucuuuuuaauagggcugcacuucagaagguuacagaacaacgagugagaguguugcagaccuuucagauuugauacuuugagcugcucccaaagauuguagcuaaaagaaguuuuuuucugggucugucugaaugaaucaguuguuaagaacuuguacuuuuuccauuuguugauuuuaaguuugugauuuugagaccugggauucagaaaucuguguauucuguguccuuucuugcagaauaggcuguagucauuccucuugcagggaaggucguacaauaguugacaugugguugacuugcgaagagaagcuagcuugagcccagguuggauuuggguggauguggucaccaguguucacuggcaggcgggacucauugcuaucguccacacuugaaaucucucuggagaaccuucaugcagcaugacuaugugcaggccccauaagacagucagaaggacaccucacuggcugagaacccucagauuucuguugaauuucuauuagcugcugauaagcugauacugcuggccaagauaacccugaccacuugacgcuaaaccauuaguucucacuggggugcauugacucagaucucaagcucaucaugguaacuucaaauuuuguucaccagaauaucuagcaaauuaaaaaaaaaaaaaaaaguaggccaaacuggguauggcaguguauaccuauaaucccagcacuuaaggggcagaggcaaaaagguugcuaggaaauugagaccagccuggucuacuacauacugauugucaggacagccagggcuacacaauggaacucugucucaaaaacaagcuuccucacaccguuaaaaaaaaacaacaacaaacaaauaagcaaaauaaccaaaacaacagcaaaaaccaacagaacaaaaccauauacuggaguaggacuauucugggauguagauguguuucuuuccaguccacucggguguuucgguggugguaguaguggugggcuuuguuuucucaacccacagaagugcugugucugacaauagcugugccucucgaagcucauucagcuacaauacccuucuaaaugcccugaacuguagagugugacccauacuaagaacuugacaaaugccagaggacugaagaaauaaggccaugcucccugaaugugugccacaagaugcguaagccacugucuuuuugaucaaaaaaggaaauuaaauuguguuuucugggaaucauaucuucuucaguaguacacagauuauuuaacgacuuuuuucucuuggauucauuuuucccuuaaggggcagcuaaagaccugguuguccuugacauuguuuuguguugauugcucugcagcagucuugggaccaccuaauacuuguugagcugggaacagcucgugcauuccuucgcaauaauuucuguccacuaaaacacccucaugucugugacaccagaagggaggccuaggaacugccgggaaugugaugacuccuguuagguacuagacagaugugguccucuugcuguggauaaauaguggugagucuagcuauaagagccuuuggaauggcaccuuugggaaacaggcuucuaauuuaggagagaagucggaaaggcuggugccagagccaccagaagcuaugaguuucucuggaucucccuugcugccagcuggcuguuaggcggcggcuucaaguuugcugucagaauuagcuuccucuuccugcaggguuuugggaggauugggauagcaggugggaacagagcccuguuugguggguguugcugucaggugcugugcgaaggugacgggguuggucugcacugugccuucugcuauuauaugggcagaccacguggugagaagaugcccgcgugucuagaaaagcaaaugccucccgcuuuucauuugguuagauggagcagaucauccucagucuuggaucuccgaagcagagauagcaggcaaccguuccuuacaaaacuucccgguggccuccuuuaaacagcagacucaucugccacauugcagugugauuucaaagacccugugccaugcaucugcaugugcuuugcuucuugucuaacuuacauaggugauaagcagaaugcuucagcuacugcguaguccagagagcaaauaaacacuccuggcgugcugccugggaggucgugcuggcuuccugccuuugccuuccauuuaccuguucuucccuaacuuccucuggcuauaauacguaacagggacuccaggccacccacacucacaagggcagaaguccccuguccacacucacuacacucacuuccugaacucugcacggaguuccucugaccuacaaccuuuggccugagaaccuguugucuacaccucauacucauagggacaaucucuucauaagaggaaauauuaauaugugcgccccaguguaacaaucaugguagaaaggacaauacuaaaacuuugucggacaggccuuucucacgccaccuacagguguuaacuuguacauuuaaggaggugugaauguguauguuguucuucccauucuuuugucuagaugguuucucuacugguaccugccuugcuguguuaauuagcagugugucagaaauagcuucucuuucggucgcaucagcuucccauugugcagaugcaacuggggcuggggauuguaucugauccuugggccguauguccugugaagacagcuuaagcaugccauuuugcauacguacggguguguccccacaaguggucugcagagccacugagcucugugagcaccuucgggaaguauuggaucagcauguugcucauagaccaccaguaagaggacuguugggucuucuuuauucuccugaucugguuccugagaagugacaguuuggaguagugauuuuuuuuuuuuuccacaauuagaagugaaguggaaguuugaguuaaguaugggccuuugcgacauuguugaggcugguaaguucucuugugggacucuguaacuguucuuguguauggccugucagaauuucuuaaauacagaccuaaaagugugagccuggguggagugggcugccagaucauuaguacagaaucaagacaaguacaaaguaugguuucucugcauuugcuaaugucugaauuacaggcuucagcuaaugcuguuauuaacuuguggcuucuccaaggccacaaaaaaaauaucuucuagccuagaauuucuccucuccuuccuucccuccucccccauacacauacagacagacacacaacacguaaugcauguacauacacauggguguguauggagauugaaaaggagauuaaaacauguagacuccaauuuucuguagaaaucuuuucagaagucuagacuuuuucacauuuuuuuuuuaucucuaggaaggucauacaggucaaauuaguuuggucuuauauuugguuguucuguaugauuuuuauaaccagggagguauuugauccuuccaagguaaaggagaugaaagcaaaaauggcuuaagaggaucagagcuccgcaugcuaggaacaugaacggauggagcugcaguuugcuuuugagaugccuuuuuuaaaaggaagauucugucuguccuugugucccagugucugugugagugcaugccgugugugugcuguggauccuguauagcugaggucagugaggagccuucugcuguggguucuagggacucagcucagguccuuuggaaaacaggauucaucuuaccccugagaggacuuuucagccccugcacgugcucuuuagucaguaaacauuugggaugcuguuaaucuaaaauuaauuuucaguuuuuaaaagacugaauucugucaaaaaaaggggaaccugauuuggugaagagaaagcugugguccuuuuuuaaauuuguuuuuuuuuagaaauuuguaaaaggcaguccuauauaaagcugguuuaccuguucauaaaaaauaaaccaucugggcauggugacacaugccuguaaucauacccuucaggaucuuaaggcagaauggucauaaguucaugguuagccugggcugaaagauugaaaccagugugggcuguccagcaaaaccuuucucaaaagcaagcagaaaucucuaacaacaaacucacaguucacuagccguagaaggagugaccaaggggaaaagaucaccucucucuaucucucuugcucucucucuugcucucucucgcucucucgcucucuugcucucucacucucucauucgcucgcuugcucgcaugcaauggagugcuguggaugguaacuuuucuucuagugcucauuguaguaugucacaguugaugcucuuugcuguaguguccauuccacaaggaaaagguuagagccuauuacuuuaucccaggaccuagaaggauacccagcaccuuugagugcccucugggucuucguauucgacgugucaaggauccuguguuagaugcuggccugggcaccaucuuugaccuuuaugguauacucaaacgcuugggagcuguguggcagcauacuuaaugcuucagaauuuaagccugcaaucugaauuaccugauggcguaauauaauguccacuugcaaaacaguugacagguguauuucagguaaucuaagaugcugucaguuauggaauaggccauuucucucagcuaucagggaaaagaaaugcugucaguuaaacuauaucagguaucagcauaagaggguuaguuuugauaacugcuauaacagauuaucaaaaacagcugagacaaccagauguuuuaucucauaguucuguagaucagaagucaggguaugugugugacugguaugucuccuugaaguguuggccagcuuggcuuuuguuagagguucugggaagaauuucccauuuaccucaggcucuuucagguuauugguagacuucuguucuuugaggguuguuccuuauugucucucagugggggccaccugcacuucuuagagacuuuuuugguacuugccaugggcuuuauaccuuagccugggcauuagcacggcagacccuucuuguaucuggauuuuaaugggcccuucuacucucuguucucuagcuagggaaauuaccugcuucugagggcuguuuggguagauuugguccagcauucauagguuccuggaguuagaggaccugaacagcuuaggaggagaguuccugagucauccuaauaccagcaguggcaaaaugacugucucugucuuagcauagaggagugacugaugcuuauacagcauugggaauguuggaaagcaugcuugaguguuagcuguuuccauacaaaugccaugaucacagugguggcacaacgccugucaccuugaaccuuggugcauuugucaaacccuaauuaaaagaaugcauuuugcugacagcaaacuugauaacaaagguagagauuaguacuuaagugccagagguaggcaugugcuaggacacuuccuuacuccuuguaggaaugugagguaggguacaccagcuccauuuacaggggagaaaguugguuuggaagggggcaaaaaucagugcuaguggcauuccuccuaugaaucccaggauucuaaaguugguauacuuuuuauguauucacuuggcucacugucccggagaauagcauaugaaaagugucacaggagaggcuuccacucacuggagcagguggucugcuagcuaggaaggagauaaaggggaaggcacauuuuccucugauggcucccuuguuuguucuugcuauuuaaucuuuaauucauugagacaagagccccaagccuucauccuuuuaaauacccuaaugaucuucuuaagucaacaaagcaguugccugauccgugaagauauggcuuuaaaaaaagauaugagcaguucuuuaguaaaaccacaccaacaguauccauacaggacaggguaaguacuguggaggucauagaacuaggagucaggagacuaggaggacuuccuuaauggagaaccucagggaaggccucuguguaaaauaauacuucugccaagaccagggugugcaaaagguagccugagcuuaccuguaaucuuaauguagaugaacacaaagaaagaaggccuuuuugguaggcaugagugagaaguucagagagccagaugauggggcuggaaugcgacucauugagagugccugcauaguaugcauaaggcccugaguaaaguuauaagcaacacacacacaccaugugugcaccaugugguaucaugaaugaaaaugucucccauaggcuuacauguuugaaugcuugguauucccaguuaguggaacuauuuggaauggauuaggacggugugcccuuauuggagacagggugucacugggggugggcucugacauuucaaaagccugugccaggccaagugucuuucucucugccugcugccuguggaucaggauguaacucucuuagcugcugcucuaguacaguguggucugcuuccuaccaugcugaucauggacuaacccugacacuguaagcaagcccccaacuaaaugucuucuucuauaauugccuuggucauggggucucuucacagcaauagaaccauaacuaagacacuggguuuaaugaaagugccaacgagauuucauagagaaaucucuguucacagauccgcuauagugagcugggagccugugccccagacaugagcuuuguaugacuucaaagggguggaaguuuuggaacuauuuuuaauucuugccuuuagccccauuuuaaguguaccaaagcauaggggaugaguaggaggguggguuggcagaagcagauaaaaagagaggaugcuugagcucagagugcucagggauccgccacacguugugccaagagaauuacuucagguaaacguuuuugaaagcugagcucaucaucccuuugagucuaguuuucuuuuugcccuuuucaggucuuuucaggaccucccccucccugcaaguuguuagacucugaaccccugaguuaucugaucuccuuucucccugacacuuccuucuaucccaggcagccuugucccuggccacuuccuagccagccucucucugccccugacuuuugcacucugcugucaccaggugauuucucugaaaugaaguucugagugguuacuuccugcaugacaaugggcuccccaaaauuaccauccugucuggaaggaguuuccuguccagguucaguccagcuaugauucuuaccagcccugaagacuuaaaaucacuaccccuaaaguggaggugccagugcaccuacccaaaggcaaccuguagauuuaaaaggaguuaauagugagauucagucagcaguguuugguacgcgcacccucuaugaacaguauucgauagcuacucucuguguggcaagcccagcuggucuagccugcugcuuucaggucagccucgccccacucuuccagcaggcagcaagauaaguacagaauuacuuauugggaagauacaaucaguaaucucuguagcagcuucacugucaaugaauucgcauauugcccaguuucuaggaaaucuuuuuuauugcauuuuacaaaaguguucuuccgaagugaguugguaauagccagucaguuuuuuacccucugucugcugaggucuagugcacacucacuaagcaccuaucauaagguuugagaacacaaggaggguagucaacuaugagaagguuuuucuuuaaccauugagcuucugccuaucucguugacccagccuaaucucguguauuguugacccauuaagaagaugugucugaggcacaagugauguauguaguccucacuguucuaaggucuaugaggcaaggaguauaaggacagugucggggagacugagucugucugagaagggcuaggaggagucaggaaugguuucacagguuguuaagacagaggcagugugacagaagauggagaugcaugucuaaugucaagacaguggcugaagccucgcuguaauacuccagccaugugguugaacaacuuccucccaaagucugagaccuuuccuuugugacccaaggcuaauagcaucugccucucucaagauugcccagaagcgcucgaguaugugcauguagaaaagugccugacuucagaguuuauaaauugcuacagagugaguuccaggacagccagagcuauacagagaaacccugucucgaaaaaccaaaguaauaauaauaauaaaaauaaauaaauaaauugcuuggugugacuuugcucucuauacuuuaaucugggcacauuaauauauuuucuugucuauguuuacuguaacaagcuagucaaccaguauacuaaugauuacauuggacuggauaguuuugccuguacguuuugucuucucaauauguuggaucucaguggcauauuuucauucauaguaugacaggcauguuaauauauauaagucuauguuuugagauguauugaauuaaggaacagauaauuugauaguuuucagaagcuucaagaagaaucaggucaaaacauuaauuucuaccuuacagguagggaaacuuaggcacuucuagauagcuucugauauuugcccagagucauuuaagauggcagaugaauggcaaagauaggauuagaagccugugccccuuguuuuccuggcuuuauauuuucuugugaacucaaucccaaggcuugagagcuuggccauguucagccccuuguugucugucaccuggcuucaaccaggcaugggaagguugagugagccagagccuagccuaagggagagcccuagggaacaccccacccagcagccucucggcugcccugaagguauuuaugagugugaagguccaccuggaaaccgagggagaggcugggaagagcaaccagcuguagcugccagagaguggaggaagggagaagaggccuggucccugagaguaaaugacuuguaacuaacuaggguccagcaggaggagccagguggagcucaggggauggaaagccauguggagaaguccaaagggcaggggaggcugccacagacugcuucuugguacacaagccuucuguccucucagagcauucccuuuuaccuucugcugggaagcaugcgcucugcuuacucacucacuugguguuguaaucuuuauuguguaggcaggcagaggggagggcugcgcacacaggaaggcucugaccuuaacccuccugacuugaaacaguugaagaguguuugacauuguguuccuuuaagugugucguuuaguuagagagaaagcggugcucagggaguaggauccaacagcuuuccugaagccaaaguucccagggugugggucacacgcuugucaacugggagugacugaaaaaucacgacacccaaccgcacccagaccuguggagucagcccuucugggugugauccaaaggcagugccccuguggagcucaagcgagguucaguguaagaaccuuguagggugccagaugaauucugcucugugucaggacagaaucagucccuggcugcucaagagucaggaauuccauuugguuuucucaucuacauaugaggucuccgaggagccuuugagcacagauccaugcaagccccuuccuugaaauuugucaggccuuguguaauccacccauuaaaggggguggggucaaaccagaaacuucuacauuuaaauuguuacugcauccucuuguggaggaacaaaacagaaugcccucagaggaauacugucuguuuccauuuccacacaccacagcucagcacaggugaggcccacaguuccgagugccaucagcugaggcucugaggcaggucagcaaguauuuuuccagagaagacaggguuuuaauauucugagacauugaggguuaacucuugaccaccuugcuauaacauggaguauaggagcaaauuguucuuugaaggccacguggacuuccaguuuuuaugagaaauuguuuucaugcuuaacaugaaauucauguccagcacauuuaauuuaucugugacuuucaggaaaggcauguggacuauuugaauucacaugaaaucugcaguuuuagguucaaggccaaacagggucacuuuucuuuuuucuuuucuuuuuucuuuucuuuucuuuucaauucucuucucuucuuguuuuucuuguuuuuuuuuuguuuguuuuuaacaaauguuuugcuugucuugaauuucuaaaccauauguguuucucucucucucucaagaauguucccaaaaaaccugaaaguaggcaucccuugagaaauuuaugcucacaaaccuguuaauuauuaaaaaugaaaucuaaaggauacaacuuggucuugaaauguuuaugacauuugauuaagagaaacuguuguuuauuguaucugcuuucccaaucucccucucuuccuuguuuuuauuccuuuguuugucugucuauuuuuguuuggggguuguuuuguuuuuguuuuuguuguuuugguuugguuugguuuuggcaacucugccucuguagcucaggcugaucuggaacugacuuuguaguccaggcugguaguaagcuauugauuuucuugccuuggccuuuccaauccaaggacuccaagaaugagccccuauacccauccaugcgcuuacacucgaccagguauugaaaccuucuaaagaaaguguaauuaauuuuacaaggagaaaacuacaguuaugacaggcacacuggcuuguccaaggaugcacauauggacagcagacuagcucaggcuuuuuguguugguauuuuauuguuguuaaugauuaucaguuauuuuucuuucuuuguaccuuugaaagacucugucuuuuauuggucacaagauuguucucugaaguauauaaaacacaaaaaguauuuccagcuuucuaaagcuugaggcucagcagagucagcauccucaguauaaaguccggggaagagauggcagguugagcauccgaagagccuaccaucauaacaacuucgugggguggaguugccaggacccacucagucucuguuuccuguaagguaucguugcuaagaauccaccuguaguugaaguuucauugguggaugucuuuaauugacuguuacauugaagucaaaggcuuuucuaucuuguuuuuuguuuguuuguguuuuuuguuguuaauuuaucaaaaaacacugccaaggggguuuaagaguaaauguugggaaagaauuaagaguuugguguucuccagaacucaaaagaaaagauucaagaauggcagucuggaaggguacuaggacaagccuggaagcuguuugcuauacaggcacaaucccuuuuuucucuuugguuguaugucaccaaaauguuuuguaaugauuuuuaaaauaucuauugacaguauugaaaaagggguuuugcauguuggcaaugcagaagccugauagauaguuuauaaaucucagcccugccaccuucaacuugugugaccuugaagaacuuacuuaagcuuuccaugucuagguguccucuauggcaaacuagaaaugaauuccugugaggugugaguuaauuaucaauguguuuaugacuguauuugacacuuccuauugccauuuuaauuaacugaagcuuaauuauuauaauugcuggagccaggagagacaguggggggaagggaggaugcuaaaauugccacaguccagccuucugugaauucucccaggauaaauaauucccuuuggugcagugauuugagguuuuuguuuucauuggcauggaacauugcuuuugaauuuccccaguagaguauagugagaucaccaaaccacuuuaacccaugcuggcuuagauagaacucacuguguuggccaggcuaaccucaaaaucauggcaguccuccugcuucgacuucccaaguccuaguauuagaggcauaagccacuauuuaccucuuaaaacacacucugucuuauuuacuguucuauugcugugaggagacaucaugaccaagguaacuuacagaagaaaguacuuaguugggagcuuucuacauuuuagaggguugauccaugaucaucagggugggaaggagacagcauguugcaggagcaguagcuaaggguuuugcauccuguuccacagacaguaggcagagggagccaggcaacuuuagccuccucuauccuccuuccccuccauugucucuccuggcuccugaaauuacauggcuuuuguaaucauaaugaccugucugugccuugguuuccucauuuauuagcugaagucaacaccugagaugugggauuuguaagccucaaaggccacucucaacgauacaucuucucuaacaaagacugugccuccuaauccaacccaaacaauuccauuaaguggggaccaagcauucaaacauaagagccugugggggccauucucagucaaaccaccauacucuugcauucaucuaucuuccaagaggugggaaauuugcaugagauguuuuccauggguggagauaaaggcuggaagcaaagcugucagagcucuacccuagaaagaaauaaugcgaugucuguugaaaagggccuucaauguuuaggcauuaauucauacuuaucucauaaccauaccauuucuauucuguagcaaaaagaaacaaaacucauucuggagaaacaagaauuucguuccuaaauugcaaacuuuuucuucuguagguucauaugggaaggacuuuggggugagcaucuucucuauuuccagcuggcuuuucuggugaguaaagucuuuuuaugacugcuucauauguuaacuuggauauacuuaaagcaugcuauugaacuuggacuuagugacugauccugcaggaaguacuaaguauccaaugauguucuucucuuggucugauuugauaaggggucaacguggacaggauagauagauugaauagucucccauuugugagcagaguucuaggauguuacugcagaaagacuuuuuuaugaggaagaguggagggaggcucaguuuugcccacauucauaggccugcuugaaagcagcuccaggacucccaguccagcggcaggagccagcaacuacagccuugucucacacagugcaggcugcggcaucugugugguagggcacccugcaacuccgaacugucuguucugccucgugugggagccaccauacauggcucuugaguguuagauguugacuguguugcuuucucuugcucaguugagaauuuaaauguauauaauuauguccauuuuggggcuucaagagggaaugaguuuagccucgugcuccucauuguggcccagugggaggccgaaccuucuccccuuucaaaggguaucucuugcccagugaggcuggacgagggaucucuggggcccccucuuuggaugcuuuuugauuagaucugcuuucuacuuauaaugacaugucugugccucuguguccucaucucccagcugacguuaauaccugucuguuccucccagauguguuggaagaagcuugcacuuuaaaagucauggaaggagcuuucuucacaagcuuuuuuauuuucuuuucaaaacuaugcuguugugucuggaagcauuucgguuugcauacucguuauggauugggucucuguucucuaagacgguguaguuggaugaacucgguguuuccaggugauugucacugugagaccagagacucaaagcccuccacuccugugaggcauggccugggaaggcagugaggucaggcugacacggccgagguaggccuucucuaaccuggcugucacccccguaaggugcuucaucucagaaaccaaagcagaugcccuucccuugacuuugauggggcuucuagugcugugaucaaacaccaugaccaaaagcagauugaggaagaaaggguuuauuucagauuauagcuuuuauagcccaucauccagggaagucagggcaggaacucaaggcaagaaccuggagacaggaacagaugcagaggccaugaggagugcuacuuacugguguguuccucauauggcuuguucaaccugcuuucuuacaccauccgaaaccacagugagccauucugguaggggcauuuucucaauuaagguucucucuucccucuucacucuuuggcuuucugaucuuuagcagugcuaagucucaauuucaguauuuggugccuuguuuucuucagcaaguaaaacucucucaggugucaaugucgauauggccggaguagcucucagacuuauauucuaagacaggaauuuuagcugguagggcagagcauccaucagucaguagauuccauuugcuucaggaaugugccauucaguuuugacaagacagcuuccucugcagcagcagcaagcuggguccagggaaguaacuacacuaguacuuuuugaaagguuugcucuaagcagaagguaucaucacugaaacagccucugugggaaccugagacauuggucagugagaagggguauagcuauugaugcuccuggauaccccagggauauuacuuuauuauaccagacucugcuuuauauuacaguuuauggguauggugagcuuuuuaauuuuuuucagcggcaccgccaaaaguuguagugugugucucagugacagagauguuaggguucagucuuugggucccauuuucuauagguuuugaaaacucuguaaccuauauucacuacuguaguguucuacacaacaguugcguagcccuggaagcacucuguucucugugugcuuccauccuccuucagcgccaaccccagcaaccacuguuguuucuaccgucucaguaguuuagcuuuuccagaguguccaccaguugagauugccguaauguauaaccuuucaaagugguuuauccuguuuaguaauaugcacuggauauuuaucaccugcuaaagguuuggcaauuguggacaaacuacacagacauucauaggcacauuuuugucugaauagaaguucucaguucauuugaguaaacacccgaggacacccuuacuggauugugugguagggcugccuuuacuuuggugagaagucagcaaagugucugggccucuuugcauguccauuguuagcuucuguggcccuguauccucaucagcauuugguauuggugauguggauuugggcuguucuaguaggugugcaguauaucagacggguuguuuucuuacuguugaaaguauuuaacugcuugagggccauggcauggaccaccagguacguguuguacugcuuacugccgauuuggggggggggauuuccccccucuguuugauaauaggucuuuaucagaaguuucuuuuucaaauauuuucauucugccugugguuucucuuuccauucucaugaaauggucuuuagcagagcagaaggguuuuguuuuccuuuucguuuuaaugaggagaagcgcauugguucucuuugacuggaucaccuucaguuauuucugagaagucaugcugcccccacgcacgugugcgcgcacacacacacacacacacacacauacacccaucaucauuuauuuuccugcugcugugguggagaggucucaauggcaggaacuagaagcugcugaucacaucacucccagaauuuggaacacagagcaaugaaugcauguggagagcaugaacuauccaguucccaccccaggaaacggugccuucugcagggagcaggacuucccacuaaaaugaacugaauccggacagccgagauaauuccccacagauaugcccagagcucccucucccaggugaucucagauucugucagguucucaagugcuguuaagcguuacuacccaagccuucccacacgcuccuagaguagcuucugguuuuuaguuuuuaguuuuaccauuagaucaucggucuugaauccugugaaggcugugaggugucuccucugguuugguuuuuaaugcuuuugaugagaagguucuuuauaccauugcccuuuuuacuucccugucaaagcuuagcagacgguauuuaugagagucuguuucugacccucuuuccauugcucuaacgacacuuuugucaggaccaugcuaucugauuacuguagcauucugagucuugcagucagacucaguccuccaaaguggcccuuuaauagugauuuuccaggucuuuuguuucucuguguacguguuagagugaguuuauuaauuuaaaaaguaauucuauagauuugggggaugguaaagaucaaguugagaagauuugcaaucauaaggucacugcaguuuucucucuaugagcaugaacuguucauuuauucaguucuuugauucauuucaucagaauuuuguacuuuuucuuacguaguguuuauagcucaacauuucauuuggggaggugcuaauauaauuuuaauuugaaauucaacaugaucauugcagauagauagauagauagauagauagauagauagauagauauaauaaaagaaguuguauccggcaacuuuccuuugaucacuuacuugacuggagacaaguuuuguuauuuuuuucagauuuauagaugaucaugucaccugugaacaaaguuuuuuuuucaucauuuauuuaugaguguguguuuguguguguguaugugugugaauucaugugcacauggguacacacacagguuuacacuucaaggucagaggacaauucuggguagucaguuuguucuggggaucaaaguuagccugccagccuuggugguaagcaucucuauaucucauagauuccuguuuauuuuuuauuugucuuucugguuacauuagcccuuugaauacaauguugaaaguaguggcaguuugucaucagaugaauggauuuaaaaaguauuuuauauguauguauguauguauaugucugguagaauuugaucuugcucuaaagaauugaaaguagcgagauucagaaagacagauuuugcauguguucucauauguagacuccagauuuaaguuuauauauaaacauauaaacucauaccuauguaggauguggaaauagaaaggggacuauaagaagaaaacaguagauguaaaugaaagagaagagacaagaaagaaaaauaaaaagagaggggaugagcuagagagacagcucacaguuaagaacucucuuagagaaccugagcuccgugcccagcaccagcugucugugagucuagcucugggcaaucugacauccuccucugcauccauggauccugcauacauacacacacacacacacacacacacacagagagagagagagagagagagagagagagagagagagagagagagagagagggagggagagagagagagaaagagaaagagagagagagagagagaaugaaucaaccacaaaugagaucuuuccggaagaaagagaagaaaagccaugggagagggcauagugaucuuuucuaauuuuaggaaagcuugcuguuuaaaucguuguguuugacaccacuaaacguucuguuaacugcaguuuuugcaguauccuugcuuuuguuuuuggagauuuuuaagggggagguauuuuguuuuugucuuugugagauggggucucacaguccuggcccauuuuggcuuggagcucuguaguuuaggguugccuugaagugugucagcccuucuacuagaguuucccaacugcuggaauuagggcauucaccccacgcugcucacuguggggacuuuauagacauucuuggucaaucagaggauguuuauuuccagcugacagaguuuuuauacauauuggguuuuucuaagugccuuuacugcugaaaaccaaacauguuauuguguuuuaucugucagaagccuauuauauauuacauaauuauaucacaagaauauuuccugacacaaaugucagccuuuuugugaauaauacuguuuuuaucuugauaacuuuguuuucuaauuuuacaacauuauuuguaacaaaucuuuuucucuauuauaaucuuugaauuagugcugauuggcuacuguauaugucuucccaguaacaaaaccagagcucucaacacugaacaaauauguauauauuuuauaugggguaaaguacagaagcuaugcaggcauguucuaccaaggcccuuagucuuuggauuuucuuaauugauuuuaaaaguuuaagcauuuuuuugagaaauaauuaaagcauauuuuaguaauuuaaugauccuuuaaauguacuguuagucaucucucuucugaaccuacaauaauguuugucuuuuuagccucaguuuccauaguuaacauuuaaaaaugccagauccaaaccauuccacuaggaguucaaagaacugagagucagcaucucaguaucuauagucucuuaggccugauguaaggaaagucauugaauaucauuggcuuuuaacuuccgucccaaauuuaacaguuaauuccugauuuggcuuggccugacugaggaccuggaauagcagauuuuuggaaagaagcggugggcaggggcagggcaugguacagagagaacaguaacaaagccauagcucccacacaugaaagacacaaguccacgacuaauccugagguguuuauauucacaggcauacauguccauggcuuaauuuccugucaguaauaguaauuuuagcacacauuaaguuaaaaauacuaaaaugacguugucaaagauuuuguuaauaagguuuagaaauuucaguggcagauuuaauuuuccugcauauuguuuuagauacaaaugacauuaucucaucaucaucacagcuagagagauguucacuggcuacggccauuuuacugguuuugcagaggaccuguguuuaguucaccuccaacacacacacacauacacacacacacacacacacacacacagcggcucacauccuuucuaguucccauuuucuccuaaaaaaaaaaaaaaaaagaaugcacagauugggggucacagauugggggucacagauuggggguugcuccgucuuagcaaaggaguguaugaguugaggcugguuuauguguggauaugggaauuuccuagauuuuuaggccaagcuggguuucccacacuguuuuggcugggcugcaugccuuugggaaugucagguagaguagguaggcucacaguuuuaugcuggacucgaugugagcaguuguuucagaugcuccugugccugggccucugucauggugaacacuccccuucucccuuccgccgcuuuugccggggcuguguuacacagcaucaugaacauacacuaaguguguggagggaugguuauagcuaagugggggauccuuguggagguuccaggggcuaaaaugacaucauuagguagaggcuaguggucugcuaagaaaaguguucauagucacaaggauuggacacggggaugggcuaugaguggguuucugggggaaugaaacuaggucaaggugguuucagucuggucugcaacacuuaacucuccagggucaggaaguucaaucaguuggccuugcagaauuguuaccacacuugcgccuuuuguuuuuccuucuguaacuuguuuaugauaaaguagaugaugacucugaagcacuucccgugggcuggcugcugugagugugcugccucagggcgcuugcauacagauagagaggacugcugcuucagccgugcuccaguuccuuccggaugcucucccaccuuccccaug

SEQ ID NO: 3038 - RNA, 2364 nt, Mus musculus
cacaauuauuccauaccaguuuauuuuagauaaugugcuucaaaaacuuuaucauaaauaaccuuucacaucauaaaauaacuuaguaagauuuauaauaaaacuucugagaauuuaacaucucaucaaaauacauuuaaacuguggcuugaaaauaugauuaauccucuuuuacuuuccuuuuauuugagggcauaaagaccaaaaaaaaaaaagaaaaaaaauacccaaacuauugcuauacauuuaaaguuucaacaaagcaauauuuggcuuauuugaaaguaaccuggccauccuaaauuagcaguuuucuuucuugcagugcuuuguaguuuuugucccuuuugccuuggauuucucuuuucucgcagcuuccuucuucaggcucaccucucucucccucugcaaagucaucucugagcccucgugcaguugaacucggccccuugacaucaguuucuguaauccuugcaucagcguggggagugacugcuugaguaacuacaaagguauuucaaaacuucagugcaauuugguucaguuauuuccauucggaugccaucaccguuccgggagauuaaucacgggcacccacugauccauguagcgacuuucccggcaaaaacaaauaaguugacuuaaggcaggauccuuccauugugaugaauguggguucugugaacagauuuugaaaaaauuacuuccccggaaaauaaucagcuucugcuacuaauugugcuacuuuugaaagggccaaaccccgaacauucuguuaaaaacagcaucuagcauagucuaaacaccuguaacgugcacggaacuacacagaguuuugcauauuaacuaccccauucugcaugagguuaccauucuuaagaccucccuuccaagcauguacccuggugggucauaaguaaaagacuccugaaaagcauucucaggcugugugcacggugagggcugcagggcaggcagcugcugaacucuuaucuucccugacgaugaauagcacauuuuacuggcagcaacaaguaaccaggcagucacuucccuacacaagucagaagagaaagaguacaaaaacaaaaaaccagaagaccuagacagcacgguucuuucugaaaacacuaucaacccaccacacauuuuuaagcgguggggaggagggagcucguuuaaacaaacucaagagcagcaaagaaaagaauuccacucgguacacuucagaguaucuaucuauauccagggaauuaauaaggucugucuccuacaccacuucuaccuuuagcuuugacagcaaaugaagaaugaagcuaacuucuuaacgaaggguaaaccgggaauuuauuuggcuuuaucuaaucuguucugcucaaagaauuagccacgcgagguugugcagagguaagcagagguagcagcugggcagcuugcugacucacagggauaucuuccgccgcuggaggccacccacgagcuuagacacgcuccguacccuaucacaacccccgcgagaucagcguucagcucggacaagguccaccccagcagauucugggcugcagccccgggucucuuaccgucaccagcacacagugcagguccggggucugcgcggcgcccccgcucuccgccgggcccgcgucguucuccaguagcagcagcucagcuagccgacccggguugcugacccgcaggauguugaugucguucucgcagcagaacgcacggaugagggugaaauggaucugcagagccacaucccggucgucgucuucgucagcagccagcaggcacaguaccacguuaucggggucucugcgggcagcggggcagcggugaguugcauacgcucaggggggcgcgggguagaggcgggugggugggcgagcggggaacgcgggccacuuacacguugagcagcuuggcagccucguacacgccgaccguaauggugcgcugacuccgagccuugcugagcacuuccuccagggcaucgcccaccguguccauccugcgggcggcagggugagagcgggucagccggguccccggacgcgaggcgggaggggcggcggccaccgagucggcaggcacacuuaccuuucggucuucugcucugcagccgagaauuccuccaaagucauauugcaagugcgagucccucccucggcgcgcgggcugcuccuggcccccacagugcgcggcgccggcucugcgcucgcucccacccucccuucuccgcuccggccggccggcugcucgccuagccucgcuggggaacucugcacugcugccucggggccacuggaggacaaagggcccgauuccggagauauggggcuagcccucagccaacca

SEQ ID NO: 3039 - RNA, 59914 nt, Mus musculus
gagacugaguaacugcuagauccuuggacuuccauucacagcugcgacugaaccauuguugggaauugggcugccgacuguaagucaucaauaaauuccuuuacuauuuagaaauuauccauaaguucugugacucuagagaacccugacuaauacaaguaccaauuuuuaaaaauuuuaccuaaccaaaaaaaauugcauuuuacaugagauaaccugguuuuguucauuaacuaagagcuaguauuguuuguuuuguuuugucuuguuuuggagacaggguuucucuguauagcccugguuguccuggaacucacuuuguagaccaggcuggccucgaacucagaaaucugccugccucugccucccaaguacggggauuaaaggcaugcgccaccaccacccagccugcucacuuucucucacugguccacuuuguauaucccaacuucacucugcccccuccccuaacuuucccagaaaaucucucagcucuauucuguagccaacucauuugcuugcauaccucaaauaauuauuucccaagacuccuuaggaacacaggacaagugccugcucccucacaaccgaucaaaauaguacucucccuuugagacuuaaguagaggacaucccuucaauggacccauaaucauuccuucuaacaaagauuuaacaggaaaaaaugaaacaccccugcuaggccuuuuuuauauccugucagaguuaggaacgaugguuuccugcugaagaucuacacuuuucagcuuccuuuguggacugugaaaguaaguuucacaccgaaaagugcuaucucccaccuacuucuguaggugccuuucccacaaggagaagccacacacauccaccauggguggcaaaaugcccccucacagugaauaaacauccugcuuaaggucagaugaagccugucuuuccaccuuccaucucucuauagcugcuuaaauugccuaacaguggggaugcuggcagauuuuguguauuugaaugucaguggacauaaucaaacuuuauuucugcagugaagugugggaagguuccuaugauguggaauuacauauauuuauauguguauacacacauauaugucuauaacuaacauacacacacacacacacacacacauacacacgagcuuaguuuagguuuuggcacuucauggacacaggcuagguuguguuuagccaucaaauaacuucugaauagaccaaaaaccaccagccaaguuucaguugagaacucuuccgauuccuaacuugcgcagugaauccaaaugcaacacuuagaugugcaccuucugucagaugaaauuugugcuuaccuaagacguuccggacugcgggccuugccccuugugguuucuucacugaccauuuuuauuuguuuguucucaaggagucuuaagguaagagaaguccuucugaaguagagaaaggcauacgguaccuacaaaaccaguuuuccauuuacaaggaugcggccuugucugggagagcagcacaccuguggaucuguuguugccgcccucaccgcucccgacucuucgacagccuguguccuuuucucaugcugacuugaccacauuccuggaauaauuuauuucggggguggggggguggggguggaggguggguguuaccuccuuccuugggugaggaccuccucccugagagagcaaagccuugagggcugaggaaaucccgcccugaaucgucauccucccccccacccccccaccccccacugcucauguauuaaaauacuuauuguuaguaacuucacuagugcguggugggcauaaugaaugaagcauccuagccagcggagcugcauguucaauuucuccuuacaggaaccgugguguagcauccacaaauggauagagaaguuauagaagucuggcgaagcaggcaagagauggcagggcccugaaauuacaaguuggcuaggauagcuuugguuuuauuuuuuagaauaguuuuuauugauccuccaucaagccauuucauacacacacacacacacacacacacucacacacacacacacacacacacacacacacacacacacacacacacagaguccaucuggaauauggauacaccuuuuaggugugaaaaaucucagaagggagguuaggaacaauuuagcaggauauccuuacuugguccagauugaugccuuagacacagcuguugccuuuaucuguuccccauaaccaucaaaucccuccuaacagaaccaugccaugccuguaaaggaucaucucuaugaucuuugcugaaggcagggggauaugaggucaguguuagacucucuacuccagcucagccauauaguauaugcccaugagcacaucuugcguuugcucgaaacaaaaugauaucaaugcuacuucauucacaggaaaacaaauucacacucaaaaguuuggggacauccuucacacauacugugagguguuggagauagauaggaaacaaaauuaaaucuuucccuuuguuuucugaugggagagcagagaauaaccuaagcaauauggcagauaguaauuaguauaaucgagaaagauacauaaaaccaggcgagaacugggauucagggagcaauguaucaguuuaccuagggagcucuaaaaagccuccauaauuagccgcccuccuuguagagucugaaaugagaguggagaguauccugggcuggccugagaaauccauuaaauaaugagggaaauuuaacauaacauuuggaauacgcgggauguuguauccacauuguuuauauaauccagaaggcagucuguguaauuguagaaaacacgacaggaguuaaaguaaguuugggguagcaaagaaagaguugaucauuuuaauuguugugccuggacauagcaaacauacuuuugaccaagaaggugugcuggcgagggugcucuugguuuuuauucuaaagaagguggugaccauuuccaauuccccauuggcugggguccucacagucuuauuuaauugacuacucugaaaagaacuugugccuaagaaauguaaauaacagcaaggggucucuguuucaaggagaaaaggacaacuguaccaagccaacaauuuucuagacuagagagcagugggccuuugaggauacaaaaguuuuacuggguagggaagauuaaaacauuuacaaguauuaaaaaguuggaaagacucaaacauuauuuuguuuguuuguuguuuuuuuuuucuguuuuuuuuuuuuuuuuuuuuuccgagacaggguuuguccuggaauucacuuuguagaccaggcuggccucaaacucagagaucugccugccucugucuccaagugcugggauuaaaggcaugcgcuaccacugcucagcaagguuuuaauuccuuguccuaaacacgaguuuuauaguaccugauagaaaacacucauaguugauguuuccuacaugaguauauggaaauaauugaauaaagaggugacucagaugguuugcugcacucauauuuuguugcaauuuacaggcaaaaauaccucugugggagagagauguuuuaaucuagcauaaaagaugcugagagguaggggguauguucuccagcaaacauucccaacucugaaguugccaugugcauugaacuauuucccaucaucaaccauaauaaugcugaggaggacguuaaucaugcuguuuauagguuuguaaaugcauuucuuccaaagaccucaaguguuuaauggacaugaccuaauuuacccucacaagucuagccuccuuuaauagaugaggaaaccgaggcauaaagaagcugaguaacuucuucaaggucaagcauguuccuagggaacggagccagaugccagaccucugcuguuucugccuagcucugucucucuagaccuugaagaugaugugcaugcaucccauggcacuaggugcuucugugucuaccccuugcccauugcauagccagugaucaggaaugguuauuuuauguuccugaggaaggaacuucuuuaauauugcuaaaauauuaacuauauagcaugucucuuugagagacaauuuuugcuuauauguuaagauggcauaaauaaauauaaauuuugauugauaagggaagcauagauugggaauaucguuuucucagugaaagccagucaacaggagccccucccaaaguaaggcauuugaguugaucaucuuuucuuaugcuuggcauuggacguacuugaauucucaacuauacucuauaaauuagaaaacaaauuauucaaaauuuagguauuuauguaaugccacagaacuaauaauuaacaaagcugacauuuaaucccccacaucauuauguuuacugagucuccacaucuuccuuuuuguuuguuuguuuguuuguuuguuucuguuuuucaaaacaggguuucuuuguauaguccuggcugucguagaacucacucuguagaccaggcuggccuugaacucagaagucugccugccucugccucccaagugcugagauuaaaggugugugccaacacugccuggccacaucuuccaaaaagccagaccacccaguucacacaucuuauccuauccugugaucugaugauccaggaugagagcugagucaucauccugcauaaaauguuagcaaauuuuaaaaauuauuaugcaaaauuugaauauuucaauauuacuauugucaaccuuccugguaaaaauguuuaauagguuuaaaaguauacaacuggccaggcgugguggcguaugccuuuaaucccagcauuugggaggcagaggcaggcggauuucugaguucgaggccagccuggucuacaaagugaguuccaggacagccagggcuauacagagaaacccugucuugaaaaaccaaaaaaaaaaaaaaaaaaaaaagaguauacaacuaaaauuuggaauuuugucucaguuuuauuuuuucccuuugcucauuagaaugcauaauggucagcuuucuguacugacauuuuagagcaucuauuuuucuauuuauuuucuuuuauguguauggauauuugacauggauaggucuguguaccguguacaugcugauacccugaagggucucagauacccuggaaguggaguuacagacaguugggagcugucaaguaagcacugggaauugaacccaaguccuccuggaaaaauagcaaauacuuuuagcucugaaccaucucuucagccccuuggagcauagaguugccagauggaaccucugagcucugaggaaguucugaaacacacacaauaugauaucacauccuucucaggaggagccauguaguaacaugcuuugagcaccacuuuuacuuuaacuauuuucaucauucaaaaugaucaaaugauguaaaaaauaagauuuguaaaaaacugauguggcuggacauggugguacacaccuguauuuccagcacuuagaaggcagaugcagguagauccaugugaauucaggccaaucuggucuagaaagcaaauucuagaacagccagaauuacaugguaagagccugucucaaaaacucaacagaaaaaaaagugaauuauguguauauaaucuaauaacucaagcaacuguaugugcacaugaacacagacacacacacacacacacacacacacacacacacacacacacacggagguaugaaaaaagguacacucaaaauacuagacaaauaaaauggaauuacaagaccaggcaaugguggcacaugccuuuaaucccagcacuuggaaggcagagacagguggauuucugaguucgaggccaaccuggucuacagagugaguucaaggacagccagggcuacacagagaaaccgugucucagaaaaaaaaaaaauggaauuacaaaaauguucaacuacuagauaugauugaugguaaauaccuguaauuucagcauucagggaccugaagcaggacgauuaugaauuugaggcgagucugggcuacacagugagauccugcuucaaaacaagcaagcaaacaaaaaaauaacaaaagguuuuuaacuagcucacaggaaugcagguuagagaaaaaaauuaaaaauuaaaaaccuaucaagcaggcauuguagcaccuccccaguucuaucacuguagagacugagaugggggaaucuuaugucagaggcuagccuuacccauguauugaguuugaagccagccugggcuauaucacaguagcuucuccaaccacaguauaaucaaauuagaaaagcagaaaaauaacaagccucuccaaagugguaaauucugcauaaauaauucccagauuuaaaaaaggcagucuuaagguuuuuguuuuuuguuguuguuuuuguuuuguuuguuuuguuucauuuuguuuuguuucaaaaagauguagaaagaaaugacaguacaaaaaauauugacaucuguaagguguagcuaagguagaucuuggaggcuuugcuuuguccuuugaauucccuaguacuuuuauuucucuguagcaaaauaggaacguuucugcuuuaagucguuuucucugcaucaucuuagcuucugggcggcaauguccuagucuuuuauacugcaguuguuucaguguuccauaaaaguuguuuuaacaaguuaaugacuagacauaccaagcuacuuagcuacauggaauugagaccaaaucaaccccugccuagagcuggagugcccagggcacuccugugagggauggauccuucuucccugggaaccacugcacaggcaccaguguaaaugacugccuggucugucccaggacagcuucuuuagcuguacagcagcuaagagugcauucagcaaugaacgaucaaucagaguaggaaauauucgacacauauaauuccacauucuuguccucaguaaaaauaauuucacuaguuaauuaaaucaggucacagaccacagaucuagcucaguggaaguguuuauguagcagcauggaggccagagcucaacccagcuuugacaaacugucaggcuccacucuucucccuugccugccucaauucuguaauuuuuucccaugccuccuuccuauucuugcucuacccaugcauccauaaaaccuaccuucaaaaggaccauaaaggucauuuauuacagcuucccauucaauaacuggauacacuuuagucagggaagcguuaagccacaagcuuaguuuggaacugacuggacugagaguacucugagaaaagcauuuaucaugaaucaaauuagaaagcauaaguacgcucaguaaguaaguauggaaaugacccugaaccuauaaagacagacugaaaagacagguauccucaaaaacuggacaguucuggaaaggugagugugccagaaucugcggauaguuguaaaguucuaaaagaaugguaaagcccuaacgucacagucuucacacuccauuucuaagauucuguagaugaugugaaauuuuauuuacuuuuucaaucaaaaaaaaaaguaauugauuuguauguauguggguguuuggcuguauggaggugugugcacucugugugugcagggccuauggaagccagaagagaggaugggacccccuagaaugggagguaacagaugguagagagcugucauaugggugcuaggaauugaauccaggcccucugaaagagcagucagugcccuuaacugcugaaccauacuuuagccccacuucaaaaaaauuacauuagcagggugguggugaugcauaccuuuauucucaggacuuaggaaaaagcagaggcagggggaucucugugaguuuuggucaguuuagucuacagacugaguucuagaacagccagggcuauacagugaaaacaaagaaacaaaaacaaacaaguaaacaaaaaaaaaaagaaaagaacaaaaaagucagguagugauaguguacucuucuaauccuaacagucaggacacaaaggcagacagaucuccaaguuugagaacaauuugaucuacagaguaaguucuagaacagccagggcuauacagaggaacucaaccuuaaauaaauaaauaaauaaauaaauaaauaaauaaauaaauaaauuucuguguguauuuguauguguauguuugugauaugucauucauguggcgaucaggggacaacccauugaaguuuauucucuccuuguacaguguguauccuggggcuuuaacucagguuaucagauuuggcagcaaauacugugccuucucuccagccccugaaaguuuauucuuuucuuucacaacugauaaugcauucaaucaucugaugcauccaguacacugaaguuagauuucucagugagaaugaggaaaaggcugucuaggguguaugugagguguguguguguguguguguguguguguguguguguuggcuuugguaaguuuaguccauuugugccugaucuuuucuugguguauuuauaacucaggauaugagaugccagugugggggaaaaauuugaugaugauaugcaagugaugucacucugguauaauuuugagauucucagccaacuugccuugcuuuuucaugacugccuccucagaacaguuaacacugucuucauuuagcuccugagagagagagagagagagagagagagagagagagagagagagagagaacuugggaucccugggguuacccugugugugugugugugugugugugugugugugugucugucugucugucugucugucugucugucuaauaaggaaacauacuuacaaauguuagguauggaaaccagucuuuuauuuauuauuauuauuuuauugucauuauuaguauaucacacuauagccaggugugguggcacacgccuucaauccaagcacucgggaggcagaggcaggcggauuucugaguuggaggccagccuggucuacagagugaguuccaggacaaccagggcuacacagaaaaacccugucaaaacaaaaugaaacaaaacaaaacaaaacaaaaaaaagaaacuugucucuuuucccuuuuuuucucuuaaucuucccucauucuauccuucggaugauggugagaaaauuuaaacuuugguguguaauuaagccaguauuaaaaaucuaaaaugucaaauuaaacugaaauaaaauaacuauagggcagcaagcacuaagagagcguuuugcuuuucacccauaaucauuacaaagcaagaaaagugcagacaccucaaucauuagcccaucaaaaccucgcaggaggcacaaucccgguaaaucaggaucuccagggagccuagccuguaaagcagcagcaauuaccuugcuucucugaagucagcccgacuggaggcugagugcugcccuagccucacuccagguguggaagaaccgguguuauuaucgcuacuuaagugcagacugucagauucugcgcuaagaacgaagaaaaccagugggacuugucagucaggugcccaacuaaaguuucccagguuaugcgcauagcagugaggaaagcaacagcaguaguaaacagugccaagggagaauggaucaaaaguuugacuggagugugguguggugaugcaggcuugcaguauagcuacuugaagguuacccugaacuacccaggggaguccuguuucaaaacucaaagcgcaaaacaaaacaaaacaaaacaaaucugucuuuccuuggucuuaaggcuuaggcaccuccccaucacccacccccucgcacccugcaccuuccccgcaccccccccccccacacacauauaauuaucguauuuguuugcucuguauguguguauguguuuccagggugcaaguauggagaagacaacaaccuacaggaguuaguucucuccuucuaccacguggagcgugggcguugacugcuggucuuuaggcauuggggcaagucagucuauuugaauuuucguagcugcugagaugcuaaaguggaaguuugggauuugggaggcuaucuuagggccguggagcauuuguaacuguggcuucuagaguggcaguauuuggcacuagucacuaucacgcucagccgaucuuucccaguucugugcuucagccuacucuugaauuauucuaugagaacucucucacccaggcugaaagaucaguguucauuuccuuccucuuccucuucugauaaccuauugauuuugccuaggagacuuaucauggcugagucuccagucuuacuaucaacacccuacccauaagucauuucaccaaaccuccaagcuggggaaaaaaaaaaaaagugaaaacaaaacauuuuuaaagucauuaaaaauuuuaccuuggagcaagaaccugagacauuuuuuuaaaaaucaauuuuuaucuguacauuuauauagucugugacacucuuaacuagucugaacuacuuuugugaucucaaacacuuuuuaaacgaaccuaggagcaggguguguccuucuaagaggaguauuugaugugauggaacgaggguggggcugaagcguuugggaauaaauacauuuucacaugcgacauaauccagaaccaaacucauucccuacggggcugaaguggcaggacuggcuucuauaaauagacaggcgagcucggucuggacucuuguacaauaucaucugacagacuggacggauaaaacgagccgggagagaacuaagcaggggagaggagaagaaagagaggaaacuguccagcgagucagaagaccccgcggugugagacgcuuguagcuaggcugucuuuuccagguuucacaguacgggcuugcagaagagccagcagggcuuucuggcucucuccgagucacacgucacaggugcuauuuacagagcugccccagggguccagcuccacggggcgcuuuuugaugugcucuauuaaggcuagacaauuucuaagacagccaacagcugcuaccaguuuuuaaagggaaaggcuaacgcagcagaagagaaucacacagacuccugggaguaaaagcuuuuucaucaccuugcgcuggcuucuggcugggagcuaccacaaugacuucuuagcagcuuuucaugagcccagugcccaaagguugagaggucuugagugacagucucugagcugugccucagucauugcuugguucaucuucuaugcaauuaguguuuguggggacucugcgauuaggccacaggcuuguguuugcuuccguggucaaaugaguugcugagguauggagaaguuucuagaagccuuacgcaauuguguuuucauuaaugaguaccugcuucaucaaaagcacgcggauuauauuuagaaugagcaaggaacuaagaaaacaagacacaauaaauaccuguugaaggacuaguggaacaugguguuuaaaagcaaacgcuuuugaccuccgugggguucaagcuaaguguagcuuaaugaccuuugucaaguucaagcuuucuaaguaagaacaguugguuucuaguuuaaucacugaacauacaauucauuuaacuucucuaagucuuguuuuuucucaacuauaaaacgagauaauuauacaugccuugucuacaaaguugucaguaggaucaaaugagauaaugucauaaaagcccuuuauaaauuagaacauacuauauaaaugcaaacuauuauuaugcuuaauucuagugacuagugaauaauaaacugguggaaccaauaauccuauuguccccgacaaguuccacccacucuaccuucuaggcaccuccaccuacuucuuucucugccuuucgugaaagauggggaagagaacaccacagacauuucccuaguuaaguuucccaaucacagaucuaugaagauguaacuaaaagaaaaaaaaauauguaguuuaagauuacaauugcuggggcuggugagauggcucaguggguaagagcacccgacugcucuucugaagguccggaguucaaaucccagcaaccacaugguggcucacaaccauccguaaugugaucugacucccucuucuggagugucugaagacagcuacaguguacuuacauuaaauaaauaaauaaauaaauaaauaaaucuguuuguuuuaaaaaaaaaaaaaagauuacaauugcuuaguuuuauugcugggguuugaacccagggccuuauacaugcuggaggagcacucugccacggcccagacaacucugucuccccuccuucccgacaaauuucgucagccucuuugguggugaugcguaugaucuguacugagaagggacugaaggcaaaagguaaagucacaaacacggagcuaccagggaguagcuucggggcuucucucagacccuccuucugucuccuguagcucucugcucaggcugauccagagguccuuuaagaaagaaguaaaagguacuuagggaggcuagauggaauuugaacuuagauuauaacaaauuauaacuuauaauaaauaauaacuauaaaauaaauaaauauauauauaugugguguagagcuaaauuuuggucaaguucauuaguucaagucucaguuucuucaccuuuaaaauggaacguaaucuauuuuauaggcuguuguaagacauaaaagaaacuucucugccaucauuauucauaaugcaacaaauguugcuucuaauuagagguagaacagguaauguagauucauccagauugaaagccagagauaaagucccagugauccaaaguguagaauuagagcgguucccuagccuuccucacccagggcaagcaaguucugcuacugcucagaagacguuagacugagguggcugguguuuauuuuauugaucacauuuauuuauuuuguguauuguggacauauguaugccacaguaaauauguggagaucagaggaaaacucagaggaguugguccuuuccucuuaccauaugaaucccagggauugcacaugggcugucgggcugcguggcaagcaccucucuaccugcucagccaucucaaugguccuugaguuaguucuuaaauauccccauucucggaugauuuagacuugcauccuuuaaaauagcucagacgucaaucacacaacucccaguauguuuaggaaacucuaaaccggaacuuggaauuuaaaguggcuuucugcaucugaguccaaaguacccaguucccucagugcauaccagguugguuucacuagauugauagcgacaggaauaacaugggccagcagcagguguuccuacuggcuggagauuugaagaggacuagccaggacaagucagcucagcaugcaguggaauugccuuuggugguuuagggcugccuagcugagagaauaacuugaguuccugugacacacuugccucuucucacuccccacucacuucugaguaacuucacacauucucaaccuuuccagcagauccccaaaucucuguccucaaucuagggguuucuccuaagucuaaguuauuaucuguggucuucuggugucauuuggaugucccacggguaccacaagcucaccagcucccaggcugauguucucacccauauauccacagacuggccucuacccaguguuugaugccuuccacccagagaucucuaucuuagugagcgaggcauccuccacccagcuguuuuaacagcaggugguuuuugacaucuuccucccacagccagucucucaucaagcccaagcauuucuaccugcuaaacaucucuggaauucaccuucucuucaccccuguuucuauuagcucaacuucaggcugugguuaucucuugccugaauuauuauuguaagagccucuaaacugguugucuuauacacagccccaguaccaauccauuguccacaagaggaaugguuugaugcauacaagucuaauccggucauccuuuccuugaaaagaaaauguuuuguuuccaagugcucagagaagaaaauguaagguccucuaagaccccugugaucuguugaggugacucccucagcaucacuucuccuugacccuuuuuguuuuaccgauggucugauucaaccuuggguacacauuaaggucaccuggagaguauuuagaccguccucaaggcuaggcuguguugaagaugaauaaagcugucugcccacucaucuuuuauucuuugcacacauuguugucuuuacugaaacauuuucuuccucauguuuucucuucucgcugcauagaugucacacucguccuucaucccucaacugggguauuauguuguccucacucucucaagcuuggcgcuuuguccugaaaugaauuuaaacuuucucaaguaaaaauuuccccacaguuggguuuugagaugugucugaagagagugaaggccagggucucaccauuuaauguggaugaaucacagaaccagagacagacucuguggguagcaucuuggcuugugcccacacugccucucuuccuucagggcaccagaauuggagaauaaaaucuagaaucuggcuaugcugugucugcauggcauggaaggaauuaauuaccaucaaagugaaugauagucaucaaagaaggcaggaaggaaaaggggaggcggggagggaaaucagagcuucccuucccuucuuuuuuuuuuuuuuuuuuccuuuugucuacaguagucauuauacuguggauuuguggauucagugguaaagaugacagaucagacccaggagagugauaagcugcagucagaaugcaaaggcccaagaaaaaaugcuagaaaguaaaaacugcugaugaaugagagugaggauuuuagauuggguguuucuggaagguuccuuguuuauguggacuaggaaaggcaaauggucagccaugccacaaucagagagaagagaauuuccuacucaaauaacagcugcuacaaaggccuacacagaagggagcccaggaggaagacaucuaaagcaaaaauaguacaaucacuggccagccagaagaugcugagaggaagguggacuaaggacugaggugagcaaagacuggaucacaugaaacuuauggucuacaauuuauuauuugacuuuuaguaggaagacaacaggaagcuacaggauuuaacuggcagggaagagaucugauuugugcauagucugugcaucuauaagugguaucuuaacucuggaauggcagugaacuagagaagggaaguaggcccccuugaagaaauaaaccaucucucacaagugguugcuuggucugauuuaguuuggauuguucagaucucaaaguugaauguguuuccaagggucuacucccaaagggccagaaucugaagaguuggcucccggggcuggugucgggcaaauccaaaagaagucuggaauaaaccacuaauuauggaggagagaguguguacauuuauccuuuccucuaaaaagcaggaaacagaagaaaaauauucguuggaaucucucccugcagaagacaugguauagucuguucccuuucccgaggaacucuugcucaguauccuuccaaaggcuuaacaaguuaaccccguucuaguuuccugaacugacuuuccaagacguugggaucugucugauuuuucuaucaugguuuuuggcuuuguuuucccauucugucucuccacagagcccugaagauagcaauuguuugccuggcucuacaguucucccagccuuugucccucugugguuucuuuccuucauuccacuuauuucuaccaaauuucaucuggacaauauucuguguaacagaggagggauuugacuacuguagacuauaucuaagccucugcuucccaggacacuacuacccaguuccccaaauccagggcaacaguagaaugugccugggccagccugcuucuauaaauaaccugucacaaaguuaccaaaggaaaauuugaugauucagagcacagagccagguuuuccagucucuugcuuuaguacugguugcuaugacguugugcugaaagccauauauacaagugguucacacugagugaggacauguuaugugccuagcuccauaccaggaucccaguaaucccagagauuuaugaucuuuuuacaauacaggcuuuauugucauuuuuuauugucuaggcucuguggaguugaguuucccauuugaugaaaguaauagagaugagauucugaguuggccaggcuccaaagccuccagggauuuaacugcagcuugcuuauccuggguuuagccaucacaucuuuccuucuaugaguucauugccugauauaauucuuucaagauuauaauuacaaaagauuauccacugugaacuuaauggaagcuacuacugauugucaacaugacacaaucuggaaucaccuaagagccaggacucugggcaugccuuucagggauuaucuagauuagguuaauugaggugggaggagccacuuuaacuccuggugacaucaugacaucaacugggggccuagacugaagaacaaagggaaagugagcugagcacaagcucucaucacuugcucuucuugagucuagaugcaauuugacuagcaguuuacucaagcgucugccaaaugacuuccccacuaugauggacuguacccucaaacugagagccaaaguccauucuccuuuaaguuacuuugaucagagaauuuuauaacagccuuaggguaaaguaacugauaugaacuugauuauccaugcugagauauuuuucuucugagaauauauggcagaacaaggguugaguugaugacagauccaaagugcuggguuuuaauucaaauaaucuuauuuccucuacucaauuaauaggcuucuaaauaccacaagugaaaauguuuaucuuggaguuauauggagugcugccaauauuuuaacuauuauauugaacuauuuaacuuuaaaaaucaaacaaacaaauauguauuuguuuuaccaucaggaaauaagaaagauguuaaaguuaaagggggaaaguggaggcauuucguggacgccgcaaguggagaacguaugugagagcagacccagaggggagcugggcggaccugucagaguguuagaauuugagcuuuggucuuuuggacccaggaucuugaaaugaaauagugauuccuguccuguaaacuguaagguuuauauaggaaucuuggaaacaaugggaacaagacugaauuauaccaggcuuuuggguauuauggaccacucugaaguguguggacugcucaaaacccuccuggcuuugccuucauugaauuugaagaucccucaaauuugagaugcugcugcugcugaaaagggaaguggaaauuauggcccgccucucucuuggcguugcugcccuugaugugaucaccgcaggaggaugacuccaccugagcacagaucuccaagaaggagaagguucuaccaaagccagagcaggucacuuucuuuuuucuuucuuuuuuuuuuuuuuuaagguuuauuuacuuauuauauguaaguacacuguagcuguccucagacacuccagaagagggcaucagauuuuguuucggaugguugugagccaccaugugguugcugggauuugaacucaggaccuuuggaagagcagucggcgcucuuaaccacugagccaucucaccagcccccagcaggucacuuucuagagauaaaagagacaggucuccaucuaguaagagaaaucacaagccaucucuggauccuucucaaggucucauagcugauuuaggucaaaugaaagaaauaaaagaccaguuugcaaaggaagugguguacaagaaguacuuucauugacaggaguauguauaagaaauuaaaguuuugagauaagcuugguacauuuuaaagauguucuaguuguucaaauuuguuuugucuuucagaaaagugacacgcaaaacaauaugauuauaguuucgaauggauuauaugagacauacgauagcaagaauuguuacuuuacgauguucccuugagcaagauugaauuugcuuugaacuuuaguuuuucugaaauaaacccagacucugcccaguuaaagugugauguacugaugauauagaaaccucuggcggaguuugacuaaagcuguaguuccucuaguagcugagacacggugugguccuguggaugaauugauaagcagucuuuagaggcugcugugaacacaaggcaacagggaaaggguaggaacggcacccagaagguuuucaaagcgguucccuccugguugaggagcugcuguacauuguagaguugaacuuuugaguuaccgugcaagauuuauuuucauacugucauuugaaauauguuugugagaauccuuggguuaaaguuuugguugcaaauuguuguuuaacuuaaaagccuguuuucucuugcacacaaaucugugaacuugguaucaaguccagguauagcauuccuauuagaagccauauuuguauuuucuuguaaagugcuuuugaauuaauaaaacacuagcauaaccauguaguagucaguugagcgaacccacugcugccauguucuuauccuugggggaaaagagggaaaauggaaaaaccaaagaaacauggaauggggaaaauucauuuagauugucuuuaagcaagcugauaaguuacuuguguagaaaaucagaucagccccuccccuuccccacaggguuuccuuguguagcccuggcuauccuagaauucacucuauagaucaggcuggccucaaacugacagagauccaccucccagugcugggauuaaaggcaugcaccacacuuccuggcuugcagauccuuauugugaauuccuaucugguugaagguugaccucugugucugcagcauguggucugugugcugaacagacauagaacuuagggaugcuagcuuguuucagagaucagacuggauuacauuagauaagacaucucauacacuuuuaaauaucuaucugucuguuuuaggauuuuauugcugugaaaagacaccaugaucaaggcaacuuuuacgaucaaggcaacucuuauaaaggacaacauuuaauuagggguggcuuacagcuucugagauguaguccauuacugucauggcaggaaacauggcagagagaaggcaggcaugguccugaagaaggagcugauaguuuuacaucuugaucagaagacaucagaaggagauuguaucuuauacuggaauuagcuugagcacauauaaccucaaagccugccuucacagugacacacuuccuucaguaaggccacaccuccuaacagugucauucucuaugaccaagcauucaaaugucgcuaccgucuccgaccagcagaaaagaagcgacgaaaccgacguccuucucaaggcaguuuauucagaaacuucacaaugugcaggaaaaagaaugccccgaccucucucggccauuccccuuuauccccuccaguccacucccccucaccccaguccacauaggcacaguucauuggcucaggacugcauucgucacaucauccgaucuuaugucguggugcaucugugcaaugcagcucaagguacguggcuaucuugagauaugaggaagucaggugacagucauaagacuuggcagcaguccugggcgccaucuuggggccgcggccacaccagcuccucacauuuaaacauaugaaucuauggggacaugcccauucaaacuaacacacuccacucccuaguccccguacgcuuguagccauaacauaaugcaaaaugcauuuaguccaacuuuaaaaauccccauagucugucauagacucaacaauguuuaaaaguccagaguuuaaagucucuucugagauucacauaaucucuuaacuguagucugcagacacaucccuaguugcagcagcuuuccguaguuacagaagaaaauuucauaaucccuuucuucucuccuugauucuaaagccagaaccaugugacugaagcuaccaaguucuguugcuugcuggggcugaaacaugaccccaucauucaauuacaucuucaccagcuuucaguuuugaugguuuccgucucugcuuaacauuggcagucacagaguuugcucuguaggucagguuggcuuugaacucagagaucugcuugccucugucuccauaguucugggauuaaagguguauaccacccaugcuuagaccuaagcuuuucuuuaauuccuuuccacaaauugaaugcuuagcugggugggauagaguccugaagucaccucucccuuaauucuacuuaaugucuuuaaucuguuuaucuccuugaacacaggauuuaguuucauucuaccuccuggugccacuuucauccuugaaccauacauuuuguauuuuuccuugcucagcuugcucuguuucaucuaaauacucuucauaagagugaagcacaggacaaagucuguacuagaccauuuugagauuuccuuugccgaugcaaaauuaaucuaaaucuucucaccugagccucaggcagacaaaggcaaaaaaaaaaaaaaaaaaaaaaaaagcagauauuccucaucaaaacaucacaagaaugaucuuuaggcaacauacuaaaauucuucucugaacuuuuugagccaggcccccaguucaaaucacccucaggcuuccaugcuucuacugguauggccuguuaagcugugcuuaaagaaagcauucagcugcuuuucuaacucagugcaccaacauccacauuccuucaaaugaaagcaaggacaggccuauugcagcaauaccccaauaccugguaccaacuucugucuuaggguuuauugcuguggaaaaaacaccauuaccaugauaacugugguaguuugaauagguauagccccauagauucaaggguuugaaugcuuggcccauagggaguugugcuauuaggagaugugaccuuguuggaguggguguggccuuguuggaggaaauguguugcuguggaggugaggcuuugaggucuccuauguucaaacuacacccagugugguacacaguauuuccuugcugcuugcagaucaacauguaaaacucucacuucuccagcaucauguguggugccauguucccugccaugaaaauaauggacuaaaccucugaaacuauaaaccaacccccaauuaaauauuuuucguuauaaaacuugccaugguuaugguaucucuucacagcaauaaaacccuaauaaaacagcaacucuugccgggugguaauggcacacgccuuuaaucccagcacucgggaggcagaggcaagcagauuucugaguucgaggccagccuggucuacagagugaguucuaggacagccaaaguacacagagaaacccugucucgaaaaaccaaaaaccaaccaaacaaacaaacaaaaaacccagcaacucuuauaaaggaaaacauuuaauuggugcuggucuauaguuucagaggauuaguccauuaucaucauggcaaaaagcauagcagugugcaggcagacauggugcuggagaaggagcugagaguacuauaucccguucugcaggcaacaagaagugaacagguuuguuucugagaucucaaagcucaccacagugaugcaccuccuccaacaaagccacaccuacuccaacaagaccacaccucuaaauagugcugcucacuaugggucuaucagggccaucuuuauucaaaccacuacauuccacuccuugguccccauaggcucaugccauaucauaauguaaaauuguauuuauuccaacuucaaacacccuuaucucaauccuguuuaaaauuaguucaaauuccuagauauauucugaaauucaugcaaucucuuaacucuaauuuuccacaaaacaaaaauuaauaggcagaucucauacuuucaacauauacaggcacaggauauuuauugccauucuaaaucggaggaaagggaaccuggugaggaaauacuauuccaaagcgagaccaaaaaccagcugggcaaacuccaaacucugcaucuccacauacgaugucaaagugcucuucagauuuccgacuccuuucagcuuuguugacaauagcauacuucuccuucucaggcugguuccacuccuguuaggagcucuccuuggcagguaucccaucacucuggcaucuccaacaucuuggggucucuaagacaauuuaaguuucaccuucacagcuucacacaauggccucucuaggccuccaagcacagacaccccugaccuagccucagcagcuucccuaauggaggaggaagaucgcauaaucccucucuucuauccuugacuaaaaccagaaccauguggcugaaacugccaaguacuucuguuuguugcggcuggagcaugccucuccuuguucaauuacaucuucaccagcuuucuguuuucaacaguuucuuucucugcuuaaacuuggcuuacaaaacgguuucuuucuaaaacuugcucugcagaguaggcuggccccaaacucagagaucugccugccugucccuccagagugcugggauuauaggagaacaccaucacacuuggcucuaaguuuuucucuuucuuuuucuuuuucuuuuucuuuuuaaagauuuauuuauuuauuauacguaaguacacuguagcugucuucagauacuccaaaagagggagucagaucucguuacagaugguugugagccaccaugugguugcugggauuugaacuccggaagagcagucaggugcucuuacccacugagccaucucaccagccccuguagcugacuucugacacaccagaagagggcgucagaucucauuacagaugguugugagccaccacguggaugcugggauuugaacucaggacccccagaagaacagucagugcucuuaaccucugagccaucucaccagccccuaaguuuuucuuuaauuccuuuuuaaaaacuggaagcuuaacuggaugggauuuuguucugaggucacccaccacucccuuuaacaucaggcuuuucuguagucaguuuacacauccuggugucccccuuucuccucaaaugguacauuuucuauuuuuucuugcuuagcuugcuacuuuucaucauaaaucugaguaaguauuucuacuaauaaccaagcagcaaagucaauacuaggcuauauggaaauuuccacuggcaaagcugcuaaugagagcucuucaauuuagccacaggcagaucuuuuggacaauggcaaaaagcagacacauucuucaacaaaauaucacaguaacagcuucuaggccacaugcuaauauucuucuccucugaagccucuugaacugggcccccacauuucaaauaacacuucgcaccacuaucuuccaugcuccugcuauuguagcccauuaaauuaugcagacagacauggugcuggagaaggagcugagaguucuacauguguuucugcaggcagcaggaugugaacuuguuacuagccaaggccauccugcccacugaguuaugacuccugagaguucuucuguugccugccuucucugcuuuauuuauugguuaacauaauauuucauuuuauuuuguuuacuaaaaacuaagaggagugaaaaaagaugauaucaaacccuuaggcucucaaccauguuacuguggaccuacaaguuggauaguuaaaggcuucagcaguauaaauggagcaggucuuuuuucuuuaucucuuucuuuaucuuuuucuuucucucuuucuuucuuucuuucuuucuuucuuucuuccuuucuuucuucccuuuuaaaaaaauuuuauuuauuauuauauguaaguacacuguagcuguuuucagacaccccagaagagagggucagaucucauuacagauguuugugagccaccaugugguugcuggaauuugaacucaggaccuucggaagaacagucagugcucuuaaccacugagccaucucucuagccccucuuucuuccuuuuaaacaagauugcuuuuuuuuuuaaauuuauuucauauauguguguacacuguuucugucuucagacacaccagaagaggguauuggauccccauuaaagaugguugugagccaccaugugguugcugggaauugaacucaggaccuuuggaagagcagucgaugcucuuaaaccucugagccaucucucuagccugcagauugacuuucuaagacauguagauuuugacuuuccacauaagacccaugcccaagcauuugcaauagcugccccaagucauagaagaaaggacucuuaugccugugaaggucuauauaaagaaggaaugaaaaugaagauccacguuagauccaccacugguauccuaucuuaguuaggguuuuacugcugugaauagaugcuaugaccaaagcaacucuuauaagaacagcauuuaguuggggcugccuuacaggcucagagguucaguccauuaucaucaaggcaagaacauggcagcauccagacagguguggugcaggaggagcugagaguucuuuauuuucaugugaaggcugcuaggagaauacugauuuccaggcagcuaggaugagggucuuaaagcccacaccuacaaugccacaccuacuacuccaaaaaguccauaccuacuccaauagggccacaccuucuauuagugcuacucucugggcugagcauauacaaaccaucacauucuacucccucacccccaucuacuuguucaaacauaugagucuaugggggccauaccuaaacauagcauaaugcaaaauacauuuaguucaacuucaaaaguucccauacacuauagcagccucaacaauguuaaaaguccaaaguucacagucucuucugagauucauccaaucacuuaacuguaaaccccaaagcaagacaggaaaccagcugggcaaacuccaaacucugcaucuccugucugaugucaaaauguucuucagagcuccaacuccuuuuucaucuuuguuggcugcaacaaacuucuuucuccugggcuaauucuauucccuguuaccagccuuccucagcagaagccuauggcucugguauuucaaacauauugggaucuccagagcaacuuuaauguuguuacaguuucauguuucaaugucugggauccauacaugaucuuugggagcucuuccaaagggcuggugucacuuuuccagcucuucccucuguagcacucuaagguugauccauuccacugcugcugcuguucuuggugauuaugccaugguaccggcaucuccaacacacuggggucuucuacugcaacuaggcuucaccaauagccucucauaggcucuuuucauggugccaagccucaaauccuuugcaugaccccuuagguccuggccaucaacugcaacugagguugcaccuucaccaauggcccuccauggccucucacagugccaagccucagcuugucuccuugaccccuuuaugguuucaaaagcagaaccacauggugacucuuacacauuaccaaguguagcuguagcacgagguacaaccuuggcuaucucuggaacacagcuucuuugugcucucuaagagcacuucccagaagauuucaccucagugaugcuggucucuucuuaaucaccacuaauuucuuagucccagcuaacaaguaucaauuguuccuguagucccuucuaguuuggacucuaaagccagagccauguggccaaagcugcugaguucugcugcuugcaggaccuggaacaugucuccccugcucuauuacauuaucgcuagcuuccucuuuuucaacucuuucacugccuaagcuuggcuguccuggaucuugcucuguagauugauguuuaacucagagaucugcauaccuguauccugagauuaaaaguguguaccaccaugcccgaauucaaacuuuucuucaccuagaacuugcucugucucugccuggccuugaacucagagauaugcuuggcuuuaucuccuggaauuaaagguguguaccaucauuccuggaucuaaauuuagcugggcaggaucuugccucaaagucccacuuccuuaauuuguuaucuccuugaacacaggauucagcuccauuucacuuuucuggugcccguuuaauacucaaucauauauuuuauauuuuuccuuucucagcuuaguaugcuuguuuaaaaugcucuucgugagauucaaccagagaacaaagucuaugaugaacauuucugagacuucccuuguaaaugcaauuaaucugagucucuucaccuuagccucagguagacacuucagacaagggcaaaaaguagccacauucuucaccaaaauaccacgaaaacagucucuaggccauauauugaaauuuuccacugaacccucuuggggcaggucugcacaauucaaaucacuuucaguaacaaagucuuccauaguccuaccaggauagcccauuaagcuccauuuaaagcaucccacugcuuuccaaauccaaagucccauaguccacaaacaaaacguggucagaccuaucaaagcaauaccuuggucccaaagcaauaccuuggucccugguaccaacuucugucuuuggguuuuauucuaugaacagacaccaugaccaagacaacucuuauaaggacauuuaauuggggcugguuuacagguucagagguucagucuauuaucaucaaggcaagaacauggcagcauccagauagacauggugcaggaggagcugagaguucuacaucucaugugauggcugcuaggaaaauacugauuuccaggcagcuaggaugaguuuuuuuuuuuuuugggggggggguguuggagacaggguuucucuguguagcccuggcuggccucgaacucagaaaucuaccugccucugccuccuaaguguuggaauuaaaggagugugccaccacugccagguuuaggaugagggucuuaaagccacacccucagugccaugccuacuacuccaaaaaggccacaucuacuccaacagagccacaccuuuuaaauaguaucacuggcugagcauauaccaaucaucacauaucucaacaguucuaauuuguuggcuuuaucuagaaaacaugugugugugcguuuucuuguuucuggauaagcuauaaguggcauuaauuagaccuccuuuauuuuaaaaaucaugcaaauuguagauaagcucccugcugcuuaaacacauuuaauguaauguuuaauagcaauggcugagauaaguauuggaacccugcaacuuaauuaacuaugcugaccugaguagucaccugccuccgcugucccuucaggaagaugagauggagaaaguauuggcuccuccuucccuccuuccccuucuuucuuucauucgcucucccucucuucccuccuuccuucuuuccuuccuuccuuccagaaauacuuuuugagcuccugcaguguguaaccucuggaaauauauacugcaaugagagaaaaaauaagucauuuucuugauuuauaacugucuaguuggcugaaacagauucucugucucuuugccucuguauuuaucucugucucucugucuccauguguaugugcaugugugcccaauauagucuuuagaucucacucuguaugagcugagaagacacuguaagcguuccauacaagaguauaagcaugauugaaacuauguugggaaaauauacuuucuagauuguuuucaucugugggcucaauguguguuuaaggauugacuuuccagauaaccgaggagauaggcaugaaugugugaggcagugauugggcagugccucucacagugucuggugacuuguuuucuguuugaccccuugggaaacugcuacuccauuacuaaggcuuugcccugacaaaugacauaacaucuguccaaaggccaaugcaauggggaaggaagccuaagcucucuugagcaugugccuaaucugaacaaacuuaguccaaauacaaaauaaaaugaaguaguguauuuugaggaugaaaacacaauagaaucuuggcccuaaaacagcgcuuuugccugucccaggcuuuuaauugugcauagguaaagaugaucauaacucaaggcuaagaucaucauacaaauguaaacuuuagccacagaugcuuaucgcaggcccuauucucucauuucaaugggcuaugaucuuuaggaucaaauuaacuaacuagucacccaaggacucuagcuucugauggucuugggccaauauccugaucaauugccaacuaucugugugacuaagcgaagcacugaucacucugugccucagguuugccaccuauaccucagggaugauaguaauaaccauuucucuguuuuuguguaauggaaugaaguaaaacauuguuuuaguuuagguuuuauuguuguggggagacaccauaaccucaacaacucuuauagaagaaaacauuuaguuggggcuggcuuacaguuucagagguucaguccacuagcauuguggucggaagcaugacaacaugcaggcagauacggugcaggaggagcuugaaguucuacaucuugauccaaaggcagacaggaggagagccuccucugcacuggguggagcuugagcauaggacuucaaagcuuacucccacauuaauguacuuccuccaacaaggccacaccuacuucaauaaggccuuaccuccuaauaguaccaauucccauaggccaagaauauucaaaucaccacacacccuaauagugccauuuuccaugagccaaguauauucaaaucaccacauucuacuaccugguccaacauaggcuuguucaaauauaugaguuuaugugggccauaccuaaacauagcauaaugcaaaauacauuuaguccaacuucaaaaguccccauaaccuaccgcagucucaacaauguuaaaaguccaaaguucagucuuucccgagauucaugcaaucucuuaacuauaaucccuuauaaaaucagaaucaaaaaguagaucacauacuuccaauaucacaggauauacauuuccauuucaaaauguagagaagggagcauaauuuggaaauacuggaccaaaaacaagaccagaaaccagcugagaaaacuccaaauucugcaccuccauguuuaaugucaaaaugcuuuucagaucaucaacucuuuucaguuuuuuuuuuuuuuuucguuucugcaacacaauuuuuucucuuagucuguuucuacucccuguuagaaccuuucuucugcagguaucccacaccucugucaucucuagcaucauggagucaccaaggcaacuucaacuucacagccucuugcuccaaugacugagaaccacacaugauuuucuggccuccuccaaaaggcuugagucacuucuccagcucugcccucuguggcacucuaagcucugucuaacuccgcuccacuacugcugcugcuguuuuuggugggucauuccauggcacuggcauuucaaauauacugggaucuuccacagcaacuaggcuacacuuuuaccaauaaccucucauaggcucuuuucaugaugccaugccucaacuucuuugcaugaccccuucaguccugggccuucaacuggcacugaggcuggaccaucaccaauagucuuuccuggccuuucacauugccaagucuucagugacucuccaugacuccuucaugccuugaaaaccagcaccaccugcguaaucacccuuacacauggcugcuagcauaaagucuaucuucagaacacagcuucuuuguccucucagaaaacacuuuccagaagauuucaccucagugaugcuggucuuuucuuaaucaucacuauuuucuuaucuccagcaaaccagcaucaacuuucucuguaaccucuucuauuccugacucuaaaacuagagccauaugggccaagaugcaaaguacugcugcuugcuugggcugcuugccucuuguuauauuacauuaucaccagcuuucuguuuuugaugacuuccuuugcugccuaagcuugguuguccuggaacugguucuguagaaugacuuugaacucagagaucuucauaccucugucuucuggguucugggauuaaaagcacauacugccaugccugaaucuaagcuuuucuuuaccaggagccugcucuguauuaguauggccuugaacucagagaucugcuugccacuguuuccugggauuaaaugcauguaccaauaugccuggaccuaggauuuucuucagauccuuuuuagaagauauuaauaagcuuggccacuaugccucaagauucaaaacaaaagugugugucaucccacaucaauauccagaucaaaagccuguaucuuccagccucaugauugggaucacagguguacucuccauuuuuagauuguaguucauuucagauauagucaaguugacaacugagcauagccaucacaacccaucccuugugaauuugacacacaaucauguccccuuauguugaaaugaaaacaauaaucagguuauaauaacaaaugccuagcaugguauaauucucuuuuguucaacugcaaacacauaaacaagaaucuuagcugacuagaaaucuuaggcauuagaaagggcuacugggacaauugaugcuggcuaacugaagcuuagacuuaaagcauugcacugcuuuaguaacccaaaguccccaaauccucuaaacaaaaugauagucaggccuauuauagcaauaccccagucccugguaccaacuucugucuuaaguuggguauuauugcugugaagagacuccaugaacaagacaauaaagaaaaacauuuaauuggagcuggcauacaguuucagaagguuaguccauuaucaugaccgaaagcauggaagugugcaggcagauaugguacuaaagggacugauaauucuacaucuugauccaaaggcagccaggaggagacuagaauuacacacuggauggagcuuaagcuuaagacuucaaagcccacccccauagugacacacuuccucuaacaaguccacacuccuaauagcgccacuucccaugggccgagcauauucaaaccaccacaaaaaguacauucuuuauaaaaaaaaaacaacuacuuuauuugcauaauugugaaaaauagaagagcuuuaaagaauggaacaggaaugguaugcuugcaggagaaagcaagaagucagugaugcacaagaaaauccaggucuaaguggagacugugagcaccuugggaaggaaacuauguccagagcaaggagacagaggcagggacaaaaagggacuugaagagcuacaaaaauaugaucugccugcuucuccgucuugccagaggcuccuucuaccaaagcagugccuucagacaccuagcauagucaaggucuuugguucucugaaggaagguaguuuccauguugacugacuguaucacguacugugccuaucuaaugaaauuugguagagaggugaggaauagucaccaguauuaagaggacauuuuugugguuuaauccauccaaccccucaguaaacagaccuugcccagagauguuaagacuugcuuacugucacauagugaacaaugucagggccaccguaucuacucuacuuuauuuccuaaaucaucgaugguuuuaccuucucuuucuaacucugcuaauugguagauuaagaaguacagaccuguuaaucaaaaagagucuuuccuuagugguuaguuguccaagauuagaaacauaaugugagguacucuuuaugugugucaccugugugccuguuuccuggagaccaaaagagggcaucagaucuccuggaauugaaguuacagauggugugaacugccaugcagaugcuuggaauugaacccagauacucuggaggugcaaccgguguucuuaaccucugagucuucucucccauccuuuuaauuuucuuucuucauuuuucuuacucucucucucucucucucucucucucucuccucucucucucucucuccucucuccucucuccucucuccucucuccucucuccucuccccucuccccucuccccucuccccucuccccucuccccucuccccucuccucuccucucuccucucuccucucuccucucuccucucuccucuccucucuccucucuccucucuccucucuccucucuccucucuccucucuccucucuccucucuccucucuccucucuccucucuccucucuccucucucuccuuucuauuuugcccaggcaggccuggaacuuaggcaaguuuggcuuucucagccucccaaguguugggaucacaaguauaugucaccgugccauaccagacauguuuuacuuuauuguucacuguauuauagugucugacacuccagguucuuuguuuguuuugucuugauuauuuuuuuaaaaaguccucuagaauucagcuuuuccaaagcacacauacugcauaaaaugaggaacaaauaucugaucucaguuccuuuucuauuuuuaaagauuuauuuauuauuauauguaaauacacuguagcugucuucagacauuacaggagagagcaucaaaucucauuauagaugguugugagccaccaugugguugcugggauuugaacucaggaccuuuggaagagcagucauuggucuuucccgcugagccaucucaccagccccuccaauugcuuuucauuuauccuucauuuaaacaaucaguuaaaguacugagcacuuccugugucccagacacuaaggccauagaaaugcauaacagaucgucuuuauauccuuagccuaaugagauuucuaguccacagggaaaagccuaggauuguaaguaaacaaauaggaaaacaagagaauuucagacaaggcugcauguugaggagaugaaaaugucauccaguauaauaagaaugaacugagagaagcaggcauccauuuauuuuggguugucugagggcguguuacuugggaugagccuagacauccagaaagacauggccacuaaugcuucaagaagagcauuuccaaagaugguaauggcugguaaagauauacugaaucauguuuuuaaaaauguuuuuauucauguguaugugugucuaucuagugaaugccaccuguguggacguaccugcccaguccagaagaagguguggaauccccuagaacagaacuagaaauucugcuaggcuagggacauagagaugaucuguuaugcauuaggaucuguuauaaauagcuacgagccacucauauggaugcugauauaucagcuuggacccucuuuaaagaguccggcucugaaauacauguuacuuuauuuuguuuaaaauuuagaacuccagguucaauucuaaauccugagaauacaucagguaaaaacaaaacaaaaaccuuuuuuuuuuuuuuuuuuuuuuacaacucuuaagauuacaguuuaaugguuuggguuuuuucuacaguuuagcaggguagcagaugagucugagacucagaccacacagggcauguuuacugggcaaucccaaucacuccacaggccaagcggcucccagcauuuccagucuuuguacuuucuucauuuccaccuuugcccaagucaucuuguuucucguggaccaccauuguacggccaaugauggagugcucuccugagagugagaucacacgaucaucaauggacacauuggccacaccguucuuuccagcagucacauugcccaggucuccaacaugccucucuucauccgccgggccgccauguuucuuagagugaggauuaaaaugagguccugcacugguacagccuuguguauuauccccauacugauggacguggaacccaugcuggccuucaguuaauccuguaauuuguccugacaacacaacugguucaccgcuugccuucugcucgaaguggaugguucccugcaccggaccaucgcccuucagcaugcacaccgcuuuccucgccaugcuuccccgggagacgcgcggcggccuccuccggagggaccugagagagcaagacgagaaggcgacggauggaaggcgccgcaggaaaggaaggcgccaaaaaaaaaaaaaaaaaaaaaaaaaaaaaaaaaaccaaaaacaacaaaacccuuuuuuuuguuuuuguuuuuuguuuuuuuuguuuuuuguuuuuuguuuuuucgagacaggguuucucuguauagcccugacuguccuggaacucacuuuguagaccaggccagauuaaaggcgugcgccaccaccgcccggcuaacaaaaaccuuuuaacuuaaguguuugaaggcuuucgcagacgauuuaaaagauugagugaggcucgucuccagcaggaugaacaauggaggcaaacaaaguugaacaagguaaggauuucaaacaauagagcaagaggaaaagggaguguagacaagacagagacaaaauuuucacagaaaaguagcacucauuccuuccuaaugcugcugcugaaggaagugucagucuacggaaucaccugaguacaccaugcacugacauggauuaagcaucuuuaaagagcucaaccacuuuaauaugacaguuuuauuuauagauuguuauagauccauuuauagacuuucccuuauguuauugauguacuugaaaaauuuuaacuauuguuggguugccauagaauuuauuguaguagcuugaaguuaagaauuaaaaauaucuucaaauuagugacauauuuuguaguuguuaaagaaaaaaaaaaaaagcaauggaggcuggagauaugacacaguagagaagaauguuugcugcccuuccuggggacccgaguuuggcucucagcauccucacuggguggcucacaacugccuguaauuagguaaaacaugccuacacauaaaguaaaauuuccaggagagcugauguauuuguuuuucaacucugcaggcuuaucacauagauggcaaacacacagagacauaugcaaauauacauaaaaauuaaaaauaggagauauuugcauccuaguguggugguguguaccucuagucccugacacuuuguaggcugaaauggaacacuuaagcccaagacuucaauaccaaaccuaacaacauaagaagauuguauguuuguuuaaaagaaggggccagagagauggcucaguaguaagagaccuuguucuugaagccaggguuagguucucagaacucacauggugacucacaagccauccauaacuuuaguucuggaagaucagaugcccuuauauacaauguuugcaggcaccaggcaaacacauggugcacacacauuuguguagguaaucaugccuacauauacauaaaguaaaauuuaaaaaucuaaaaaauauguuuguaaggaaagaaaaaccagugaaaagaagcaaaacacuuuuuuaaaaaaaaauuauauauauauauggauacacuguagcuaucuuuagacacaccagagaggacaucagauccuguuacagacgguugugagccaucaugugguugcugggaauugaacucuggaagagcagucagugcucuuaaccucugagccaucucuccagcccccaaaagcaaacacuuuugugcuucaaagaacgcaaugagaacaaagaaacaauaacccauacaaugggaggaaaccuuuucaaacucuuuauuaaguaaagaacuuauccuuagaagcuauaaaaaacaaacaaacaaaaacaacccugacaaugccaaauaaaaagacaaucuaaugagaacauggaaaacaagucacucaucaaaacaggcauaaggauaguuaaagagcagcuugaagccggaaaugauucauucauggcaguucacaaaaagguucaacgugagcuagcgucggaccuagacauucuacuccuggguuaaauagacaagagaaauuuacuuguauacaccuguucaccguagcagcauucacaguaguuaaaaauggaaguagggcugaugaaauggcucaauggguaagacguccgaugcacaagccugcuaugaaguggaaacuuaaggugggaugguguuuuauuggggcaaacaugcaaaggaguguuuuccugaagugggcacaggagaaagacuaggacacacaugaaggaacauuuagcuaaaacagacacaggugaaaagauggucuguuaaagcgaacagacaaaaggacaaguaauaaaugaauuuuuuuacuaaccacucacauauauuagucuaccuugcauuauguacuugagcuacauuucucgggacuccauagagagaaacgcaccgaaaacuucuagugguguguuguaauauuuuuuuacuucugaggacuugggcugauggacagagugaugucagaugagacagaugcauaugcuaaggaaagauauguucugagacaagacccauggaggacccaugaugcuuggaggguaugaauagaacuugacagacagugauagaggcugaacuggccuuguugguagaacuaccuauguaaugcuugugugucuuugcugaucuuuacuucccugaaagaggcacagccaagaacuccugguguuccucugggucccuccuguuaacuugacccgaggcugaggccugguugucucuucuagauagugucaccaugguugauuuguguuugcuauccugacucuaucuguaaaguauuuauaaguggaucaagcuguugcuacugaucuguaaauuaaacugccgauuuucagacagcauggauaggaguugcuccaaagaaccuuucuaaacaggucuacuuccccuauaucuuuauuuccccacuaccucuuggugggugguagacuaacagagagguuaaaauguuaaaaucaaaacaaaacaaaaaaacccauaaaaacaaaauuuuaaaaaauuaaaguuacacuggugaccaaaguuugauuccccaaaauaaagguggaagccauggcuuaacuccugaaaguuguccucuggucuccauacauguacugugguacaugugcauucacacaugugcgugcacacacacacacacacacacacacacacacacacacacacacacacucuaaagcgguaauaaaacauuuuaaaucauuaaauguuuuauuuauuuuaaacuuuauucuacaagcauauugcaaacacacauaggacaccacaucuucacacacacacacacacacacacacacacacacacacacacucaccaaaauuaacuagagcaaaccugaagacuauaugacucagugaaugucuaugcaguuagaguagccacuaggaucagaagcugugcagcuucacuuuugguuuuccccuuucgcuaucaaauauaauuuuaugcacuuauuuauccccuaaaaugaagaacacacgcuggaguuauauccagaaaaccauuacuuuaucuccucuuucaugacucauacccacuaccagacuuaguucauuuucuuuuucuuuuuuuuuuuuaaagauuaauuuauuuauguacacuguagcugucuucagacacuccagaagagggcaccagaucucguuacgggugguugugagccaccaugugauugccggcauuugaacucagaaccuucggaagagcagucagugcucuuaaccgcugagccaucucuccagcccuuaguucauuuucauacccuaauauuuacccuuuauuguucuuucuacauguuauacugcucccacauguaccuuugcuuauauauauaucuguauucuugacuaaaguccacaugugauggagaacauguaguuuuuuuccucucuaagauugugugacuucacuuaauauuauucuuucuaagagcacccauuuuccuauacauuuugugauuacauuuuucuuuagagcugaauaguauucauauaaauauauauauauauauauauauauauauauauauauauauauauauacaauauguacauauauucauauauaucauacaaacauauauguauaccaaauguauauauaccaaauuuccauuauucauuuuccuauugaugggcaucuagguugaucuuaauucuuugcuguagugaauaaagcagcaauauauguaguuaggccuaugauggugauaucuuuacuaaauaugaauaguaagucagcauagcaacuguuuacauggcuuuuagguaugauaaaugaucugaagaugguuuaaaguauaugaaagaauauguauaguaucuacauaagagauuugagcaucccuggauuuugguaguuggguguccuaaaggcaaccccaugaauauagauauauggaucucucucucucucucucucucucucucucucucuuucucucucucucucucucucucaguuggacaaaccaagcuuucuuucuuccucaaacacacagaggagccaugcuagauucauucccugcagggaaucacacucuccagcuggccucucuccaggcagccaguuggccaguuggcgucuuuaucuuacagaacagcucugaaaaagccuuggcccuguuuggaaauuguuccccucuuaaaauuaauuugaaacgguuagucuaauaugaauuguuuuuuaaaucugagaaguauguguucaaagagggagagggccucugcaggcggcccuuggacggcuuacuuggcauuuuuuuccuucccagcacugaagaucugaagccuggagagggacuggagggagguuggagcccauuuaucugggggaauaguugagguauucugagguuacuuagcucgacaaggaaaaacccagggagauucugagaguagaauccaugagcuguugacauggaaaaagcuccuuuuggaauguuuccaggaaaacuagacuaauaccaaaauguuccaagaaaacaaacugcauuaaaaugacaaagaaacuuuaaugacugacuugauccaagcaauaggucccauagcuaagggaaugaauucugauccagaaaaucuauguaaaaauguuuuguacucuuuagauaugcccagagcuggaagagcagcuugugaccuggaacaccugagugcuucagaucugcaguggggacugggugggacuuacagggacgauggcugacaaaauacaaccuaucugugagagucauaagaagagaaacucagccaggugguagugaugcauaccuuuaaccccagcacucgggaggcagagaaagggggaaaucucugaguuugaggccagccuggucuacagaaugaguugcaggauagccauggcuacacagagaaacccugucucaaaaaacaaaaacaaaaacaaaacaaaaaaggaagaagaggaagaaaaagaagaagaugaggaggaggagaaacuauauuuuauuuuauuuuuaaaugaaauuauuuauuuguuuuauaugaguacacuguagcugucuucagacacaccagaagagggcaucagaucccauuacagaugguugcuggggauugaacucaggaccucuggaagaguagucagugcucuuaaccacugagcuaucucucuagccugagaaacuauacuuuaaagggaaaaauagaggcagagcuucaggaaacuauaaagcaauggaaaacacuguaaaagagcacacacgggccaaggggcacagaaguaagcugagcugagcugagccccucagugacaguuucuucugaagggucuuacauggcagaaaccauuuccaggugaaugcuggguaaucuuauacucaggacaaggccagaguucucacaagccucaaacccaguauuuccuuccaugucaggguagacaaauguugugccauuaucugacuucgaguagcagccacacaccauggaugugaugauucauaucuauaaucucagcacucagaaggcugaagcagaugagucucaugauuuggggaccaaccugggcuacagcaugagauccuagugagauguguguguguguguguguguguguguguguguguguguguguguguauguauguauguauguaugagagagaaccaaauucauaaaacuuaaagaugaacaaaaagagguuaaaguacauacugcucucauugaggauccaaguucccuuacuagcauccacacuggggcaagaucacagccuacuauaacucuuuucuuuguuuguuuguuuguuuguuuguuuuuugagacaggguuucucuguguagcccuggcuguccuggaacucacuuuguagaccaggcuggccucgaacucagaaaucggccugccucugccucccaagugcugggauuaaaggcgugcaccaccacugcccggccacagccuacuauaacucaaacuccaggaggaccugacaccucuggccucugugagcaucuauaccuaugugcacacacauacacaacuuaaaauaauaaaaauacaaucucuugaaaagaagacguauuucaaacaaguggaaaaucuagaaaaaauggacaaaugucuagauguauacgagcuaucaaaaucaaauugggaagauauaaacaaacuucaacagagccaacaccacugaagaaguaguaaauauucuuccaucaaagaaaaagcucaggaugagacacauucacuacugaguuauaccaaaccuuuagagaagaguuaauaccacuguuucucaacuauuccaugaaacaaauggaaagaauacugacaaauucaugucacgaagccaacauaacuaugucaccaaacccagauaaggacacaguaaagaaaaaaaaaaccaaaaaacuauagaccaauuucccuaaugagcuagcugcaacaauucucauuauacuuuuggcaaacugaaaugaagagcacauuuaaaacagucauacuccguaagcaaccaggaaugaaagugucguucaacagauacaaaccaggaaauauagcucagcacauaaaugcagagagggccuguguucaaguucaacaugccuuaaugauaaaagcccugaugagacuagaaaaccaaggaaugcacaccaacauaagaaaggcuacgcuccacaaggucacaguaaguacuauacuaaaggaagaaaggaggaaagcauuuguuuuaacaccuagagugagaacuacucacucuccauuuucaugcaaucuaguacuuaaagucugagcuagaaauaaaaagcaaaggaacaacuacaauuauuccaacuuguugacaacacgaucuuguacuaaaaagacuuaaagacuucaccagaaaaccccuagaccugauaauuacuuguagcaaagaagaaaaagcauaucaccuuaauuccaauuccagaagaucuugcgcccucuucuggccuccugcagcauugcaugcacgugggauacacacaagaauaagaaauucaaauaaauauaaaaaugaaaaaaaaaaaaaaccgcauccaauaaaacuacauucacccuccccuucaaaaaaggaaagaaacagaaugaagaagaguuaaaaguuggaaaaacaaagcaugaggaauuugugguggaaauguacuggacagauggacagggacacacauacaccgacacacaugcacacacacacagagacacacagacacacacacacagacacacagacacacacacacacaccacauauauacucuaauuugaacccuuaagaauguuuagguuagagagauggcucagcgguuaagagcaccaacugcucuuccagagauccugaguucaauucucagagacugugcaugguggcucacaaccaucuguaaugggaucauaugcccucuucuggugugucugaggagagcaauggugguguacucauuaaaaaaaaaaaaaaaaaaaagaauguuuagguugcccuaauguuaauugaaacuuuuuuccucucaaagcuaguaaggagaaugcugguauaagaaggaaaucuuuaucugauggcgaauuugaaagguuauguucuugugcucaaauauggaagggaugguguugauccaagagcugcuugcuuaaacaguccccauccaguuugucuauaugagcaaacaggauaccauaagaugccuagugaagaguaagcugcaauuucagguaaaaguuugauucuugagaguacauugucauaaaaggaaaggaauggaguaacuggggagcaacucagggccuuggcaaugagcgauuucuucacaggagaaucaaaggacgagucuccugugccuggguccuaguccucugugcucugcagcaggugauggggagcaacaaugucuaucugguagaaacaaggaauguagagggacacaucucacuguggucauggagagggagaaguagccagcuuuuuaggagauagacaauggaaagaacaaaguuacucacaggagagcuaucacugcagcauaacacacgcacaagcacacacacacacacccacacacccuagguugauccuccacccccaauccaugcucaauguuccucguaaaccagaaggcuuccuuauguucuggcaaucucugucccagaggccaaauuuggccuuccgguccaccguuucuacccaugccauuugaguacuaacuguccuuggugaauuuccugcuacaguuacacaguuuaguagugggagagacuugugacucacugaauugaaaaccguccuguuuagaacagacuugcugagucuauucugcacgaacuaauauuccaauaggaaacauuuucacacacaggaggauacauuuuucacacuggaguccaaauugcauaggugugacuccaacuacccgggaagcuuaaaccuuccguagcucccagcucuuccguauccucaagacucagugccaaggucaccaccuccaguucuccuucccuccccaacacugcuugauugugaccuuauuuucuuguucccuacagcuaagucuaagagcaucuuuuauaacccuaaccuaccauugagugggguuuaguuuuuaauaaaauuuauuuuauucuauuuuuguguguguggaugucuugccugcauguaugucuaugcaucacauucaugccuggugccugcagagaacagagaugguauuggauccccuaagacuggaguuacaauuuuaagcugccauguggguagugggacuugaauccagguccuuuggaagaacagauaaugcucuuaaucuguguaccaucucucuagaccaggaugagguuuuguguaguggcuuucuccccauuggauuacgagauccuugugaacaaaaacuguauauuauacacuuuaauuuucuauugcauuuguuuaucuauuuguuuaguguggugugugugugugugugugugugugugugugcacuuguggaggucagagaagagcuugcaggagucaguucuauuauuauuauuaaaaguccaaauaauaaaccugguuuugguauucauaaguuguucgucugcagauucagccaaccacccgcacuuuuuuaaaaaauguguuuuguuuuguuuuuuccugaacauacacagaucccucgauauuguucuauaagcaauacuguacaguggcuaaagaugaucuaauguguauggagagugagcacuggcugaaugaaaugcaauaccacuuuacagaagggacuugagcaucuacaauucuaguaucuguggaggguuauggaaccccuaggcaucaaacagugacugcagaccuucauuggugaacacaaguacuuacagaugugcugacacucugucacacagagaagaaaaugucucucucucucugucucucucugucuccaucucugucugucucucucuuccugccuuucuuuuuucuuuuuuuguuaaauguguaugagugcuuugccugcaagcauuucagugcaagugccuggugucuacagcaaccagaagagccaagggacuccuacccagugucacagagcuagaaaguacuuguaucaacugaaauuccaagcaacuccuuaacugacuaaucaccaaucucagauacaagcuaagucugaggcucugggauaagccgguuccuuucccuuugaacugcagaugggugguuucugucaggcuggaaaucccugcuccagaggauuucugacgacucgcacugggcuggccuuguauauccagggauugccuucugggagacuccgcuguuuuaaugaucaugucagcuggguuuccucauugaauuacaccauuugccacuuugaagucagccugaguuaucagauuuccuuucccagggugccgcagaggaacacuacagugaaggaguuacucccagccccccaguucugcuuugacagauuuuucucuugcuaaagucagcaggauuguggauuggcugaagccggaaggcugugugugcccgucuucuguaaccacuugucuccaccuccuagcccagcugagaauuaacguguuucaagcauggauguccaugaggucagugaacuggcuuaaagaggacaguaguuaaggauacugguauuaagccaggaguggagacauauaccuuuaaucccagcagucaggagacagagguaggcagaucucuaccaguucaaggccagcauggucuacauagagaauuuuaggguuacauaaagaaaccuugugggggagggggagcagaaagccauugccuguaugacuugccagacuucauuccaacccugguccugaugcgaggcauggcauccagagccacuuguuugcugguuugcacucggugcagccuuucucacagaagaugcuugcgcuuuggggguaaaggcuucaacaagauugaagaagucagccuuggacagagaggugccagagguggaguguuccuugccucagcacagcaaguccccuucagaaaggcaagaggacgcugggcuaagaagaggugcccacgaguacaggaaaggggaggccaguguggccaucccggcuuccaccauguucacgugugagucaguguauugucaccacagccaggccuggcugggcuacuccaggcccuaggggaagaagauagacaugauuucugucauccuagagcagugcagagauuaaaaaugcacagucauacagaugaucguagauuaugauuguagggcauuaaguaggcuauuguaagguauacgcaaaauugggaaugauauggcauguguauuuugaagggaagaaacaaagauggccuuuuggggauguaaaagggcuguauugaagguuggcgagccagaagaauagaacaggcaguugcaggagagggaacugauggcgagaaggcuguagaauagaagucagcccaaucaaacugaaauaggcucacccgcuguacuggcuaguuuugugugaacuugacacagcuggaguuaccacagagaaaggagcuucaguugaggaaaugccucugugagauccaacugaaaggcauuuucucaauuagugaucaagggggaaaggccccuugugggugggaccaucucuggacugguaaucuuggguucuauaagagagcaggcugagcaagccaggagaagcaagccaguaaggaacaucccuccauggccucugcaucagcuccugcuuccugaccugcuugaguuccaguccugacuuccuuggugaugaacagcaguguggaaguguaaaccgaauaaacccuuuccccacaacuugcuucuuggucaugauguuugugcaggaauagaaacccugacuaagacaccugccuuucuuauuuacuuuucugagccuguggccuggagccugcugggcagguucucugccacugagcuacauuuccagcccucacuggcucuggaaccuucagucuccuguucuuauuucauguaaacuuaacucaccccugaugaaagcggaggcucuagucuacugggucugcaauuuuucaugagcuuuuuauccucagaguagaggacauuucaggacauggggcuccuuucugucuuauuugaugguuagcagaacuuacuaguacaaauugcucugguugucuggagucagauggcuugcauucagauucucacucuguuaccuguaagucacaacuuuugaaaugugauuuaccugccccaugcuucagcuuucacgucugugaaauaagucuaagaagaaaggcauccacuuuugaagcuuaguaagaaaguuccuggguugucaccuuggggcucgacuugucacaugcaacauacccucugcuuuucaguguucccaccauggccuugagugacaucaaggacagugguaugcauuuccaggugaacuguuccuggaguccuggaguuugccuugauuauacaauccaaugcagaaccaaguuuaaguuagguucugugccaugaacuucaucuccuuugauccucccauuaacuuaagaaguagguauuauaucuuuauagaaacucagcuuacagucggaccaagccauugcuguuccuaggcacaccccugaguuucugauucaggaggaauaggcaaggcuugggaaccuuaauuacaccuauuuccaauucuguuucccacuguaacauuaaccagcugagcucccagauugucucuggcuagaaaguuuaugugagcugaguguacaguuuagcaagguaggcagguaauuucaauauaaaaacauuaaggauuuaaaaaagagguguguguguguguguguguaggugccuguggcuagcagaagacgucagguccaguagagacagaguuauaggugauggugagcuaacaccaugagugcaaaaacagcaagugcucuuaccuacuaaucgaucucucuaucccauaaauauguuuguaagugaaucuacccagcccacaucuuuguuuguccaaaucacuaauucucuacugagcauagcggaacugauaaauuugcccugaauuguuuugcuucacauaaucucaacucacaauuucuuucucuuugucuguaaguuuugugugugcgugauguguuggggaagcacaugugcugugucugugugcucucaggauugguucuucccuuccauuacguugguccugagggccgggcuuagguugcuagguuuggugacaagugccuuuaccugcugacccguuucacuaaacaaaauucacaacuuuucauucugaauuccaaaaaauucaacaaauucccuaaaaccaauuuuuuuuuucuuuauaaaaguuacaugauaggcuggggaauugucucagcaguuaagaguacuuguugcucugguagagaacuuggguucaauucccagcacacccauggcaacccauaguugccuguccagucucaggagauccaaagcucuguucuggccuuugagggcacgagaaauacaugugguacauagacauauguguaggcaaaauacuuaacagguuaaaaaagaaaagguaaaguguaucaaucuaaaaauuaaaaguauauuuacaugcaagaauguuuugauugcgugcaugucuaugcagcagguuugcuuagggccuuacaaggggagaagagggcauuggauucccuggggguggauauauagaaguuugugagcuaccgaauuugugcuggcaauugaacaugggucuccugaaagagcagccagugaauuucaccccugagccacaucucuagccccuuacuuuuuaucuuuuauucuggaaaucaaacccaaggcuuuaugcaugcugaauaugcacuccaccacugaguacugcuccaacucugagauucuuuucuuaagauuagacaaugcaugagacagccaagccugcccuaaccugaaauaaagugacuggcagguacuuuuaagcugugugcugugaauauuuaugugcuuuagugcacacaauaacaaugugcuggauugggagcuugaaucaauuguuguuauauagcaaauugcccucagaacuuaguuguuuuuguuguuguucuuguuguuucgauguuugguuuuaaacaaugagcauuuauuaugucaagaauucagaagcaggcuagcuugaugauuugggcucagaaucucuuauggcuaauaugguaccgcagaccuguaauuccagcacuacggaggcugaaacaugaggcucccuggaggaaaaccagccugaguugccuaauguagcuagggcuacaaaucugaucuuauuucauaaauaaguaaauuuugcuggggagaagauggcuucaguagauaaaucacuuaccaugcagacaugaggaccaagucuccagaacucacagggaagucaggcagaauaguguucaucucccaccucaguccucccacggggaggugagaagugguacccucugacaccucaguccucccacggggaggugggaggcaaacacaggacugguauaagcaacagaagacagcaaaggggacugagcuucugauagaaggugaagaacuaacuuuagguuguccugugaccucuacucaaauuucugcaguuuacacacaccaaugagcauaaacacacacacacacacacacacacacacacacacacacacacacacacacacauacacgccaaacaaagaaaauaggggcuugaaggauggcucagcagucucagccaacagugcuugcugcucuuccagcgugcuugacuuugguucuuggcacccacauuaauugucucacaauugcuuuuaauucuggcucuaagagaucugacacccuucucugguuuuaauggcauuuacaugcauauguacauaccuacacucauacauaaacauaauaaaaaauauauuuaaauaaaugaagccuaauacgucucgguguauuuuuaagcuggaagaauccucaugaauuaccaagcagauggauucuaacgucaucgucuucacucuacagaugaguaacucgagcuucaaagaugaaaaaagaaaauuuucuaaggacccaggucuuguauuugcuucagcucuaugacuucauuaaauucucccagcaucucucuuccuguucuuaguuuauucauaagaaaaugaggauuacagagacaaacaagcuuuuuccagagcugacuccugcugcuuccuggagucaaggucaaaaucuauagcacacauauggcuccugggacucucuccauaaagcaucugaccacuuagaauaaggcagcccaguauccgcacggaucaagaugaagcuuucugccuggauagcaagaggccuuucagagagcaucucaaccaucuucuuuagccaauggcuuacuugagccaagaaugucagaaguuacacagggcagugccccaugucugccucuuaaaguaggaucacaaauuucaaagcaugagguaguaugagguccuacucuauaucccacaucauaugcuugagccccuauuauaaaugauguaugucaucaugauaguuauuuucauaaucaagaauuaaucaaauuaacacuuaugaaacauuacugugcacugggaagcuuuuccacgugucuuuccucggcacagcuuuccagccuguagucugcugacauuaucauugcauggaaaggccucaggggcacagagaagguaacucaucuucgcaugcuuagucagcuggaaaacagcagagccaguccugaaaucuagacacuggaaccuccaccuuauccuuguaaucaacaucgcuguguaagaagcuuuucugcccugaugcaguagauguuguaaauggagcuaggcaucaagcugucagcuggcaagacugagaaagaaagaaagaaaguagaggcagaaauggaguaucaucugcaagcauuucagaaugguguacaaaggugcucagagugaucuaacacaguuaggaagaugguagaagaggugagcuuuaaauggagaccuguaaggucaguuacacggugugugcaucgagaccuacggaggcaugcagcugaaagccaggaacuagguacuggaacauagcagcuucacaaguccagggucuguuucggagguaaugaacgcucugaaacuggaugauaguugcagaagauggugaguguaaugauguaccagaagugauuggauuauauacuuuaaaacgaggaauaugugcuaugaauuuggggucauugguguguaaguaagaugaugucuguccuucacaaaucagggcaucggguugggaugugaccggauaugacagaacagucuaggaguagugagcuggcccagaaugccuggugucaagggcuuggggaggguggggcagacacaggucucagagcagauacagaaggcagacaggguuccccaggacauuuucagcaauccaacuuuccugcaacaggaccaugcuaagggguggaguuuuuuuuaacauaacuuuaaaaaaaauuguuugauaauuuuauaaaaucuauuuugaucauauuauucuccucuuccuucugagaagcacuuuuuaagaaagacaaaucuagcugggccuuuaaucccagcacucaggaggcagaggacggcagauuucugugaguucaaggccagcuuggucuacauaaagaauuucaagacagagcuacaaugugcgacagucuccaaacccucucccccauuccaaaaaaagaaaaaagaaaaaagaaaaaagaaaaaagaaaaaaaaaacugauccuuuugugaagaaggguacucaugggaaaguagaacaggaacuuuuauucaacugcucagggugugagaucgucacuacacaccaagaacagaaccccaucucuccugugccuuucauucuuuccuuucggcauuccuacacugagaagcaguagguuuacgucuuguucacccccuggauguucugcugcuggggacaguacugugaacagaacaggcguggcccuggcugucucacaaccaguggucuggucaggcagacuggcaauaaugcacccaauaugacacaguuaauagacuaggaugugacaagugccauggaagucugaggucaggugcuugcuuuguggugccugucacauuaccugaaguuagaaguucuaggucaaacccuuaagcgagaggcugugagccuucaagcucugcuugcugccaguguccacacaugaggcaugacaguguaacagcgguauugucugcccaaaggccuggaggugaggcaaugcuucagggcauaaaggucaaccucacuggcagaagcuccagagagcugacccuuucccauacaguaaaucuugaucagguaccugguacugauaaccuugaaccuaucaguaucugacgucaggauugaagaguuuuugagaugcuagagugcaauguauagaggagaacacuccauaggaaguguuuauuugugggggucggugggggaucuagugaaccucaacacugugaaaggcacugccucucuguuuucucccaugccagccauguaggaguaggcccaagcucuaucauuuccuaagaguuuacuccucaagagacaguuauuccuugauauuuuacaaaauaaccuuaaggaagucaauaaggucauuauucuuuguaauugugauggagcacauaccugccaggaucuucauuacuggagauucagccuggcuauaaacuccccuaagacacaugugccugcauccuguagucagggacugaagcuuccaugugccagucaaugaguaacauguugggacuacagcccagaucacaggcugucuaaccugugagaagugagggagacaaugaaucaaugguuucugugauuugagggugauaaaguaggagcacagagauaaacuguggcugaggugcaguuuagaugaucagaucaggggccaggcuccaguguccaggcccagaugugauaacugcacugcucugcccucagcacaaaaagacaaauacuugcguucuuuaauuuaauccuccugacaauuccaugcagagaguauuucaugagcacuaacacugcuggguagcauuuacaaaaugccucacuuaggucaccaguccauuaguuacugugguggcggagcugcacgcuggacaggagagcugaaaguggauaaugaagcucagaaguccauagagucaaagcacaugugugggguagcgccagcgaggcccagggaaaggggguacgaaguagugaacucacucccuggguuacuccggagagauaucaaaacaacaaauaaagggagaagagagaucccaccauugauauccccucaaagacuucuuagcagauggcuggccugucagagggcagagugacggguagaaugucgcucagcagcugucucucgcuccucauccuuccugaauccagagucugaaaggcaaagccaccuuucucaguccccuuuacuuguucuguaugagucagagcgcccaccacugagauguauucauagaagacucaaaaugagaguggauuaaaggcaugaaaauggaaccauccaggguccugcugcacucacgaagccaccauucuagauggaagugucugguccugugagucagcaguuggcauagcagucuagcuugcugaucuagggcagugucuggugccuuuucugaagggcucagccuaguggguguucuccagccuuuccuucuauuuuacgaaguuuaguuuccgguaucuauuuaauacugcuacaaugauuuuucccccucuacuuuuucccccaaaaucucgauaugaaaccaucugaugggcauaucuggacuuggacaaggcucuuaacauuucugaguuuuuauuucuucaccuauaaaauaguucugaaaccacuucccauaaggcaguguugaaugagaguaguguuuugaaacgugcauguuaagagcagauaacaaagucuguagccuguagaaacugccuaccaucuaacugugugagugcuuauucucucugcaguccugggaggagcucuggugagaugggcacugagugugcucuucccuuuguuugugagaguuaaagcuaacuugcuuggugaccagcacagggcuugccaagcucacagcucacagcauuucccucucgaagguuaguggcuuuuccuuccuucuaacugaugcuacauauuguuguugguuuuguuuggguuuguuuguuguauauguuuaaauuagcuuauaaaaugcuaggcaucacucugguuuucuuuccuugaagaaacuggagcccuggcuacccuaaagcuuacuaugcauaccaggcuggccuugaacacacacuaauucacuugcugagauuaaagaccuguaccccugugucacgcucauuauggauuuuacaacuugguuguccuucuugcccugucucuaccuucauuccuagcucauagccuucucucccagucucuggauguuuccaggccacaugagcucccccccccccaccgcccccuucuuugcaucucuucuuagccucucuuggcuuuuuuaguuuucuagacuuuccccacguuuacuccugcuucuggguaaaagauuaguacauuaagaacuaggauccacaugugagaaagaacacaugcuuucugcuuuucuuagccugggucacuugaacuaaugcuuuucaaaguuguucauuuuccugccgauuucaaaacugcaauuuucuuuaugaccgaguaaaaugcaauacuauaucauauuuucauccauuugucuguugauaagcuucuagcugguuucauuguuauuauuauugugaauagagcagcaauguaauguuuuuaggguaguauagggagucuuuuggguauaugugcaagguacacaguggcucucuuuugaauuuuuuugagaaagcuccagaccgauuuccauauuggugaugcuaguuugcacucccccagaaguaaggaaacgcuccucucuccccaugucuuaaucagcgcuugcuguuaguucucucuuucauuuuauguguauggguguuuugccugcauauaugacuuuacaccacauguguguguggugcuugcagagacuggaagagggcauuggaugcccugggucuguaguuacaaguaguugugaaccacuguguggcuucugggaaucaaacucagguccucuggaagaccagccagugcucauaugugccgagccauuccuccagucccuugauuugcuuaacacgauaguuuuuguuugcuguguggaugagaguguggguguguagauuccgcacacgcauguggagguugaagaugacuuucaggagcuugggcucgucuuucagcaggaguuucugggauggaacucgggcuuaugcagcaagggaguuuaucugcugagccauuucacugacccagcuuccuugaugacaaacauucuugcagggcugagaugcuaucccaaaguuuuaauuagcauuucucugauguugaauauuuaaaaagaauucuuaguggcuauuggugcuuuuuccuuuugagaacaguaaauucaucucaauaaaccuauuuguugauuggcugcuucgcuuguguugcuauugaauuuuuguagcucuuuauacauuuuagccauuaguacccuauccaaagcagaguuggcaacuguauugucccauucugugggcuguuugcuuacuuugcugauaguuuccuuuguuguggagaaacuuuuuaacuucaugcaacgcuauguguuacuguuuccuguguuacuggagaccuguucaaaccccuuaucuugaugugugaucuccauguuuuccucuagcgguuucaaugcuucagguuuugaaccaaggucuuagauuuccuuggaagugaucuuuguacauggugagagcauaggucuaauuucauucuucuguuaguagaggucuagccuugucaguaacauuuguugaauaagcucuuuuuccuccuuuguauguuuuugaugacugucaaaaauuagguggcuuuagcugugugguuuuacuccuguauggguccucuacuguguuuaguugaucugugugucuuuuucugugccaggaccagguucucuuuguuacuguuaaacuguaucauaguuugaauucaagugugauaccugcagcuuuguucuuucucuuuaagauuucucuagcccagcggugguggugcacgucuuuaaucccaguacuugggaggcagaggcaggcagauuucugaguucgaggccagccuggucuacaaagugaguuccagaacagcuacacagagaaaccccgucucgaaaaaaaccaaaaacaaaaaacaaaaaaaaaaaaaaaaaaaaaaagauugcuuuaucuauauaugauccuuuguguuuccacaaaaaauacuuggaauugcuuuuuuucgagcucugcaaagacugcauuggacuaucuuuaaaggaaaugguaucaucucuguagcuuacuuuugcuaagguaguuguuuccacgaugcucauuauguuguggcagauguguaggaacucacugaugaugaggauggcuggaaaguaacgaguuaaggaugcaacaaggaaaguaguuccgucacccgacaugcguuuucuccguaauacaaaaccuaacaguguucuuucugaugcucuggagacugaucuucucauacguaugucuuggcgcuaaccguccuuccuccugccauaccaagcaaagcuuugccuuauuucauaagagcuuugcucugagcgugagcagggcaggcaaugcuuucugagaggcugcagugucugucaauucgacggaaacgggaggagggaagguucuacuguguguccugccuuugugcugagaugugcccaggcgucucccacacuccuccagggggaggcagggcaaagucccaaauagggaguccacagugcuuccuggucuccucuuugaguacccugggugcugcccguguuccuccuggggagagagucaggaagcaggagguggggucugaggucuauauuuccugucagggcaucuaagagccuggcaggaaggggaagguggccugggacaaacaggagagccaagcaccagaaggucuagaggagagaaagccuuccucuggaguuuuagguguaccucuuuaguaacugaaggccuuuccacaaugauccuuaaggaagcagcucucugggaugagccuugcuuguucauauugcuucauuugggguggauauaaauacauacgcuuuauucagggcaaaccagugauucugucauggccuuaguagggacagaaugacaggguuccugcccuugggacaggaccagcaugcgugggccuccgugagugucaaugucugcugugggcacagaguuuguuuguauaauaauguacauauuuucacauuccucugaggaauguccucccuguuaacauuaaugaccccgugauaaucagagacagcguuugucugggaagcauagauauggcuaaugucucagcaaaauggcaaauucuggaaucuucaggauaguccuuaaaaagagcucuaaaaacaugggucaaaaauauacaauuucgggcuggugagauggcucaguggguaagagcacccgacugcucuucugaagguccagaguucaaaucccagcaaccacaugguggcucacaaccaucuguaacaagaucugacgcccucuucuggagugucugaggacagcuacaguguacuuacauauaauaaauaaauaaaucuuaaaaaaaaauauacaauuucucaacuaugcaaaauauaaggaugaaauacaaauuaugaggggcuucaggaaucuaaaggaacagaagcagcugugcugugagccacuugacagaaagacacuaaggacagagauaaagagauuuagggagugguaaucacaggagauucccacccagcuaaguuucauuugucuaaggcaggcagauugcugaguccaggguccgccugggacaguacgugguuugauccaggugugguagaaaugguaauuucaggaugggcccaacccugcuaguuuaucaucuguguuuaauagaggcaggcugauaucugaauucuuuugcaauguuaaaagaaaaugugcucucucugucacaggaagaaucacaggacugggucauggaaugcagauucaaaaggaaaccuggagcaaaugacuggauugauauguaaaauaagaguggucuuaugauguucaagggaugagaucugcaaagaaucuuuuagacuaugaagagagaacugcuuggagaaccaucuugagcagagaaagcaggagagagagagagagagagagagagagagagagagagagagagagagagagagagagagagagagagagagagagagagagagaggagcaaagaaaaagcagccugggaagcugaacugagcgaacauaggccguuagcuuggauccacaauuugauuucuagucauuuguuuuuccaccuuccagauaccccuucucucagaaccccucuccaagcagagguugguccuugguaaauacccaggaaggguauucaacucauuggcugaaggcucaaggcuaucuagacagcuuacuagcauggagagaaacucuaggcagaauaauaaaugacagagagcccacaguccucucaguacgugucaugguuauggggugcagggcacgggaggagguucccagagcaggugcagagacagggagagaauggcuccacuccugccaaucucaaaucucugagauucccaggguuugagcuuauucaaccuuaccaguucuuacgccugucugguagcaugagcccacaugcccuacaaggggaagaguggugcgggacacuuaggagguaggugggcuugucaaaacagggauaggaagcuggugcugucagugguugggaguggucggauaaagucagcagauggaggagagcagaagcuaaagaggcacacagaaaauggggaaauaguggcuggcuuaggguugcacacagccacucuugagguuuacuucucagcaagaggguugaggaguaaaauccacugagaaggauuugcagagcccucagcagacauuugugcugggcaccuccugcguaucccugaaagcagguaaagggaagacucuggguugcuuugguuuguugugucucccagagccugccagcagugguugcuacaugguggccgacacaacaacuguagcuuaugauaacuuacgcuuuaagaaaacagaggaucuugggggagaccgagcucuguucaguguggagagcuuuuuggggugcagcuuggcaggagucugacauuggccaaggacaaggaaaugggcuucagacaggaaucugacauuggccaugacaaggaaguaaguucauggagggaccagacauuggcuaaggacaaggaaguaagaauuugguuuuaguguagaacaaagaaguaggcucagcuaucuucaugauccuuagaaacagcuaacacgggggcuggagagauggcucagugguuaagagcaccgacugcucuuccagagguccugaguucaaaucccagcaaccacaugguggcucacaaccaucuguaacaagaucugacucccucuucuggagugucugaagacagcuacaguguacuuauauauauuaaauaaauaaaucuuuaaaaaaaaaaaaaaaaaaaaagaaacagcuaacaccagagugaccauuggguuuugugucuugcuuauuccucauuguacuacucacccugaauacuugcaugcaauuaaaaugguauaaaaagcagacugggaaaguuaaauuugccuucagucucagaauugacugggaucaugcuacaauguugucuaacuguuuuuucuuuugaauccucauuccguacuggagaacccauugacugacugaguggucuuggucaguucagcaacuguuuguugaguacccucuauguuucuuccaggugcucugcuggucagaggacacgaagcugaauccaggaaucccugcacacuccagagacagaggcagaaggaggcacucaggguuggagagacuguaaugugugggauguugagagugaaguguugaucuuaggcaggauaaguaggaauuauccagguguguuuuaguuaggguuacuguugcuuugacacaucaugaccaagacaaccuguggaagaaaggguuuauuucagcuuauacuugcaggcccaucacugaagaagucuaggcaggaaccgaugcagagaccguccauggaggaguguugcuuaccggcuugcuuaacugcuuucuuaaagaauaagaaagccacucacaauggccugacccucccccacuaaucaccacuuaagaaaauguccuaaauggcuucccuauggccagauguuauagaagcauaucuuauuuagaguuaagaguccauggccauccuggcagggaacauggcagcaggcaggcaggcaggcaggcauagcacuggacuucgagcucacaucuugagagccugccccagugacacaccuccucuaacaagaccacaccuccuaauccuuuccaaagaguuauuccagcugggaucagggacuaaaaccuauaaaccuguugggggccauucucauccaaaccaccacagugaaaaacauuggaccuucguucugaaggcaaugaaagaauuucacaggugcuuuaaaagcuuucaaggaaugucuuaagguaguaguuacaaaauuaaaagcaauuaaaaaucaucagacacugaacagucacucaaaauaaacauagcugugcaaaggacuccacgu

SEQ ID NO: 3040 - RNA, 1831 nt, Mus musculus
aaaugauauaaaucuggagggauuuuucacacagccuaucuuuuuaggugugccuuucccauauuuuauuaaacucgaguuguuguuuuaaaaaacagcagcauuaucaaagacacaucuguacaaacauuuuacaaaagagaacucucuaggaucagcuacaucaaggacaagcagaaaaauagaugcaguccaacaaagacauugaaaaugacuucagacguuggaaaugccuuuucuuauacaaacgauggcagaugaacacugcgcaggaucaauuagugagugaacugcucuuccuuuccugaagguugggaggcagggagcgaaugggucaccaacaacccggauagccaaaucgccgcuuucccauuucaaaccguuuaagucuuuggguagauucaagucgcugggaaacaagugggcugccuggcacuagcuucuuaaccaagcuaucuagccuuugcuuaacucucccggucagguuuccagugacuagacaaggaauuucagaaaugcguccuuaaaaaaccaagggcgagggaggugaccugagcucagcaucuagagaacuuguuuguggagagagaaggaagaggucaaagcugggaggaaaauuaccuccugacugagaauuaacaggccaacccaucuggucugaggugccgaggaagucggggcauccuacaggaaaccuacaagcuagguucgcuucucaucucccccagcuccuuaagcuccaccuuuuuguauuugcccgacuuccuccguuuggugaccaccaagaccaccacaccagccacuaccgcuaccgagacgacagcgaugacggcaaugacgccggcggugaggcgcuucauggagaacugggggggcuucucguccagguaguagaugagcguccgcuccacaugcagggguuccccacgcaccugcacguccaggccgcggcggcccaugaacagugacucgccuuuaaugucccuuucgaaguaguaggcggcaucagcgauguccacgucucucaagcccuucugcgacgcguucugccgaagcucuaucugaauggugggcuccucauaguguaccgcggauaggaagcuggggugcagcuuguagcguucuuggaagagccgccgcagcucggagucuaggucagagugguugaaggcucggucggucgggcgguggcgcaacucaaugaggaugugguggguucgcaccacuucgucgcagcgcaggcuuuggucucccuuguccgugcggcgcacgcccaccgaguuuacgcaccagcacaccgaggucugguugcacuggcgcgccuugaagcggcccuugucgucacacuccgggucguagaggccaucguuguccaguaucgcgugcucgcucggcaucaccaggcugcggccgcucuuccgggcgcucaugcgcgccuugagcagcaggcacuuggaaguuagcguggagcagucgaccaauaccugugagcccauugcccgacauuggcagaccccgccugggccauuugugucgcagaccgucaucuuguugguggggcauguacaguugcucugagccgugcaaaagcgggucgccaucgccagcaguagcaguagcagcggugcuagauccaagccccucgccauggugggguggaguagaauggaccuccaacuacagaccagaggcagggauucugaaggaucaggcuggguaggacacugcaggcgacuccugccgggcuuuucccuccagcucuuauaagcuccuguaccuguaggacugguuagcuagugacucacucaauggaauuuggguggcgcucccu

SEQ ID NO: 3041 - RNA, 801 nt, Mus musculus
cacugaucacucuccuauguucauuuccucaaaaugaugaguccugcccaguuccuguuucuguuagugcucuggauucgggguaaggaguucuggaaugggagggaugagaauggggauggagggugaucucuggaugccuaugugugcuguuuauuugugguggggcaggucauaucuucuaggaugugagguuuuguuacauccuaaugagauauuccagauggaacaguagcuguacuaagaucaauauucugacauagauuggauggagugguauagacucugauguuuagaaccuucaacauuuguuuuaugacaaaauauuugauauauaauauuuuuaaaucugaaaaacugcuaggaucuuacuugaaaggaauagcauuuucaaguaagauuucaaguagauuuucaaguagauuucacaaagguugcucaggaccuuugcacaugauuuuccacuauuguauuguaauuucagaaaccaacggugauguugugaugacccagacuccacucacuuugucgguuaccauuggacaaccagccuccaucucuugcaagucaagucagagccucuuagauagugauggaaagacauauuugaauugguuguuacagaggccaggccagucuccaaagcgccuaaucuaucuggugucuaaacuggacucuggagucccugacagguucacuggcaguggaucagggacagauuucacacugaaaaucagcagaguggaggcugaggauuugggaguuuauuauugcuggcaagguacacauuuuccucacaca

SEQ ID NO: 3042 - RNA, 783 nt, Mus musculus
cugaucacucuccuauguuuauuuccucaaaaugaugaguccugcccaguuccuguuucuguuagugcucuggauucaggguaaggaguuuuggaaugugagggaugagaauggggauggagggugaucucuggaugccuaugugugcuguuuauuugugguggggcaggucauaucuuccagaaugugagguuuuguuacauccuaaugagauauuccacauggaacaguaucuguacuaagaucaguauucugacauagauuggauggagugguauagacuccaucuauaauggaugauguuuagaaacuucaacacuuguuuuaugacaaagcauuugauauauaauauuuuuaaaucugaaaaacugcuaggaucuuacuugaaaggaauagcauaaaagauuucacaaagguugcucaggaucuuugcacaugauuuuccacuauuguauuguaauuucagaaaccaacggugauguugugaugacccagacuccacucacuuugucgguuaccauuggacaaccagccucuaucucuugcaagucaagucagagccucuuauauaguaauggaaaaaccuauuugaauugguuauuacagaggccaggccagucuccaaagcgccuaaucuaucuggugucuaaacuggacucuggagucccugacagguucacuggcaguggaucaggaacagauuuuacacugaaaaucagcagaguggaggcugaggauuugggaguuuauuacugcgugcaagguacacauuuuccucacaca

SEQ ID NO: 3043 - RNA, 749 nt, Mus musculus
ugugugaggauaauauguaccuugcaagcaguaauaaacucccaaaucuucagccuccacucugcugauuuuaaguguaaaaucuguuucugauccacugccacugaaccugucagggaugccaggguccaguuuggacaccugauacauuaggugcuuuggagccuggccaggccucuguuguaaccaauucaaauaugucuuuccauuacuauauaagaggcucugacuugacuugcaagagauagaggcugguuguccaaugguaaccgacaaagacaguggagucugggucaucacaacaucaccguugguuucugaaauuacaauacaauaguggaaaaucaugggcaaagguccugagcaaccuuugugaaaucuuuuauguuauuccuuucaaguaagauccuagacauuauugagauuuaaaaauauuauaugucaaaugcuuuuucacaaaacaaguaauuugaagguuuuaauuaucagagucuacaccacuccauccaaucuaugucagaauauugaucuuagcauagcuacuguuccaucuggaauuucuccacauccuguagaauguggccugccccaucacacaugaauaacacacacaagcaucuaagagaucacccuucauugccauuguccacaauuacccccacuccuuacccugaauccagagcauuaacagaaacaggaacuggacaggacucaucauuuugaggagaugaacuuaggagagugaucag

SEQ ID NO: 3044 - RNA, 781 nt, Mus musculus
aggcgccucaucaaaaugaagcugccuguucugcuaguggugcugcuauuguucacgaguccagguaauguuaggggaaaaugagaaagaagaaugggaagggaacaugaauacuggcucaaaaugaugaucacaauuguucugucuuuuuaugaaaaaauaaaucuuauccuaucgaauagguccugaggaauuuaugucugucugagggagguuccugauggcaaagacuguguguuguaauaaugauuaagacacagauagacuuagauagcauaaguuauggccagaagauccugauggcuuucaaugaacuuguuuuguuaaaagguaauuuuaguauguaaagaauuauauauaaaacuguauaaaaaaacucacuugaaauaauuaucaaauagggaaaaaucacaaauacuguucaugaagauuuuccauaacauuguauuucuuugucauuauuucagccucaagcagugauguuguucugacccaaacuccacucucucugccugucaauauuggagaucaagccucuaucucuugcaagucuacuaagagucuucugaauagugauggauucacuuauuuggacugguaccugcagaagccaggccagucuccacagcuccuaauauauuugguuucuaaucgauuuucuggaguuccagacagguucaguggcagugggucaggaacagauuucacacucaagaucagcagaguggaggcugaggauuugggaguuuauuauugcuuccagaguaacuaucuuccucuc

SEQ ID NO: 3045 - RNA, 289 nt, Mus musculus
gggaggaguacuccaauacuguugacaguaauaaguagcaacaucuucagucugaagacugguaaugcugagaguguaauccuuuccagauccacugccacugaaucuugaaggaaccccaguuuccaaacugguugcaccagauauuaagagccuaggagcauuuccugguuucugcugauaccaggcuaaccaauuauuaauguggucacuugccuugcaaguaauggugacucugccuccuagagauacagacaaguaggaugaagauugugucaucuggauguca

SEQ ID NO: 3046 - RNA, 1911 nt, Mus musculus
gaugaaagcugcacauuuuuuucgaagggaucgagaaagugcuggaggucuuguuuuccagacagcaguccgacgcaagacagggaucuggggaucuucguaccaucccaagaucugagugggauguccuuuugaaggaugugcagugcucaaucauaagugugacaaagacugacaagcaggaaguuuauguacucagugagaguggcauguuuuucuccaaggaacguuucauuuugaagacaucugguacugaucugguacaucucuuacugaaagcacugguuccccuguugaagcuugcuagggauugacccaauucaaaguuucuuuuauucucauaagaauuucaugaagcccuuccacacgagaauuucgagaaagaaaucgaguuucuuaauacaauuuuccaaaauaaagcagcauauuguaugggaugcaugaauucugacugcuggcgcuuguaugcuuuggauuucccagagagccgaguaaucaaucagccagaucaaacccuggaaauucugaugaaugagcuugacccagcaguuauggaccaguucuacaugaaagaugguguuacugcaaaggaugucacucgugagaguggaauucaugaccugauaccagguucugucauugaugccacacuguuuaauucuuguggcuacucgauauauggaaugaaaucggauggaacauauuggacuauucauaucacuccagaaccagaauuuucuuauguuagcuuugaaacaaaccuaagucagaccugcuaugacgaccugaucaggaaaguuguggaagucuucaagccaggaaaauuugugaccaccuuguuuguuaaucagaguucuaaaugucacaagugcuuucuucgccccagaagauugacgacuuuaaaggucuugauugccagagugcuauguucaaugauuacaauuuuguuuuuaccaguuuuucuaagaaacagcaacaacagcagaguugacuaggaaaaaugaagaagaaaaaaugcaaaaaaagaagacacacaggagaugguggcugcuuucuagauacugauccugggggccaugcuaaccaugaccaccaccucguaguugcagaaaggccuagguguaaugauaguguaaucauuuugaaguguaugcauuauuauaucaaggaguuaguuaucuugcuugaaugcucucuucuguguuuagguguucuaugucacucuugcuguggaacugaugugcauguagaaaagaacuuuaacuguaugaaucuuuacgacacuugugaaaaugauacaauuugguuuaugcacaguguaauauuucugcaggcaucauccaaaauuccccacaaacaaggcuuucguccccauuagaugcggccucagcugacaucugcgacuguucuauuaaauugaugccagaguuuuuacauccaguuaccucuacuuucuagggcauauucucuacuaauguuacucaaaaccauuuuuuacuacauacagguguuuuaugauggcaauuaaaguuuuucuuccacaaguugagucuuuguaagaaaaugacuccaguugcuuguuucauauucugcuguuuuaauaguugcuccugcauguagaguccuaugguuuuuccaccaccuuugaugaagcaauacacugcuacacugugggcuuauauuauaaucuuacaaucccagaugagaguuuggagauggucccuugauuaauuuuuuuuccuaagacauaagaauguggucucuuuauuggcaugaauuucuguggaagauaaaugacaaaacugaauguaucaaauaaaaagaacucagucuccagggagaugagcaaggagaacccauuaaagaaaacuccauggaaaugauaggcugugcagcacaccuuaauuagca

SEQ ID NO: 3047 - RNA, 887 nt, Mus musculus
uaguacguggccgauucugagugugaagaggaccguccccugugaaaggaagaagaguggaaaggagucccggguggccgggagguggcugaucuuaaagggauagaugcuuuugcuauucccaagccgaauuuauuuggaaagaagggaugagaguugggggaaagugacugcacaggucauguguccuuagaaguucaggaguugcccaauuuguggcuaggaagguauuaagaauuacaauuacagcuuugauagagaugacagugaucuguagaacagauaacccagagcgcccggaacgccucuuaaccuguuuauaaaggaggaucccaggccuggcgcacuugaaguaaucugcacaaggucacacagucacaaaaauuuauuaagucucccgguugguuuggcaugcuuuacacugcccucaggagaaauagaacgacaacgaccaaaguggggaagguucaaauguuugaccaaagcguuuaaaauucucuuaaaguaguugcgaauacccugaagauuucagagcugguguguggaagaguaagaaguugcauccuucagcaguguacucagaacaccaaccaaacacugggaagauuuuuaaugauguuggcaguuuguguacgcuggucuccaucugcaugaagcacacuuaauuuccacucagccccaaucccuauaaacccauuucucccuuuaguucucaccacauuccuucucucuucuguacaacaaaucucuaaagcgccuugucuuccuguccucucucaucucacacacacugcacaggcauuaguauuccucagcuccacccagauugcucugauucacucacaugguuuuaauaaauucgaagaggagucccguuuuuccuccua

SEQ ID NO: 3048 - RNA, 60733 nt, Mus musculus
acggaacccucgcucaaugggcgaugucugcacaaggcugucacucagguggcaguggcugagacguggccgggcagcucugcugcugcggcgcgaagucgagaggcggcgggguccguggcgcgcgcucgcagugcuccgaggcuccgagcggcgagacgggcgggcgccgacggcagggucuccaugcccgcgcguggggcgggccgcugauggagcgcgccacccggcccgggccgcgcgcgcugcugcugcuucuguuccugcugcugggcugcgcggcggggaucucggcggucgcgcccgcccgcaguuugcuugcucccgcgucggagacaguguuuggcuuaggggcagcggccgccccgacuucggccgcgcgggugccugcgguggcaacggccgaagugaccguggaggacgccgaggcauugccggcugccgcuggcgaaccggagucacgcgcgacggagcccgaugacgacguggaacugcggccucgcggcaggugagagguugggaacuagggucggggcaccucucgcagggaugcgagugacugcggacaaagcagagagccgcgacaccuuccugucccacucugagcgccugccugguccuggcugugggagggcaacagcaucuuuaaaggaggaugagggaugccuggagaaugcaacacccggcuuagggaagaaagucacuuccccgcuuucauuguuuucgggcuuuaaccauaugcacuuuacacucccauucccaaauacuugacucguucuguccugauucuguugcgacagguaaaacgacuuucaaaagagaugccuacauuuauccuucaaauacaagucuguuguggcuccuggucgaggguuuugauuuucuguuucucuaauugagauaugcgggaacaccugcaucagaauuaccagggggaugcugguuaaauggacaguuuucuaggcuccgccccgguuuuacuaaaccagaccuuuucuggguaagaacaagcacucucaagagcuccgaacacacuuagagguuaaaguuuaaggagugugcuuggguucuuuuauccuagcagcuuuuugauauuuaaaggggguuagcauaguuuauuucaguuggauuucuuagccuuauaaacauacaaauucaagagacaaguuuuaaagcaauuuucaaagucugcacagaauguaaaauacuuuaauaaaguauuuuucagauagcauguguggagaaaguggcacuauuuaauagaaagaaugcuaaaagagcauuagguaaauuaagagcugcaucuaaauuagaacauaucuaaguuuguaacauaguaguuauagauuauaaaaaguaucagaaccuugaucuagguacccagugauuaccagaaauaaacagggcaagcccuaaaauucuccauacaccauuugaauaguuauauuuaagaauguuuaaguaauaaagaauacaauuucaucuauuugcgaauguaugaacucuccuagaugagugaaacagcugugaagaguaaauuacacgaaguagagagaacuauucuguuuuccuuagaacacacaccugcagcagcagggacuuucuaaagcugagcagaaccccugggguuauggagguagagcaggaagccucugcucuuggaaggaauacgcagucaauccagcaaucgggaugaagcagaagguccuaacuguagggcgguucaaaugaacaguagaaagcaguacaaaggaacugucaugggugaugcacaguuugcugguguaugcuguguaaggcaagggaugagguagguuuauagauaagaaauggcugugacagaaugauuugguucuuaaaaauggguagaauucugauagaugguggacuuaagacagcaagaagaauggggguuggaaauuauauugagaccauuuuggggagcgugugugcgugugugcguguguguguguguguguguguguguguauucuucgccuaacagcauuaucacuuggaaccacguuagaccuccagaaucaaguaccucccaaccuacuaagcaccugccuuguaauagaucacugugugauuuauauacacauuagucugagaaaucuuaaucuugaauggucaggucuauuucucuagcaacaagguuuacugaaacaagguaaagauacuaguauuauauuccauuacuugggacuaauaugagagauaguugaagcaaaaucuuaguuccuagcaagugaguugguucuucaucucuugauacagcuguauaaagaucaagaguuaguggccagaaaaugauagcaaacaggaacaucaagaggcuuagagaaucugggaagaaaagguaagggauguugguccugaugccucagagauuuaggucauccagauugaugcuugccaggaagauggacaugaaagacuucagcuaaagggaaggcagacagauagcuacaguuauaaagcagagaaggugcccacaagaaagccccaggaaaucuuauagacagcagcaacauagcugacuagguuggaguauaggacugagucuggaaaauuuuggugaugagcacacuuaauaguuucauuaaaccaaggaaguaaguugcaaaggguaagaauuacucucuuucugaaucacucccgacuuuccuuccugguaguuuaccaggagggagccuguauggacagguuggaaaugaaaggaaggaaggauaagauacagagaagccaugggagguaggaggcuugcugugagaucugaguuacaaagggcagcaaaggauugcuugucaaucaggaggaccacuuuccuccugcucagacacaagugaaaauagaggagguguguugggaggagagaguguguggucccuguuaacaguaguguggagucugcagagugugaaugagugagaagucaugggcaagcggguccacaggagcuaaguagucagcguucuaccuaagugcucuucacaagccaaaaaucugaaaauauuaguuccauaauaauagaacaauauccuguuuguuucaaggggagggcuagaggggcagagcugaguuaaccaagcguugauuacaaacagcugugaagaacucugaagcuugcagaagggggugagggguggcugcuuuuuugugccuugucuuuugaugauuagccuuagcaagaugggaccuacugagacucaguucucucuugugauuggcuuucauccaccuuaccuggugccugaauguugacucugucucaggcaugugacuggcuggauaaacacccuuuuuccaaaaaauguaaacuuguuuuuccaguagcagucucagaaaguuuucuucuaaacuuuagacugguaaaugguauuuccccaccccaccccccacugagaaaauuaggacaaacgccucaaucacacacuuaacuauggauacuguuguguuaccagcucgacuuccaacauguguuaauaaauugccaaguguuacucaggguuccugcaguagguuaggccugcaauuccuuacuugcuuccugcagugaguuuggccuacaaaauguuauuugcuuccugaaguggguugggcccagggaaguguuacuugggguuucugcaguggaucauuuaucuucacacugaagacauguugaagguacaaagaacuaauuuagucuugcuugucauacucauugcaaaguguauuuccuuuuuccuugcuuggucucuauacuuccuaacaaaagaauuacuaaaguugauauuuccuggcgucuugauacacugugcaccugcugucagaaguuuuuggcuugaaauaacauuaaacauuuuuugcaaauauaagaugauuuaauuccucuuuauuucucuuucauuugucuuuccccagacugagcugauaggaaccaaaggugcagaaagcugguuuccucagauguucgaauucauaauauuuuguuuguugucuuaaaccccacugggccuuuaaaugauauagcaucuccaaauacuguguugaaagagagcauuguuacccauguaggccugucaggguucacucuuccacccuggacccuggagguuaaccaaaaacuugauuuaaagaagaacuuauaaguaacuuugcaaacaaguuacuaccaaacuaaacuuaccuggggccaguaaauggacuguccuuccucucuguaguuuccuucgacuugacugaugccuagacugaauaucugugacagccacgaggcuguccuugaucugaccucagcucuguguguucauuuuaccaaagggaccugucugucaguugcugugagcagccauuagaacauggcuccucaauaccuggcggcaucuccaccuguuuuuuuucuuuuccuuucuucuuuucuuuaaugaaagcgguauacauacauaguauauguaccuaucuauacggauuguuuaaaacguuuugggggaccaucaguagcaugaaagaggcccagaggugaguccaaaacaccaaaacaagcaaacaaagaaagaaaaccuauuuaagacuacaguaacaaaugauagagaacuuguaaguuacaggaguaaauauguaguuuuaaacuauccuguucuauuugugaguaaaucuuuugaguaaauuguuucauuguauaauauggaaauaccuuuuaacuugcaaacuuuauaugccccagcacaggggaacgcuggggccaaaaagugggaguggguaggggaguuggggggaggguaugggggacuuuugggauagcauuggaaauguaaaugaggaaaauaccuaauuaaaaaaaauaaaaauuaaaaaaaaaaaaaggaaauaccuuuuacuuucuucaaguagcccaaguuggccuugaacucaugaucuucugaccuacaccaucuaaauacugagcuuuuuuuuuuuuuuuuaaagacaaaguguugcaguguagcccaggcuggcccaaguuuuugagccuccagauucccuauuggcaggauuauaggcaucugccaccauuguuuggaaaauguuuccaucuuuaaaaggacucucuguuacucuuguuuccuguaaauuugcuuaagcuucuucaaggucuagcugauaucccaaaacaauugagugaaguugacagcuuugggcauucuguuuguuuucguuugaggcuuggcuguucuuaugauaugccuaaauacaggaagcuugguuaaaugguuucuuuaguagaugaggacuaggaagucaaagccagacagcacuaguuguuuguuuguuuguuuaugagaacauacacuuccucuauugaaaguguguuuugguagaaaauucuuggccccaaaaacagauauaucaaaucacauucucauguuugugaaguaugcuuacuagaaggaaauaaauagaaaauauuaaaguaagcaguuguuaaucuguaauuauucaauccagauaaugcccucugucaccuguuagacuguccacaggagauaagacuccuuugaaggaguuuagcaucuaccagaauccagcaaaccuaacggucuguggguagauauucugagcaacuuauucagagccagggcuucuuuaaaauucaaucagagccgaggcaaucugugcauucauuuggccucgggucauuucuguuaaauugagggcguauucaaagugguuacaagauaaaugacaccuugaugacauuucuggaagaaaaaaggcugcauauuauaguagaauaauaggcagauuuagaguugauagacuaauagaguugggaagccugcccugugcuuaccgagacaaguuccauuucuuugcaucuuccucagccucccugccuguaugauguggauaaugccuuuaugucaugcauuuacuuuguguaauaagcauuucuuuauuuuacaaggcuagguacugagaguagagagaagcucagggucuagcagaaaaaaaaaaaacucuguuuacugaauuaacuagauuauggagauagucaggcauccuuauaauggcgugaaggcaaagagauugagagugucacugucauauaauuaaguccuuaaauuaaauaagugucaggguaagagucucagugguugagagcacuugcuguucuugcagaauucccagguuugguucccagcaccuaaaugguagcucacaaccauccauaacucuuaguuccaggugaccugaugcccucuucugaccuccaggggcaccaggcauguauauauggugcacauacauacaugcaggcaaaauaaaauaaaauaaaaauuucugucaaagaaaugucaaagaccagagaaaugguucaguagguaagaugccuugccacagagccugacgauuauacuggaucucuggaauccagaugagguggcacuuaugaaauccuugcauuucuacaucgagaugggaugggagacaggagaguuaccgagauacuuguaggucagcuagccuggaauacagugucuugaagaaacaagggagauccugucccaaaaauaagguggaaggaaagagcugauucccaaaguuaucuugugauagccauaugcacaugcauguguaugcucgcucucucucucacucucucucucucucucucucucucucucucucucucacacacacacacacgcacacacacacacacauaaaauaaaaauuuuaauuuaaaaaagcaguucucucgggcacaauaggcaacagacucacucaagcaagggcacagugaggguuuacagugaauuuaacaaguuucuaagccugagcucccagaucacuauggaucugcauagugaucuuugagaucuggugggaaucuauggacuauagaguuuuuaaguaauguaauguaaugagacauuuaauaaaacacuaauuaagaagccaagccagauagcguauauguaccuguaaucccagcacucagaggcagaaggaccaggcauuuagggccauccccugccauauacagaggcuauaggacagacaagacagacacaaaagagugaauuucuuugcuuugaacucaaauuaugugaaagcuuagaaaguaacuauaguuauugcuuuccagaaacccuuaauauuuagguuaguuuuaauuauuuucuuuauuucuuuuuaaaaaaaaauauuuauuuauuuauuuuucauauguaguacaccacuguaacuguuuucacacacccuggaagagggcgucagaucucauuacggaugguugugacccacccugugguugccgggauuugaacuuaggaccuucagaagagcagucagugcucuuacccacugagccacucuccagcccuuuaauuauuuucuuaagcugggaacaaugcaggcuaccaagaugggucagcagugaaggggcuugccaccaacccugacuacaugcucuccauuccucgaacccacuuggugaaaggagagaaccagcuccuguaaguugacuucugaccucuacaguuaagaucuuggcacacauaggcugccccaaacaaacaaaauaaauauuaaaaaaaaaaauagucuuaagcacuuggcaaaugaaauauuagcagacagggugaaaauugaaugaacaagggaaccuuguugaaaggcuggaaaccccuggggggugugccuguugucauggguugagagaggugugaggagaggggauucgagcuuggcagaagaaaguacacaggagccaaacugcaaagcaguuggcacagcagagaaguucauccgagcucuccucuggaagcaagcucaucagaaaagcaaagaaaugguccagggccagaagauaccucaagagaggcuuuugagauguuuugaugaacaacgagucuguucuagggccagggcagaaacaaauguaaaggcagcuucggaaauagaaucaagaguucacagcugggcuggcgagguggcucagcagguaagagcacugacugcucuuccgaagguccugaguucaaaucccagcaaccacaugguggcucacaaccacccauaaugagaucugaugcccucuucuagugugucugaagucagcuacaguguacuuauauauaauaauaaauaaaucuuaaaaaaaaaaaguucauagccaugaucuuaaugucucaagagggugagaaagcagguggugaugucugauggcaaaguguuucagugugaggagagaagugggaggaagacauuggguaagagguuuggcuuucugaaugccugaauuccugauaagggguggaaccuacugcugagcuaugguaaaagggauggcaaaccauagguaccaugaagguuuguuuggagagaaaacuguaggcuuugguuuuccaggaagagcaugcaguacaaacagaaaguacuugcuaggaagagaugaaggcuguggggauggcagaugagaguguacaaaacugguccucuaggaagcagggaccucugugggucccuugauaagggggauggaauacugugaaacccuuucuggagauagcuggagagaucugggacagugcucacugggaaucccaaacaugcucugcuacacugaagaaguugcaaaccagguggugguggcgcaugccuucagucccagcacuugggagaccgaggcgggcgaauuucugaguugaaggccagauuggucuacagagugaguuccaggacagccagggauacacagagaaacccugucucaaaaaaccaaaagagagaggggaagaagaagaagaagaggaggaggaggaggagcagcagcagcagcagcagcagcagcgcuuucagaaguggcuccagaucauguucuaaggagucgugauuucuuugccuccucuguugcaagccauuuagcacagcugagcuuagugugaaauucacccuggauaucacgauacauuguuuugugagccuuuaauaguuuguaguaauguuuauggucaggcaguuuggguuauauugaucuggaugaaauaacaggcagcucacaguugccuauuaacuucagguccagggguuacaucaacuucuccuggccuccacaagcggcacaaacauguaaccuacacauacaaaacaaacagacacacauacuacacauaaauaaaaauaagucuuuuugugggacaaaggguagggagcaggaaucugggucucuguguagccuuggcuggccucaaacucaaccgaggucugccugcuucccaagugcuaggauuaaaggcaugcaccacuaagcccagcuaaaauuaaaucuuuuuguuuuguuuuguuuucaaaaaaaguuuuuaaauaaaauggagagcaaccaaggaagacaccagaugucaccuucagacgugcacaggggacacauauacaugcaaaaauaaauauauaaauaaaaaguauaaaagcucaagcugggugaaacugaggagaauaaaggcagagccauggagaucuguacugggucugacucccaagugcuaccugcgaauucuuucauucuugaauaaguuaaggguuuucaucauguuugaaguagugcauucaugggaagauaaaugucuuucuguucucccucuuuuccucccucugucccaugccugugucaccucuguccccuuguuaucccugcacuuggcuuguagcagagucuggcugcuugcuugcugcuuucacagucaggggcaucgagcaugcaucucaugacuauaauugggugaucuacagacccuuaugucugcacugucccggugaugcaucuuaauuccagcuguagcaugaggaaggagccaaagugagcacuccuaguaugugacagccaccuugucacacaccccagccuguaacacagaacguuugauacgguuugguuuggcuugguuuugaaauacucacagagcacccaugaggcuggggugaggcucucuugaccuuaguaguucuagacuagcuuggacaauagguagaaaguuuaaaaggaauuagacuggcccuuuucuguggguugucaucuggaguuauguggcaagauuuuuauuuucacaaauuaaagacuuacgacuucaaaguuuaaaauaagaaaauuaacacauaauuuggcacuuacacuuaucuuauguauuuuuggguuuuuaaagacaggauuuuuacuuuguagcucaggcuggccuuaaaacuugguauguugcccaggcugguuuucuggagaucgucugucuucugagugcugggaucauggggugugccaagauaccuuacagauuguacugcgagagacuucagaugagguuauauuaacuuaguccccugacugacucauagcuuugcuuugugcggaacauaguuacauauauuuggaauuggcauggucuuuuuacaagauuugaaguuuuuaucuaucuguuuguuuuguguguaugugcuucugcaguguaugcuggagcacccacguuugaagaucaguggcaaccuucaggaguuaacucuccccauaaccauaaaaucaaacucaggguguugggcagaucaugcagcaucuuuaccagcugagcccaccacacccaugcaugguuuugaaagcuggcagauaagcccagggaauuccugcuguuccaccaggaaucaaaaacaguucagcugaaaccaguguucaaaucuuucauccaguguacaauuuauagagucugcuguguaucugggauguaugacccaugcaaaagagacacuaacaguaagaaaaaucauucuguuugaacaugugaaggacucacagaguagucuugacuuuggauguaucaacuuugguuagccaagaagccuguuagguaacuucauuauaagacagacuugugugucgaggggagaggccuaaagccagagauaaaaaauugggaauuccugcagucaagucaaauucaguuccuauccucucaugaugggagcuggcccaaauggcugccacagcaaguucugcugcucaugggcccuguguccccagcccugggaccuagggauaaguuugguugcagacauugcauggaaaaaaaaaaaagaaaagaaaaaaaaaaagaaagaaagaaaagaaaagggaauugccaacacagauauguguuuaaagcuaugagacuggcugggaucaccaaaguaguuaaaccuaaggagagacucuuuuaagugacuggaaagauaaagaggaaccagaaaauggaacugagaaagaggaucauagacgagugaagaaauauuuuuuucauuuucaaaauuuuuauaacuacauuccccuguuaccuuuucucccuccaguucugcacgucccuccccccacauacauauacauacaacacaaauauguaaauacagccuguccaguucauauaaaguucguucugggugucagggcugaccacuucguauuggauacacgugcagggcugagagagcucuucccauucucagcaguccccaguggcuuuuucuuuaggguugaaaucguucgcgcucucccccuuccgugugucauguccacugugcaggccuuguuuaggcagcccuguugaugagacuucagcgguguagcuucucugacauuucuagagacacaauuucacaacacacuuccuguuccucagauccuuacuaacuugccacuucguuuuuguuuuuguuuuuguuuuugagacaggguuucucuguauaguccuggcuguccuggaacucacuuuguagaccaggcuggccucgaacucagaaaucgccuccuucugccucccaugugcuaggauuaaaggcgugcgccacuaccacccgacaacuugccacuucuucuucugaaauaauuccugagccuuaugaguuaugguauagauguugugcuuagaacuagguaccacauggucccauggucuccuguccucugcauuuuaauugguugugguuuucugcaauggucucugccuguugggugggggugggcaggcugugguggcacacgcuuugaaucucagauggaucucugugaguuuaaagccauccuggucucagauugaguuccaggaaauccagggcuacacaaagaaaccccgucuugagaaaaagaaaaaaaaaaauuaggaaacuaacuaggcaugguggcacauacuuuuagucccaguauucaggaaacagaagcaggugggucucugaguuugagacuauccaaaucuacagguuccuggacaaucagggcgcuauggccacuuagagagacccugccuccauaagcaaacaaacaaacaaauuaggaaauaugcuaucuuaggaaccacauaaagaguauguuucaagaauugggguaggggaaaguguuguugggauggauacguaaagaauaaaaauuaaaaagaaaaaaaaaguauguuucucaaaguacaggacuggcccugagugucauugugaagucaguagcgaguccaguaagaacugccuuaguacucugugggaguuugguugcaaaaagaaguaaguaagggauuggaggguagguauaagagaguaguugguuugcuugauuguuuuuguuuuugcuuaauuuaguauugggacuuucaggguucuuugagagggggcuaugaaacagagacuuucuguguagcccaaauugaucuuaagcucuuaauucugccccugccuucuugaugcugggaauauagacuuauccaccaggccuagcucauucugauuuuaaguuggagggaauuacagcagauugaauccuagccguguguaucaagcugcucuaguacaguaccagagauugaguggcuagaaacaaccaaaauauuuuucucacaguuguggauaagaaagagagaggugagggcaagaugguacuaaggauaggaggaucagugacuuaaagaauuaaaaaauuaaaaaaaaaagguuuguuuguugggcgucaaagaagaggaagcgagcaggagggagaagggcuggugguugugacaugcuugaauguggccuugauagagucaggggucugacaggaggggcuggugcaagguagacacaguaaaacucagagaacugaggcgaaguauguaaggucaccagcagcuaaacucuuccaggaauaagcuaguuuccuuugugagggucagcacaggaccauuaggagcggugauggaugggacagucugguccuaauaacuuugagggagaaguggaagaaaaugagccagaaguagcaaagagauaaaaaccugguagucaagagucaugguagcggaauguccuuucuuccauagggaagcaguauucuuagaguaaguuccaggaaagcaagcaucagagugaacguuuggggaggggccagggcucagccaauaaaggcuuacuguauaagcauggggacccagguaaaaacccgguguggucgugcacuacuacuguaauccaagaccccggggaggcagucagggagagcccuguggcucagaccuccacagagauguacauaugugcacauacaagaaaguucgggggaaggaggaaugggucucaggagguggggaacgggaagaggagaggacucagcagggauguucccaucuucaugguagugaggauguggaaggaagggaggccuaggaguugggagcuuuuuaucagagacuugagcagauaaagggcguaaugaaguuaguuguccuguucuagagauagauggguggcaaaaccguaaauguugaggggcaguggacuccccacuucucuuacugauagaaccaagugucuuucagugaugacauaagugcaaggugucuuggauugcuuucuaacuuuguucauuuuucaucuacagguccuugguaaucaucagcacuuuagauggacgaaucgcugcacuggaugccgagaaugaugggaaaaagcagugggauuuggacguggggucugguuccuugguuucaucuagccucagcaagccagagguaaggaaagucaaguuguauugagaaucgcugcugugucuugugaggcucgaguguagcgccucacuuagagacuucgaacagucacuucaccugucuguaaaaugggguggaugacagcacccguuucuuaggaucgcugcaggcauuaaauguguuaaucauaucaguaacagaggaacuguguccgcuguauuguacagcacauuaucugauggauaacaugaucaucuuuucuuaagaucaucuucggcucuccaaggaguaacaauuauugaaaauuucuaguuagaaauccguguugcagaauucuaugcuuuguuauucucuacauuuuuuuuaagucuuguacauccuaauuuucuuuuuuauaugguccaaaccaagucacuuaaaaauguguguguguguguguguguguguguguguguguguguguguguguguaauuggaguggaggagauggaggggagaggacccaggcacauaggcacacaugugccagguugcacauguggagguuguaggucagccuuguggagucaguucucucguuccaccguggguccuagggacugaaguccagucgccagaccagaccugugagguaagcacuuuuacccgcugaaucaucucagcagcccuaaaggcaccacauuucaguacacuuuauuaauuguagagcacuuguccuuccucgguaugagcucuagaauauggagagcagcagauucagaccaugcuucuaaaacuacuccgucuccgucccuuagcagugaguucuuccucagugaggaauggcccaccccagugcgaugggauggagagaggauacaagagaggccuugaggaaauaagccuauuuuuuaguauuuaaucuugccucuggggcgccuccuccuucugagcuuuagucuguaaguaaaucucucucuagaguugcggcagcugacaugcagucagucaccugucuccucccacaucaguccucccugaguguggacacccucacaguagucaucucuuacaaaacucccuagccauugucaagcugggaagagacaaacucggacaugagggguuuaagaaugacuuauuaacguuguggacaugggcacuggauacaccacuccaggccucccuucuguaaccacacuuccugugcccuccagcaagcacagccugcaucauccugcaaucuccacacaucccagugcuaggccuggaucgagcaguguuuguuaugcuccguuuuuugucacaugaugcgcugaaguguguuuugagacuagugagauucugugguuaagaacacuaacacuaagaacaaguugacugucuuuaaacugaaaucaaguuuuaagaaugguauucaagggcuggagagauggcucagccauuaaagacuagacguacaaccaaacauguaagaacgguauucaggccuggugguggcggugugcaccucuaaucucaucacucaggaggcagagacaggcaguuugagacuagccuggucuacagagcauguuccaggacagccagggcuacacagagaaacccugucucaaaagccaaaaacaaaaggaaagguauucacaugauuaguguuauucucauuaaacaugcuuauuugugcucuucuagaaucuuccuuauuuuuaaacuugaugugaaagacgaucagcaaauugagaucauaaaccacuuacaucugagguaauuuuaguguguugugugguucaaagcauguguggauuuguaaacagaaaauccacacauaaaauugggugagcuguguggcauggccaaguggagaacaaacagcuguacuaacaaguccugccagacgugagcaagcgcuuagggucauuuucagcugcauagcagguuuaagguuagccaaaauauccaugggccggugggauggcucaguggguaaagcugcuaggauccaagucugacaaccugaguucaaacccaggguccacaugaugaaaaaaaugaacucccauacauuguccuuugaccugcgcuugcacccuauggcuguaacccacccacccacaugcacaaauaaguuaauuaauuaauguaaaauuuuuuuuuacauuuugugucucugugugugcacgcaagcacacacgugcacauuuauaugcauauccagaagccagaagaggguguuguaucucuuggagcuggaguggcaagagguugugagccacucugugugggugcuuaggaucugaacucagauccucuguaagaacaagaaguucucuuaauugcugagccaucucucuagaccuccaaaaauuaaaagagagagagagagacugcuauacauuaucuacuuuuugaucauuuaugaugauagcuuaauaaugguuauacauagauauguuaaugacauuguucucaguguuauaauauauacuugauguuccuuauagucauccucccaauguuggcaagucaaucccauuuaaaauguuaaaaauugaaccucggcugugauuuacuugcaguaugauaaagacucgccuggaugcauuguguguaucuguccuggagccuuuucuguguguucugaaacagucuuauuggguauccuaggauagccuuguauugguaucccaggauagccuuguauucauaucuucugccucagccuucugaguguuaggauuauaggcauguagcaucacacccagcuauauaucuguuucuauaauauuaaaauuaaaauaaauugcacagguagauguaucucuaugaguuccaaggccaaccuuggucuacuugaguuuuaggcaagcuggagcuauacaguaagacucucuguaugggaaguaaaacaagagagagaaggggagggggggauagaauuuacagaagauuuacuaguuaauaauaagcccaaugcaugauagcacaacgugcuaucaguaugaaagaggcacucuuuuuacauauuugcaaaucucccccacccccaaccucccuuuuggauuuuucaaggcaggguuucucuguguaccucugauuggccuugaacuuaaaaagaucugccugccucugccucucaagugcugggauuaaaggagugcacagcaccacugccuggugacaacuagauuuuuauaauugcuuuauuaaauacauugcauuguugccagauaugauggcaaaugcccauagucccugcaugaggaaauagaggccagccuuggcuauaucaugacuaaaggccagccugaaauauaugagaccugucucaaaaaaagagaacaaacuaaaaguauacuguacuuuuguuucaauuauaugaagaaaauucaaccacauacaucggucauuuggagaagggaggaauauuuuaguggccuuuugcuuugguuugauacugacccagaacaaguaucugaaagagucugaaucuaaagcaauuaacauuuuaaagaauauuuuuuauguguuauuggguuuuuauuuuguuugugucagggucucaccauguggcccuagcugccuugaaacuugcuguguauaccugcugaccucaaacucgcagaaaucugcuugccuuugccucuggagugcuagguuuaaaggcaugaaccacucugaccuuauuugugugugugugugcgcgcgcgcucguguuccucauuugugcagugcucagagaggccagaagagaguguuggaucccuuggacuggaaucugaggugcuugugagccguccaguauggguacugggaacuaaaccccaguccucugcaagaacagcaagugcucuuaacugcugagcugucucaccagcucuguuauacucuagugcaguaacauccacuagcccaucuugccuuuuacaaaaacauccaugguuuucugacuuccauagggaauauagacuauaaguuauuaauacauaguacauuggaaaaaaaauugaguuugucauuaccaucacugaucuaauuagaaacugcuggguuggguuggguuggguuggguuggguuggguuggguugggcuggguuggguuggguugggcuggguuggguuggguuggguuggguuggguugggcuggguuggguuggguuggguugggcugggguuuugguguugggauugagggcuuuccuguauccuaagcuagguuacuacugugcuacuaccuagccuuuagaccuccuucuaaguacuaggaaacugcagguuuacuccuacagacacagccuaccuuguguucuaauuuucgcuugaaaacucaaauuuuaucacggguacuggcagcuguuuucuuugaugugaaaagccuacuuuguucuuacuggggaaaugucugguguuucccgagccucaucuccgucgcugguuucaguugaugaacagagugaagcugcuaaacagagcagacaauucaguccacacaagugcugcuccugagcugccucagaugcacccaagugcucagcacacguacgcccugguuagucacaagagcaggaagaagguaguacuagggccaagagcuaauaacauuuaucaugguuguugcuucaaauauuuuuacuucuccaucuguuucucuuugucucuguuucucugugugugugucucucccucccucccucccuccaucccucucuccaucuuuccuuauucucauucucuuuccucccugcccuuccuucuucaggagagucuugcuguggagcccacugucuucuagaaguuacaaucccccuguuucagccuccagaguguuaguguuacagguauuugccacagugccuggcaagcgcuuuagugcuaagaauuaaaugugaggucuuauacaugcuaggcaugugcucugccacugggcuucacccccaggaccaucaagaacugcuucuuguuguuuguuuguuuguuuguuuguuuuuaaaacagggucuuauuaugagacagggcuggcccugaacuuagaaauacccaccugccucugacaagaacauguaugaggccagaaacagugauucaugccuguaaucucugaauuucaaaaguggacucaggagaauaaugauuucuagaccagccugggucauacauugagacucucuuaagaagacacaagcaaagccagacacacgguagccagaucccugcacuuggggcagaguuugggagacguaaaucuaagaguucaagaucguuguuggcugcauccaggugacuuccaaaucaucuuggauuacaugaaacccugcuuuuaaaaaguaagcaaaacaaacagauaaaaaacaaacaaacaaacagaaaaacaacacucacacaaaaagcuugcauaaagccgacaaaguaaauguauuugcuguauaaauaugaggauuugcauugggaucuccuggcauggggugaaagcucguguaaugguuuaauccuggaaucccagugcugagaaaauguagacuggaggacaucaagacuuucuggucagcuacucuugcuugaucagugaacugucucgaacaggagguccagagugauugaaggagauacucagcauugaccucugaccuccacaugcacacauguguauacucccucccaccccucaagcacacauaugcacguagcccguauguacaagcacuauauuuuuauuaaaaguacaaacucauuaaacauuacacaucacaguauguagguucagaucccauuguauccugguuuguucugaugucgugaacuuuuucugaucugcaggggucuauaaaccagugugucguguugcuuuaguugugugucguguugcuuuaguuguauuuuggcuguguaggugaaacuuccuggugcacaagggagagugacagcuccaugaggagcgaauagugugaauuauauuuagaauugcauguggcaggaaggcucaggugccuugggacacaucucauuugccaauccuuccuguugacagggcacccacaaaacuuccucaaaagaauguugauccgaaaccaaccuacagcugugccucugagcguguguugggaugaccggggaaccagguucacucugggaacuuugauagauuaugcucccuaggaaaugaaccacuauuuuuggacaaccaguagcuaagacuuguguuuuaaauuuucagaaggaccuccugaggugaaaucugauuugcuuuuucuuugguaacugaaauauaguuucaaccuugaaaagguauggagauuuggcuaugguuccuuaaugacugucuuaaauuuuuacucuaauaaauaauaauucauucuguaguguguuuuuucuuuggaggucccugggcagccuuuggaccacacuuacaucuaaauagaauaaagcugucaugguagauauuggguaaaggcacuugcugcuaaaccugagaaacuuaguuugauccaaaccaauauggugacaggagagaaccucaaauuguccucugaccuccaccaccgugucauggcacaugcaugcgugagcauacaugcucuugcacacacacagaauaaauaaauguaauuuuaaaacaaaaucuuggcugaugggcugggcaugguagcacacuuuucaauccuagcacgcaggaaacgggcaaacaagauaucuguggguucaaggcuagccugaucuacauagugauaucuaggcaagccagggcuacauagugagacccuaucuccaucaaucagucaauaaauaaguuucaauagacuaaauguuuuugacucuuauuucucugugucaugggacacacauuuauuuauuuauuuauuuauuuauuuauuuauuuauuuauuugcaugcaggcaaucugacuuuuaguuaggaugccuuuaugaagaccauuucaagcguguacucgucugcagcuaacuuguacuuagauggcugcuuucaucuuggacuuuaaacacagcaugcuacuuucugguuuugcacuaugucugccccccuuuucccccuaaaaagagcaaacaacucuauuguuagucuauacuuacuuugaacuuaagaguuuuauuuuauuuuaagcaugguuauccccaggagacgagcauuucuauuucaaacaggugcauacacagacaggugcauaaacagcagacagcaaugaaaugcugcuauugguggagagaaguguguuccagcccaccuucacccuggucagcacaggggcuuccugccucagccguacaguagcaggauuaccggcaugcaccaccacacuggucugcugaagcaccuuugaacagaaggaacuagagcuggccaugguggcacacaccuauaauccuagcacuugagaaacugagacaguuggauuguuaguuugaagccagccuaggcugcaugaaugagauccuaucacccaacacaggaaagcgggugugugugcacaccacauguauagugugcuauucauaguuaacucugauuuguucacaaacaugacuuucauagaaacuguguuacuuuauuagaacucaguugggcauggguggggcauaucuauaaucucagaauuuaguucaaggucagccuggacuacacagugagacccuaaccccucucuccucaaaaaaagaaagcaagcugcaaucuuucucucuuuucugcuagaaacugaacuuaggcugagaagagggaaccacaguggugaaaacgccucuaugagauuguucuggaggcagagaugggagucguuuuccuagugacugauaggcgagagcucuguccauugggguggugcugccucuaagcagugguccaggcauauauaauaaaagcaggcugagcaagccaguaaacagcauuccucauguccucugcuucaguccugcuccguguuccaucagugauggaguauggccugaaauaaacuucuccaaauugcuuuugauaauggugauuccucacagcaagagaaaaguaacuuagacagacuuuaugaacucuggagaaggccuguguguccuuugcaaucucugaaauguugucuaauugagggcuaaagagaaaccucacuagauaagaucacuggcugcucuugcagagggacccagguuugguuucuagccuuuaacucuaguuacaggcuaucuucuggcauccaugggcacugggcacacauguggugcguuuacauacaugcaaauacucaaacacauagaaauaaauaaaucuuuaaagauugucuaauuuauacuaaaagaugcccaagucauuuaaauuaauuguguauguguguggaugagacacagagaaagacagagagagagagauggggcugggggcucucagccuggaacacauguauuccuggcuggccuccaccucuucacccuccuuucucagucuuccaaaugccgggguuacaggcaugcaccagugugccuggcgcacauuucuuuugguuugaacauuaaacggugcuuuuugaaccagccaagucaucagcugugaaguccguucugaagaguaccugucaauuuugcagcaagccaguaucuaaaugauugcuuaauugcuuuucauuauagaaaugaaacugguuugauuuaauuuuuauuaauuccuuaguguggccgaaagcaaucugaacuaaacuaauuuauucuagcacgaguguugccaaaugagaaauugagauuacuccacagcuauuguuuaggaaacgggguucucccugugcguuguuuuucuauuuuauguguugacuaguuguguguguauguguguguguguaugugugugugugugagagagagagagagagagagagagagaguguguguguauguguguuuuagugcgugcgugcgugugugugugcacucgcgcacaugagagugugcaugcgugugugugugugugugugugugugugugugugugugauguggggaagggagguuucacuugccaccgcacucuugcggaggucagggacagcucuguguagucaguucucuccuuucacuugagauaggcuccaggcuugaccucuggguauccggcaggcagggucuugcccacugagcugucccugggccccuucucuucauuuucuuuguuuauuuuauuuuuauuuuuauuagauauuuucuuuauuuacauuucaaauuuuauccccuuuccucauuucccuuccaaaaaccccccuaucccauucccccucccccuguucacgaacccaccuacucccgccucccuguccuggcauuucccuacacuggggcaucgagccuucacaggaccaagggccucuccucucauugaugucccacaaggccauccucugcuacauaugcggcuggagccuugagucccuccuuguguacucuuugguuggugauuuagucccugggagcuugggggggggggggaagguggguacuggcuaguucauauuguuguuccuccuagggggcugcaaacccuuucaguuccuuggguccuuucucuauccuucucuucauuuucuuuugagcaugucacuuuggguguguccuaauaacuggauauaucagaagcucucaagccccuccugcaggaacuucagcuccuguuagcugugaagccccucgucaucugugaggcacuguccuuagggauuccuuaguaaccuuauucguauuucccccaucaguaacuuuggcauuuaaggggaaauacagacuguuucuauauacagcaguguuggggcuucuuuuuguuaagucacaaauaauaaaggguguagucacuuauucaucugguaguggagucagugguuuauuuugguuaggaauugacauuuuuggcugaggauauagcucauuugguagagugcacaauucccuggguucagucaccacccccacauaaaacugguaugguagcacaggcuuguaauaccaggagugugaagguggaggcaggagaaucaaaguuuagcaucaucuuauauuauacacauagaggauucaaggccagccugggcuacaugagacacuuucaacuuuuuaaaaaguucccauuuuauguccuacacagaguacaucaucuuuaaaaaacugaaauauuaaaaauauaaugucuuggcucuauagagauguggcucagugggcuucucuuccaggggaccugaguuugagucccagcucugacaucuuagcugccuguaacucagagaaguuuagagcuuuaggcagagcaucccgcagaacccaagggcucccuacaaucccuucuucuucucaacacuccaugcauuucaaaaccuugaguucccaagacauuaagaccucucuccuuacaggaugcuaaggaaguauuugacuguucggaccuuguauuuccagaggagaggucugagcugcacacagaacaguguuaguguccuaggaaccaagaacuuggucaccuugagaguagagcaagagacagcugaagauuagacuuuuagaauccaguuucuuaacauugagacugggacagguggagaaaacaguauucagagauggagcugguuuuaugauuuuuauagguuuuucugcauuccuuucaaugucuuuaacugcugcuugguguuaauacauacuacuuuuuuuuuuuuuuacuuuauuuuuauuuauuuuuugaaaccgggucucaugugucccaggcuugggaaccugaacucacugugcuguugaggauggccauaacaccugagccucuggccucuaccuccugacugugguauuacaggcaugcacuaccauaccaguuuucugcaguccuggggauggagcccacacuaggcaagcauucugccaacugaauuacauccacagccucuaccuuaacuauuuuaaaauauacauguuucacaguuagagauaccuggccuauuuggcaaaugugucucuuguagacaacccccuugauuuauuagagucucuuuacaauucuuauagcaaagggaaugucaaaauccuuuccauuuuguuuauagagggauuggggaagccuaaaaaggagguaaaggagagauguguaagccuguuuauaacaaaagagcuuagagacuaggagaggugaaccuuuaaaaauaguuauggaugaggggaagaaaaacauuuuaaaaaaacaguuauggaagggcuggcaggauggcucaggugguaaagauaccugccaccaaggcugacaccugagcucauuuccuagaacccacagggugaaagaagagaacugguuccugaagguugucuuccaaccucauucauguaugccucuucacuacaguaaacauugcuuuuuuacacagacagacagacagacauagaaagauagaugaaauaguugugguauaauuaugaaaaucgacagaaguaugucaauguaagaaauguaagaaagacaggucucccagcaaguguguaguggcaugagggaccugaggaguggagccgggugaggggcagagcagucugucaugugccuuggcuucagaugcagcaagcggcguggcuaauaaauaaagcugcuguuguggguggacagugcccagcuucgugcuucugaugaguacuguccaucuauuuugccccucccuaggauuagugaguuucagucuugguuccuggcaucuuuguuguugcugugcugugcuacaggugccccuaccgugauggaggagggcaggggaguguuccccugucguuagugcuccaggguaacugucuucacuguucucucugucacugaugggaagguucucauccuugccccacuuucucuucaccuucccaugucauucuuucucacccacgcuacagccggaacuuaagucucuagcucuucccguugguguauuacaaagcagacuggcaucucuaggucacaggagccauuuucaacuucggucacacugugcgugaauuauuacuggauacagcuuuggggauuugauaaugguuaaugucugagucaguuauugacaaaacaguugugcauaugcgucuggcuuucaaagcagaccgagaaaaaaaaauuagaaaaaaaaucuaagaaguacagauaaagcaaauacagauuacgaaccauuaucuuauucuguuuaggugaauaauaggaucaucaacugacacuacaaugaaaaauugauuggggaacuuuuuaaguggcaaaauugagcugacuccuuagaacucaaaguuugguagccacauuaucaaaaguggggcagacaaauaaucugcaccuuauggcauaacacagggcucugcacgcuuuuuauguagagguucagauaguaaauauguaggugucagauaccuugggcaucgaaggauacauggucucuguugcuauuauaacaaugguugcaauuauagugagcucugcaguugcugcucagaagugcucauggauauaugcaaaugauagaaugugugaauguauuauaagacuuuuuuaaaugaaacugaucgggcaaaauuucgccugugcaguucacagucuccuaacacaauaggaaguaguaccagaucugaggcacacaguccaggacaugcauggguuaaaagaaguuguuaaggaaugugugaaguccuggauauggcccuucuauaggacauugaauccuuucuccaaaaaggagugauucucucuagagagauggcucaguggcugcucuugcagaggaccccaguucaauucccagcacgcagaugguggcucacagcugucuauaacucaaguuccagagguuccacuaccaucuucuggccuccuugaccaccaggcauacacauuguacacagacauaugcucagguaaagggcccauacauguaaaguagaacaauaaauauauaaacuuuuaacuuaagaaaagggaucugaaagaagccccuucuguggugugaggaaucagacagaauguauguauguggacucccucuauaaaguuagucuuugggucgaccugagaugugaacucuuacguucuuacgaaccaucuggccaagugucaguaguuauuggaaaucaauacacgagggcugccgcacuggccucauuacauuucagacguucagaauacuucacaguaaguuaaaguugaguaugugggcacacaggaagugaagacgacagccaggacugcacagagaagcccugucucugggggacguaggaaagaagaagugaauggaaaccguucacacagccggaggauuuguuuuucucuaauaguguuuguucauuuuaauguccuuuuccuguucuucauucgacguuccuuuuccccguggaaaccagaguucuuauucccacugcagucuuucggacuguucugacuacaugugcacaugugugucacuuagaguucuguucaggaucagaagucaaaucacuuuacccagcuguuaguucuugguaauugcacagaaaagcgcucuagaucuuugguauugaguuugcuaaccaguguggcagauccuucguuuuaaaauuaugacgggggggggggggagaacaaauagaggaaauaaauucaaaauagcaagaauugauacuucguuaaaugaccaaagagaaacccaggucccauaauuagcuugaaacgcagagcagcggaucagaacgaauagcugcucccggggacagauggguggaauaugguuaugcaucauccgucacugcaaccuacauuuuuuuuuuuucuaucaagagacucaaagcugacuaucggagugacucauuccuuugcuuagaggaugagguaaugcuauugugaggggugaugucaucgcuaccugaacugcaugcauauagaucacugcucaggcucuccaggaaaagcaccaucugcuuugauauccacagccugaaaggcuuugcagagauuggugcaaaggucgccagccucaaguaugacucauaggcagccaaucagcgaagagcggcuguugaaaaaguaaacuucuaaaaccauaauccaaacguaugacaggaugaaucaauacugaaucacauuucuuauaucgugugcuuugcacucacugaaguuaccaccauugaaggauuaaccucuagauauaaagccauuuucagguggucaggcaucacaauccuucuugguugauuaaagcauuuuuuuucuaauuggcgauaaauuuucuguuacuuuggagugcauaggucguucagugcaugugaguuugacagcugcuuucugcagauaggaccugcauucccuuggaaccagcugcuacucuaggggaagaguugcuaguaaaagaggacacaugucacaggaggugcucgcuaaugguggcagacccacugagccucccuucauuucggugacagugucccuuuggauuuacugcaauccgauucugucauucuguuguguagagcgucagauuccuaacagaugauagaaaacagacgauagugaauacuugauuuccuucauuuguaccuugaaaugguauaucaucugcauauuguaucuguaucugaaaugguauaucaucugcauauuguaucuguaucacaacacacauuugucguaauggcaacuuuaaaucagauagucuucaaauacaaagucaauuguguuaaguagagugugcuguuaucaagaaauauaaggaaggagggcuggagaaauggcucaguugguaagaacacuuaagugcucuaccagaggaccuggguucauuucccagugcccacauagcagcucacaacugccuguaacccaugcaugaauaagguuuaagagggacagagauacaaggaaacaaauaaguagaaauuuuaaacuaaguaauaucaggugacauacauucgaugucuuuggagaacuuaugaaaacagcagauacuagcuagacgcgauggcacaugcccgguacuacauagugaguucuagggcaaccugggcuacaauaugaaaucugucucaaaacugcaacaggaaggccauguaaauauccuauuuguuaucaaauuuucugccuagaaauaacauuaauaauuguugccugaucuaaauuuuuuacugucaugguuaaaaaaugcaauuuucucagucuucccuuuaaaaaaauuuuuauugguacuuauuuuuuuuucauuagucugaacuuaggaauuucucucuuuucuuugacuagugcuuccuuugucuggcaccauguguccauacuugucuuuugucauaaugagaugguaauggcccaucuuguauccacuccaccucgguucugggcucccauuuccuuuugguagaaaauuaaaaucuagauuuuuacuguagaguuaauuaacaaucacuggauacaaacaaauuaucagcauuucugugucugguaaauauuccuauaauuuugagauccuaacaguuugaggcuauaauagagucucagcuucgguugccacagaaagugaaggagagggcugaauauguuacagaucagugguagagcacucgacuaauacgacgcauuauuucacugucaguauauuaauucacucaccagggccugaagcccaagguuccaucccuauccuaggaaaauuagauacagagugggcuggagagauggcucaguggguaagagcacuggcugcucuuacaaaggacccagguucacuucccaccaccugcaugacaacucacaaccaucuaacaccugcuccaagggguccagcgcccucucuggccuccaugggaacugcauacacaguacacaaacaaauacaggcaaaacacauaaaaauaaauacaucuuaagaaaacagagauauaaaagcagagaggcugagaaguagagcaucagccccuuaucugggaaccugagaccuuugguucaauucuuaauguauacuaccaguauuugcuuggauuuugaaacagauaagugauaccagguugagggccaauaggauuuuagugggaaguuguaucagaaggugugccagggagaagaaacacauugccagugaaaaaugagugguaccaggaaugguggugugugguuauguaaccauaccagauugcugccacacggggaaaagggaaggacaugugacaggaagguuguuggaggucacacuuacaggacucuggauguccuccacaggauuucaaguccuuaggauuuggggucuuugguuagaagcuaauaaagagccauugaagauuuuucaaucuugucguaacaagcuuaacuggcccagagggauuaaucuaagagauacaucagcuuaaacugggggaauugcaguggagaucugugaggagguucugauaagagcucaggucagacauaauaaggaucugaacuagaauaugaauggaguuaggacaguggucuucaccugucuuccagacccggaguuuaaggcagaggucaggaagcagagagugugcguugacucccagcuuagagcuacuuaaagaaagccugcugcuccagcaacccaaggcauccaucugggguucuguguuaaaccaguaaggcugauguuuguuuuaaagaguuuguuuugcaugugugguuuguuuugucuucaacucuuucauagucucucuucccaaaguuuuaagcuuuauagaucaagacagaaguuguguugcuaauuggaguuaaaauuuaacuuuuaaugccagcagaagccaaugccaugaaguucuguacugaaauuccuaagacauucuuggcccugcuuuccugucuuuugcccaugcugcccagagaagccaccauugaaacuucccuguuauuacacagcucugacaugacauguccucacuucccucacuguuaaccagucuuugucuucugcuugcugcccaugccuccgcugucucuccucagccugugcacuuucucguggugccucauuuuacccggaagccuuugcaagcuuguuccccaaaugucaacaugauguacuguuucguguugagagcuuugccuggcuguuauuagcuuucucagcaggaucugccauggguucuccauugaccacucaaccugcaugcuucucugccucuuuaucuucaauucucuucccccuuaugaugaucucucucacugauaugacauauacauaccauuuauuuaugaauaggaugcugguuuuguuugucugcuucccucucuugagccacccguccagauuuuguucagcuggccguagugguguauaucuuuaguccuagcacucgggcggcagaggcagguagaucuaggucagccuggucuaagauugaguuccaagccagccaggacuauaaggagaaacccuguuuugaaaaaccaaauuaaaaaaaaaauuuuuguuuaaagaagaaaggaugagggcuggagagauggcucagcgguuaagagcacugacugcucuuccagagguccugaguucaauucccugcaaccacaugguggcucacaaccaucuguaauuggauccaaugcccuugucuguugugucugaagacagcuaugguguacucacauacauucaguaaauaaguaaauaaauaaauaaauaaauaaacguuuuuuuaaaaaaaaagaaggaugagucucccauaaaacacuugggaggcuuaguuaucagcuaacucaccgcagacuugagaaaguaaaggaagaaaagggacagugguuggauucgcauuccucacccugucugcgcuccuucggucugagucuaugauguaacuggcagagugauguaagccucgaaaguaauccauguuacccauuuaugagaauaucaugauccuuagcauguuaacagcuaggaaagcuacaguggccuuaucuauuauuuauaguuuuauuuauuuuuuauuucuauuuauuuauguauuuuuuacuucacuggaucuccaggcucucuuuugacaccuuacucaucaauaugagaccuucuugaccuauagcagaguuugagaaaaaccauauuggacggccaggccaggccaggggacuguggacccauaaggugaugggugacucuuucaauuacgucugguggauagccacauugauuuauauauuguucaaaaccccagaucuuauuaccacucuucaaaguaugaggcuuuaaaaagcggcuucuguucuagguguuugggaacaagaugaucauccccucccuggauggagaccucuuccagugggaccgggaccgagagagcauggaggccguccccuucacgguggagucccugcucgaaucuuccuacaaguuuggagaugauguuguucugguuggagggaaaucucugacuacauacggacucagugcuuacaguggaaaggugagugacggugcaguggggguggggagcaggcggauggaaggaacagcauguuuagucagggucucucuguguaacuggcuagccuggagugugucgaccaggcuggccucagacucacugagcuccaccuaccugcaugcaguuguuccuuuguaauuauccccugagaacaaacuuuguuuuaaugaaucaauggugagggaguaaugggaaacggaguuuauuuacggugaaaguaaucaucagagggcuagcgcgauggcugagcugccggaggcucacaaccaaaaauacaggaagaaacaucagaguaggacaacaggaggagagagaauuuauaaauauggucuacugugcuggguaggugcuuuuguaguguguuauuuugaagucuucauaaggaugauguauuuuauacacauuuuuacaggcaaagaacccuucaaagauuaguaauaauccugaugauaggaauaauuggugcuugucuaucugguuuggcuauaaaauugcccaaggagagagugccgcucacuaaacaguaaggaaauggagaccuuuaagggauucagaaacuccaagucagauuugccucagaucaggcugaugguaaagucauugauggccuagauucucuccagcaagacuccgggauacaguccagagucuuagucccuggauguauagacguuuucuguauagauuuacacuaugaaagggaaggcugggggcuggagagauggcucagcgguuaagagcauugacugcucuuccagagguccugaguucaagucccagcaaccacaugguggcucacaaccaucuguaaugggaucugaugcucucuucugggguagacagcuacaauguacucacauacauaaaauaaauaaaucuuuuaaaaaaauauuuaaaagaaaaagaaagggaaggcugggagcaggacuucuuaaccugaagguuccuaguucaguggcccucuuccaggagccaggcucuccgcagccuggggauuaaggauuccaugcuauccaggauggccauuggugcuuuguuuuguuugaaauugagcugucagccucccuuuauguuaguauucuccucuguaaaacagcagggcugaccagucccgcgguucucugccuggauguucugcuacgagaagucugggaucccagcauguuucugucuuuucugaggauuucaguuuggauccaacuaaggaggcucuguuuuucuucagucaaaagacauuagggcucagaguuuuaaagcuggauacguaacgcuagguggggauugugaggcugaguguucuuucgccucaucggagcuuuaguaaugccgugucugcagagauacaauuggcuauucauuucuucuuuggaauuccccauggaauuccccaaaauagggcucaaauuauauaaguccuuaaaaucauccauucccugaaauaaacauuguuggaacuuucaugguucuaaguaacucauuuuccgguuuaggaaucuaaagaugcccauaacuuagguauuucuuuaauuucauuuuacuuuuuuaaaaauugugagcccagcauggugugugccuuuaaucccagcacuagagacagagacaggcaaaucucuugaguuugaggccagccugaucuacaaagggaguuucaagacagccagggcaacacagagaaacccugucucaagaaaaaaaacaaauuauagagaucgugugcuggacauacuggcacacauuucaauccuagcaccugggaggcagaggcagguggaucucuuugaguucaagaccagcuuuaacuacaaaaguaaguuccaugccagccagggcuacauagagacaggguguggguggguggggugucugccugccugccugucuaugccuaucugucugcugucuuucuugcuucuuugacuuauuuuaugucugucuuuucagcugagguauaucuguucugccuugggaugucgccgaugggauagugaugaaauggaagaagaggaagacaucuugcuucugcagcguacgcagaagacugugcgagcugucgggccucgaagcggcagugagaaguggguauccgaacaucaggaauggcguuauuuagaaauuccaaaagcuggucaugcggugcacaccuuuagucccaacagaggcagguggauaaaaagggggaugugacuccauuaaaccuaggauuucuuaaagacuuuccuuuguacagauucugugaauccaaagcacaauguacuuuuuuuuuuugguuuuucgagacaggguuucucuguguagcccuggcuguccuggaacucacuuuguagaccaggcuggccucgaacucagaaauccgccugccucugccucccaagugcugggauuaaaggcgugggccacuaccgcccggcuacaauguacuuuuaagagaaaugaaugccuauguuaaucucaaagaugugaggagaaagcccacagacccaaaucaucauggcugcauuaguuacagcuagcuuuuuuaaaauucauauacacauucugucuacccauaaaggcagggcucaagagaucaacaucgggcacgagggagacaagguuuuuauaguucuggaguagggguuuccacaaauggggaguuugacaggcaaaauuggcaggguuauaggaacaggauuuaaacauaacaaguuagucauaaugaccugaaacaaagaccugauugcaaggaggugguccuugcuaagaguaggguugcaagaugguuauaacaacuuuugaaacaaagacaagauugccauuccuggaacugggagaacaaaaccauuaguaauuaagguuacagguagggcauagcccaauucuugcaaagcagagauuuaaucauaaauaggaaugaaccuaguuagucuuuacuauaagaugguuuucaagccuaaaaugggccaaacagcaucacaucgugugcugcaaggugugguaaccaggagucccauggagugaauguauuuuuagcuuaguccuuggucagugacauuuggccuaguaacaugacugauagaaguuacuuaauggcaggacacuugagugucuaguggaugccuuggucguuugucucacuagcccuauuuuauuuuauuuaccuuuucauuuuugcagugcugaggaucaagcccagcucuccccacgcgcuaggcaauguuccaucacugaucugccgucccagcucccagcuucagaguagucacuuacucugcuaucuuuaaaaguaccagccauucauuugaccuaacaaauaaugagccccuuauguaauuuaccacuuaauauaugauucagcuguuagauacgcugguccucugucauguccagacuuucucagcuugauauacuaagcucugagucaccuguguaguuaaaaaaaaaaucacuuuagaucccaucuugauauuuugaaacugaaccacuuagaaacuuuugucaucugaugaaauagaauugaggcaucuguccugaaauuugcuuucaaacccaauuaagaaaguauuuccuuuuuucuguuuuugcuggccugugaauagagauuuguauuugccugccagaguuuauccuacugggauuguuaaaucugagagcucugugggagcacaggugcaguuuaguagauuugugaguuaccagaauccaaagagcaagcgugggccucuaauucuauugagagagagagagagagagagagaucuaaucuccauauuccuuaaacauaaauauagauguauauauaucaacauuuccaaauucauagcuagaccauuuuauaaucuuagugacugucauuauaguuaauuaugugugugcauuuccugcucccugacuauagagaaaacauugcuggauaagacagacaucuaggacagagggaaucaucugucauaucuuggucaauagagaacaaaaauggguuuugcuuaggugauugaagaaguuccauuggaaucuaaaaguaauguauacagcuugccuuuuacacugguuuguugggguguacuuugcugcacuugaaugacaugugcucagguaauuaagaaauuaaggccggcugcaagucaccucauuuuaaugugauuuuguuguguuuuaugaaguacauguuaauuuuugauagaacgucuggccuuagguguuuacugucuacggccucagaauagcugcuugcaaaggaucagccacggcucucugaggcccucuugugguguaaaucagcauugcauuccauuucaaaaaguuaagaugagcugggcgugguggugcacuccuuuaaucccagcacuugggaggcagaggcagguggauuucugaguucaaggccagccuggucuacaaagugaguuccaggacagccaggacuacacagagaaacccugucucaaaaaaaacaaaaaacaaacaaacaaaaaaagcuaugaugaugucuucucacaaaaguguucuauuuucuucuucagucuaaaagcaguacuguauuauuugcgugcuguauuauuuggucccuucauuuaaacguaagauucuaaaacacaccuuuauaaauuuaagguggaauuucaguguuggccacuuugaacuucgguauauuccagacauggaaacuagagccggauucauugaaagcaccuuuaaaccggguggaaacaaagaagacucuaaaauuauuucagauguggaagaacaagaagccaccaugcuggacacagugauaaaaguuuccguugcugauuggaaggucauggcguuuaguaggaagggaggccgccuggaaugggaguaccagguauccgagaccacagacucaguagcucuguccccagguuuuguuugaccauacacauuacuagagggagguaaugccauuuuggaaucucagguauuuuucucugcuuuaaaacugugacuuuaagagacauuuuguggagcuggcaagaugguuuagucagugaguauuugcugugcaagccugaggaccugcguucagauccccaucacaacaugaaaagcgaggccugagguuccaggucuguucccagcccagggaaggcauagaaaggcagguccaugcuggucggccccgucugaccaguggauuccuguaauccuguaauuccuguaagagaaccugaaucaaaaauuaagauggagaagcuagagagauaaauggcucaguggcuaagaggagcugcagcucuugcagagaacacagacacucacagaaaggagggagagggagggaaggggaaggagggagggagagagaaggcauuuacaagcggaaaucuguaaauuccgcuuucguugcugacugcuucucuccucugucuaguuuuguacucccaucgcguccgccuggcuggugagggauggcaaggucauccccaucagccuguuugaugauacaaguuacacagccagcgaagaagccuugggagacgaagaagacauuguagaggcugcucggggagccacagagaacagcguguacuuagguggguagcguuagccaggaaaggcccacugacgcccagcgugcuucacuggcggcccuuucuacuuaguuuccgaguacuuucuuugccuuacuuucccuuaacgucugugccuugauuuguauuccugcgguuuuuccgcuuguccaguucugcaaccugauuaguuuacuguguucuuuucaucugagacacaaguuagaaaggcucagaaaugcccucauucuguggagccgugguucucagccuuccuaaugcugugacccccgguuccucauguggcgaucccgaacuauaaauuuguuguuguugcuacuucauaaugguaauuuugcuacugauauaaauuguaauguaaauaucuguguuuucugaucguuguggcaaccccuauggaaggauuguuggacccccaggguugagacccucagguugagaagcacuacucuagagacugaaaaccucgucacaucugugcuguuugcuuucuuccugcaagccacaguuuguuuauuucauggcaucuuuacagcuaaacugaaaaaaaacaaagcucuccugugauucuguacuacugagcauaucacauaaauacauuuugaaauguuuguaucuguuuagguuagcuuggguuauugagacaaaauuauauaaacuacaugccacccauacuucaacccagucuccaugaaaugccaugaucugaaggaacgaaugucuuugacaacaugaacaagucaaauauaucacuaaauaaucaagucauggaaauaaagagcgcccuccuuuucguaaaauaaaguaaaacaugagcaugacuuguagcauuggccacacuguuaucacggcccuggcauuagaguuguuuagauaaacuuccuuuacaggcuguuggaagcacagaaagucuuauuuuuugauguuuugguggaaaugguuuuguguuacugaaaaggugcuauuauucaguucggggaacauuguagaggcuuuauauauauauauguuuuucgguuuuguugagucaaauguaaaugcuuugagcaucuucccuggaaagagcuauguagcaaaggaauaacauuugucuaagugcauuaaaucagagcaaacuuuuaagaacuccaucaugugacugacauguuuuugaccaugugguugacccagggauguacagaggccagcuguaccugcagucguccgucagggucucagaaaaguucccuacaagcccaaaggccuuggagucuguaaauggcgaaaaugcaauuauuccucugccgacgaucaaauggaagcccuuaauccguaagucacuuagagacuuuacaaauacuacugaagugccuacuagguaagucaggugugguagcgugggccugcaacuuccuagcacuugaauguggaagcaggagguucaucgacauagugaguuugaagucagucugggugacaggagacccuaucucgaaacaaaaaacaaacaaacaaacaaacccagcaccuuuauuccaagcaccugggaggcugaaacagugggaucucuguuaguucauggucagccuagucugcacaaugaguuccagccaaccagggcacaguaagaccacaucuccaagaccaacuagcaagcaaagcauuuaaaacagaauaagccaggccaugguggugcagaggcaggcagaucucugaguucgaggccagccuggucuacagagcauguuccaggacagccagggcuauacagagaaacccugucucucaaaacacaaaacaaaacaaaacagaaaaauaaguguauguagguaaacaaguuaccugguaaucacauauuuuugagacaaauaaacaaauugaaguacuggaccaaauccuuuaguuuucuuucuauaccuuuugcguguuuuuauuguaaauguuauacuugaagggcuucuuuuaaaauuuuguuugaguuuaauuuuauuuauguggguuagagugaucaaacucaaguuugaagcuucgauguuagaugccuuuacccagugacccaacgugcugacccuuaagcgauucuuuggaugaaugacccuuucugcaucuguuguuuugagauacggucugacuauguuacccauguucaucucccuacuccuaagcucaaauugucugcuucacacagaugugggucaucuuccuaguguaggaccugauugcgucucaguagcaaggaugucucaguagcaaggcucuuugaccuguguucuugagcugagcugugggcaaaugucagcuaagugaaugaaugagccuaugccuuucauugaagucacgugguuaauaguguacguucucuuuagauucuccuucuaggacuccugucuugguugggucugaugaauuugacaaaugucuaaguaaugauaaguauucccacgaagaauacaguaauggugcacuuucaauccuccaguauccauacgguaagugucauuugucucgugcaguuauuugaaauuaauuaauagaauuaagacgaaguuaaauuggcugggugguggcagacacaccuuuaauccuagcacucgggaggcagaggcagguggaucucagaguuuaaggccagccuggucuacagagugaguucugggagagccagagcuacacagagaaacccugucuuggagugcggggaacagaacuguugcaguuguguuaacagagaaccccucgugacgcuuguuuucucagauaacgguuacuaucugccauacuacaagagagaaaggaauaagcggagcacgcagaucacagucagguuccuggacagcccccacuacagcaagaacauccgcaagaaggacccuauccuccugcugcacugguggaaggagauauucgggacgauccugcuuugcaucguagccacgaccuucaucgugcgcaggcuuuuccauccucagccccacaggguaagaugcucugucaaccuaaugugcuuccaagugguugcuguguaggaaaccucugggagggagaguuccggcacucagacuuaccagagaaucaucugcgcuuguacugucuccgucacuuagccacagagucacuguaccugaacagccaguaugacauagccuacugcugccagguugcagucucauacagugugugacuacaacauaguauuuaguaucuguguaucugaaauagaugaggcacacuuaaaaaaaaaaaaaaaaaaaacacuagccacaauuguuuucaacuuuauugcaauguuacgggucggcuggagagaugguucagugguuagaggaccugaguucauuuugcagcacccacaucagacaacccuuaccugccuguaacuccagcuacuggaaaucugacacccucuucuggccuccauagguguccacauguuuuuggcauagggucauacacauaaguaaaaaauaaaauaucuuuuuaauacauuugugagcacacuguuguggacgugugcuguagaugcuugaacggccaugauucaaagcauggcugcaugccauuucuaccuucuugucuucacguaggccuugguccauugcacucuggcuuucacuccucacagcucacaagagugaccuugacaggagcuuuaggugaccuuugguuaaauggaguagacaucuuccuguccccggcucugggucgacagugccaguugcuucuccuugacuuuccuaucugccuuccuugacccaggcccucccagucuccuuggagguugaauggauccuucaggacuucaccuuccucagcucuggccuccacugagaccccucacaugcucuguucucuucagcaccaagagucuuacagagagauuuccaaauuccaccuuccuccuuuuuguaagaccagggucuuacccuguaacccagguugaccagaacugauggcagacugccugccucagcgucaugggugcugggauucaagguuugaucccagaucuaaauccuuucucuggagcagcuuucuaguuagaacuauacaaauggcucaaaugagccguaucucagacugcgcccauucaucccauccauccccagccggucccacaggcauuucugucucagacugaagugcccugcucucuuaccacagccaaagcccuucucucccucaccagucaccauccgccaaggucuucuuucuaauuaucugcaguucucauuuccuucuuuauacacacaccugucaucugauuggaggaacauccuauaacuggguucauguccacuccuguccgccagccauucucauccccacuccaccuguagacccgaauaacugacuugacauucuuguuagaauuaaguuuagcuuucgucagcuaugccaggguuccgagugguccaugcccugacugcucuguucucaucugccccacgccuuagauccuggaguuagguccucggccccugucaaacacagccucuucccuugcuagugcaguuaguaggaaaggucucauuucucucugccugugacgacauucuggaaccagcuagcuacuuguccagcucuccagucccuuacagagaaccuggcaggacaagaaucaguuaaugaguggacgagccaugauuaccuccgcccuucacugugcuaauuuuuagucucaaccuuccuacugcugugacccuucaauacaguuccucauauaguugcgacccccccaaccauaaaauuauuuucauugcuacuucauaccuaugauuuuacuacucuuaugaaucauaagguaaauaucugauaugagggccaucugguaugugacuccugugaaagguuuuuggacuccacaaagagguugcaguccaccagugagaacagcugcucuagaaaaccuuuuagcuguuuguaaagaggcauugccagguuucauugcauguuggcagaacacuuauaaaagcgucuucagggccuggaggauggauggcuuagagguuaagaauauagaagaagugccacaguucaguucccaguaccacagggcaucucauagccaucugucacuguguuucuaaggaaucagacacgcucucuggccugggugggcaccuucacacacauauacauauggugcauacauguacaagaaggcaaacaugcacguaaaguaaaaaaaaucuuuuuaaaaagagaaagaaaacaaaauccauuugaggaaggcaaugggacgcaaaccuguugaagucuagaagagggggucgcugcuuugugcuugugcuuuucuuucagugccauuugcuguucaguguuaucucuugagaugagaugaugagcugacuucuguucgccuccguccuaacaguaacugcuuucugccuucucagcagcggaaggagucugaaacucagugccagacugaaaguaaauacgacuccgugagugccgaugucagugacaacagcuggaaugacaugaaguacucaggauacguaucccgguaagagucuuggcgagcgaccgucgaugcacagacagcuucaggcugugaagucagugaauuccgcugugaacucacauccgauucgucauccaccaacugagauauuagcaaaaugucuaaucccgugugagcugucgcuccucuuagaagauuggacagagugcaguuggcccuugaacuauugagggcuuuugcauuuggggagguggauucguucuaagguccuugacuagcuauuuuuaggaauucagaugaucgcucuucccucucugugaauguaauuggcccagggaggguuggcaucaauuaugucuccaccuuaacuguucucugcccagcugaggcaacuacuaaauuagcgugaguguacagucagagcuuaacuucauaagagcgacccggcagagcagccgagucuccagcacgcaugcauucauucucacagguacucaacagaccuuugauuugccaaguaguguccaaauucuagaacuguaaagaggaacaaaaauauuuugcccacauuuauggucccuguggugcaguggugcugagacauaugcgcuucauuguaacugcaaacaaacaaacaaacaaacaaacaggcauuccauccguuguguggacagugcugugggaacauuaagacgugugugaucagcagaaugaaggaagguuggauuucauuaaaggcaaagcaucugucccaggagagcgcagggcagaacaagagcccugaacucaagagaggauaggaugcacagcguaggucaaaccccugccuucccccaugcucucauuacaguacucaguauaccuagucagaaaauuaggaaaucagcucugccauggggaacgcaaacugcacccugaacugggcagucaugagacaugccuuccccucugaaccugacaggagaacaaagcaugguggcucgugacaguaauccaagcuguugggggccaagagcaggacugccaugaggcaccacgggugacaggcugcaggugacuaagcuuggcugagcaccuuccccggugggcgcacugacucucaggcaacccuaccugugucagcuuugguuccugcugagaguuccagcugugaguggacuuaaguggaauaagauugauugucuuuguuuagggaaauuuuaaaagcaaugaaauacagcuaaggaacauuuuuaacagaaaagccaaagaaagcagaacuuagagaggggagaagaugguacugugguagcugacaaaguuugggauagaacaggucauuagugcaguuacuguaagaacaagagauugccagcuaacaaagccauucauucauccauucaucagcaugaaguuuauaacuuaauguguuugcuuguuuaugcacacaggugaccuuagaauacugcuagucaaguucucgcugugcuaucuaugcgauacguucugacaguuguagaguauaugcuuuuguguguggugauguaguacuggacugcuuuuguucaauaucgaaauguuauuguagcauuucagacuuuaaaauuucguauguauuuuuuaagauaucuaacagauuuugagccaauucagugcaugggucgugguggcuuuggcguugucuuugaagcuaaaaacaaaguagaugacugcaauuacgcuaucaagaggauccggcuccccaacagguaacgggcaaugcuuucaguagacuuggaaggcaucucauuacgcacagugcccaccuugugcuccguagucacagugugcuuucuacuuccaacucuuugguucgaagcgaccuggagacugcguuaaaguguggucuuugagacuggcaagauagauugcuuggagguuaaaugcacuuguugcacaagugugaguucagaugccaccacccaaauaaaaagcugggcauccuacacacaccucugugugugugugugugugugugugugugugaguguuccagaacugaggggagaaaaaaaucuaaaauacacuuuuugaaaagauuucaguacuaccauauaccugaggcuaacucauguguucuuaauuuuauuuucaaagagacuucuaauguacucuuuuuuuuuuucaccagugagcaccaaauacuuaaucuuauuuucuauacuuuauacuucagggaguuggcacgggagaagguaaugcgggaaguuaaagccuuggcuaagcuggaacacccaggcauugugagguauuucaacgccuggcuggaaaccccaccagagaaguggcaagaagagauggaugagaucuggcucaaagacgaaagguaacucuguuaggcagacuuacagaugaguguguccuccuaggcuagcacugugcugugaacguggugccgggucagggccugaccugaggaggaaagugcggccggcaccuguaucuucuuguuauucucggaccccuggagaagaacuucagauuugguguaaagcaugcuuucucugccugcuuucucugcgugcuuucucugccugcuuucucugcgugcuuucucugugugcuuucucugccugcuuucucugcaugcuuucucugcaugcuuucucugccugcuuucucugcgugcuuucucugccugcuuucucugcgugcuuucucugugugcuuucucugccugcuuucucugugugcuuucucugcaugcuuucucugugugcuuucucugccugcuuucucugccugcuuucucuccaugcuuucucugugugcuuucucugccugcuuucucugugugcuuucucugcaugcuuucucugugugcuuucucugccugcuuucucuccaugcuuucucugugugcuuucucugugugcuuucucugcaugcuuucucugugugcuuucucugccugcuuucucuccaugcuuucucugccugcuuucucugcaugcuuucucugcgugcuuucucugcgugcuuucucugugugcuuucucugugugcuuucucugcaugcuuucucuccaugcuuucucugcgugcuuucucugccugcuuucucugugugcuuucucugcgugcuuucucuccaugcuuucucugccugcuuucucuacaugcuuucucugugugcuuucucugccugcuuucucugcaugcuuucucugugugcuuucucugcaugccuuuucuucauaugaauaauacucaggggauccacacuggcuuuucucagggugauguguuucuguaauacuguauccguucuuuuuucucuuuuauggguuuuucucuuggcaguuaauaauuuauaacuguguuguaaaugguucuaggcuauuucaagcucguucguuuguuuuuuugagaguuuuuccuguauagccuuggcuguccuagaauucacucuguaggcuaggcugaccucaaacucagaucugccugccucuguuucuggugggauuaaaaggugugcaccaccacugccuggcugucuauuucaguuuuuaaaaguauauauacuggggucuggagaaauggauuagugguuaagagcacugacugcucuuccgaagguccugagcucaggucccagcaaccacaugguggcucacaaccaucuguaaugggaucugacgcccucuucuggugugucugaagucagcuacaguguacuuacauauaauaauaaaucuuaaaaaaaaaguauauauacuuagguaaccugcagauaucaccaaccuagcaccccugcgguguuaccugugcgugaugugcuauaggagggaagcccccagaaaccaccaugaagaauagugaagcaacaugccugcagagcguucaguccuggaggugucuugcuaaggaacaccuauuacagacgccaggacaaaggggaguggccucucgcaucaaggccugugagcuacguuaauuugcuucagaacuggggcuguccagaagcccugucauuagcaucgcuuuccuaauuuacauuuuguacgaaaggcuacacagaugacuguguacauauuucagguauauaauuaagcuccuagggcuagagagauggcucagugguuaagaggacuuguugcucuugcagaggacuugggcucauuuccuggcacccaugucaggaagcucacaacugccuguaacuccaguaccagggacuccaauacccccuucuagcuucuacagccgcugcacacaugaggugcacaugcagacaagaaggcauacacuuauauacacaaauuugaaacaaaauuaagcuuucaaauaaaaauuuugaaaaggaauagauaggguaagauguucuuugucgcacaugauguguuuuauucccacugcguguuuucgguaauuguguuuauaauaauugaaacauuuuaaaccacugugcaggucacaugacugacauacauucacucagcucuuuucguuucucccccuuuuagcacagacuggccgcucagcuccccuagcccgauggaugccccaucuguuaagauccgaaggauggauccuuucucuacaaaagagcagaucgaagucauagcuccuucuccugaaagaagucggucuuucucggugggcauuuccuguggccagacaagcucaucggagagccaguucucuccccuggaguucucagggacagacugcggagacaacagugacucagcggacgcagccuacaaccuccaggacaguugccugacggacugcgaggacguggaagauggcaccguggacggcaaugacgagggacacuccuuugaacuuuguccguccgaagcuucucccuauacccggucaagggaaggaacguccuccuccauaguguuugaggacucuggcugcggcaacgcguccaguaaggaggagcccagagggaaccggcugcaugauggcaaccauuauguuaauaagcuaacugaucucaagugcuccagcagcaggucuucuucagaagccaccaccuugucuaccuccccuaccaggccaaccacucuaagcuuggauuucaccaagaacacugugggccagcuccagcccagcucccccaagguguaucuguacauucagaugcagcugugcaggaaggagaaccucaaagacuggaugaaccggcgcugcagcuuggaggaccgggagcacggcgugugccugcacaucuuccugcagaucgcagaggcaguggaguuccugcacagcaagggacucaugcacagggaccucaaggucuguagccagaggcggccacgccgggcuuugggugugcccugggguucagagcagaggucggggaaggaagcagggaaggaagaagucucauaugugaaaggcucaggcagacugugcaucuuccuuuacggccuguuuauuuuuguuuuacuguaaacacuguuuccagcagucccgaugggggggaagaucucauaucuaaauuccagcaugagcagauauaccacauaauuccuaugcuuuaaaaauaaauuuacaucgcugggcagucauggcccgugccuuuaaucccagcacucuggagguaggggcaaguggaucucuugaguuugaggccagccagaguugcacagagaaacccugucucaaaaaugugcgcgagugcgugugcgugugcgugugcguguguguguguguguguguguguguguaggucaaaggauaacuuuuaagugccauuucccuuucaccaugugggucccagggauagaacucagguugucaggcuuggcagcaagcaccuuuauccacuaggccaucuuggauaagccaucuuggaccucugacuauuuuuuugucuuugaauaaccuugaccagggucucugcaucgcagagugagagggaucugaguggaaggggagacgagccuucucgcuagccagcucggauuuggagcagcagagcccguguuuuuuccccauugcugacugugugggccuugagaagccaauuagagaaaaguggcaaaugcuuaauuaaguggccaaagcugugcaaauuaaacccugaucucagaguguacaguacugaacagagcagcaauacagugugcuaaauugcauacaguucuaacucaggcuacuacacucugcaaucaaagcacuaaagaggcugagacaggaggauugcuaugaguucaaggccauccugucccaguaauacauaaauacauacacaauguuuccauaguauagacuucuaaaaugugcagaacuguagcuaguuuguugguucuauuaaacuuuuauuugacuguuucuugucaugacccacauacaccugguagcccucaguagguauguauggaacccauaaauauuuccugagggaagugaccuaaacacuuggcauauuugaccuugcguuaaauauuuuaaauuuuauuuugauauaauaacaaacuugcuuccaauacuuaaguagcuauaacaggaguuguuuucugggcugagagugucucuccagugguagagugcuugccuagcaugcagugaggccccgagauugagccccacagucggucucuggccacauagcaaguuuccagcuagccuagcuacaugagaccauuaucuaucuucaaaacaaacaaaaaguugcuuucuucuaaaaucaucaacaaaauguuuuuaaauuuuuuaauguguuuuaagaauuuggggagaaaaugggacuaagaaucagggagaaccccugugcuccuacacacccaccacuuguccuaagcagucguugugcuucaguaaguuugauguggguccaagcugggugccguggacggauccacacacaguggaaguugagagguguuuccuuugguuggacuggagaaggugacuuacagcagagaccuucagguucagauuggugauccgagcuguugaggugugaaugcggucaacuuccucacgcauguacaaguuccccauagccuacucccuguccugcagaagcagcgucaugaaacucaaggccaaugacuucauuaacagucauaauaugcugguuuuauaaugugagcaagauguuggcaaagguuugcucaacauuacucuguuguauaaagaacuuuuccuauuuguaugugcaccagaagaauucccaaaagaaaguuaauuuucccuuuaguuuuucuaaaaauauaaagagguuuauuccuuugaaaaggcagccauuucaaaauauuaacaccaccacgaaucuuuccccucgcugaaaagccuguaucuugccauguucugacccaggaugccauguuaaaccuugucagcuuuccuccuuauaaagcuuggucacaugucugucaucagcaccacucaugccgccucuccaggaauucuguuuuccuuugggcuuuucucagagaacccgauucucagcacaccuaggucauuuauccucugauuucuguggugguccaaaccaugcgcgcccaccuuguuccccgaucccagccucaaagcagugccgggcauguuuuggaccuuuggcucauuuuaguuuggauuuucuuuugcuugcaaccaccagcauuaguacugacaaaguccgcagaagcucuguccaccaugcgacaaaacaaucaggcauucaguacagcgucagcuagaaucagacaauuuggugagcaugcguucucuucuuccuguuuauucuuugcacuuacaaccagguucuccugucacagacucaagguggcagcuaaugguucccggacauguuugucuuuuaagcuuucuguaaggcuuuugguaguacaugguaaaaaacuuuuuuuuucuuuccccugagguggccagaaauccuaaggcuuguuuucaguaaaccaaggucccuagaccaucccuccacuggacuccuugaaaggaagcggauccggcaagggugggauugcuccauacugagacccaagggaauucacaaagucuggaugcuucuagaagaagcacuggaaauagaugcuaaagagacaaauacugucuuuaagaguucuauaauugccauuggaaaaugggaggggacacuagggucgcagcuugguugguagaaugcuugucuugcaggcaggaagccaugugugauuuaaagucaucuucagcuacauagugagguugagauccgccuggacuacuugagacucaagagaacagagacagaguuccaacgcaaauaccgcuuuguguaacucuuacauguaggcauaagaccuuggguuggaucuguggccugacagugggaaggagaagagaaagaaagguacugucauuuauugucucugauauggggccaucgcugagaaaguucuagauuauuaccacagauuuuaguugccuuauugcuucaaagucagaauuguauuauggcaucuuaggaaugaaaguguuggugcagucccauggucuccagagaacucuccagcccacaggcacccuagcacucccaggaucuuaggaaucaaaguguuauuuauucuggcaguguuggaagcaggaugagguuugaucuugugagcuaaauggcuuuucuuucagugaugagggaaagugacagauuuccuauaugggaccugaagucggaggagugcaugugacauuugguuagcuacauguaauaugugaguucaagugggaauuuagaacucgggccagaggcuagguguaacucuuaguauugggagcugagggauuuagaagcaagguagaacaccagucaugaguucugauuccccugauaaguugcccccacccucggacacagaccaggugaugggcguguuacauucuuuagauggucagguggucucgaauaugcacuucucucucucucucucucugucucucucucucucucucucuucacaggacagcagcaccuuuuagagagucauauccucuuuauuucuuuucuaaaaaucauauaauucuuuuggcuuuuucucccuucucuguauauacucacugugcuuuuuauuauuauuauuauuuucccagccuuccaacauauucuucacaauggaugauguggucaagguuggggacuuuggacuggugacugcuauggaccaagaugaagaagagcagacuguacugacuccaaugccagccuaugcuacgcacacgggacaaguagggaccaagcuauacaugagcccagagcaggugagucuuuccgacuuuagauaguuaggcagugccuaaugaggcuuuucccauggucuugguacagugcccagccauacauagccugaaaauuaugaaagcaauucugccccagugagaaaauacaaccaugaaacaugcugucaccucugaaccagaccuaaaaagagacuuugagagccacacauuguggcucauggcaguaaugcaaggagucgggaggcuggagcaggaggauugccaugaguucagauccagccuagguuacaaaaugaggccugucucaaaaacccaaagagaaaaaaagaugggauguggguaaggaaacacacagaucacguaacacaucgacaguguguuaauaaagaaaugaaaaauacugaaauuuauagaaguuuucaaauuucuauuuggacuuaaguguguuucuguuuguucugguucugaggcagggucucuuguagcuuggcccuugaacccuccacccccugcuucuguuucauaccuuuguuuguuaugugagacuucucugcuucucugcguaagaaugguuguggguuuugcucagggggaggagaggagccacaggguagcaagcaaaccuacaauaaaacagcaucuccagauugauuuuaauaguuuaaaauaaaagcaauuaaguuucucuagcaaaucuacuuaagaggaagagaaaaaaaauuaaaagguugcugcagagauuuaggagucacagagaaagagagaaaucagguggccuaaguaauuggguuggcuuucucagugauggaguuaagacuuagugaaggaaaaauaaaaauguucuaaguaggcagaggcaggcggauuucugaguuugaggccagccuggucuacagugugaguuccaggaccgccaggcuacacagagaagcccugucucagggggaaaaaaauagauucaaaccauuauuuuccuugaaaacuacuucuaacuacauuaugcagugcauagugauuaaaauacaacuagaauucccauuucccaaccccaucucaaaccagggaucugcagucucaacuuuuuuuuuuccuuuucuuuucuuuuuuuuuugagacaggguuacucuguguagcccuggcuguccuggaacucacuuuguagaccaggcuggccucgaacucacagacauccagcugccucugccuccugagugcugggauuaaaggcgugugcuagcacuugcuuucacuuuuaacaaaguucaccuuuucggccuucagauguaguuggugccaggcauacucuagcuacugccuguccugcugcccucucgugggauacgcaacgaacugcucuucaaagcucaauaaaaggucucuucaaguagcucagucuccacaaauucaugcaaucaaaauaaauaugugggggcuggggagauggcuuagccauugagagcacuggcugcucuuccaaaggacccugguucaauucccagcaucugcauggcagcuuacagcuauaacuccaauuccaggguaucugacacaaacacacaugcaggcaaaacaccaaugaacauaaaauaaaaauccaaaacuuuuaagucucaauuuuuacaauccaguaacauguuaauaauucuuucuccuuauauauuaaucuuucuucuuuaaaaggaaugggaaaauauaggaauauauaauaaagaaaaaggcguuuaccaaaaauaaguauaaaauuuccagcuguguacaugcaugcacacauaucuuauauguaaauauaucuuuuuauaucuuuuaauauuauauauaaauuguuauguuggaaaccaaaguuggaauuuuguuucauaguuuucgaucaguauucacaugugaccauucaugaguucuuggacauccucagacagaugugaaacauacaugcaguucagauugcucaauguuuguuuugaacacuaaaguuaaugucaguuuugcugggaggccagucacuuggauaauuggcccagcaucucuguuacaucuucaucgacucugccauggacaggauuccauucauucaacugugaaugagucaguuuacauugcccaaauauuguaugaggguaucuuuuucccccguaccuauguugccaguguccuuggacauuuucuuugaaggcuucccaagccacagagggaggcaagggacagugcuauagguugcaguaaucacuuuagaucauaguaugguggguacauaccugauacagucaguggaacuuugcaccugcuauuuugugagcagaagccagccugcauagaaggaaccaaagaggcagauagcuagagugauguggaggagagggggugauggccuccguccugucaccuguuuccucucccccucccccugguacagcaguuuugaggugagccaguuccagggcuguuuaccuguagucaaguaacuggccuaaggaaauguucauaaauaaaagggcucucccaaggcuccaggacuucgcuuugcauuugaauggggcuuuccuuaauagagcagagcagaugugauucuuugcccugugguaucagguauuuauugagggccugcucuguacuuagcccagugcugaaugaugggaagggaacacaaaagcagcaggucucuucccugccaggacugggaaggcacaaaaaauaugcacaugaaaaauagggcugugcaugcagagcagucugcaauuaagugcguaaugaaggcuccccgguugauuaguggcuugcaguaaugaccgacuucaggacuccggugauuagaaaugagauuggcuucagauagugucgcuuugaaaagcuucaccucagggggccugagcggcccuuacagacuccagagcaccaggcuccgaguuucugcccuucgugcugaugcauaucucucuggagccuuaccugggcuuucccucugugaugcuuagugcuguaauuacaccugcccacaucgaaagagggcaggagagggacuuagagauuaacucuuugcucauacccagagguaacugaaucagcucagggcccgugaugcugcguaggaacugagccaucucugugugaauacucuaaugauaugcucccucuggggcaauuuuuuuuuuaacauaucuuuaugcuauuucagauucauggaaacaacuacucccauaaaguggacaucuucucuuuaggcuugauucuguuugaacuccucuacccauucagcacccagauggaacgaguccggguaagugcgucucaggcacccaugaggacgggcagagggauuacuuacaauuuacaagaguuuuuuggugguuacguuucuucuuuuuuaaacuuuuaacuacgcaugugugcgcgugcgguugugugagagugcagguaugcccugaugucggaggcuucagaugccccuggaguggaguugcaugcaguucuaagcugcacagcugaacucuccagcgccauuaaguuuauucucgaugccauuagacaguuaaacuaggagcaaaagggacccagugagcaacaggauuauucuagauguucuguugguaucaguucaucaucaccuuaacaguaguuugcauuuggcaaccuugugaccacugcagagccagagggagcugggaggguaacgugagugagggcaggaaauagugccaguuggauggaggaaacccuauggaggacaaguggucaugcagucacagacagaugcuggcagauggcacacggcuagguuuuccaaacaucaugaccguagguuuucagucagacaguacuaguuggguaugguacugcaaccuuuaaucccagcacuugggaggcgaagacagggcagaucucuguguguuggaggcuggcuugguaaacagagcagguuccaggccagucaaggcuaccagcuaccgagugagcucugucuaagcaaaauaagagauccacucaagcaaagaaucaagaaucaaauuuguggauuaaucaguucaucaaagacacugggaagaaagugaaaaguuuggggcuagagagaaggcacagaaagcccuugcuguucauucagaggacaggaguucaguucccagcaucuacauauggcaagcaguucacaguugcuuguacuccagggacuaauaccugggcugccugggugcacaugcauacacacacaggcaugagcacauaggcacauuaauaaaaauaaggaaagggaaaagacaggcugggguguugucaguguacuuaucuagcaugugugagaaguggacauacgacaaaauaaagcuaaaagauuaacuuucuuucuuucuagauuuuaacugaugucagaaaucucaaguuuccucuacuguucacucagaaauauccccaagagguauggauaauuuucagcucuuucucuaaaaucaucacauuaagugcuuaaauuguucuuaagacacccugaaacacaaaggguccuuagcagucaauuggucagcuuugccuuuucaggugagacacccaacauucuagaucaauggcucgcaacgccuuuagaccuaaacaguuuucacagggguugacuaagaucauuagaaaacacagguauuuacauuaugauucauaacuguagcauaauuaaaguuaugaaguagcaacaaaauaaccuuauggaugggggucaccacagcauggggaacuguauguuaaagggucauagcauuaggaaggccgagagcacugaucuaggagaccagguuguuaggacugcccugaacccaguggccugcagaggucaggcugcaccgccaccuucccugaggcugacuucauaaagccccucacaggagcagucuauguuaacuccgugcugggauuuggucugagagcucuaaaaauggcuuauucuuaagcagagggaggcuccaggugcucuucaggccacacgggaggugguuuaggagauugguagauuaagcugguccucggguuaaaaagacauuguaacaucauuucuuuuuguaacuuauuccuauaguguguggaggucuaaagcuuagcacuuuaaugcuuacacauugauaaaucuuggcuuuagaaaugcuuuauugagauuauuguaaauucacguguauuuguaaaaugaaucuacauuuaaaaucaggugacaucuaugccucagggaugugauucuaaaaccuuucauuucauuucauuauaaaaggcuuuuuacacccagauagccucuguacauuugcagcaaagcuaacgggcuaaauucagccugcugccuauuuguaaauuuguuuguuuguuuauuauagggggcgugugugugugugugugugugugugugugugugugugugugcgcgcgcgcacgcgcgcgcacaagccugugcauguauaggugguauaugcaugugugccugugaggcccugcagagaccaggggaggagcaggugcccugcugucaacucuccaccuuauuccuaauucucucacugaaccuggaacucagcucgcaggcaacaaguccuagugguccuccugucucugccuucuacaaugcuaaauaauaugugugcaggcaugaccacuuuugugugugugugcguguguguguuagggacgcaaacuuggguccucaacaagcauucuuacccacugagccacuuccauggcccuugcugccaagcuugaugaccugaguuggcguuuuaggccccauaugauagagagaacuguaccccuuaaguuguccuuaaaguuccauauauguaccacggugcacacuuacacacacacacacacacacacacacacacacacacacacacacacacacacgcccccuauaauaaacaaacaaacaaauuuacaaauaggcagcaggcugaauuuagcccguuagcuuugcugcaaauguacagaggcuaucuggguguaaaaagccuuuuauaaugaaaugaaaugaaagguuuuagaaucacaucccugaggcauagaugucaccugauuuuaaauguagauucauuuuacaaauacacgugaauuuacaauaaucucaauaaagcauuucuaaagccaagauuuaucaauguguaagcauuaaagugcuaagcuuuagaccuccacacacuauaggaauaaguuacaaaaagaaaugauguuacaaugucuuuuuaacccgaggaccagcuuaaucuaccaaucuccuaaaccaccucccguguggccugaagagcaccuggagccucccucugcuuaagaauaagccauuuuuagagcucucagaccaaaucccagcacggaguuaacauagacugcuccugugaggggcuuuaugaagucagccucagggaagguggcggugcagccugaccucugcaggccacuggguucagggcaguccuaacaaccuggucuccuagaucagugcucucggccuuccuaaugcuaugacccuuuaacauacaguuccccaugcuguggcgacccccauccauaagguuauuuuguugcuacuucauaacuuuaauuaugcuacaguuaugaaucauaauguaaauuccuguguuuucuaaugaucuuagucaaccccugugaaaacuguuuaggucuaaaggcguugcgagccauugauauuuucuaacacagccuaaaacacacacacacacacacacauacacacacacacacacacacacacacacacacacacacacacgauaauagcucagccauucucuauggcugccgugggacuucugggaaagcugucuaaucagaugugcuucacacacuaaaacaguuaugcagaaguuuggcugcagcugaggguguagauaaaggccauuuaugccuaccuaccacuugaagagagcccuguguuccagcuccuuuacugaaggggguggggggagggcagagagagagagaauauauguguguguauucaugugcacacguguacucagugcuuuuaacacaaaaccauuuuuauguuucagcauaugaugguucaagacaugcucucuccaucccccacggagcggccugaagccacagacaucauugaaaaugccauauuugagaacuuggaguuucccgggaaaacgguucugagacagcggucccgcuccaugaguucaucuggaacaaaacauuccagacagcccagcugcucguacagcccacugccuggcaacuagcccucagcugcccucgaagguggcagagcaggcacccugaggaacauggcucuccacagcgguggacucagauuuuaugcuuugaucaguuggacucgggaccaauuuuucuaagucagacuggaucacgggccuaacccaguuugaucuuaacugaacuucaaggaaagggcuguguaaaggacacaugaacuuguugcuugucggugucccaagacuagcuggucagcuuagaaccuucacuuuucaccaggcgguagaagagauccucaaauggucugaacuggaaaugucuuuaaagcacaaaaguguaaaagacccucucacaugggaacuacauguucuagaaacgugcuuucuagagauacaagggugauuuuggaagugguuguuauaaagcugacuucauuuuuuucccuggugagccgugacccaucugcacuaauuugcaaggcacauagcacaagcugggucgccauuuaugucgguagugucauagucugcagcagugaauagcgucauucuucagguggucuagggagcgcgaagagcuuuuuuguacuuuuuaccuccaauaaugggaaaaugaagcuuuuagguauuggucaaaagaucugauuugagaguuuuggguuuuuuuuuuaagugcaguaggaaauggauuaucuauuacaacuaacuucuucaauuauggaauuuuuauccuaguagaauucugucuuaaauguaauacuacaaguggguacauucccccaaacugauuauagauaaguuuaaucaucucaacuugcuaacauguuuucauuuuuccuguaaauacguuuauuuuuuauuuauaaaaauucugaaaucaauccauuuggguuggugguguacagaacgcacguaagugugauaacuauuaugacuucuuucaagucuaaaugauuuaauaaaaaaauuuuaaauuauacuuaau

SEQ ID NO: 3049 - RNA, 493 nt, Mus musculus
acucuuccggggacggugcucagaggcacucaggaugguccagcguuugacauaccgccguaggcuuuccuacaacacagccucuaacaaaacuaggcugucucgaaccccuggcaacaggauuguuuaccucuacaccaagaagguugggaaagcaccuaaauccgcauguggcgugugcccaggcagacuucgagggguucgugcugugcggcccaaaguccuuaugagacugucuaagacacagaagcacgucagcagggccuauggcggcuccaugugugccaaguguguccgugacaggaucaagcgggcuuuccuuauugaggagcagaaaaucguugugaaaguguugaaggcacaagcacagagucagaaagcaaaauagauaugcacauuuuuuaaguaauaaaaaucaagacuugaucuaaaaaaaaaaaaaaaaaaaaaaaaaaaaaaaaaaaaaaaaaaaaaaagaaagcuccagaacaau

SEQ ID NO: 3050 - RNA, 493 nt, Mus musculus
auuguucuggagcuuucuuuuuuuuuuuuuuuuuuuuuuuuuuuuuuuuuuuuuuuuuuuuuuuagaucaagucuugauuuuuauuacuuaaaaaaugugcauaucuauuuugcuuucugacucugugcuugugccuucaacacuuucacaacgauuuucugcuccucaauaaggaaagcccgcuugauccugucacggacacacuuggcacacauggagccgccauaggcccugcugacgugcuucugugucuuagacagucucauaaggacuuugggccgcacagcacgaaccccucgaagucugccugggcacacgccacaugcggauuuaggugcuuucccaaccuucuugguguagagguaaacaauccuguugccagggguucgagacagccuaguuuuguuagaggcuguguuguaggaaagccuacggcgguaugucaaacgcuggaccauccugagugccucugagcaccguccccggaagagu

SEQ ID NO: 3051 - RNA, 5221 nt, Mus musculus
uaucugaggaggaagaauccccuuauaaaauaggcaacagugggugaccuggcaggcagagcuguuguggucagcuguggaaaggaagccucguugccaccaugaacuucuccggcaaguaccaauugcagagccaggagaacuuugagccauucaugaaggcaauaggugaguggugauuaugacagcaacgaggggcuagcccuacuaucaacagauaguccaggucugguguugagguggaaggagggguccaggcuauaccgaauugaggaguucuccagugacucuccugcucucuuguuacuuuuacugcuccccacuggacaaagcuacuccagggaaguggaaacaacccuacauuggaagaugaacugguucgaagugugugucucauggcacuuuauucuaagaccuuguuccuucacucacuuucuagcaaacauugauucaaggccaaccauacgccaaccccaugcuuguacauauaccagagagacagagugugauaggcuacaauccugaccaauguucagagacaaagcuacaaucuugaccaguuauuuggagauaaauggaaugaagugucuccuaauauguaugacucuauaccaggcauugccaugcaaugcccacaguaaauacucaccauaaaacugagcuguuuucccauuuuacaguugaggcgacugggguaggugagguagcugugaugaggcucacaguuuagagaguguuuguguuggaguuagaagcaggugcugggucccagagacccuauuuaaacacccuaugucucccaggguacucagguacgggggagacugugaugaugaaagcugagccuggaaccagggagagaagaguauauaacaggaagaaagaggccugugggcagagggggaaguggaacaaaggggguuaccaacauggaaaagaugaggaacagcaagaguggggaaaggacucucgggucauccuaggacucagagcuucuuuugcagacaagucaaagaucaugaaugugaggaucccuuaguuuugcaagggacccuccacugucacugugaacuccccgguucuugugaacuccuguucauguaaaagcacagauuuguucugaaaucugaaaagcccuauucuaggguaaaggauuuuuguacauuacccccaagagccuugacuccagaggccacagcaaguuugccaggcaugguccuacuuugugcauggccuaauuaucuguagcucccauaucacuucaaagguaauuggauuuggaagcuaaacauucuggaggaugaaguguucccacucuaagagccaggccacuaaagaaggagggaucugugggggguggaggggaggaugaguaagaagcagggagccacagagggaagggucuuuacaacaaaugaaucgcugggcugagaauguggcucgguugguagaguguuugccuagcaugcaugaagcccuggguucaaucccuugcaccauauaagccagguacaauggcacaugacugcgauuuuagcacuaaggauguggaagcaggaggaucagacacucaaggucauccuccaccauagagugaguuaaggcuaaccuaggcugcaagagacccugucucaaaaaauaauaguacuaacuggcaaaguacuagcagacuaccgacuuuccgcaucagaaggcaaagaccuaacugcucacaggacuacuguauggaaauguguggggucucuguucucccaguuuuuaacuuuacauggucucuaccaggucugcccgaggaccucauccagaaagggaaggacaucaagggggugucagaaaucgugcaugaagggaagaaaaucaaacucaccaucaccuauggacccaaagugguccgcaaugaguucacccugggggaggagugcgaacuggagaccaugacuggggaaaaagucaagguauguaguuccaccuccaucucuuucccagaacuucuccuaacggagaccaugucacugaaacuacuucaggcaggagacacagagagcuuugagaguagacuucucauugucucagggaucgugggcaucugggcucucacaauggaggaggauguggggauaauggagcacagagaaggagccucagucucaggucucccaggcacagugcuccuggcucucagaguccuucaaggaaagccuagaacuggggcacauuggugucagugaaaaccuucaucugagcuagggcagcuuuacguccgcugggagaugguuccaggcagcaaugccagcugucugugggcugugugacuaauggacaggugauagagagauccagaggcuguggguccugucauccccgccccugcccccgucugaguccugcacagccuaggguagcgaguguaaugugcuucuguucucugucccugcccuuuccaggaagcuuugugccucaaauucaacaagagucucuuuaucacuucugguugcucuuauuucugccucuuuuacaagucaaagagaagggagggcgggguuucuccugauugguucaugacaaggguuggggugucaguuuuacuacagcccuuuuucaauguccacuguagaagcagauauuugaugucuuuugcucuugauuaggauucuccccuccaucccucucuuacuuccuuuccuuucauucuuuuccccccuuuagcauuuugccauguagcccauacuagccucaaacccagcaugcuccugccucacgagugcuggaaagccuuaaaguacugugcccagccaugauucuauuuacuacuguccuugauguauacagcuuggaauuggcacuacaauagaaagaaagaaagaaagaaagaaagaaagaaagaaagaaagaaagaaagaaggaaaggaaggaaggaagagagaaaggaagaaagaaagacucaguaaccaccgaaguaaaaugaauucccacccccacccccagcugcugaugauuggaguuuuucuaccuccucccucuacaagcuugagaaaugggauuuuauauuuuauuuucagauuuuucccccagggcagaaccacuuagguaagcuugacauuuucuuucauucauaaauaugcccuauuuccauuuagcaccaaagaacuggagagggacaggacauuugauuccuugucaguugauaccaugcagggaaccaacuucauuagcuucauugccaggccuuugcucacgggccacccucugucuucccugcaggcagucgucaagcuggaaggugacaauaaaauggugacaacuuucaaaggcauaaaguccgugacugaacucaauggagacacaaucaccaauguaaguugacccucuggucuugccauccagugcuugaggugaacgguacgguguguuugugugagugugugugugugugugugugugugugaaggauaagagacagcuggaugccaucucucauucuucacccuuuccccccaagaccuggacucucucuuccuugccucuugucaaugucuucuaccaccuaagaggaugcauauguacuacggaguugauagauaucagaucuauugaacaacacuuuucuaaucggagaaaguaaggcagagaccagaagagcaggucgaauggcagcaucaggguuuccuggccugggucugucucuuaggcuaaucucacagcaguucauuacucaagcaaaccccaagggaggcuguuuacacuauagacagugaggauugcacucaggacaccugcagccaucuuguucuugucaaaucacggcagaauaucagggugauucccugacacauagaagagcgguaucuugagggaggggcacccuuuucuaauucaccuggugucucacaccuucuugugcuccacuuucagagucagccacuccccugccucugccucucuccuccuuguccacucccuggccuuacccuuuucccagcagcagcaaacgggaugggugaggagguguguggugugcugaggcacaggacagcaugugcagagcauagcuggccuugcccuguuucugcggccauggggccucacaccucacacucaggccauaggacagaaguccauucaacccagagaugucccagacuucacugugucugcagacauccuguccaggaggccucacgacugaaguugcagcagcacuucccaucgaugaaaaccuccacaagggaggcuuuguauguccaucgauguuccuauuugaugacaucagagugauuaacagccuuagcacuaaccaaugggccacacagccauccaucuuccacagcccaggugccuaauaaacaccucugcccacuuggcauugguguggagucauucauuuaucaaguuuauggcugcuaaugaaugacacgcuggguaugcacucccgugcagucauccuccaugcccagcuguuggucauguauugcccccgcuacaguaauucauaguguuucucucauggucaggucuuccagcuuuccuuuguauccaaaaugcaccucagucaggucacagaaggcaaaccccugucuaagugaccgcaucuggucaagugaaaaucccccugcaccguggagagaggggggcaucaaucaggaaacaacauucacgccccacacucuugccccucacuccuacaaaagagcagguguguucaguguucucgugugcucauucacaccguccauacaguaagagggaaguagauagcaccuacuacguuccagccuaguggcccacuguacauaugcuuguguucagccacagguaguuaaugugcaggaaaucucaaugaaauuuugaaagacagcucucccuccauaugaacaagagaagugaggagacccagcaugcuauucuagaaaagguugccaaucgcgccucagcuccgagagaaaauggggauuuuucaaguuguuuaauaugucagcacauuugggacuauuuggggcgguuacuuuuuguuuguuuguuuguuuguuuuacaauucaucaucaagaaaauauuucauaauuucucuuuugacuuucagaccaugacauugggcgacauugucuacaagagagucagcaagagaauuuagacaaggcuauauuucauauucuuuuacaguguaaaauuaauacaauaaaguuaccuuucuuuuggaauaacuucuccuugauggcuucucau

SEQ ID NO: 3052 - RNA, 9118 nt, Mus musculus
cggagcagcugggaaccugggauuguucuggagcucgccggaacucaccggaacucgccgcccugugugaggcccugugcagagguucuagccagguagacacuggugcuuuguaguacccacaggucuuucauguucaagaccccaaagacucguaaacauaagaaggccagggaucccccuguguguggcaguguguccucaguuaacuaugcaaagugaugguucuagauaagaacugacccaaacgcguuucucaccuaaacgcguuucucauccacucugauauuugguagcauuuuggagcacuaguaaggaccauggcucagguacaaagggagacugggacuggaagggagggcuccuuggaucuaggauaucugguggauuuaacaaugcauggagaaaucagggccgcucgucacugguuucuuugugaaggccuaguugacaccaggcacaguuggauugggugcugagacagcagugaauagagaaucccuguucaugagaacuuugcaugcacguguggaaacauaccagaucuggaaaaguguuaguuauugcugcucccuguggacugugugggagaggcaccauucaacagcagcagagagcgggguagaaaggaaaagcuggaaucagcuguuugugauuuuagccacugcugaccuagaacucauuagccagcuuaagccuuaaacucgaaauccugcuucagccucccuggugcuggggucacaggucugcaccaucauacuugauuuagagucugcacuuuaaacaccugaaagcaugcauugaacaugggaaagcuuuggggaugauaauucaggggacagcagacaggugucagaggucaucaaaacagguagcuuuccaaacaagcccuacugggugagaaauuuuuuggugugucuguuuaagggcuuugagcacgaagacacaaaggcucagagaccugugugccuacauaugcccuuccaugagagaccaauguggcuggaaggucagaacuugaguaaccaccagggcuguaggugacuagugggcaucugagcuucccucugccccagagaagccuggugguuuccagcagaugagagaaagcuaaggacucuucuggguguggguuuggguuacucggcaauccaaguaagagguaguguccccagucuagaaguuuguggcaaccugacccuaggaggaacguuuuggaugcuaaaaauggagccaggacauaggguguggcacaguugguagaauguuugucugcccugcucugaggccccaggccaccauaaaacuggaugugguggagugugcauguagucccaguacagggggcgggggugcggggaggggggguuagagaucagcaaaggucaucaaggaggucaaagccaguuuuagauuuaugaaaccugucucaaaaagaaaaaauaaugccagcacugaugguguugccuccuagguagggagaaaacaaagagcaauggacagcucucacugugggaggacugaggaggacaguguuguuuuguuuuguuuuuguuguuguuuguuuguuuaaacaggguuucucuguauagcccuggcuguccuggaacucuagaccaggcuguccucgaacucagaaauccacuugccucugccuccugagugcugggauuaaaggcguacgccaccacacccagcgaggaggacaguuuuaaucugugugucuguguagggaucaccuauagcucacccuaguggugagcaugacccggauucuucugggucagagggagaacucugaauagaaggaaauguuuggucucuuccuuucccuccuuuccuuuuuuuucaacaaagcauuuucugcggcuuucuuuuuuuccuuucuaguguacauauaguaguacacuuaguacauauaguauaucacuuugauauauuacaagaagacuagaaggaaggggaugacagcccagcucaucuugacuaggcaaacacugcggguaggaauugaguucauuucucaugagcagugagaggaagucuggaucccaaacugagcgaauauaaugagugcuauagaugaggagagagacuugggaggccugagacuuaaaccaaagacaaacacgggguguuugacuagagaugacaggaucagaugaaucuuaaaccaauucuguuguugcuucuuggagaauggcgccuagguaggucaaaguagagaaggaagacugagggccuggcuggguguggucccaugagccuauaaucccauaaucccagcauuuaggagguggagguagggugaucucauccaaggccuaauuuuuugaaacaggguuucucuguguagcccuggcuguccuagaacucacuauaaaccaggcuggccuugaacucagagauccaccagccucugccucccaagugcuaggacuaaaggugugugauguaccaccacugccuggcuccaaguccaauuuuaaaaggugugugccagugccauggcccagugaguaaaggcucuuaaugccaagccugacggccugaguuugaucccacaugauaaaagggaagaaccaacucuccaaaguuguccucugaccacuuguggggccacggcccauguaugccccacauauccacacaaaauaaaaaugaaugcagcaaaaacauuugaggggguguuaaguuacagauauacaaaguggaaggcagaaaguaaacuguggauuuugaguccauaggcagaucaaacuugaugaagcucacagugccuuuccugccaauguccaagcccugcuuaaagaaagccauuagggaaagaagcgggcauagucauucuacugaacauuacucucccugaucgcauccucuucccaguaaacagccugggccuuuccugcuaaucaggauuauguuuggagggugugcuggacaucccauauccucccaaugagcugcacccccagccauuguuuuauacuugagagggguugucaacgauucgguauuaucugacuaucacacaaagcuauaagugcccaucugaaccuggcucagaauaaccccagcaugcaaacauaugcagaaacauaccauaaaugucagcuugacuaagugcagguguggcugcguuuuacuuccugauccuaggcugguccucucugaacagcucaccauucaggaugacuuaggaauuguacugucauguacucaugugucaacuugcuugacugucuugcuugucuucaauaccccugcuccuucuguggcuuuggagagccuccucccugccuguggaugcacacuuuucuccuuggcaucuuucuuucuuuuuuuuuuaaagauuuaauuuauuacuauauguaaguacacuguagcugucuucagucacaccaaaagagggcaucagaucuccuuacggaugauugugaggccaccaugugguugcugggaauugaacucaggaccucuggaagagcagucagugcucuuaaccgcugagccaucucuccagccccuuggcaucuuucuuauagggcaccaggguacuaauaccguuccauaguaagaaaggauuuugcuaucaaaagcuuacucuucaucuuuccauacuaaagaaacaacuugaagccacuugaaaauuuuuucaccucaacaaaaucugaacucaauuuuaaucucuccauagaaaaauaaaaccccggguugaggaugcagcucagcugguggccuaaagcccugaguuugacuuccagcccuguauaaaccaaaggugauggaguacuuaccaucaguacugggaaauggagacuggaggaucugacacucaagguuaucuuugagcacaaaguguuccaggccagcuugagcuacuucugauugggggagagaggcagugaggagggagaaagacuuaaguuccuaguagagacuucagccccuguaucugcuuuagauuuaggcuguugggauaaggaccuuguccccagaguccaccuucuggguuugaaguguauaucccauggcacacugugaauucagaggacugcugcuuagucagaccccaagaccacaaauaaccuaaauuuagcgauuugguuaaaaaucucauuaaaaagcacauuccagaacugcuccagcaugccggacagccucuaaaguguauucacccauuaugaaauagaaaguggaucuuagcauagcuguacauugcuauacaucagugaagaugaauuauuauauugagagauguuacauggcuggggugcuuuuacuccaacuaagagagcuguguggucacuaggcaacagucuuuuguuucaaggagauuuucauuaaaaaaaaguauauuuuguguguguguguauacuuguacaggugcugcaggacacaggugaaggucagaggacaacuuguaggucccagggauuaaacugaggcuugucagcaagugucuuuaccuacugagccaucuugcugacucagcaauacaaucuuaaugggaccaccaugaauucugucgaccaaaauauuauguaacaccugacuguauauuguuauauuguuauggaaggagacuaaaucucaagccagcgaaugaaugugacuucacacuuaguaaguuucacuuauaacuguuuauaacagagacacaacuagcccaggaggguagaauaucaggaguuagugcauaauauccacugccaguacagcaggcuuucuguuagagcaaccaguuuaccuuagcugaauggaaagaaaaccauacaguaaaaugcaagcaaguuuucaaaauaggccaccaaggagccauugaauguugcuagucuucauucuaguauuuuuuuuuuuuuuuuuuuuuuggcgggggucgggaggugucucauuggcuggaauuuucuguguagaccaggcuggccuugaacucagaaauccaccugcuucugccugccaagggcugggauuaaaggcaugcgccaccacugccaugcacagcuugauuucagcuuagcuuaguugcaugauagucccuuuuaacuuacaauuagaagauuaaaugacuuacucugauacauugaauaguauuuauggcagaggaaaggucuaaauuuaucugauuuuuuaaaaagauuuuuguguguggccuguauaucugcacgcagugccugcagaggccagcagagggcguugaagaauccucuggagcuagaguugguugugagcugccaagugggcccugggaacugaaugauccucuguaaaaguagccauugcuuuuagcugaugaaccaucucuuuaguccaaauuaucugauuuguaaaccugucacaaccgugauaaaccuuauacucaugaguguauguaacauuugagcucuggugauagcucagacagaaaaguacuugcagaacaaacuugaagagcuaaguuugauccccagcacccacauggaaagcuggguguuauggcauguguguguccccagugcugaggagguggagacagaagaucccuggggaucacugggcagucauccuagccuaaagagcaagcccuaggucccauugagagacucucaaaacacaaggcucccaagaaauaauaccugagcuuagccucuggccugcucucacauauacagugcacacaaaugaauacgcauacgagcaaggcgugcaugcacauacacucacgcacacacaaacacuguacacuauuguauacuccguuauuuauuuauuuacagauccuuacauuuauaaugcauuuuccaccagcuaagacaggugcuuguaagccuagcacuauggaggcggcaacagaagaaggaacacaaguaugagcuagccuguucaauagcagcuaaggcuacuuaguaggaccgcaucaccauguugaaaugaaaaaaaaaaaaaaagcaggcuuuagagauggcucagcagguauaagacugcacugcucuaagagaggacccaaguuugguucccagcacuuacaucagauggcucacagcccccggucagccccagaagcaucugauaacaguggccuccuggggcuguauauacaaacccauacccacauaccuagacauaauuucuaaaauuuaaauugaaaacaaaacccaacgagcaauaauuuccuucucuauuacuauuagaguuuccuaccccagacuaugucaaaagaacucccgucagcaugaguacaacaccaguuacuacgcgcuacuuacuauauaaguaacgucgaacucucucaggacagagaaaaugucaucaguaaaaugaugccucaacagagggucuucucucauucuuuuucuagagaaauacauuccuggucagcgugauggaagaggcucaggccaaugacucuuuucaacuugaacuugaagauuucauuagaaagcagaaagccagaggauuacauccaaaugucugcuucagaaagauggcagcggauuccguucaccagaagagagacaguggcagcccuggagccaugcgggggcuaccauucuggcucagaaacgacuucagauccucuccuuccuauaaaaggcugacaguggaaaaccagguaccuuacugcagacaaagacuggaaucucuaaaacacagucugaaaaaccagccaaucagucaagacagaaaggagaggacaaggcuccagggggaaggagaagccaccacuugggagccagggaugcccaaggggaaacucuacagagugagggguucacgcacggaagacagccucagcagaaggaaggucucagcagagccaguggcuacacagaagucuaagcacagaaaggagaaccaccaugaugggagagacuccaccaaaggcaggcgccggucccaccaaaagcagaaggggccggaggagagggauuugugggacgaagcuauccugggcagucgcuacugaugauugcacauuucgggucccaaaagucaguguguugauucucuugguaaggguggauuaaaugaccucaaagcaauuagaugccaggccagcggcuguggcccaucuacucugcugguguagcacuugugagucuucacaggguugcucuccugguacuggcagugacagacccuuuagugugcaaggccuuugggcugugcugacagacacagggacuuucagucacaagccugagugccuggagcuguagaagccagucaguccagcaagaucuaggugcuggauacuguucugcuccaggcguuaaucaucagaggcccuagcccuuggcucagagcagaagcuaaugggaguagauaguagcugucagcuucccagcaggccuugcauuugaaugcucggcuccuguuaacaggccagagcuacaguccuggggacgggcguauucagacgccuggcaucucccugaagcucuuccugugagcagggccuccuugcccuucuacagcuuuuuguuguuuccaguaccucugcuuccuauuguuucugcccuuagccacucugggaauuugagccauguucuuaccaucauugcuacuauggaaaacacggcaacaagagcugcugccaccuuugccauagcuacugcucuggcgaugcuucuguccuucacucggucuucuggcugccacucaacccucuaauaaugauaaagaucaaaagaagacaagaaaagaauugugaucugcacuaauugggcugcauuuuuuuuccaagcugaggauuuaauccagagccuugggcuugcuaggcaagagcucucucacuuagcuacaucucacccccagucgugagcugccuucugaugggccaccaaaggaagugcccugccacaccuagucuggcuaaaauuuaggcugcaggauuacccaacauucacugagguuuaugaaaagcagaucgacaugugcucuguaaaacagucuuggcaauaauagcugggcuuacagguguucaccaccaugcccaccaagcgagaacugucuuauaauacauuagccagaugcuauuaaacaagcaaaauuaaaugucaaaacauuuaaaagcaaagcagaaggccuugcuauaaaaaucuauaaaaauuagagucuugaaaauaggcauuaaauaaacacacagaagaacuccagaaagacauggaguaucugguacgagugggcucaggacacaagaauuugauggguaaaggacagcagugagggacagacuaaccuucaaggggcuagugagagggcuugggguagaggugcuugccaccaagccuggcuuaaaccugaguuugaucucugggacucacacuguaggagagagcuaacgccugcagugugcuggcuuuaugcagaauuuuguuucauaugcgacuuuucccguugcuauuugucaagaaacagagcggagggaaauuacuuguuaucauucuguuaaauguccugccccaggugucaaauuaucaucucucaaaacaggaccacuuggcuuuuuaaacucuuccaguagagggugguagaagguuauuguagagucaggaaagggggacauucccuuucccuggugugcccuuaguuacaaaaacagggaguugcuagggaaaagguccuaccuauugccuaucuaugugccucagcaaauggcuuuguugguggauucucuuugcagaguguaaauccugagugguuggggaaaggacccucaggcucccccgcucugaguuaugccuccccagccccacccauggagcccagccccaggcaggucaacugccaccuguaggucacagccagccaccugcucggugcucuggaucugacaguuguagcauuugaaucucaaguauacaaagugcagaugucuucauucauugaacugcguuccagagccuguacaggugggccuggugacuggcucaguguguguugccaagcuugacaaccugugcuccaucccuggguccuucauggcgggaggagagagaacccauucccgcuagcgcucugaccuccacaugcggcauguacucacccccccaccccccaacacacaaaguuuuuuuaaaacaugcauucauuuuaucuuggauuucaccaauaaaaauguuguguaugacuguuu

SEQ ID NO: 3053 - RNA, 929 nt, Mus musculus
uuuuguuuuugucuuuuguaauaagauaagggggaaagaccaggcacacaccauaugcugcugacaaucacagagaggaacuuuugguaggucgcagguuuugcagauucgagacauaagaaccuaucaccccauccccacaugucccucccuauuccuguuccagcccuuguucccgaagguuaagccucaggacuccugaaugaagaaagccuuguaccaaagcaaaaguguaaaaccacaguuguuguccguaaauuugcaacugcugagcuggagucagaguggagaggaagaauccuacauuuuaaaaugucccuccauuugucuucacugggcucuagcagccuaugaccagcaaggcaaaaaccauuacaccuggccugugcauucacagaagcaaugugccauggucaucugccugcucuucaaggucagaucagagaagcgugagggaaaacugggauguguucugaggucucugacagucacagaaggaaauauaccuccagaggaagggcaucacagccuguucccgcaucugagcugcaacagaggcagaacugggugagguggauaggagucagacagcguagcugcagcagguccuccagugaagcaaaugcuuucugcaaaugacaggccacaucucaagacugaugggaaaauagcaaaggaucaagauggccucuugcucuagucacucuguaaaugguaaggcugaaaccugggcugcaaugcacccucuguccccugaaggcucauacccuguccacagcggaaggaaggaagaacacaccucaccucaggguugcucgucccaccucagauugugaaauuugagcaucucccugcuucugucucagcaauuauauuuucuugcuuauaguuccgugggggcuggacuggcaggaguggacuggcugugu

SEQ ID NO: 3054 - RNA, 7009 nt, Mus musculus
uauauuuuuucuagaauuuuauuuauuaggcuggcuuuauuggugucuauuccuauagcuuccuuccuuagugaagaccauugcccuuucaucuuguuaaaaucaaaguaagaaaagaugaacacaguuccaacuaugaauaggguucaguuacuagccuacagucgaguaagucuuugggaggcuuuggaaggcuguaugcucugcaugugacugcagugugaagccucggggucagaaagcagacugcauugaggauggcccgcagugaccugccugaccucauucuugcucuuguccgauucugucaccugcacuguggccuggaucuagcacugacuucuaacaacugacaguacagcaggugagucacuucugagaugaggugguaaaaaaaagccugucgucuguccuguucaccccuuccuguuugcucauccaauccccagggaagccggcugccaucucaagugcccuaugaagaccuuuucuguggugcagaaagaaaaaaaaaaaaaauagguggccucaggaggaacugaggguaagcuuaaccaugugagugaccucaccaacagacucuuccccagcugauucacagcccagugagcaaugauuaauuauacccaucugagcgcucccagauuccuaacccacauuaaaugagaggguguuuguuaaggcauuggauugugugauaacuuuggaaugacuuaaugugacaaauaauuuacaccaucaggcugguaaaugacacuguuugguggcucagccuuguuggaggaaguaagucacugggggcaggcacaugucauucauuucucucugcuucaugcuugcucuuaaagauguggucugucagcuuccugcucccgcugcuguuccuguuccugcugcuugcugcugugccucccuuccacaauggacgaugacggacagauaucccucugcagccacgagccaaauuaaacucucucuuccugaagucgccuuuggcugugguguuuuaucacagcaacagaaaaguaacuagugcauugcccucgggacaaauggcaagaucugucacaagcucaagaacaacaaucaaaucuuuguacuuaaugcucuugcaccaaauauccuguugauuaucugauaggaaaauggggaggggagaagaagacaaagaaauuaacuguagcacacacucgaucccuggaaaaauaaaaccaaacacugaaaacucagguaagaggcuuuugacacaacaguuaggacgugaagaguggucauucuucucuuccuuaugcuuacucucaagcccauuuacaaaccaguuugaggacuggagagaugucucugagguuuagaaugcaaacuucccuuagagaggaccuggguucaguuuccauuauccaugucaggagacacauagccacuuguaacuccaacuucagggaaucugaugcccucuucugguuuugggggaugcgcgcgcacgcacacacacacacacacacacacacacacacacacacuuaauguaaaauaaaaauagaauaaaaaacuaguuugaaauauucguauauuuucaugccuuuaauaaaaauuugaggaaugugugcauguggaaguuauaggacaacuugaggaacccauuuaccuuguagguaaauucuccuuuuaccugugggcugaggaacugaacuucaguugccaucaaacucagagauaggcccacugagccaucuuuccagccauauuuucauguaauuuaaagaaaucacucaaagaggucccuauaguuaguuuaagugcaugcagagaggcuccugaaguuaguaugaaugcaugcacauguggggugcacacauguuuugcugacauguauagagguuagaagccaguguugaguguccuuccucaauugcucuccacauuuacuuauuucuuuauuuuagauuuauuuauuuuuacuuuauauguaaaaggguuuggccugcauguaugucugugugccacgugcaugccagguaccagugggaauuagaagagggaaucggauccucuggaaauggaguaaugaaugguugugaguuaagauguggguacugggaauugaacccagguucuuauauggggcaacaugugcucuuaaccacugagucaucuuuccaguuccuuaccaccugcucuuuuuuagagacaugaucuuucaaugaccuguaagcucacugguuuggccaggcuccaggguaccuggcuccauaccuucccccagggcuggcguaacaggagcauacaaucaccccuagcucuuuaccuggguccugaggaugcaaaccuagguugugugcuuaggugguaggcacuuuucccacccucuccuugcccaugauuuugaccucuacaucauuacaaguuuucuaucuaguuguucuauaaauuacugacagauugagaauuauaaauguaauugaucuuucuuucuaguucuaucagguuugugugugugugugucaugcuuauugucuaguacuuaccuguuuuaaaugccuaggcuucucaguugauugaucucuuccuaauacagagcccaccugugucucugauaauuuucuuggcuccgaaguuuucuucauguaguaucaaccaggacuuguugauuucuuuugauuguuugcaugauaucgacuuuuacaugcuuuuacauuuaauaugcccuuaucauauuugcaauaagcauacuguagucccccauguaguuggguuguaauuuuaaauucacuuuuccuguuuaaucuuuucacucuuguauuuauagugaacauuuauauuuaauauaauuccugaugcagucaucuucaauaugacauuucguguuuuguuuccuguguucuauuuuuugucauuuaguuucuuuuuuauaccauccuuguggucuacuuaugcaacuguaauuaggaucuauuucuagaaucuuuaugucagccaaauagcaacuuuguacccauuaaaaguaacccucuccuuccccuucagcaguaacuguuaaaguuucucuuuguguucuuguuauuguuauuuagggucccuagguucacauuaugugacucuaccaugguccacuaauaucaucauuuuacuaguucaagacaaauauagaaaucucacugucaguacuagcugcuuucuuguuuguacaaccaaauaccuaacaugaagcaaguuaaaggagaaaguguuuugggggcuggaaaacauggcucagugguuaaaagcacugcuuaugcagaggacugaauuugguugccaauauccacguuguauggcucauaauugccuguaauucuagcucuaggagaaucugacaucccccuuuggccucuaaugacaccaacacacgugcaaucaaguugacagucaaaauuaucuaauacaccucccuuugaguuaugcuucauucuguuuacaacauaccucuuuucaucacuucuacauaaccuacaauagcauuaguguuaaaaauaauuauuaacauuugggaaacuuaaaagacucaaaaagaacugagcauggugauacacaccuuuaaucccagcacucagagagcagaggcaggaggaucucugaguuaugccuugucuacagagugaguucuaagacagccagggcuacacagagagacccugucuagagaaaaacaaacaaaacagaguagaacaaaaacugaacaaaacugccggaggagggggccagcccugguggggucuucgaagggguaagagcaucagcagaggauugcuguauaauaauaaaacauuuauuuaucuaaguuuaaguuacuguggcugacuugccuuuuguguuccucuaagcccagaaacugcagucucuggcacuuaguaccucaaaacagcaggagauuaaguaaaggauuaauugcuagagccuuuccuuuuuguccagaugccucuuacugucaggcuaggaggaaguuuggagcaauacauaucuauugaaccagaagagaauaacacuggcagaaagaaaaacuuuuacauaagcaaauauguguaaacucaaauaaauuucuauacagauucaugcaugggcauuuauacauuuucuuucuuaccaguuggaucaagcauucauucuaacaauuacauacuuacaaacacacaugcauacauucucacaauuacauacuuacacacacacauccauacuuacauaugcauauggagcaaaagcccaagcaccagugcagaaagaacucauucauucuggaugaaaaaugagcuccagucuuuauuguguagagaaagaaaaggcuucuacccuuuuaauuuuuaauauaaaugaauuaaacccaaguuuauaagaagaaagcuuuguuccuuuaauaagacuaagccuaccuuguuauuaagaaaggaccuguucuguuccaugguaaggaaaaaccuuccugcuccucccccugacuguucuuuguccccaacacuuaugcauuuuuuucagaaaacaugaucacaugguaaaaaguucaucacaaguucacacauaaaaucaaaucauaaauggaaauagaaguuuacagcagagaauguuuacaugcauauccauuaggaguaauuaucuggcuaaacacccaucaccugucucagcugcauagguucauugaaaguugaaagccauaacuaaguuauuagugaaguuuuguacagauaaacccagucaauauuuuaucuucuauccuagcaccuguaauaaauuguuaguucccuuuuaugaucuuugguuaauuguuuuauaaccucuuggaaugugcucugaguaguagaaagucugguuacuaucuagaagcaaucaacuggugucacaugggagacuggcagaguucucauugcaguuuugacuaucagaaaaggaccuacuaacagucccaauauaaaagagcuuaauaaucacugauauaauucuaggaauucuuacaggaucaucauuaagaauuaagaagucaucuauuugucuguauagcaucacuacaagacaguacaucuuuguagaucugcagagaucugcucaaaagggugggcuaauaccuagugauuguuaaauauguuuaauaauaacagaaaaguauauuaauagcaggaaucuuucuuaaaaugaauuucuccugggccuugcuguggauuauaauucaaagcagaccaucuuaggaagaucaccugcuaguuauuagcuuguccucugauggcuccugacacaaaaacaaacaaaacucagaaagccuuucuuucuuucuuucuuucuuucuuucuuucuuucuuucuuucuuucuuucuuucuuucucucucucucucucucucucucucucucucucucucucucucucucucucucucucucucuuucucuucuucucucuuuuuuaaaauauggucucauguuucccaaacuagccuugaaaccuuuauguagccaaagacaaccuugaacuucugguccuucuaucuccacugugcaucaacacuccaggcucauucagugcaagggauugaauccagggcuuggugagcauuaggcaagugaucuaccaaccaagcuacaccacuagugcuguugcaugauacggguuuucuuggaggugcuuuccuuccuacugucccaaaguuccauccuuucucauuuccuuucugccuugggcuguuguuuagucacuuucuggauugguuuucugggacugacuucuuuuagcugagauguuuugauuuccauuacaucacuggaaaaaaacuuuaucuggacauagaauucuaguuuggugauucuuuuuuuuuuuuuuuuuuuuuaaguacuuaaaaauguucuuggugcugggcaugguaacacaucugugaucccaauggucuggcggcugcagcaagaguuugaagcuaugcuggguuagugugagacuucucuggggggaaaauguauaccacuuccucaauccccaaaguuucagagaaaaaaacaaacaaaccugcuguugcucacaguggcauuuccuauaaggaacaccuacuucugcuuucuuucaauaauuuuucuccagcuuuagcuuucagcaaugaauaugugucauggcacagauuugccuuauucaauucagcuucuugaauuuguagguucaugucuuuugacaaaugaggagacauuuucgguugcuuucugaauacuucacacaccucauggaucucuaggacucuguucucuguucagauugagugcguuccacaggccugucacugauacggccucuggaguugcagaucauuacugagucuauauggcacacuucuauuuguuucuccuuggcuuuuuaauucuauuaucuucaguuagcucauuuggcaauuucuggcacuuuaaugagguuuaacauuuuguguaauuuacuauuuauuuauuuugugugugugugugugugugugagagagagagagagagagagagagugcaugagcauauggaggacaaagggugacucucagaaguuauuuuucucuuuccaucaugugggucccagguauuaaacucgggcuauugggcuuaguggcaagugccauuacccacuaagccauucaucacccgucugaugaauuuuaaacuuuuaauuaagaaggauuuucaaacuauugcugaagccuuucaugauauauauuuuaguaucccuuuuagguaauuugacauucauuucaucuuacaacuuaacguauguugguuuuucuuuuuauacauuguuuuccugguuauuggaugguuuucuuuacauauccugaacauuuuggguacuguauuaguaaggguucucuagagucacagaacuuauagucucuauauaguaaaggaauuuauugaugacuuacagucugcaguccaauucccaacaaugguucaguagcagcugugaauggaaguccaaggaucuagcaauugcucagucccacguggcaagcaggcaaaggagug

SEQ ID NO: 3055 - RNA, 3229 nt, Mus musculus
augaaccagaguuuuauuggaauuacuuacaagaguaugguugaggaguuacuuauaggaacagaaauaacucaaagacagcuagcugcauuaccaaaguccauaccaacauuagugacagcagguuggacaguuucuuuccagaugccugaguuggucuaaaucucuucuuggcugcuuaaaugguuucuacuucuuccaggcagcuagucuggucugagaauuuucuuuacagcuugacuugucugaaagucuucuuuguugcuuuuacugcuuucucuaguaaggaggggcuuagcgaauuugguuagucucagggaccuccugaaacuucucaguuuaccuucccauuaacacaacaucuuauggacacagaauuaguuaaggcuauucuggauaaaaauagcaaagcuagagaugucucacauagaauuucaaaucacaguauagaugcauaacaauaaaagcagccucauacugggacaaaaacaggcauauagagcaauggguuucaauagaagacccagaaagagacucauacacacaacugcaguuaucuggagcacagaguaugcuuuguuaagagaccacaucuuaccagcaaauagugcuaagaaacuggaaacccacagcugaagaauaaaaauagauuccuauuucuugccuugcacaaaauuuaauccaaaauggaucaaggaccuuauuagaagacuugaaacguuuagaggaaaauauagaaagaacacuucaaaacauccagaaaauccuucggaaaaggacuccaaccacccaggaaauaauugcaauaacugagaaaugaaauugcaugaacugaaaaaguuuuuguauaacauuuugacauuucuauauaagaauauauaaagaccucaaaaaaaaaaguaguucaagcagcguuuaauccaaguaaugggaagggagagggaggccaaccucucugaauuccaggcaagucaggguuauacagugagacucuaacucaacaaacaaaaccaggaauccaaaaaauuaaacacacacaccaaaccaagggaaaacaaaccacacccaacuaacaaaugggcaaaugaacugaacacagaguucucacauaggagaaaaacaucaacauccuuagacaucaaugaacuguaaaugagaacuacacagagauuccaucucacaccaacugggaaggccuucauccagaaagcacacaaguaccacagugggacuacuuuuagauuuaugcagagcaaucuaaggcagccucccauagagaugcuuguacgucuauauuuaauguagcaacauucaaacagcuaguuuacccagucaguagauguccaccuauagaccucuggacaaagaaaaugugccauagaugcucaaucuagucuuacucagccauaaagaaaagcaauauuaaaucaucugcagggaaaauguauaaaacuggagaaaccucauccuaaacaaacacaaccaaucaauccaaaccgaacaaucucuucuaaaaaacaaaaccgagaaaaccccugacucugaaacacaaguaucacaaucucccugugucucucucucucacagacagacacacagucagacagacauagcucauagaaaaauggcaguuuauaaauguacaaggagaagcccuguguuuuaugagguguuuaauuuuaauugggcauguuuauuaggugagccaaagggggcauuugauugcuggacuucaauacguugauaucuaguagucaguuucaggaggagugaguggccaaaugagggaauagaccuugguggcuagccuuacaaaugucuaacgguuuuuaugcagagggaaugggcgagaagggcaacgccugacagagcuauguuugccaugcucaaucuggccagagucucuucagugggaaggaaaccaugagagagagagagagagagagagagagagagagagagagagagagagagagagagagagagagaggacaggaaaagauaauggggugaauaugaacaacucuugugguucauuuacaugaaaacauaauagugaagucccuccuuuuguagagugaacauauucuaacuuagccauguaaaggaucagaaaauaaaauauauguucacagauuagcaacauuaaaauguuuucugagguuucauuuauuuaaauuuuauaugaauggguauuuugcuuguauuuaugucuaugcacuaccugccugcuugguacucuggaguccagagauggcaccugaaucccugguacuggaaugacagaugguugugaaccaucaugugggagcugagaauuaaaccuggguccucuggaagagccaccagcgcucugagcgccagagucaucucuccagcccccaacacacaauaguuucuguucauuguuagcaaggagugggaagguggggcgggggagaaggcauuccgaguacuaguuauagaaguucacaguacuauaaugcauaugugcaggcuaccuguauuccaaaugaaucuaauggugauacuaugucaaagcccucgaagaaaagguagcauaucuuaacauuucagcacuuucuacauuuugaauugcauuuagucagguaacaauggaaauaauaucauacagcaggaaaauaauuaaauuauuauacauuuucuuauagacucacauaguuauaaauacugacauugaugaaaacuuauguagacaacuaaaggaaacacggaacacacacacacacacacacacacacacacacacacacacacacucacacaaacauacaugcuacacuccuaaauaaacauaaaauauuuaaugggcuaaaaaugagaauuugggagguagguaagauuuaauauagauuuuuucccacuuuagaaacaagacuuaaacauuucaauuauaucaaaugagaaaauugugaaaguagucaaaggcuaagaagguuugacacacuguaucuauacauuuuuuuucucauuaacuucuugucauuuguugacucuacaauuuugacaacuucccaaagcucugcuaugaaucucuuuuccuuucuuggaugcuccuaaacuuuaaucaguguagucugucuguguuuagugcuauugccuagaacuucugagagugaaaucaggagagacuaucacauguucucucauuccucaguuuuuaaaacaauugauuuaaauugacauaauacucaaacacaaacauccu

SEQ ID NO: 3056 - RNA, 38815 nt, Mus musculus
cauccacacuguagaaccccacccaacuuaacucugcgccugcgccgcgcgcgugcguacuagcccugcugccgccgcgcccuucucugggcgucugauucccuuccucccagccccgcccaggcggcugcccgugaccugccugggcgcagggaacggaaagucggaagggguaagaggaguucaguucaucaugggacucuuuggaaaaacccaggagaagccucccaaagagcugguaagggccagcgaccggggaagcuccgcagcggaggugggaacagccagcugcgcucucaggcuggccccuauuuccggggccuuccacucugccgaggggccgagggaagaguuuaggauugggaugugaggagaagcgcgccuuggccgcucggcguccgacccggguguguagggccugguuaggagcaccucggccucgcccccaggcgcuggaggcgccacgccgccgggccccgaggaagcacucucuccccugcgcgcggugguacgggccgcccggaaccuuucuccugcgcaagccccgcccccgcgccggccugcagaccacccggaggacuugcccuagaccggaagguugugugcggugaaccgggucggagcccccaaaaaguccaggcaccugccaggcagguccuuuucucgcucuccucugugugcagggaagcccgacuuguguuuauucuagaagcucaguucucucaggcccuacccauaaggaugcuaccgaaaacaguucggauccuacucugaauccuuagaucugccuaucaauugaguuauuuuagaaaccaaguaucagccgccuaaguuugaguccuacuuuuagacgucucggcucucugaucucgaaaaacuuguccgagacuucuccuaugucaaguaggaagagugcuaccgcaguaauugaccauugaaggaugugaaguuugagcuaguagugguagugaaggugcauucuuuuuuuuguuuuguuuuuguuuuuuucgagacaggguuucucuguguagaccuggcuguccuggaacucucuuuguagaccaggcuggccucgaacucagaaauccgccugccucugccucccaagugcugggauuaaaggcaugcgccaccaccgcccagcgugaaggugcauucuuuacacacccagccuuauuacugaccaccaguagucgcaccaacaguaccagcucccagcacauagcacuuguggggucccauuccagaccuacuaaaucagauuuaaauuaugacuaucccgagugguuagaaugugccuugaccuuugagaagcacuguuucuacagcacucaaacuuguccuucuaaaccuuuaguucacuuauggaaguguagcugucaagccagucuaauuaacguugccauuuuccggugcguguucuuuuuuuuuuuuuuuuuuaagagggguacuuuacuagaggagaaauugacauuacauucuuagcaaugacacuuauuauuuaaaauaauggaaacguuaaacgaguaauguacauaccaggcauaaguuuaaauaguaauaagacuguuuucuuuagacuaucucaacuuauggaugacaaagcuaaagccacacacuaguaaugauuuacuuaucuucaagaagaguauacaaauaccacaaaauggucuacauaauguucugaagugaaauuguaugcuugucucauuuaaguuccacauguucaguuuuauacgagagagcaaaauguaacaggugaaugaaaguucuuaauaagaaaagguuuuaagagaugcaguguggccugcaguucagcugcuuggucauuuucaggacauuccugaaagcaagaguucaagggcagacuagacaguggcucagaaagcaaagauuuuucgggaaagucuggguguuguaguuucugagacauuaccaugcauucguuuuaaaaauuuaauccccacauuaaaaaugaaaguaacauuguaaaaguaaagacuuuagaguuggcuguucaucauccugcaaggucugugucuugcccuuaacuuuuuccgguguguuauuuuaugugaaauggaaguuggauguaaacuugaugagauccaaguuaaacuaauuuagcaagaaugucugggcgcgugguggcgcacaccuuuaaucccagcacucgggaggcagaggcaggcagauuucugaguuugaggccagccuggucuacaaagugaauuccaggacagccagggcuauacagagaaacccugucucgaaaaaaaaaaaaaaagucucacaaggaagugugaacuucguacuauguacauguuaaaaaauaguucuggguguguacuggcuaguuuugugucaacuugacacaggcuggaguuaucacagagaaaggagauccagcugcaaggcauuuucucaauuagugaucaagggggaaaggccccuuguggguggaaccaucucugggcugguagucuugauucuauaagagagcaggcugagcaagccggggaagcaagccaguaaagaacaucccuccauggccucugcaucagcuccugcuuccugaccugcuugaguuccaguccugacuuccuuuggugaugaacagcaauguggaaguguaagccuaauaaacccuuuccuccccaacuugcuucuuggucaugauguuuugugcaggaauagcaacccugacuaagacaggguggaaaugaaagagaucaccagucugugucugggcaaggcaaacuucuguuauggaucaggaaggugugcucagaagagucaacuuacagagacagcaaguacaccugguuuuuauucuuacucaggugguaacugugccuuuuccacacugauuggggucugaccucacagucuuauucacucagcuugcuugaaaagaauugccacaccagaaaugaagaaagggggugugugugucacugcuccaucuaauuccuggagagcaguaggaggccuuuguauaaacaaggguguugggaugggaguuugaaacauuuguauaaaaagucuuguaagguggggaagacuaaaagauuugaauuccuucuaaacacaaauuuaauauuucuuuaauauuauuacuaauaauauaaguaauaaauuauaauaaaauuauaacuaauaaaguaagacuauuucuagcauauuauguugggcauaugauaaguaguuucauuuuguuuguuuguagagagguucuuguucugugugcuguaugguuucugucaacuucacacaaaccuagacauaucuggguggagggaaucgaaauuugggaauugccuuaggcaagucugugggguauuguaaugauggaugugggagggccuggcugucugggcuaugccaccccuggacaagugguccugagugguccucaauggucucuguugcaguucccaccucuaggucucuugaccucugaugcauuacaacugcaagcugaaauguacccuuuucuuccccaaguugcuuuuggucaugauguuuaucacagcaguagaaaccaagcuaaggcaucauguaucccaggcuggcuuggaauuguugauucuucuaagagcugaucuuaccuguguguaccaccauauuuggcugcuugucucauuaauaauguugcuaguaacuuuggucaccugcuuucaggucauguaagccagguaucuaugauguauuuuuuucuuuugcugcuauucaauaaaauagcacggggcggggggcauggacuugcacugagcaucuaaauuggacccaauagugucuaccaaaccaauaugauuuaaucaccauuugguuaauuguaagggauacugcggccaacuaacuagcagaguggcagccaguugacuuguuaagaagcuccaguaccugcacugcucucuggcucuccuccguuuucuguaaacgccaucggaucauauugucuagauuucucagaauuugcucucguucugggaguugccugauuugugacuagguuuuguuuugcuuuacuuuaauaaacucacugaauaugauugguugaaggauuuuuuucucuuagcaauagagagaaacaugaggggugcuaccuuggugcuucauggauuggcucugcaguuucucauuaacccuuuuucuuaaauuccuuagcaucuguuuguaccucuuuucuaaauugaaugaucuuuuaaugguuuucugauugguaauuucuuuucuaaugccaucauuccuuucuuacuuguuagcugacagucuucaguacagaccuucuuguuaguuaggcaugcuugguuaccuggacauacacuuugugcugaaaaggcaggagcaguaagugcccaguugcucucucuuuaaucaguaauguuagaauaagggguugacagaauguuuuccagagauaggaaaugcuuuuucuaucgagugucauuuuagucuuguagauuuuaauguuuuauaugucauagucacuuuucaccauuauuuugugugauguugaaauacaaguuuggucaguggugcuaaagagucugucacuuuuaaacauaaucuuaauggucucugagugcuuccuugcuuucuagugacuggaaacagacuggcauucacaaauacugaugcugguugcaggcgaucacuguccucggcagauuacugagaaccaguugccagcccacuaaaguuagauguuugguaaagaaauguaagguuucucuggaagaagaugaacuuacguucaaagacuuaaauuauccugaaaacucucauauauaauguuuggaauugauuuuuuaaaagaagacauuuauguaggagaggccuucauauauccuggaugcaaauucuuuauaaaucuuauuggugacuuguucagcacacaccucucaaugggacaucuaaauuaaacuccucaccucaagcucagggcacccuacggaaggggaggccgaggauggaggacaccaggagaacaaggcccucuaauguaacugagccaagcucauaugaacucacagggacugaaguagcaagcacagggccuaacugggacugccccagguccucuguguauguguucuagcuuccuguuuaguauuuuuauggaacuccugagugugugaacaagugaacugauucuugugccuucucuuggggccccuuuccuucaguugguuugccuugucuaauuucaauaugauggcuuuguuuuaucuuacuauauauuauuuuguuauauuuugauaucucuuggauagccuguucuuuucuaaugagagacagaaaaggaguggaucuggaugggagaggagguggggaggaacugggaggagggaggggaaacugugguuaguauauagugugugagaaaaaaaaaucucauuuuuaguaaaguaacuaaaauuauauugaaacuauguuuauguguuauacauuauauaauaauauauuuauuacacacagauauauaguacuuugauggguucccagcucucucacaugagaguuacaaccauugcuaacucuguauccagggcaucugauguccucuucucuuugggcaccaggcauauauauaguacaagacauguaggcaaaacacucauauacauaaauacaucuaaauuuuuuucaaaaacuaaauaaauguuuuuuauuauuauuggcaugguuauaaauaucuucuucgcauuugugauauuuuucuuuaauuacagccuugugcaaaguaaaaauucauacuuuuaaauaaaaaugucagcccuuuccuuucugguuauugcuugugucuuuuaaaacuuaauuucaaagauuuauuuuuuauuuauuuauuuuuuagggaaauauuaaucaauuuuauguaauguucuuuuauguauguauguauguguauauguauuuauuuuuauuagauauuuucuuuauauacauuucaaaugcuauccugaaagucccuauacccucccuccgcccugcuccccuacccacccacucccgcuuuaacgauuuauuuuuaaguuaaguguggguaucuggguguggguguacacauguaagucagaggacuagcacauuggaucuccuagagcuggaguuucacgggugcugggaaucccagggccuacguaagagcgcauguauccuagcuugcugggccaacucuccagccuguuucuuaacuuucuuuguuuguuuuguuuuuuauguguuuugcuuuuuuguguuuuguuuuguuuuguuuuguuuuguuuuguuuuguuuuaagaaauccucuaacucgacagcaucucuuccuagaucgagggcuugaagagagagcuucuuguugugugcuaggcaagccuucuuucacugagccacaucucuaguuuuccaguuaacucugguauaaugacuuuuauuucauaauuguguuuugaauccaccaggaauuagcuucagggauugguggaaccaggauuuggacaauugguuucugugcauuguuugucucagcacugguuguaggugaugccuucuugcucauuucaguuuccuucaucuaguuugugccuggcauauaauagccucagugaaugaauuugaauaaagcacuuaucuugauagucucaaccuuucuguagguuuuuuuauggucuucacaacauagucuaacuuacaaauugauuuuuaaaaccuuguuacugcauuccuacuuauuuaaauaccuuuuuuguguuaguaaaguacuguugaaacuaacuaaauauuuguuuaaauuucuuuuuaucuguuuugaaucuucuuuaagguaucuucauacuuauggaaccucuuugauacauuuuguugagcugcuggucucagacuguguuucugaucccuuaaagaauauuagagacauauggaagcauguaaaaugcuaagugucaucugggcugccccagucuagugaaacuggcauuuuuaaaauuuauacauaaauauuaacaauagccaaaaguuauagaaaacucaguuggucaucaacaggugaagagagaaauguuugugguguauacauauaaugggauuaaggugaaacauaaaaaaagaugauuuucaugccauaacaagcaugaaccuugaaaacaugcuaugaaaugaaagaauuuagaaccaaagggcacauacuguaugaauguuuuuauaugauauaaucagaacaaccaguucuauaaagauagaaaauaaaauacuaguugccaaggacuugguagaugggaagauaagggauccuuuaagguguguacuauauuccaaggugaugaaaagauuuuaaggguugauagcaaguuguacuaaauuucgccaucaauuauauacuuuaacaugauuaguugcauauuacauaaauuuaacuuaaaauguaaauaagccuauaaaauguaaauaaaccuaaccugauuaauuauuuaaaaauuauauuaccuuguaguuuuauuuauguuuuaaauuuuuguguguauguagaugacaugccugugcauaugccagaagaggauguagagcaucacuuucugccuuauucccuuauuccuuauuuccuaaaagcucauuaaacuugaagcucaccauuuuggcaagguuggcuuggccagugaacuccagggauucacuuguuucugucucccaguuuugggguuauaagucauggcuggcuuuuaaguguugaaacauuucuuucagugguaucauuguuuuuauaaauauuuuacagauuuugguaaguaauuauuaaauguuaaacuugaaauuuaauagaaacacaucuacugauagaaaauuuuaaaugcaguuuaauucauguacuugugugugaaugcuacaggguucugaguucuguuccuuuacaauuaauauagaauuuuugguuuauauagaauauaaguacugaaagcccuuucaguaaggagcuggugauggaauggcacugaaguaguagcaaugucacucaguucuuccgagucaugugccaaaacgcauacaguaauuuaauauaacuuuuacuuuuaaugaaauaucagcugacacuugagauuuucuucaguauuuuugaaaaaggaaaagaacuggaaagcagcucacuggcgugagaaugagcuaguuauuagagucccugcaccaggaccuccacuuggcuacacuuagugccucagaguuaaccugacaggaagaaaaauaacauaaaaagauaaguuccuaguacacaggcagaguaguuuuuaaaauaauuauguguaaaagaugaaaaucuucugaugccguaagacuguccuugcccagguaccauguacaaaauacuaguguaccugcagagccuucucuaaaguguucuucuucccugccaggcuguaaacaguuuagagugccuguuuaccgugaaugaagaguuaguuaaaaaagaaagggaaggaagaaauggcccuaaagauuuuucugcagaauuaaaaaaaaaaaugugucuaaacucaauguagaauuaauauagaauuuuuaagaaugugcaaaauugacuaggaaugcuugcuucucugauaauucccuauuuaaaauuuccccagguuaaugaauggucacugaagaucagaaaggaaaugagaguuguugacaggcaaauaagagguaaauuacuauuuuauguuuucuauucuauacucuuuuuuuaaaaaaaaaagauuuauuuauauauuuauuuuauguauguaaguacauacauacaucaguagcuguacagaugguugugagccuucaugugauuguugggaauuaaauuuuuuuuaggaccucugcuugcuguggucaacccugcucacucuacuagcucagugccugcuugcuccggcccaaagauuuacuuauuauuauacauaaguacauuguaguugucuucagacacaccagaagagggugucagaucucauuacggaugguugugagccaccaugugauugcuggaauuugaacucaggaccuucagaaagagcagucggugcucuaaaccacugagccaucucgccagccaaauucuauacacuuaaaaaaaaagauuuauuuauuuauuuuauguacaugaguacacuguagcuguauagaugguuguaagccaucaugugguugcugggaauugaacucaggaccucuguuugcuccagcccaaagauuuacuuauuguuauauauaagaacacuguagcugucuucagacacaccagaaaggggcaucagaucucauuauggaugguuguaagccaccaugugguugcugggauuugaacuccgucagcauaugaagugguuacguugauagcagaggguuauuuuuucuuccuuccugauucauuaccuuucggguauuuacgugcccggggguauggcaugugccaguaugaguaagugugcuugcuuuguuaaccaucucaacugcacagaaauguuuuuaaaccacugcuggcaugcauuaaaacaacacugucugccuuccauaguguuaggaagaaggacgggguacacagacuguuagguuuggauuuuaucagcagauuuugagaacuggggaaaauguggccacauauuuacuuuuacugaugggaagcugaggccuccagccagcucugucgaguugggacugcaguggcuggggaugucgcugagguggcagaguaccugccugacauaaaauccugaguuugagaccuuccauauauaaaccagauguggucccccuugacuguaauccuagcauuugggaaguagaggcaagaagaucaauucaugaucuccuaacagguauauuccaauacugagaagcagcaaguucaaggcugcccucaaacacgugagacccuaucucagacaucaaaauggggguugggggaacugcagaggauugucauccuagcuacagauuuccuucccaccccacaguggccugcauagcacuuuccagcacugugaaacuagccaguaggaaggaaguuuucaggucaguucuagcuugauucuucugucucguagccaaaauauguccugccucagcaguauggucuuaccaucuauuucuggugggcagccaaaagguaaugacaauggcccguguuauuauagugcuucuggggucuccccguuaccacaaguaagccuuggcacugagauuuuuauuuaauaauaaucccaugucuucuuggagacuuauuguugaucaugcagguuaaucugcauuuguauuucuuagaaauuaacuuaauaaaguagugaguuucccuaaggguuuuuagagcuuugguuuuggcuaaucaccugcacucuuccugaucugcccuauccuuucuuaaaccuuuaaccuccaauauucccuugccucuacuauuauacuauagagauucuacuauucuccucuuuuuuaaaggaauuuuaaaaaacaccuuugugaauagaaaagauugauaucagaaaagugucccaggauuauaguaucacaacuuuaaaaaagaauuagagaugagaauucuauugucagcuguguuaauuuuggucuuaacacuucuacuucaauuguaaaugaaaguuugaaugcaucaacuaugaaacaacugcuuuucacacuggacagaugacugugaauaaugacaaaagaaacagaaagagaacccucauagucugccuucuuguuagagauacguuucuugaaaguggcucaugggaggggaucccgaaaaaacauggucgucucauugaauugaggauuuggaggucaggguaagggaggcuaacauuuguguccugagugagaagaggaacauagccaggggaagaucucgagaucuccacagggucugaggcugcggcugaacacagagugcggcugacaggauacuuacugggacaaaacaacugccaggaaguuuuaagcugaacaguuuccaaagcuaacagaggguuggaagaugguuuaguuuuucaaacacaguaaagagauuuuguuaaaauccgagacauucaauauagacuggaaaagguuuacauuuaguauuaagguaagaauaaaggcacguuuaugaggaaagcguaugaacaggucuugaaguugaucugcaagugacuuagcugccagucaaaauaaaacuuaaugcucuuuaaaggacuacaaaauuaugacaccuaacagugagucauucucagugccaaguaaaaaggccacugcagggcuauagaacaaugacccacacagacaaaguaaauaaaucggacaauagaaauagacagaaaaaaaaacccaauuaaucuaaaagggauaagaaauaugagggguuuuucagcccuaccuuuuuuucuuucuuucuuuuuuuuuuuuuuuuuuuguuuuuuugagacaggguuucucuguauaucccuggcuguccuggagcucacucuauagaccaggcuggucucgaacucgaaauccgucugccucugccucccaagugcugggauuaaaggcauucgccaccaccgccugucucagcccuacuuuuaauaaugguucuuaaaugcuuuaaccucucuucuagcccucuauccaccagagguaguggaaaagaaagguuauuaggauaugggggcagaggauauguuuagaaguuguucuuuggagccacucacaucuguguuaucuggaaaucagcaguucaguucacagaauuaaucagcggcagcuugauccacucacaaacccuacaugaauaugucaauagucagguuuggcaaugucaggauagcaaaugaaucagcaucaguagcaugauuuagcagagacagccaggccucagcugaauugggacaagucagcaggagggacuaguaccacagggacuccaggaguuccugucugugucucaagugaagacucaagaccaagaagcauugcaaaacuagcugugcaagcaagccaagccccagucacugugugaugugccuauuuauacucccuccaaauauguguccuccacgggucuugccucaugugucaugccucagcacaugagucuuuaucagcugacaucacucugccaauuggcccaaguccacugaagcagcaggggccucuggagaaauuuuuuggugcauuucucuuuauggagucagagcaaauggagcucagcaaugcauggaaggcgaaccaaugaaugugugucauuagugaagacuuguucaucaugaguccuuucacgugcuuacuucagcagauuauccuuucaauugugucugcguuaucgaaacauccuuuuacuuguguccacuucaggaaaauacuccuucauguguuugcuccaaaaaaaccaccauccaacacaacugauuuucaaagaaaccagaaguuuccacuuaagaaauguuaguuuaaaacaaagucauaagcaaaaaaaaaaaaagaaaaaaaagaaaaaagaaacaaagacuccuuaaagauaaagcaaaacuucacuaaauggauacaacaacagauuagacacuauaaaaaaaaggagauuaaaaaaauugaagauaguaacacaaacuaugcuaccagaaaaagaccagcagagauacugugaccuguggaugauguuaaguggucugauguauauaauuuaucagaagagucaagagaucagaugaaauuauagcaaaauauuuucaauaagcccauagagcccaaaaaauuaucucaaagcugaaucaauuaauugaggcacaacauguuuaguuuacugaagcauaggacagacaaccuaaaaagaggcacauuagauguaggaaacagugguagagcaucuguugccugaagugugugaggcccugggcucaaucugcaacacuauaaguaaauaaauacagaaaacaauaagaaugguuaaaacuuaauuaucagaaaugauguaaaccagaauaucuuuacuaugguagaagaaaaagcuuuauacuaaauuucuguauauaagcugggugguggugguauaugcguuuaaucccagcacuugggaggcagaggcagguggaucucugaguucgaggccagccuggucuccagagugaguuccaggacagccagggcugcauggagaaacccugucuuggaaaaaaagggggaaaauuaaaucuggagagaauacuguucaaagguuaaagugaaguuaaauauuuuuaagcuaaaagcugagccucuugccagcauaagaaauguuaaacuguagcccggggcuguagagauggcucagagacuaaaagcacuuacugcuccuucagaggaccuaggauugguucucaccaucuacacugggcaguaacuccaacuccagggaucugaugcccuggaguucuugcuuccaaggguaccugcacacacauaguacacauaaacucaguaggcaaauugcauauauguaaauguaaaaaaaaaucuuuagaaauugagggccaaaggaaaaucaaaucuagauacacacagaaugaaaacauuuuugauauaaauacaagcaauucuuucauuauuuaaaaauguuuauaauaauguagcauguaacauacaaaaauaaaauauaugauauuagcacaaauaguuuauugguaucauauacagccuauguugcauuuguuuuuuuaaaaaaauuauuuauuuauuauuuuauguacauuggugauuugacugcuuguacgucugugugaggaugucagauccccuggaacaggaguuauagacaguugugaguugccaugugggugcuagaaauuaaacccagguccucuggaagaguggccagugcucauaaccacugagccaucucucccuguugcagcugacuuuaauuauguacaugcccaauauacauaggcaugagaauuucuuuuugaaaguucacucagaagauaguuugccuuacuguuuuugcacccaaaacuaguucucuaccuugccuuuagugccccgcuauguccuggaguauguuugaauggaagcuguucacaaaaggggaguuauuaaagauuaugagaugagauuauuuccguuguuuagagcagggugauuauccuugaugcagauaagaguccuggguugcuaggugcuuuguuaggagaaggauguaugcauagcccaagcuaaaucgaugcccagcuugcuaaguuuucuauaugcuugccugucugacuucugccucacccuccaguucauugguauuauaggcaugaaucacaaugucuguauuuaauuccuuuuuagauacaaaugagcuaaaccauuucaucaaaagaaauugucagaaagcauuaaaagaacacuauugaacuauauguugucuacagcaaacucaguuuaaauccaaaaccacaaauagauugagaauacaaaguuagaaaaagauacuguaucacagauuuaaccaagagaaaggguguaacuuuauaucacgguaaaccagacucuaaaacauuaaaaauauccugagaaaaagagcuuauuauauuaauaaaaguucuaauauaaucuaauaucuacuugaucauagacauuuuccaucuaacuaaauacucuuaagguaugaaagggaaaaaaauugaaagaauuaguaggauuucauuaauaguaggagauuucacuguuccauaugguuaaguaaagaaauguauuaggacaauggaagaaaccagcuauagcuauuuagauauauacagaauuuccagcaacagcagaauaugcauuuacucaagugugcauggaauguccuccaaauaagauugcauguuugccccuaauucaagucucaaucaaccuuggucauugaaucaaugauuuaaaaaauccuuucaaccaaaaaaaaaauaaucuuugaaccuaaugguuucacugaugaauuuuacucaacauucauggaagugcuaauaccaguuugugaacuuacaaaaguguacagaggacuuucugacucaauccauaaauaaguauaucuuuaaaucaaagccaaagauaguuacaagaaaccugccaucugauacaccuuguaaaaguacuuaauacaauacuaagaagucaaauauaagaccaucuugaaaggauucugcguccuggccauguuagacuuaucuuagguuuccuguuucucucuguauuugucaacaucucaggaagcagccgugacaguggugcuccuucacccauuucaggguuucaggacagagucugaagauggggaauguaggacuucuucacacgccccuucugauuuucacaacauacaaaacaucuacaccgggaucuuuccaagcaacuuuuuugggaguaaguuagcccaaguugauuuaaaauuaugaugauucucccucugucucuugagugcuaggauuauaggugugcaccaccauacguaaaccauccaaaucauuugauuuccuccaagucuccccagugcuguagaauagaaguugucacugaauagugcccagugcaggagcugcuuucuuuuuccaaauauaaaaauguguuuuugugguacuuccucuucaaaaugaaggugggucuccuuacauugauacaaucuuacaaucuagaggucuugaucagguucauuuucuuugccaguuaaauaauuaaaaugcagaaaaaaaucugguguguggcagguagcaguggagaaauuacaaacaccacagauaacaucagacagaugcaggcauguagcagauauacagagaaagagaccugcaaagcugaggugggauuugggaaaccaaaaagcccauucucuuuucaggguuagaguuuuugaaaucucucgagaguuuuccuccccuaauuuagacuuggucaauuugaagaaaggaggguugauuggcccacaucugugugacauguccaaauccagccuuggacuuauucagccaguuuaucaucaggaggcccacugaagggaaaugggggcccuuucgggagcuuugguuucagauccugagaaaccaacucuucccacugcaaaagggcuaugguuaucagacccaaggccauugugcacucagucuguaauguccccuaugugcaacauuguuugauuaguuucuuggugaccuagucccacucuacuauagcuucugcugacuguuuaauuuuuccccuaaaaauaguauauaagaugcuguacuucuuauuuaauagacuugcuuggcauacgacauagcuugugcaagaccuggacauaaauuuuauuaucuucucugccuucuaucuuuaucuucugaucuccuaauccucgcccucaggacucugucaggaaaggauggccugcugguccagaucacuguuuaauuguagaauuaugaaugcuuaggauguaaauuguguuacauguauuuugccacaguuucuaaaauucaaaaguuuuuacugauuauaaagucuauaauaauacagacaugucuacacuccaguugaugcugguacaaugcuucaguguguucagguucucuuuaagcuguaggauuuuaacaauuacuguuccgagauugugcucccuuguuucuuaccuguaagaaagcugcaugcugauggucagaauaagcucugagaugcaugcacagugcccucugaagcuccucaguagagauagguaccaagcaggguuagagcaagcucacaaagguuuuuaagguauaauaggauuauacuucugcuuauugucaaacuauguuagucuuguuucagaaaguaguaaauacccauauauuaauauuuuuauuucaucuacuauccucugauaauuuucuacuuacagaugcaaugagaguauaauaaaaacaguuugagugcuaccaagcccaguuugcccuucguguguguguguguguguguguguguguguguguauacacagguauguggguggccaaagagggugggcguccuauuccuuggagcuggaguuaggcauugugagcccccuaucauggguugugacuccugaacucuggucucaagauugggcagcaaguauuuaacugcagacacaccucuccagccccuacccauggcuuuugauauuuuguucuaaauuuagauauccaaagagaagaagagaaaguaaaacggucugugaaagaugcagccaagaagggccaaaaggaagucugugugguucuggccaaggagaugaucaggucaaggaaagccgugagcaagcucuaugccuccaaagcacacaugaacucugugcucaugggcaugaagaaccaacucgguaaggcccagguaccugacacccccaauaaugcugcugccauuaggaucaaaucucuuuuauuuauuuauuuuaaacuuuucacauugucuuaacuaggguacuguacaaauguagaauauuauuguuacuauuauuuuguuaaucacuuuuuugccaaugguuuugaaauaaugaaucuacauagaagucuuuguuuagauguuagaacauauugaauguauauguucagcugcaguccauacucucauaaaaugaacaucuacuuuuauucuauuuagauaugauaccuuuuuguagcauuugauuaaaauucagauucuguuugaucuuggaaguccuguguacucugacuucaucuccuccuugucuccuuccuucucuacauccaucuguacugcucucucaguuccuggaacuggaucaguguaugcuuauccuagaaccuuugcauuuaaugaucucucugcaaguacacagugccccaucucuugaaaugauugguccuuauccuacaggucucaauuaagauguuaggcacacaguaaggcuuuuucuaaaacuucugucaacaacauaacucuguaacucuuuuuuuucccucucucucucccucucucuuuuucuuaauggaguuucucuguuuaacagcccuggcugucccacgacucacuuggccaauuuuuuucagaccaauuuggccugaaacucacagaaaucuuccugccucugccucccaagugcugagauuaaagacuugugcugccaagccuggcuucuaagucauugauuucuaaugaaauuaacauguucuguuaguuuuuuuuaaaaccaugcuaggaauugaacauagaacuuuguauuggcuaggcaagugauauaccgcugagcucuauccccagucuuauuuguuuguuugcuuguuuguuuguuuguuuguuuugagucucaauauguagcccuaguuggcacagaacucaaaaagauucauuugccucugcuuccugaaugcuggaauuaaagacgugggccaccaugucucacauugcuguauucuuaaugcauacacuguguccaacuagagccagacaccuugucugucuaacccauggcucuaucucuagcuuagaaaggagugucacguaauaccugugaagaacacauccauaaguagguucaaaugcuagugacuguuucucuguugugugugguuguuuccuauauguacuuugaauauuaaauguggagcaaaauccuugauucauuaguucacuuuuuggauacuuuuauuauuuaauuuuuuaaaucuuauuuagcuuuccuuucuguauaugaauguuuugccugcauguaugucuguguaguauauguguggaguaccugcagaagaggacaucguauccaguggaacuggaauucuauacgacugacugcuagcugauguguggguacugagaaucaaacccaggucuucuacaauugcagccaguacucuuaaccacugagccguaucuccagcccccuuuuuuuaaauuuuuauuuaucuguaugucuauauacaugcuugugggugcuggcaaaggccagaagagggugucugaucccccuuggaguuagaguuacaagugguauccuuugcaagagcagcagauguucuuaaccauugaaccaucucgagcucuauuuauuaguucauuuuuuccagcuaguuuuuauggccuuuuuuuucuuuccuuuuucuuucucuuuacuaucucccaguuuugaucuuagaacuccugaauuucagaaagucccucaggacaugcagacuauaugauaucguaauuuagaucccuuaccuaccgggugucuaggucuaaauguuuguacuaacucuguuuccaggugaggcuuacauaagucaccugggcucagauaccuucacugccuauuuuuauuguaauugcuucuuauauacauuaucugcuuauuguuuuuagguauuuguaagauuucucagcaauagugugauaugccuguauuaacuaaaggcuaaagucuugaauaguacuuuuccuuuuuggucucuuugacuuaggucaaauugcauuaggcuuaauuggggagggggucuuguuaaugaugguuguuuuguuuuuguuuuuuaagauuuauuuuauauauauguauguauguauauauauauguguguguguauauauauguguguauauauauguauguguguguauauauguguguguauauguguguguauguauguguguguguauguaugugugugugugcguguguauauauauauauauauauauauauauauauauacauauauauauauauauauauauauaaauuacauuauagcugucuugagacacaccagaagaaggcaucaaaucccauugcagaugguugugaguuaccauaugguugcugggaauugaacuuugaaagagcaaucagugaucuuaacugcugagccauuucuccagucccaaugaugguuguuuuugagacagggucuuauuguauaccuuacacuggccuggaacccaugauuuuccugucuccuuaacuaccucuuuuuuuuucuuucuucauucaguucaguauauuugcuucuuguuuucaaguguauuuugccuacuguacacauaaaguguugucauccuagaauuucuaauauuuaggcagcuaagaggcucucauauucagaaauagcauauaccuuuuuacuuugaauuuugaguaagaaaauuaggaagcuacauucugcauuuaaaucugcuuuaggaaucuauauguuuuuuaaaaaguaauuucuuuuuuuuuuuuuuuuucagaauucuuuuuuuuuuuuuaauuuauuuauuuauuauauguaaguacauuguagcugucuucagacacuccagaagagggggucagaucucguuacggaugguugugagccaccaugugguugcugggauuugaacucugcaccuucggaagagcagucgggugcucuaacccacugagccaucucaccagcccccuaaaaaguaauuucuaaaugaaccaaauauugaagauaaaaauaaauucacaaaagcacuagaagaaaauauauuuaacauuuauaagaagaugaaaugaaaaaaauguuuuuagagucaaauauaaaaucuuauaaaagaaaaguuauaaaugcagcacaaaauguuuaaaguuucugaacaaaauaaaaauuauugcuacaaagucaaaagaaaaagugacuagcaauuguaauccaaaagcugauaguacaauccaaaaaaagccuuuugaaaaccaucuaaaaauuacaccaagacaaaggagaggaacuggauguguaaagagguuuucagucccaauaagaaguucaggcuggugccgggugugguguugcacuccuuuaaucccagcacucaggaggcagaggcaggcggauuucugaguucgaggccagccuggucuacaaagugagcuccaggacagccagagcuauaaagagaaacccugucucgaaaaaccaaaaaaaaaaaaaaaagaaguucaggcugugcuguuggucacaggagcucauguagcccaagcuggccuugaacuccuuauggggaagaugacauuuaccucuguuccuccugucucugcuuuuccuuaaguacuaaggucacaaaacaugugucugugcaccuggcuuuaugugaagcugggaguugaacaaggguuuucugcauccucagcaaguaccacaucaauggagcuacaucccuagcccccggauaugcuuugaaugauauaaucacauuucuguccaagggcauagguuucugggggcuggugagauggcucucagcagaugaagaugcuugcugccaagccugacaacccagauuugauccccaggacccacaugguggaaggaaacagcugacuccaaaaaguuguccuccagcauccaucacauaccuauauagcagccuacaguagacucauaugaaacaugacuuuccaacucaagaucaagaaagaugacucgggguuuaugcucacucauuuaguguaauuaauaauugauucaaaaaucaugaaaguaauuuuggcuauauuagaauuuaaauauauaccuucuuucauaucaaaacaugcucucaaacaugaaaguauuuauaggaauuguuaguuggacaaguugccacaaugccuguaaucucagaacuugggagguagagagagucuagccauugaauucacagccaacccucuucucuuucccccucccccuccccaucucuccucucccccuucucccccucccccuccuccuccucuccuuuucuuuuucucuccuuuucuuuuucucuucucuucuuuuuccuuccuauccuauccuacccuauccuggaacgacuguguagaccagacugacuuugaacucacagagauucaccugccucugcauuccagugcuagaaucaaagacaugaaccaccauuccuaguaaggccagccauuuucauucuggcagauuuuacagaggagucaaagaauauauucuuuuucuuguaauuuuucuuugagaauuaagaacauuuuaagucaucuuucauuauuguuuauaaacuuggcauaugugucuaugggucauguuaaaaucauuuacuuucaugagauuuuaacuuccuuauuugcauuuuugauuugguaccaaauuuagccauggcaguguaacauggagagagccaagucccaaccaggcaugauggugcacaccuuuagucucugcacuuagcaggcagagggagguggaugucagugaguuggaggugaccuggucuacauagccaguuccaggacaucuagggcuacauaguaagauccuguuucaaaacaauaacaauuaaaaagaagaaaauggagucaaaccuacuguguaaauggccaugccaaguaauuaccauugaaugcaaguagucauaauagagaaaaagugugguaaaacauacaagaccuuaaguagacacauggcucuccaguguuuaccacaauaucacccucacuuaaaguaauaguuuaagugaaacaucucaucacauaaaauuuuugucauuaauguuugacuuugaacuuuuugauguuucauuuguuuugcauuaauuuuguaauuuguauauauuuguaaacaucagaaaaauuuacccaguuaguaaaaugcagauacuuaaagccaacacugggaagacauugcuaauaguggaacugauagcauuuugcuuuucuucagugagggauugaaucaauaaauuguggcuuauucgagcuugacauggcacucugcugugccuuuuucauaggcaagcaagguuauuggcuguaaguauagcauguacucugaggguaaaugguauguauuugugcaaguauauaaauaaguauaaguggaucaauauauauucuuuauuaugguaaaauguaagucugcaaaauuagaguaaauagccagauagauuaguaaguauccaccauuagcuuaaaaaugugauuccuaucugugcccuuugacuuugugucuuccccuauuuccugugcucccucugccaaucugagauaccauugcaucuauucuccugugcauuucuaaggggaagaguucuguagcuauuccuggauaguuguuuccauuugggucuugcgcgcccugacucaccagcaagaacgacgcugcaacaggauccuucugcacacauuuauugggagagcuugauugcagaggcaaagagaccccaagcccagaacuggugcugcuuauauaggccuaggagaggcgugucucacacccggauugguuaugcauggguuaugcuuaccaccucauuuguaugucucacaucugauugguuaacuugucucucaucugauugguuaauucucaaaaccucaucuuggccaaaaaaaaaaaaaaaaacuuuacugccuauguaugcgugguggccagcgguagccagugccacccugcaacggcacauguggcuucccacauuugggaacuuaaaccuaucaguucuuuuauaucuguuuucuuuuuacugucuuuucuucugaaagcaagugauuuuagucuuuuguuggauuuuucagacuaauguuuuaauuuucuuucauaucauuuguuuuggguuuuuuuggggaggguuguuuuuguuuuguuuguuuuguuuuguuuuaagacaggguuucucuguguaacagcccuugccuguacuggaccucauuuugcccaccagguuguccucaaacucacagagaucuaucugccucuaccuccuuaaaauuuugaugcugggauuaaagccgugcacuacuacuguccagcuucuuacauguuuuuuuauuuugaagauaauuauauucagacccauguggugcauaacuuuaaucccagcacucaagaggcagaggcaggaagaucucugugaguucgaggacuacagagagacacucucaaaugagugaaugaaucgaugaauagaaaagaacuaggugaggaguggggagacggaucaggcuguuuagguuucaugaguuaccauucagucuuuucaugaagaugagcugaaaaugagucuuucuuccuuacucucucucuauuccuuccuuuacuuuuguuuuuuuaaagaaagauuuuguuuauuuauuuaccuauuuauuauaugcaugaauguuuuuccugucuguauauaugugugugcaccaugccugaugccauggguggggggugggggguggggguggggucagaggaggauauuugauucccuggaacuagaguuagggcaauugugagcugccauguaugugguggggaccaaauccagguccucuucuagagcagcaagugcucuuaacugcugagccaucugcucaguacuuuuuccuuaauaacaaaaagaaguauuacauuuacuuuuuuauauauuuacuugcugugcaugugucgggggaacauacaugccacaauacgcacgugaaggucaaaagacaacuuuugggagucaaguucuccugucauguggauccuagggaaggagucaggucaucacuguguugguaggcaccuuuguauauggagcuaucuugcugucccccccugcccugccuuuuuacauugcaauuaaaagucagaaagguauaaguacaauuaucuuaggaaucaaauugaaagcaaauacuuggaauaaauuuaguaaaaaccccaauaagcuugaucaaaucaauauauguuuaugcuugcaaacugcuagauuccagagggcuguaaagggacguagagaaucaaggagagcugucuuucaggcccugaugaggucugaagcagaauaugaggaugaguguaguguggugugugugugugugugugugugugugugugugugugugugucggggagggagaugguacuuacuccaaacugaaaggauugcuuauguaaaugcccuggggucagagaacuguguuugcaacacuaaaggaagaccugggaguuugggauucugagcaggguguguagaggugucuggaaaggaugggcagugaggugcagaauauuguuuuuacaucuguuuggagacugauuuuuaaagacaaauuuaaaaugaagcauguuguagugacaguacagauaaagggcagugggaguugaguugagauauuuugaggagaucgagggaggaaucugaguggaaggaguaacugcacagagacagcugaaauauuucaggcuguguucuggagaguuugacaagagugcgcugaggagaaaguuggaaaggaagguugaagucagaguuuucaaaguuagguaagggauuuaaccucacacugugguuauggagaacgaauucuggguuauugugaacacaaacuauaggcucaggggacucugaugccaaagauggaggcccuagggccugagaggaaauggaauggaaugaggacauggaaugaaaggugaaugugaauacagaguggaaagaccuuagugacaccuaagcaagcuucagggagggagccuggcaagacugcaaggccauuagugaaggacacugagagcucgggagcugcugcaacagaaagccucaccugggacugacugggcuggugccucaagaucagugacugugcuggaauguuuauguugggaaauuuaauacagcugagggguagcagugucgaaucccagaaggaaggaagcaaagggaagucuccauucugggaguaggaaacaagcaaggcuuauaaccagaguucccaagcacaguuugcuagucuuggcccuagagcucuguaucagcccuagccugugacugcucugaaggguuuuuccauuaagauguucucuuauuaaaauggagcuguccccaggugggugauguuacccuuugccagcuauuaauauauuguugugauuagauacuuggcaagaacagccuucugacagcagcugcuugcagaagaagacagaugaugagcauguuuugacugggggcaagaguuaaggaagagguucagagguggggcaggaauagaauuaccauaugaucuugcaauucugcuucuggguguguacucaagaaugggaagcagaggcaugaagugcaccaucacauauuccuaugugauucguaguagccaaggggggaaacaauguaaaugcccauugguggguggagagauaaauacaauguugcauacacauaguagaauauuauucagccuuggggcuggggagauggcucaguggguaaaagugcuugcuguacaacuaagaggacaugaguuugaauuuccagcacccauuaauagcuggccaugaccacucaugccuauaauccuaguaucgggugaggauguuaagagacaggcaaaucccaggagcucccugaccugccagccuagccaaaacagcaaacuucauguuuagugagagacccugucucagaauauaaggugaauagcaguagagaaaacuccaaugucuucugacuuccuuaugugcucagggcauacacagcacacuuuuguacacacacacugugugcauacaaaauaaugcucauucuuaaaaauggaaaaaacucuggcauaaguuacacugcaugagccuuaaacauaccuucuaacaaagucuagauaccggcacauaucuaaguaccuagaauaugggcuuguuuuaaaauacaacaaaaauauguaaaaugaaauguucauacuuugggcaucaaccccacuuucucuguauauagaaccuggcaauuguuacagaagaggaggauggugucacuuuguccacuggggugacauugucggguaauacauacauaguauagguuuuugguguccuuggcucugggaagaugaccgugugaguggaagaucacuugucucauuggguguguauuucuggcaugggccguccuagcaaaaucuguaugauuuugaaauagcugcagcuauugucuacuucccuguaaguaauuacaguucugucaccacaugucagagcguaguucucuuugucaggggugcaguauguuucuaccuuccuggcagaaucuuaccuguaggggcuacaaccccuucuucaucauaacuccuuucaggacaccaucuaaauuacccugcuauauuuugauuuugaucuaacacacacacacacacacacacacacacacacacacacaaauuacagagccucaaaugaaauacuuucucauguacuuauaaugcacuuauuuucugauugacagaccauaauuacauuuccaugauaaaaugugguugugaucugcuaggucaguuagcauauucuauauuuuucaucuuucuugcuuggcuuuuuaacauuguuacagugcugaggacugaaccccaggcugugcauaugugaaacaagcccucugccucugggcugugccuuuagccccacuguguguugcuuugaaguauauguuacauugacuuauuacccuacuguguaauacauuucauaacugaguccuccugacucugugacacucacuaccauuuggccagcaguuuaugccauuuauacccuucaaaagucucuccugccuggcaucuucuauaagccauuguucucuacuucugugaucuguuucauuaggaugcacauacauguaggugguucauggcucaucuguuuuccaugucugccucguuccacugauuguuauguuauauagauucauccuuacuguuaugagugacaggacuuccacuccuuuaggacugaguguaauauagugcugugcuguauuaguuuguugucacugugaccaggauaccugaccuaugggagacagguuuauuuugacucucagacauuucaguucauaagaacauggcagagcacaucagaguaaagagguugcagagagugaaacagaaaggggcuggaucugaccugaaaagaacuucucuuaguaaucuacuucugccaggcaaaccccaguucccaaaguuuccagauacccccauauaguguauccagcauuuaaaauugagcugaagcagaugggugcuggguaugaggguuaagguggugacaucaacauuucagauucaaaccaaguaagucuguaguuucuuuauucauuuguuuguugaugagcauguaaauuugguuccaugucuugauuauugugaggcugcaaugaacuuagaaauucauauauccuuuuaaccuucucacuucacuaaauuuaauauauauacauacauauauauguguauauauauauauauauauauauacacacacacacauauacaaauauauauauauauauauuuguauauguguguguaugugucucuucccaguauauauacuaggcaacauucucuuaguuguuuuguuuuuuaagagaaucuuuauaucauuuuacuguuuuguuuuguuguugagacuaagucuuuaugcuggcuacuuuuaugucagccuggcaaaacuaaaguuaucuaagaggauucauagacccacaugggauuugccugugugugugugugcauggauguguguguacaucugugcaggugcacacaccuguggguauacagaggccagagaaggauauuggguauccugaucuaucaucuuccacccauugcuuugaaacaggguuucuggucaguuucugucacugugaugaaacacuauugccaaaaaucaauuugugaaguaaaggguuuauucaguuuacacuucgacagcacuguucauugagggaaaucaggccaggaucucaaacaacacuuuuuacaagaugugggaauuugaacucagauccgcaggcuuguagagcaaguacauuugccugcugcgccaucucccagcaacuuuaguauuuuccaauaccugucuuuuuauauccucuuaauggcauagaugcuuuacugccugacucagcugcauggauucuugagccaucuucuaaugcuaccugccaugcauuaacauuugccuuuccucucuuuccucuucuuugaccaggaaugcaaacaggccagacuugagccgaugcagaggccauggaggggugcugcuuccuguaaaaaguuguagggguagagacaggaggaucccuagggcuugcuggccaccacccuagauccaggaucaaagaaugcacgggcugguuuugugucaaagugauguaagcuacagucaucugagaggaaggagccucaguuaagggcaguggucagagaauugaagaacacuucuuaucuuggaaaugcucagugccuguuagacaggcauuugccuguucacucauguuuucuguuagguaagaaugcuuccuagggucaggguucugcugcaguuauguguucaguguguacacugcaguacaggaaacguguguguaauugaagugagcaacuugcuuugcagugagugaacgacucauggaauucuguaacacauugggaagguugcucacuugucacuugacauguuaacaaugagcacagagagggaaauggucauuugcuucuaugacacuuucuugcaaagaagauguauaguguuagaucccagaaggcuuuucccuaguaaggaacuguagcccuguguugacccacauaacugacucuguuuuacuucuguuuauuucacuuuucugaggaccagcagcuacaggcucuucacagagcagacacuaucaucuagugggugggagacucugcuuggguaagcuucaagccuucuguuucccacuguggucuuauccuuaggcuugagcccagccuuucauuugugacuuguuuccaggugucauacgaagccucccucccuaauggucagcugcagaccuucaggccacccuccacaguggcucauuggugugaaucucagagaguucacacuauacuaucuagugccuuaguugggguuucuguugcuaugaagaaacaccauagccaaagcaaguuagggaggaaaggguuuauucagcuuaugcuuccacgccacaguucaucaucaaaagaagucagggcgggaacucaagcagggcaggaacuuggacguagcaccugauggagaagcuguggaggggugcuguguacgggcuugcucagccuguuuucuuauaggacccagggccaccacccacaaucaguaugccucuaucaaucacuaauuaagaaaaauacucuauaggcuugcauguagcccaaucuuauggaggcauuuuuuuauuugagauuccuuccucucagaugacuagcuugugucaagaugacuuaaaacuguccagcagagcuagguaggagucaguuuuaaaaaaugaccucucagacaucuagcacaaugacauaucauaaaggcguggcagaaaguuuggcagcccauguacuagaggaguccagagcggagcucucucauucugugcugucuuuuggacccuccugggugauacagccuuuacuuuucagcgguccugcgaguagcugguucucugcagaagagcacagaagugaugaaggcaaugcagagucuugugaagaucccagaaauccaggccaccaugcgggagcuguccaaagagaugaugaaggugacugggcuaguugugcuuucucuacaaaacucugggguccugagcuggggcuguaaggaugugacggagagagagagacugcuccuacaaguguuuuaagaagagguugaaacaauuucuuugcaaagcaucucagaggcuggugggauuguuaguguuaagaagaggaauaagaaugccuagaucuccagacagggaacaucucgcaauggggucugugaguuccagcagaagaggagacaaagaaauacuaauuucacuguaugcugugagaguguugguaaagcuggcaaggaaggugauuauauuuucuacagugcuagaaaauaaauuguguugugcuuuacguccauucuuguaaccacucaccucugcuucucaauguuuauaaaaaaucauuuguuuaggauccccagaucuggccuuaggcuguaauuguugaugguuuuucaaacuacaaaaaggagagacugagaaccggauggaaaauaguagguaccugucaccuucaggauaagggugugacagcaacuauacuacuggccuccagacagggccagggauaagaggagggcaagugauaggcauuuuggccuaucuugaucuccagguacucuguugggguagcuauuuaacacagggcauugaaucuugaagcugccaggcaacccaaggucucuuggauuauaagucagucuggaauuggggcacaggugugucugcucuugucaucugagcugacaucuuucuuuuuuuaagacuuauuuauuuuauguauaugaguacacuguaguuggacagaugguugugagccaucaugugguugcugagaauugaacucaggaccucugcuuguuccugcccugcuugcucuggcccugcucacucuggcccaaagauuuuuuaaaauuuauuauuauauauaaguauacuguagcugucuccagacacaccagaagaaggccucagauaucauuacagaugguugugagccaccaugugguugcugggauuugaacucaggacucggaagagcagucagugcucuuaacugcugagccaucucacuagccccugagcugacaucuuguauaagugcuauuuuguacuuuagacuuguggucugacaaccaagaauauacaacucaaauuuuuguauguggaucuccaccuaccacccagaauguuuuaucugugacagugaaccauacccuggacacugggagugggcagaaggggugugaaggggcuagagaacagaugggaaaauaucauaaaagcccagggcuagcucuucagaaagaaaauguuugggcaguagcagcaagaaauagauuagaagggcguguccuuuacaugugguaugugcccacacuagaggucauuaugcuuauagagguggaugauggagcaauuuuggaguauaauuccaagcuggcacauuuuaacuuacauagcuaccaagagaggagggaaugaauuuauuaagacaacucucuaagcucuuuucacagugguuuguaaacacuaacaauaugacguggaggaagcuuguauauuguagauucuggcgaccaagugcuaacagugguacauggcugagugcauauugaggcuguccauggugacccagcucugagagaacaggggcaugcuuuuaggcauugcauuuguccccagugccugguucugugucauaggccaggaguuuggugaauggcugcuauuaagugaauaaguagauaaaugauaacuucucucucuagaaugagaagggcuguuacaacuugaauucugcuaaguacuuuuaaccaauuaacaaguaguuuuugacccuccuuuuuguuugguugaguuuuuaguuuuacuuagucuguagaguuuuacuuuguuuuacgacagaaucucacuguauuagcugaggguguccuaaaacuugauguguagcacaggcugcaaauaaucuucaugcugcagccuccaaagugcuaucuguugaacaguagacugcagcauugaaauaacuuucaacuagcuaggcugugaggccuaccuuugugaccaugaauaugaguuuguucauuugggcuggguaagggguuauaauuaguuuagauacucgcuagauucaugucuaagagagucaccucaggggucagggagcacaaagacuggaagguaaguggauggcuggaacauggguagaggccauagccaucacugccaccugcuccagggugugcagacaaggagcuaugccucuugguuuugcaaggcuacugggguuccccuucuuugacugcuugucuggggccccuuucugauauaggagagcaugcuucugacccuuugcuccaacagacacagaauggccucaucuagaguuggggacacuguuaaguguuacguuggggacaauugcagggcuuuggagaacuguuuuugcuucauggucccuugcuauuuuuuuuuucuuuaaaaacauuaugugugcaggggcuacucacucagaggagaaggggaggguggguuggggauggauugugggagggggugagugggaggagggccaugagcaagauguaaagugaguaaguuguucaugugggggugggaugugagcacugaaugugugcauguggaagcagagguugacgucuggugacuuccucgaucacuuucuacuuuuuuuguuuuuguuuuuuuguuuuuuggggguuuuuuugagacagaaucucacugaacuugcagcucaucagucuggcuagguggcuggcgguuaagcugccuuggcuagaacacccuccuucccccagggcugggugcagaugggagcuuggggauuuauuugaaaugauccucaagucuuguggcacuuuaccaacugagcuaucuccccaccucaguguuacuuucugggaaagaaggcugacugcagggcagaggcuucuaguaaagugacugguuuugcuuuguagucagaaaccuuuggcuucucuucugaugaucaguguuuggugauuaauugauacucaguacgcccaucgggguaacccuacuccagcaguagggaccugacaugcugggaugguuuuugagcauuuucuggauucugugccugcucaggccuuuguuauucuugugucucuuguagcuuucauccuguguuuuuacccuugccccucaguuuuauuugcaguguuagugcaguugcuuuccaagcagcucaagggucuuuauucaucuucgcagcauguuccugaggacugcuuucuaaguccaggaacuacuaaaguggcuguacucgccuccuuccugcaaauuuagagcacuguguccucuugugccuugucugcagagaggucaucauccaacauuuucuuugccacgugggaaagauggacuagacucagagagacuagaacuuucucugagguguuggugggagcagauguaacguugagaaaggugguguucuguucucuauucaggcuggaaucauagaggagauguuagaggauacauuugaaagcauggaugaucaagaagaaauggaagaagcagcugagauggagauugacagaauccucuuugaaaucacagcagguaugagcaggagcccuccagcccugcccucgcacccuuuuucccugagucagucagcacuagcugcaucugcauuuggaguaugcaggguauuucuuaaggaauaaguaaagcuauauaccuaguuuucaagaaacagaggauuuuuaguuucuaauuuucacaaugaaaagagcuguuaggaauuugacauuacuuuaaaacaugccuguguuaaauacagaaaaaaaguuuuaacuucuauugcuaauuuuugguuuucuuuauuuuaugcucaagaaaaugguagaauuuaauuuuuguuuuaaauuauugggagacagaagguaauuggaaaauauuuuguuaaaauuuggaaauaguuuagguuuuucgguuuauuuguuggauucuuuuggugguugaaguguuuagcuuuuuuguccaauauuguaguuuauaauaauuacuuuauaaccacuguugugguuaauauuaauauuaauuggggguuucuaugccaccuuagaucauuuaguucccagauaaaagacacaaaacuuuuauauuuauaauaaaccuuaauaccacuagagcugggcagauaucuacccucuaugcuguuuugucugcuucacugucaauaccaugccgugacauuucugccugagcugauccuacuccaucuagccagcccucaaggccaguucuucagaucccuaccccagugcaucuuccucucucuucacucugcuccuccucauguggucucuccuuagaccccaaguccugggaacugaagccccaucuaccucucuucugcccaguuauaggcuauaggcaucuuuauucaaccaguaguuuuaaauugaggagcaagguuacauagcaucacuugguguacaugaggauucucuugucucugaggcaaccagaucuugggggccaguauuuagcauuacaguacauagcaacggaccaaaccucaacuguccacaguggucucagucacucuucuugccucacuuggaauacuggauuacaggugugcaacauccccccaccccgcccccacgcacacucaucuggcuaacagugugguuguguggcacuggggauugagccugaggcuucacacacucgaaauaggcaugcuccugcugagcucuguuuccagucguuauuuugagauaggggcucauuuaguuguucaugccgaccucucuguagccuggauaaaccuugauuucuauccuccugucucaacuuuccaguuagcugagauuauaggccugugcuacccagucugccuuaaacauuuaaacuuuauucagagaaaauaaauuuagguuuucaguaguauuuaggaauuuaaauuaagaacuucagaauuaaugacuuuuuuuuuuuuuuuuuuuuaagaaagucucacuauuuugcccaagauggcccccagguccugagcuaaaguggcccuucuuccccaaguauauggacucacguauacaccaccaugcccaauagucuagaaaugaacauuuuuaugauuugggaucacggauguguucuuacuguuguaguaguagccaguuggaagacugaggcaggagguucacucaagggcagcauagcaagucugucuccccagccgcacugcgcuuccucucggcugagaugugcauugucagaggaggcagauucucacucugggcagcagcuccgcgccacugcccuggcacgggugugaguggagucuguaaaaccaaggaccuuguuccuuaugcaguggguuuuaagccguucacucucccuucaggagccuugggcaaagcacccaguaaaguaaccgaugcccuuccugagccugaacccgcaggagcgauggcugccuccgaagagggagaagaggaagaagaugaagaggaccuggaggcuaugcagucacggcuggccacacucagaagcuagggccacccaguugggggucucaacucucugguguccuccucuagguguguaucuggccucugaggagucaccauuucuuguaucucuugcacuacaccucugcugugaagcauuacauuuggagaggguucugugcugguauaucuucacgaucugcagaggauuuaaggauugcuuuuaugaaggugguguaaucaaauguauuauuuucaggagcauaaauagcagaaguaucuuccuugggggagggcaaagaaauccauuuucucaugaagcaauuuugagaagaguagauugaaugaugaggacucuauauuugguguguauguguaaaauaauauauuaauggaugucaauaaacuucugcuuuagcucuuggucucauuguaaaugucacaugcaaugaacucaagauauuaaucucccagauugucucaguguuggccuuggaaagaggacaugcuaucuccaagcaucgggacaugggagcuuagcagaaguaccuucagcuccggggccgcugguccugcucuucacaggcugguugugggggccacucuugugcauuuugucauuugucuaaccuucggguuaacgugcuguguugacugaaugaccauaucauacacugguguguacaagggaguuuuuacagcugguaggcauucuuccccacugcaagugaaaugcaggacaguuagaucugggaucaggacucuugcaguccaucccugcuuggagcuaagugucuuguacccagggacguagccuuaaccaugagcaggaagagcuaaccaggaagagguuuggauuaugcagugaaacacacacagcagagcaugcuuuagaugcauugagaaauagcccagcaguagcacuguguggagcaguuugaaaagcuuucugguaugcaugaucuucacaaaugaggacagcugucaucugaagucacaaacccuaaaguacaauagccaguauccgccaguauuguacagaauggcuuuguuacccaaaacacaacccaugugcuguucauugcuuccucuaaucccuuggcacccacugacccgguugcugucuccaugggcuuuccuuucccagccuuucaguaugucuucccucacguggugauaugcauuuacguuccuccguggauucaugacuugacuguucagcccuucucauugagcagcguuccauuuucuagcuguaccacagcuugucuugaaggccaccuggacugcuucugaguuugggaguuugaagcaaugucuguagcagguuucccuguguguuuuaauuccucuggauaccagagagcucaacccugggaucauguggucagcacaaaccugugcuguaagguaaaccagccgugcagagcacguacuguccccgucucaggaggaagaguucugccugccauccuguggcuuuggcagaauuugucaugagggauuuguguugaaguacccugggcauguuuuuauacuugccuucucuguaucuuguuugaaaauguugacauaguggccuugaacucaugaccugucugcucuaccaccacacugagcuugccgccuggauuucuucguuguugguguuuguucauuuuauaaccuggauuguuuguuuucugauuauucaaguuuaaggaccucuuacagauuuugaaccaaucaucuaucagauuauauccuauucucuguucuauucucucauuguugacuguuuuucaaagcugaagguuucuuuuuuacuuuuaauaaaacccugcuucucaauuauuuuguauauuaugccuuugguguuuaaaaaaaaaaaaguauugggggcuggagcucagcaguuaagagcacugggugcucuuccaaagguccugaguucaauuccuagcacccacaugucuguaacuccaguuccagagaaucugacacucucaaacaccaaugcacauaaaauaaaacgaaauaaauuauaaaaguauuacuacgggggauuggggauguagcucaguuguagaguacugaccuggcacgcacaagguccuggguucagucuucagguaccaacacaggcacgaacccacccacacacacaugcacaagcacaagcauugcucaugcaugcacacacacaugcaugcucacauccuaauccaaggucauuuaaaaucucuauguuaccuaguaauuuaucugguuuaguuacguguauuuauugugguggaauguggaggucagagaacaacuugcaggaacugguucucuucccacugugggcucaagguuuggacucucauggucaggcuuagagguaagcgugguuuuuuuacugagucaacuuacugacccuuggguuuauaauccaguuccaguuccuuuuuaugaaggauguuaaagucuguaugcaguuuuguuguuuucuuucuuucuuuccuuuuuuuuuuuuuuuuuuuuuccauguggauauccaguaguucaggaucuuucauuaaaaaggcugucuuucugccaguccaauugugaguauguguguguguaucacauacuuguaaauauacauauuauauauauggacauauauauucugguuauuuugucuauuuagacugagagacaccacuggacauuuccagagagaagugccaagguauggaagacucacccucucauagcagguuauaggaggaauaaaaggaaaaacugaaaugcccaccagcccugggcucagacugagcuaaguagugucuuuccucuuuuggguugauuuuugucaaguguuuggucucagaugauuaaaguaacacgugccgcau

SEQ ID NO: 3057 - RNA, 59066 nt, Mus musculus
uggcagacgccacugucgcuuuucgccgcuugcugcagccauggucaaccccaccauguucuucgacaucacggccgaugacgagcccuugggccgcgucuccgucgagcuguuugcagacaaaguuccaaagacagcagaaaacuuucgagcucugagcacuggagagaaaggauuuggcuauccuuucacagaauuauuccaggauucaugugccaggguggugacuuuacaugccauaauggcacuggcagcagguccaucuacggagagaaauuugaggaugagaacuucauccugaagcauacagguccuggcaucuuguccauggcaaaugcuggaccaaacacaaacgguucccaguuuuuuaucugcacugccaagacugaauggcuggauggcaagcauguggucuuugggaaggugaaagaaggcaugaacauuguggaagccauggagcauuuuggguccaggaauggcaagaccagcaagaagaucaccauuuccgacuguggacaacucuaauuucuuuugacuugcgggcauuuuacccaucaaaccauuccuucuguagcucaggagagcgucccuaccccaucugcucacaauguccuguaaucucugcucucacugaaguucuuuggguuccauauuuuccucauuccccuucaagucuagcuggauugcaaaguuaaguuuaugauuaugaauaaaaacuaaauaagaacugaaaaaaaaaagaaaugauucauuuacagagguauguacagaccucaagagaacagguuuuuuuuuuucaguucuccagauguauauauucaaauaucucacaccuacaucaagaaauagaacacagggccuggaaaaacagcuugacaagugcauacaagcaugaggacagauuccagaacucagguaaccacugagguccauauacuucauggacaauuucacacaugcacacacauaugcacauaacauauacauacaacagagacacacaugugcauauacacagauauauacacaugcaugcacaggcacaugugcacacacacaugcacacuuacacacauaauacauacacacauacacacaugcaugcacaggagugcacguguacacacacacacacauacacacacacacacacacaaaucccuucuauuacacuuugaaaauuuggaaacggaaaaccacugcuaacuuggaguucagcaugaugaaccagaaaagacaguugucuaccaggaaaagcucaucaaggaguugccucuuuuuuuaauuccuucaggcuacacaagguuuugagaagcuucuucaccugccacuugaaggcuauacuuuggaagaagcuagugaacaggucaagugccacaucggauuucaucugauuuuauuacagaaagaguuuaacucagcuuauuauaaaugcaucuaaauuggucacuuguguaguuuucggggcaagaacaacacuuuuauacuaauaguacacuuuaauacuaauuagcuuucuuuaaauuuuugaauguauuuguuuaguuacuuaguuuauugugcauguguaugcaccagaaugcaugagcauguguagguuaaaaaauagcuuguagaaaucacuucucuccuucuaccuugugggugccagagacugagaucagguaagccuuuucucaguggaucuucagaugaguucauccagauucuuugggcauuuucaaaaucuucaucuuacuuucauguuuugaaggacaugcuugcugaauguaacagucuacguugacaacuauuuccuucgccuguugccuuaucuuuuggccucuauuaucuccgccaaaccugacuucagucaucauucccugugugcaauguguccuuugcaagucagacagaucuuucaagcuauugucuuucccggugauuuucaguauuaggcucugguauuccuacauguagucuuuggauacagccaacugagccccuugcgucugugaguuagugucuaauuucaggaagcaucucagccacugucucagauguuuucugcuucauuguacuucuccuccucugugagacuacauucauguauauaugaaacucuuggcuaucguucuacauaccucaagugcucacuugcucucguuugucucugcauaucccugcuccucucccccauuguacugaggauugaaucuauauccucauguguguuaggcaaaugcuuuaccauugagcuacauccccagcccucuuuuucuucccuccccuucucccucuucucuuuuuuccuccuccuccucuucccucuucucuuucuuuccagcuuaagaaaccuuuaaugcuuugcauuaaaguucauuucuuuguuccuuuguuuucuucuuucucucguucuuucuuuuuuucuuuucuuuuuuuucuuguuuuuucaagacaggguuucucuguguaguccuggcuguccuggaacucacucuguagaccaggcuggccuggaacucagaaaucugccugcuucugccucccaagugcugggauuaugggauuaaaggugugcgccaccauuccuggauucauuaauuucuauaacuuaccugccuuuaaaugaauuaaucuguauuuguugcuuuucuauuguuuugauaaaacaccaugacaaagacaacuuaaagaaaaaaguucagagcuuauauuuccagaaggcuagaguuugugauggcagaguggagguaagagguagcaccuggcuggagcagcagagaacucucauuuuaauacacaaacaagagacaggggagcuaacucuaaaugacgcaagccuuuugaaaccucgaggcccaccacccgugacauacuuuuucuagcaagaccacauuuucuaacucucccuaaacagccaccaacuggagacugaguauucaaauuccagcaauuuggggacaucucauucaaaccacuauaucaugucuuauauuuucucauuacuagcuuucuccuugauucuuuguuauacucuucaugucucuaaggggaauucuaagguagaaaaggucgagguuuuuuuaaaccaugcaggauaguuuauguugaugguaaagugaaacuuugguauaaggaacuaagcagauguguauuuggaaaagucuuuguccagcuguaucaugaguuauaaguuggaggaggugguaacgacagcauagagaugguggcuuaaccagguggauggcagcagagguggaagguuguggaaguuuuugaaaaguaaugagagacaaucaaagggguguguggcuaugaucaggauacauuguguagcacaaaaccaauccagucaguguuuuagccugacuauguuauaccacauccguaccccuagccagagagcuagugacaguugacaacuucuguggaagagagagucaguucccuuuaacaguauagguaggucaaccacacuccaguagaucaccauacgucuaugacuauuugggcaucacaaauuggacugggugugguaguguacuugcuuuuaauccuaagaugugggaggcaaaacccagcagaccucuaaguucaaagccugccucaucaacauagugaguuccaagccagucaauucuacauagugagacuugucucaaaagcaaaauaacaaccacaaccacaacaaaacccaccccacaccuuggccccaccaacacauugauaucauuguuuucucuuucuaguuacuagaauugugagucaaauaaaugucuuugcuuaagaaguuacucagccucagaccagagguccuccugucucugauuccccagcaguaggcuuaaagaaccgugugcuggguuuuuuaaugcaugugcagggguuugggucuacagguggcuaugagccacacacucuaaacugaacucugguucuuugcaggagaagcaaguguucuuuaccaccagucaucucuccagcccuuucaaauauauuuuauuuuaaacuauugccuuauuguuaaugcauauaaauguuuuguuuguauauguguguguaucaugugcaaaccuggugccagggacaucagacaagaauauuggagccucuagaacuauaacuagagaccaacaugaguugcuaaaucagugcugggaauugaaccuggguuuucuggaagagcagcuugugaucuuaaccacugagccaucacuacagucuuugaauacaucuuagaaccucucacuagaaguuccagauuaaugcuuaaaaagaggguuuauuuugcuuuguuuuuaacugugauuuuaccuuuaggaagaagaaguuaguuccuuguuuauuucuaguuaauaagucacaucaaggagauaauugucuagagagaugguaaacacaauacuuuuuggaauaugguaagaaacacacugcuggaaacaaaccuacaauguguuugugauggguaagcccuaggucacucuucagaauuagauucaaggucaauuacaacaggaauugcaaaagcauaugaguccaggauuccuuuaagucacaaugaacaguuuuuauagacucagguguucuuauccuaaugaucuuugauucauugaaguugacuuaguaagugugcucaguuguucuaugguucauucaaaggcuaugcuguacccugaaguucuuugccccucuucuuucucugccuagagauugaccucuuacugggaaggagauaggaggguggcagagauagagacuggggaacuuuuucucagguugauucucccugcugagcccaggauuaacuaacaguaugucuccucuagaggucacauugucagaugcauuuuacacuccugagaucauaguugcuucuucaaggcuccaguagcaacucucgucuucuuguccuaggcugugguuuguaaugaguccugggacggcaagccuuggauauaucucauccauuguucuguggcucuucauaccagcccucacucuguaaaugugcccuuuuuucuacuccucaagugucuuacuucagcauacugccuugccagaaucuggacugauagugaaggaggggggcaagaggauagcucaguagguaaaauguuuaccuugaaaggaauaagaccugagcuugaugccaagaaccaacauaaauaugccaagagcaauuuggcaagguggcccagcaaguaaagacacuugcugccaggccggaauagacaaauuagauccccgaagccacaugguggaaggcaagaacuaacacccacacguuauccucugaacuccacacgaacaaacaaacaacuauaaaaugaaauuuaaaaaauuaaaaaugccagguauggugucaccacuuguaaugucccuauuccacuucugugcaugaacgugggaggucagaggacagcuuccaggagccaguucucuccuuucuuguguggguucugggguuagaauucagguccucagucuuggugauuagcaccuuuacuaaucuugacagaccuaauuacauauguacuuuaacagauagcuuauuaaauguacuuugucuuauagcuaguaauuucacugguuuuauacuuaaaaaaauuaaaaacccaauaccuauaaccaauaaaaaaaguauuugugaauauucauagcaacacuauuuguggcaucaagaaggcagaaacaacugaagugccuaucaucuaaugaaugaaugaacaaaauguggccuauccacacaguggauuauaauuaagaccauaaauauuauaaaucuacaacaugaacagaccuuuaaaauauuuggcuaagugagaguauacagauacauauauuacaugauuuuauucauaugaaauuuccaaauaugacauucuauaggcacaaaagccaagcuaaugguugcuaggauuugacagcuaaaaauaaugacuguuuaauguguacaaagguuccuuuugggggugaugcaaguacucuggauagagacagugguguugaucacaguugcuaauuuaaagugaaaaguuaacauguaaaaacaaaaaucacacuguaaauaauacugauugccacugacuaguucccugacuucugaugugggccuucauauaccaguagcugguguuacaaguuuuaauauauuuagugggccauauaaaauauuuuuauauugcugagcaugguggugcaugccuuuaaucccagcacucgggaggcagaggcaggaagauuucugaguucgaggucagccuggucuacaaagugaguuccaggacagccagggcuauacagagaaauccugucucaaaaaaaccaaaaaaaaaaauuuuuuuuuauauguguguuaaguaaugauaaugucaaaugcaguacucuuuuccaaagugcuuuggcaaucuuuugguacaucuagaauuuuuucuuuuucaaguacucugaaacuucaauauaugucacauuccauuuauuccuuuuaucuaucuuuucuuuuccuuuuuuugauguuaauuuuucagagucgcagauaacccucaccugcuuuaaacuccuauauaccugaggcuaguccugaauucuugauucuccugccuccacuuuccaagugcagagaucaguggguaaaggagccaucgugccuuguucuuuuuauucauuuauuuauuuuccaauugaaguacauuuaaauuauuuccauuuuucuucccacauccacuggaugugacuacuaaaauaagugaucuuauccuuucuuccaguccauauuuguuagcaguuuucucaagauacacacaggcacauacucauauacauacucacacacugguuucuaggaagcuuauaaaaguuuuaagcucaugaacauucaauguccuuuuaauguuucuggcaucucuggcuaucaggaaugcaaugaaaaacaagagaggguaauaugggaaagaauauuauuaaaauggauuacauaugaaaauguucaaauaaaauccauuauuuuauauaaugauuauaguuaacagcaaaaaccaugauuguuuucuaguaacucuacuaaauaaaagaacuuuccaucuauguaaguauuuuuuguuguuuuuuuguuguuguuguucagauuuaguaauaggacuuuguaaguucauaaaguacacuggauaucucuccaacuuuucuugguucuggaaucaugaauaaaacagaaaagucauguguguguuuuaguagaauuuaugccuaaaacaaaaaugucuuuuguuuuaguagaauuuaugccuguuauuuuccaaauuauguguuaugugaucuaaguccuccacauucucucauuuuaaaaauuuaaacugcuuauuucugagauaaauggauuuauagcauuuacugugauuauaagcugucaaaacuuucuuguuuaguacuauuaacuuaguucauaucuucaguuugaauaguucaauaauguauuuuauagacccaauccuuuauuaauauauuucuucuuuuuaugcuuuuacucuuagucauauaccauauaacaacauuauggcaagugacaugugauauauacaguggugaucccauaaguuuuucucagugacuugguaauuucuguaaggacacuauguuaucaauguaaugaaaucaucuaacaaccuuuuaucagaauauaucccucguauuaaauaauguauaacuguacaagaugccaauguagcuuuccuuugauuagucuuauaaaaauuuuacccuaauaguuucaaguuucuuaugcuguacuuuucuuaugccaaaaaaauuuuuuuaaauacuaaguaccucuccauguuuauuuauaaaauuaacccauuuauauuuauuguaaauauaaauggacuuauuccugucauuuuauuuuuaaccauaauuucuucuucuuccuuuuguuuuucuuguuuccauuucugccuuuugaugaaguggauagguuccuucauuccauuucccaccucuuaaugguuugaauauaauaaauccaauucaguuuaauucaacuucagcauuauuuaaucuuuaacauucuguugucauacauucaaaccaaauauuuuucaaaauaaacaucugguacuaauuugcauuguauagcauucccuuauacauuuugaauuuuuucugaauucucauuuucacacuauuaaaacuaaauuuccauucauuuuauaauaaagauuaagugugauguuagauuaagcaccaggcuucauaaagaagucuucaguuauucauuucauuuuuugauucaaccaagaauccucugguccaaaccauaaaaccaucuuuucucuccuuugucuuucaaagucaccucuuucauuaucacuuuuaucaucaacuccaucuacuuucucaauuucuuuguuguuucaaaaaucuuauauccacuuuacauuuucuuuuuaaaaaaccuacaucccacauaguuuugaauagaugguuugccucuagauuuaaugaacaucguuuuccagcaacucaaugccuuucuucauuuauccuucaaaauggcggaccuagacagucaugaucaguaccacgugcgccugcgccuccagcggccauuucacccaucagcccaagcuccaagaguccgccccuucuggcgcgugcgcaggagcccccagagccuagucgcuccucccccucuaacugcguacgccugaaaccgcacgucccagugcugucccucccccgcaggcugugcaccgcccccgccccuuucccgugagauucuuccgccugguggaaggucggucuucgcucgacagccuacgcgcuucaagugcaauccaauaggcgcucaugauccugggucuccccauucagucuuaucugugagccugugcgauuuucuuucuggccucaaagucgauaaccgauucggcgggacuuuuuugcauagcgcgaggcaacaaauggaagaauggagcugcggcggagggaucuaccgaccgcguucugcgcgcuuuaaugggggaucggcuucgagucguugcugagagcggggggaagggaggaggcagccaaggaauuguuuuuuuuccucaccccgcccucuucagcauaaccaauaggaacguagaauuuccuaggcugccccgccuaucccccgcgacucaaccaaucaucgguggcagcggcuccgagggggcggguccgggaggcugugcgugucuugugagagagagcucuugaaccaagucagagcuagagucggcugggcggcugggcucuguugccgccgucgugggugacucagggaggcgggaggcgggguaagcgcuccgcgggccucggcugcgggagacagagggagaagggugaaggacccgcgcgggcggucgccgcgucuucucgguucaaggcucaggacgggcgggggugcgcccgagucggcggcccggaagcggggggcgggggcgcggcaagugucgagucgcgagcgaguccacggcggcuccgaggccgcucggggcggggaucggucgcugagacgggcccuaggcacuaagagggagccuuuucuuuaacagggcgaggggacgaacacuuaggcaaaagcacuggcgccgcggcucaguccucccuucucucucucaguguccagcuuugaaagguuuggaaaaagcgaaaguuguuggggcgagagggucacgcggcacucggggggguguuugcgggggggagugcugggggguuggggaggcgcggguggcagcuuggggcgcggaguccaccugcgggggugucacuccaccggucccugucggcgcuucgucucuucgggccgccuccgaccucggccgccccccaucgcauuuuguuuuugugccuucugcagggaggagcccuuccugcuggcguggaaaccauggugcucacgcucggagaaaguuggccaguauugguggggaagcgauuccucagucuguccgcagccgaaggcaacgaaggcggccaggacaacugggacuuggagcgcguugccgaguggcccuggcugucggggaccauucgagcuguuucccacaccgacguuacuaagaaagacuugaagguaaaaaacaaaaagacuaaaacaaaauacaaaaucccuaaacaaacaaacaaaaccgucuucugggggcugggcagucagacgguuuucaguuaccuugguaacgggacaguugagcgccccucccucccuuuucugaaaugggccacuagaaaguuggcaggugaucagaagguacagaacucuagaccgugaaagucuuugaaaugggguguagugucaagguguguuugaccuagagcuccaguggccugagauuaauaauggguuuaggauuguucagacaugcuucauuaaugcaggcgcuggguccccugggacagucugauuaugcccccaacgggaggcguauuguuuauuaguaauagguuaaagaaguggaugacaauuagaaucauugaaggcuagcuugaaagugcuuucaaaaaagaugauuucagaugaugguguuccucuuuauuucuucauucaacuuuuuaaacuuuacaacuuggaagugaagugugaauguaagggaaggagcuuaguuguguuuaucuauuuaguuuuguuuggcuuguucuggugguggguauuugcugagguaugguuagugaggcaggaguagguccccgguuguuaaugaggauggguugguguggcuacagccauauauggaagccuuggguggagcugucccguauaggguguuugaaaggaaggggagaaauggaacuugcaugaccaguuaacacauucuggaaccuuuuucacuuagaucuuuugaaaggaaugaauccuacucugugauacaaauauuggugugaaaaaauaguagggaaauaaccagugaggaagccauugugcccacaaagacuccuugugcaaaaaucagcugaaaaaagauuccuaacaaaggcuccauagugauaauaacuuccaggaagcuugucaggacagacuauuucuacccugaguaauggacaugccucggaaucuucuguguuuuugcccuuuucuugaaaacuacuuaaaggaagcagguuuuagccauugucaguuaaauguugauuucugaaacacuucauuuaagcucaggcuugacagugcaugccuacaccaucacgagucuugagaggaucauuggaaaagguuacuugguuauguguuuucagaguuuccaccaugugccuugucuacauguucuaaaagugaccacugggcacuuaaccacagcaagcaucauagugaucacuaacaaauauacucuuauuugguccuuagagcagcacauuaggcuacaaaguacuguuugcuguugaucccacguuaacuuguaucuaggaagacagaguuuuuaguagucuauggaccccauccuuagaaauuaacauauccagggaguuuuccugcagggaugucccccuuagccaucauacugcuuggucagaguugugccaugcugcuucugcuuauacucugaaacauagcuuuucuccuccauuccacuuauuuuaccaaaucaaguuuuagagauagguguaugcagaugaccaaccuauuugcuuuaggcuuuuaccuuucuaccuaauacaggcuuuguguaccagauuucaaucaugguugugguuuuuuuccuuguuguuuuguuuuuccugucaaguuaaaaaagaaauuguaguacauuuauuugaucugaucuaaaugggaacaauauuuaaacuuuaucguccuuaguucuugggaaguugacaggagccuagguuuccuucuuuuaugacaaagggccuguuggauuucacauguaaaguuaaagaucuuuaacuuauuguuuucaucuccaucccucucaccccccaagccuuugagaaggagcuucacuuucagacaagucuuugguccaggcuguuguaauuagcuauuaaauaaugacaggaggacuugaauccauuuuuggcagugugucuucuaggauuucaguucaagaaaauuuuuguuacggguuuugccuugcugagaaacuuuuacaacucaaucauuuuguaaggugcaaauugcuuccuuuuuuccaagcauuuaucucuacauucccuaguugaguagcaaaaguaauuaaguuuagagaacauguuguauuuaacaaaaauguaucuuaaaacucuauaaccaaguuacauucagugagauuaaagcaagaaccaaguaauuaaagccauguuuacaucugggcuuagugaucuugaagguuuggagggugucuuuucugguggaguuacuaggcuaaaugcaagcgaauuucagguugaguucaugggacuguucauuuacuguuagugcaagccuagccuuucuagacuuguaucuggacgaaggaauacaagguaaagccugccuaacauuguuucaucuagaaagauacuuuguaacaaaaggauuuuaaagauuagaaaagcaauauaaagaguaguggacucugaagaguuaaaguguaguuaaaguaggucauuguuaaauagcuauucuguggcaagugucuuuagaccccuucuaaguauccuacuagcuaaggugguuuuuuuuuuuguuuguuuuugguuuuuguuuugguuuuuguuuuguuuuuuuuuuguuuuguuuuguuuuguuuuuguaggaauugagauuuaaagaaguuaaauaaccuguucacucuuuucuccagaccucagacagugccuuuaauaucagaaugggguuaggguauuuuauuuggcaugcuucuuugugucuaacaccuggaacuuuguaugugucuaaaucaaugaauaaaugaaggucuugggagaccuuuucuuuuacuauggggaaacaggaauaacuuacugaugaggcaguggccauuuccuaguuuuaaggacuuguuuuauuuaacccuacuguuuucuucuugagggugaaggauacauuugcauguugggaaugucuucuaccccuaccuugccuauauaggucuuuagugucuuuaagucugcuuucuugaguuuucugcuccuuccuuuggcuaucuuuagcaaauaaguauauacaguuucuuacuacugucagcaguuggaugcucucuguccuguugucuuguuagaacuggaaaauugugaaucccacugccagcaaagcuaugugaaauuagaaacucaauagcacagugcaauaaauacuuuuugccucuuauaauugaauguuaggcuguaggauuuucacauagccauugcacacauacacacaugcacacucacuggauucuuuuuuuuacuuuauggaauggugaaacuuauagugaguacugugugcauuguagagcugacauugagucaacacauaaucaaagcuucuacacuaacaccaccauucucuauguuccuacucugaacuuggaaacauuuuccuuggcauuuucaaugguuuuaugauuaaauacccaggugagaugaguuuaaaccaaaacugguauuuuuggagaauagcuugauuagauguaacauuacuccauguaacauacagacuuuacucuugggagaaaaaguagcuugaaauaucuagaacuuuccaaaaucuaaucaagauauuugauagacuaauagguaccacuuauacucuauuaaaagcaaauguggaaaaugcagguggugagccauaguuuguuaguguaaauaacauuuguuuguauucccauggaaagaacacagaaaccagguagauugaucagcucauaaacuugugugaguuccuuuaguuauuuuuucauaucaucugauagaaauguuggccgaacaucuugaaaggagugccuucuauuugauaacuugagaagguuucauguacuuaauuuguaucugaaggagaccuugagcucuaaccccuugcauuccauaagcaugccugacuuuuaacucaggaccucaggcaugcuauacaaacugccacuagcuccuaaaagauauaugugguuuugauaggaaacuaaaaaaauguugaggaaagcucaugaguuuuagauuacaguacauauuuuguacaagucaucuuuuuuuaaagccaaagcuaauaugaauuuuagucaaacacaaucuaauacuugaaagucauguagauuuguccagccacuggcauggacaucuauaaaugcaacccaacaaaaaauuuauaaaauaguagaguuuuuuguuguucuuuuuaaaaucaugauuguauuguuuugggaguugagguuuguagauggugaugccauuuugcaguuuaaaaugaucagacaguuuucaguauguaagguuuuuuuuuccuuguaaguacuucaaaugugagaguucuuguguaguuuuuuaauuagguuaucugaauggguaauaauuguguuauuaagguuugggaagccacuuacuuuuuuuaaaaucuaaauuuagugagauguauguaacuuacuuuuugaagcuaguaaaauaagauugagagaauuaaauuuaggauugagaggauuuuuuagucuuuuugagcauauguauauguuguaugcauguuugugguagagacagaagugccuuaucacucuuccucuuacucuuugagauagaggaagagucucacugacccuggaaccugcugacuaaagacuggccaccaauuuccagauccuucugugucucuucccuccacuguaaugauaggcaccuguugucucagcuuuuuauggugcugggaauaugaaaucaguccuuaugcuguaccucagacuccccaggccucuaucauuacacaucacauagaauaauuguucuugaccugagguugagguuaguugguuuccuuauauucucacauugacuuuguuaauacaaaaucauucuaaaagguuuaucaaagcugggagucaagccccagaucucuaaucuguacuuuuuuuaaugguuaucuuuuuuccuauuucugauacacagaaauaaaaaacaaaacuguuacugaaagcuggguaaggcugaugugaacagauuaaauucuggcuaggaagucuugaacaugaaguugguguuaaaaguugugugccacuguugaguacuagaaaccaaaccgaaguccucaguaagaacagcaaauacucuuuaacugcugagacaucucaucugccuagucuuagugaguuuuuaaaaagauacuguguagacuagucaagguuuaguauuaguguuggcaguauugagguggaaauucauugccaucuauguagauaagagaaacaagauaggagaccaguucaucgagagauuguugauuuauucauuuuaauaauuugguuaaugauuagaaauuguuugccgguaauacauggugguaaacaaaggcaggcagacuuugaccuguuagaguuuauaugucagccuucuacaaaagaacugugcaugugcauuaggaagaaaagguacugauguuuucauuccauccaccacagcagguguugacucugguaaggaaaaacgucuucaaagaaaggcuucuuuagcuucuagcagaugaguggaagcaaaugaucuugugaucucacuuuuuucuuucuuucuuucuuucuuucuuucuuucuuucuuucuuucuuuuuucuuucuuuuuuuuuuuuuuuuuuguuguuguuuuuucgagagaggcuuucucuguguagcccuggcuguccuggaacucacucuguagaccagucuggccuccaacucagaaauccaccugccucugccucccaagugcuggaauuaaaggcgagcgccaccauugccuggccuuaaacccacuuuuaagguugacagagauuuaacaauugcaaugggauaaguauuucuuuuggguuucaaauuccuucuaacucuucaaguucauacucuaauuagcauauguaaaacccuucuguugaggguucuuugcauucugggcuuucagaggucaucuugagggcacugacccuaaaugcucuggacuuugcaucucaaaguagucugagagcuaaggcuugaucccuuucugauuauuuaucuuaaauauuguaggcuuugaaauggaggcauaccugguagaaacaucauacauucaaguaggguaauggaagcauacaaccucagcauucauaauugaguuugcuuuguuguguuuagguguguguggaguuugauggggagucuuggagaaagagaagauggauagaugucuacagccuucagagaaaagcauuuuuaguagagcauaaccugguuuuggcagaacgaaaaucaccugaaguuccugagcaaguuauucaguggccugcaauagugaguaaaacuuguguuucauugaacugacaaauagagaauauuuaauccacuuggggugaaacaaaggcgauauaaugucccuuugaaacaguaguguaauaugucuagcaguguggaagagcuaggggagcacucgggaccuucugccuacccugguuggagcucuaugacuaggcaggucccaugacuuuuuaggaccuuuuaagaaaucaggauggagguagaaaguagcaagacaggucacacagaucuuugcuuuggcucgguggucggcauuugaagaaaauugagguuugcugcugacguuuuaaaaaguguggcaagugcauuugacaggcagcacugacuggacucagugggcauuaaugaagaaagaggauaugaggaaggcgggagugggaagagggagcucagaauauguuguagcuuuaaagacuaaacccauagaggauuucacguugccuacauuguaauuauggagcaaaagugauauauggaucuggagaggacagcccagacagauugcaugggacacaagcuggagcuugaaggaggaagagucugguauagagugcuuggagacgcugggaagcagauggaaagcugccagauugcgcaggaugcuagcaaaaguucagauuuuguuuccuagugaaaagcuacuauagguguuugaacaauauagggcugugguuguuccacccuuucuauuuuuacagcuaagaauuuucugaaaacauacccugucucucagaaaaacauguauauacuucuuucccacaugaguuuuugggaaaucaugaaucuguagaccuguguguuaauaacuuccaaauguacaucugguuuaaauuacuggguuuaaauaaauguuguaaucugguggcagcauaaauguuaggaaauccuuguaguaaauaaaaacuuaauggcuuuguuacuucuuuauguguggaaaguugucaguuccugcuuccagaaugaugucaguguaguuagaaugacauaacagguuuuuguucuauuauuuauuuguuuguuuuuguuuucagauguacaaaucucuucuagacaaagcuggcuugggagccauaacuucuguucgguuucuuggagaucaacaaaguguauuuguuuccaaagaccuuuugaaaccuauacagguaaacuauuggaaugguauuuaacguacaaauagaaguucuuuuaaugugagaagucaaaugcucuuauucauugcccuugugcauaugccuuguagggaagaaauuuaacaaaguuguuguauagcaucuguuagauagccugugaguuugugcucucucuucagaauuaaaaagauaacgguaucacauugaugauguguugugugguguggaaaaaaguaggugauaugaaagugauuuuucaaaguuacuguuuauauagguaugcuauaugcagucuucauucaugagugcuuugccuauuugcucaaauguagcuauaaaccccaguugcuguuaccauucauggcccuauguggaguccugcacagagcaguagauuucagcuuccuaaugccagucucagcugaagucacacacagagauagucuucugcauuuuuacuucagcuuugauaauauaaagaaauuugauugugcagcuuagaaaugcuguuucuuucccacuccauuuucauccuuugcuucuuucuuuccuucuuuuuguccccccccacccccacuuuguguguguguguuuauguaauuucauuauuuuaaguguccuuaaauguuacaaugcugucuggugcaggaaaguauugaagaaggaaauauacauuaguuuacuaaguuugguuuagccaugaugcucaagguuaauggaucaguauauaccaaggaagauaucugucuuugaaccgauaaacauauaagauaaaauuauugccuauugaucaguugaugaaaaugugaccagagguucauaaaagcccuguauuucuccuuagagcaguuguuccauguucccuaauucaaagaucuuagcaauuugguagucaguucuuaccaucaaggguagucacagugcauguccaaucaguuugcagaaagaacucagaucuuuuuuacaauaaagcucuuggaucuuucucguaggugauugguaauaagaguaguuuuuauuucugggcguugcuuuuagaauuuauaucuucauguauccuagcuuuucagugaaagacuucuuaguuuuguuucuuaagacugaaaaauagagguugaaauuuuuauuaguucuugggaaaaaugcacuguggcugucagcauaauuuauugaaggagcuauaauauguauguuacuuuuuccuaaagaauggucaaaguucauuucuuuauggcaucauucuguaaaauucuaugguggaggauauaugauuuaucugcuugcucuaaaguaauauagguugcaccugaaaaauccuuggacauaugcagaaguugaaauugaaacucuugguuugccuucacauugaauaugauaaucugugaauaagaaaggguuucuaaaccagcuggcauauuuguugggcccuaaaaaacuucuggguauaaccuauuacguaccccaccacuaguuagcucucugaugcuuuguuucuaagaagaaugagacuuguuucucugcccuguugggucgugcagaagaugcuuugaagauccaacugaaccucuaaauaauggauuucuagaccuuaugggucucagacaucuuguucaaugagaacuuaaauacuugccuacaaauuaguauucuugucccucuuuauggaccuuguucuuauuuguaccuguuuuuaaauuuuucauugugguaucguagacugugucugagauccaguacuugacugacccaauguuucucuugauguuacgugacuuucuugccuucaggauuugugaaacccaguguuuggugggugcuagucauuugacucaugaaacuuaccacuaacugaaaucugcauuuuugccucuuccuguucauguuugagugguuuuauaaugcuuucugaaacacuucacuuaaaaaagaagucaaacaaagaaacaacaacaacaacaacaacaacaacaaacuucugggugaacuagaguuagucugccucauuggagagcccugggcagcuaucuuugggaguaggaauuggagauugaacuguaauagcaauaaaugcauuaaguaguauacacccacaucugaauguucauuagggauugaaugagcagauauggagccucuagauuuuaucugauguuaacuuggccaaagaaauguagguuuuuuuucuagcauggccccuuacucugugacuaguuguuuacagugggagaaaugagugacccauucuuggcuaccaagucauaguaaauagccugaaggucugcuacucggggacucuguguuuagcagguuucuuuuuuuccuuuguccuguuagaaguuggguuuggcagguuacuccuauugacaguuucuguauaaauuuaucauaacuggguuugcacgcaaaaccagggaacuguggaauaaggccaagaauggagcgacugccaagaacagagugucucagaagaggcuuacucuggagucuuaggcuauucauucagguugucuguuugucccuccacuuuuuauaacaggaaacgugcauuuagaauacuaguuagauuucaugaguuugugugaaauuuaaaacaauuucagugaacuaacaguauguacgugccuuguguauuuucuggguuuucccauccaaaggguuugggauauagaguauuuuuaaauuuggauugauuaguuugauuuguauauuauucucauaaccaaaauuacgucaugucgacuccuaguauauuuuuugaaaacaaauuuuuauuagugugugagugugugccaguuguggugugagugcccuuggaggcuagaagaaggcauuggaacgccugcagcuggagcugacaggcgccugacaccgccucuggcaaccagacuuagguacucuagcagagcagcaagugcuuuuaaccccuagccaucuuuccagccugcuucucauaguucauuuauguuccuaacuugggugauuuaacuucauucuguuaaauacuuguaauuguuugaccuauucaguucacuggaguugcaguaguuuguuagguacagucaaauaguuagaaaauacuguuuaaucugauugaaccaauuugaaacauucaacucuuaaccuucauaaacaacucuuuuguucuuugauuuuacaggauguuaacagucuucggcuuucccuuacugauaaucagacagucaguaaggaauuucaagcuuugauuguaaaacauuuggaugaaagccaucuuuuacaagguauguaaauaaucugcuguugacaguucaugaguuagccagugacaggccuauaagaagcgaggauuuagacuuuucacuuacuuucuauugaaagaaacauuuuuuuuuuuugaaggaaacauuuucuuuuugauguugguaauuggaaauuucuuuuucaaucuaaaaucuuuuuaaauucuguuugcugcuucuuucuauaugguacuaugugaccaacagauccuuuuuuuuuaggcuaaagcuccugugauuuugagaguucagagguagcauuaacaaaacccagcuauauuuuggcauagacuugcuguauuuggaauuuuugucauaugaaguugauauauuugggagcuagacaauggugucucaugccuuuaaucucagcacuugggaggcagaggcaggaggaucucugaguuugcggucagccuggcuacacagagaacccugucucaaaaaauuauuaaaaaauaaaauaaaaagaagcuauuaugugguaaucucuuuuuucuuuuuacuguuacuaguuucucagucaucuucauagcuguaagcuuuugcuuuaguuucuuuuuuuuaaccuuagcuuuucaccccuuagcaguuuucugguagauuccugcguuagauuauuuuaaaacuucaaaggauagugaguucacuuuugaugaauuguuuaguacuucuugguuccauagaauaugguaauguaaauauauuaccacaccuaggagagagaauggaauucuuuucucuuuuuuuuuuuuaaggugacaagaaccuuguugguucagaaguaaaaauuuauagcuuggacccaucuacucagugguuuucagcaacuguuguacauggaaacccaucauccaaaacucuucaagucaacugugaggagguaaaagcagugauaacugaugucauccuacaggguaggguacugugcaaaacagcuguguucuucaugcuaaacccuccuuuuauaaaauguuaaaguuagaaacaaaagacauuacaguuguuguaaaaugaaguuauuugugugguauccuauugacauguugcguuaauuuccaacuauuguucucaacauuuacauuucuuccaguaucuuugucuucuuuuuuuaagauuccagcacugaaaauugucgacccagcacugauucauguugaaguuguacaugacaacuuugugacaugugguaagacacacugauuaaaccuuucuucucuuuuucguucucacauuaagugaaagaaggaagccuguguauucacuauucuauauuauagguaauucuacaagaacuggagcuguaaaacgcaagucuucugagaauaacggaaguucgguuucuaaacaagcaaaaucuuguucugagguaacugauuuauuuuugucaccgugugaagcauuguuuaacuuuaauauugcauguuagucuuuaauagugauggagcaguuuguucuguucuucuguguugucuugucugcugcuguuacaaguuccagaucuuggccauaauuucuauacucaagcagauggagauaauauaaguuuuggguucacuauuuugggugucuaaaaguuucauuuuuuuaguuauuugguuaaaauuugcaguauaugacaauuuuacuauuagaauugguucugaaagucauugaguugugcaguuaaauugaaaauuugucuggugugagaggaagggaagagccuuaggauugugagaagguuguugaaaugggacccuuaguuugugaugacuugcauugcucauuugugacuaagcauacagauguauuaccuuuucugaauaaauggcugauuaauuuuuggcucaaaaaacuggcuuuuauggaugccauguaaguucagauguuuuauuuacuucucuucugaaauauucuuuggggcuguuucucauuuugucauuaggaccuguuacaggacaaauaaauuuuacaguuuagggauucaaaugcauguguguuaagugaauaauuucccacauuauuguauucuagguuagaauucuaaauugacuagaaugauaccaagcagacugcuuauaggacuuaagagaggcccuuaaauauuaggcuauuaaggcauggagaauaaagucaaggaaagaucuagguaggguucuggaucaaaggcagaguagacuacagcaccgggaugugcuaauuugggagucuauggccuuuccugcaccuuuugucuguucagacaagaauuuugauacuucaucuaaagguuccuaaaucaaggugaugaaaaccuuucucuuccuugcaaaugucuaggcuugaaccucuuuaguggagacucagauaguucugggaagaaugaagaggucauaguagaaacuaauuagaaauuaauauuaugugucuucauuuaauuucaaauaucccauguaugaaaccagaaagcugguguguuuacuaugugcuggguaccuggaggaccagaggccuggggagagaaaggaagcaccuugagagguggaaggggggguuccuuagguuagucuugagugugugaugugacuugggagucaguaauaguagaacaugggcacugguuagguugauggaauuagcuacuguaagagguugugaagugaggcaguaaccuaaaagcauagcauuaauuuggcuugguggaagacuagauguuugggcugaauaaguaggggaagauccaauacaguaacugaacugaaaaauguggauguuugcgccuuggagcacaccaauucuaguuuauaaagcucaaauuauauggucaggugaccauguauaguauaguacuguguacuucucgguauaggagggucugagcugguuagagauccuuauucuagaagaaauggauaauaaaucuuuuaggaaagaaauauuaaaggacuauaaacagaaaaugauuguagugcuucuuaugguuauacucacagaggaucuugccugguaauucuguguuguuagaggcuguguaaaaguagguagaauuauagccgugagaauuugacguugguggaauuguugacagucuguuauagaagugaguaaaggccaguuggcugcaugcuacuuguucucgagaauggaucagcuuacauagaagugugauaagaaugagugucagguggggaaggggucagggaaugggaaugguauaccuuguuuggacauuagaaaaauuguccugauauguugacagaauuggggucaguagagacuucuugggugugugugucaguucuuuaggguguggcuagggcaguuaagccugguaagcaaacagguuuaaggaggcucuuguaaagcgugcugcugcauagugauccucugccugacucccucugguagggaaggaagcaagacuuaagcccagcuguacugucuauucacgcucaguaaguuugugugaucucccacucacuguuggacacaguagaaacuuuaaaacuuaagccugagcucuagccuagagauagauuguugaucucuacauggaaaaaagaaccacaguccauauuuuaaaaguaucagcguuuaucaggcacuuuuguugucccaguuacuuagaagucugaagcaggaggaucauuugaguuuguguuauagugugauugaucauuggauguccacauuaaguuugccaucaauauaggugagcuucuuggagugggagacuaacagaaaaauaccaacuuuaguucuuacacuaaagucauacuacuauaaaugaaguuggaaguguugauuuuuauuugaguguagguggcuugaggagccuggugcuguuacuuuaaaaauuuaugguuagucaagaaaaauaauagagaagaaaagaaaugguagccauuccucugagcaccuuccucucguccuuccuuccauguauuacagaggccugguuuuagaaugucucuuuugaaacuaaaagauuauuccuugauuccuugugaauauuuuuuuguaucaguauucuuuuauauuuuuauauucugggugauuuuauaauugagaaaguuuuagaaacgcuggucugaccuagauuuuaugagaacugaagagguaaagaaacgaauaaaaacaagcaguuuuuguagauguaagugacgggugaguacaguaacacacuuggcacccuucucccagugcuggcacuucccaagugcaguggcagugguacaggcuuacuuacagcauggucuuuggaagacaggagcuuaggauuagguaggugagacguuuggcuguagugugguuaagauaaacaugauugccagugugacgucuggcuccuugaaggucuucucugccuagcagacuauuccucagaguaugacacugcuugguuaacugggagagucugcugaagagugagccagcagugacuuuuuuagaauacugucguacacucaauuauauuaucuccgucugcuggcagggaggaacuauugccaugacugguauagaagaccuucagggaaaacucuucagguaagaagaaacuuugaccuuugucaagucagaggccagugcagaaguguaugcgugaagauggguuguggaucaagaguugugucucuguaaaguagagucuuaggcaggguaugcagaguuauucauccuucauuuccuaaagaaaaagcacuuacaguuaaggccgguucuauugcacagucacguaauugagaacaucuguacaagacuuuauugcuuuaacagagcuuaucucuaaaacugauuuuccugugugccaaguacuguagugaauguuaccaucacuauaucaacaggaacaguggcuaagaaguuccaaaaacuugauuucaaaccaagguuugauaucaggauccagugauuuuuacccucugugcugcugcugcugcugcugcugcugcugcugcugcugcugcugcugcucuccaaauccuuucccuuuuguggugaaucaccauuguaaaaggagcagauuccuccucuuuccccucuucacucuaucuccccuuccaaggaguauuuacugcauacuauauaggagauacugauguacuguggugagcauuaauacugccuaaccucucaaguaacuucuaacacuuaucuauaacuacuuaagaagaugaggcacugcuugcuguguuugucuuucaucuggucauucauacaucacuccaccaggguuccugaccaagccuuaugucugauuugaugaguucagacaggaaauaaaggagugggccuguguccaaguguacuuugugaggacacugagaacagcuaaguaaaagacuuucacagugugacaggugcuguagaaagaauuuagauaaaacuaaggaguggcuauaagauacuauuuuacagugaguaaccugacauuuugaggacauuagucaauuuaagaguaagaagauggaaccaggcagccaguaaaaacaguuggcagaaggaauagcagguacaaagcccagacuagaaaggcguuuaucaugaguauuugaagagaagccaguucaauugaaauauugugggcagagagaaggguuccuugagauggagugauaguugccugaagacuggaccguaucagauucuaaagcuuggucugugaaggguaggagcaucagaauugggauuagcaagaaugaagagaagucagacuagucugcgggaaacacagucguggugucacagaaauggaaagauucaguggauacauugaaaauggagacaugauuaaucgacuuuuugauuggaugucggguugaggaagauggggaguuucuugacuuaagcagauugauagauacuguacagaauaaaaauauauguaucuaguuuguaaucugaauuuugaaguacauugguuuuggaguauaaccuaagaauaaacauuaguaccuuaacucuagaaguauucaaaggaagggagauggcagauggaagagauaguugauaaaaggaaacugugaauaauuguuuguaaugguuugguaauucagcuuuuggagacuaccuauuuaauaagugauuaccagagaauuguaugaaaguauagucaaaagcaccuuuaaaaaaauaaacuaacgucuuuauuuaaaagauuaggagacaagcccagagguauaaaguugacugacccaagaguguagucagucaaugccccugcccaacaagcaguacaaaaccaacaggcaaucaacguguaaccaaaguugaguugacaaaaauagugucagaaagaaucagauacuuuaggaccuaaaaaguauuuaaaacaaugccagaauuuuugauaauuaaaaaguucuuauuuucgagugucuuuuauucugugcuagauagucuuugaggcuacccaaauaaaagagaaaaugauuuaugaguagacagcauuuaguauguugacaguugucacguuuuaaaaacuugaggaaauuucugucauaguuuagauguuacuagguuuggauuuggugaauacagagguagugguaggaugacauaacugaggcacaggacuggugggaagaugaguuuuacuaguuagaugguaaaauuagguagacugacugcacagucagccauacaaaaguggucuagaguuuuuugguuuuuguuauuuucuuauaguagaaaauuuuguuucuauagcuaauauaaauauguggauccaauauuuuuacuuuuacaaagguaaaauuauauggaaagggaagggggaaaauauccuagcuuuuucccauaggccagucaugacuuaauauuuuuuccagcuuggggugaccuuugugaugagccacauaagaacaagaaucguguccucaaucuuuauugcauugccaaggcuuaucgugguacccaguagguuccacugccuacaagaguccuaaguggucuggucuccugccaaucuacgcaguaagugcguggugggcacucaagucauguccagaugauugcaugugaaacagcuaucauugaagcugucaccuaaaaguucaccucuaugcauuacauuaauaaagcaauugccacauuucuuucuuauacaguaauagaguucugaaaaagaucagcuuguaaccuuacaggauuacuuaaguuuuuugaaaaccagggugcucuauuuauagauaucacauaagucuccuugguauucaauuuauuacuuguuuauucugcuggucuuuauuuggcaaugguauugugcuuacuuaguauuaaacaaaggaaauuaccuuuauuucauuaacauaugauaauuccccacuaggggcuuuguauuuaaugucuguugguuugguaucuuuuaggccucucccaguauguguccuguacagucuguucccacaacaguguuuaaggagauccugcuuggcuguacugcagcaacuccaucuagcaaggacccaagacagcaaaauacuccccaggcagccaauucuccaccuaacauuggagcaaaacuuccucaagggugaguagugcuuuguucaaaguauucagucauagaaguaaaucauuguuucugucucugauauuccugggguguuuucaugggagcuccuugggacggauugaccaggggccuucaaguauuagaggcacccaaacauggaggaaaagggaaugaauugguuguacguagaagacuuugaucagugagggugugaaggagagggcggugugguuacagugagaguuagccuaacaugcauugaaucacagugauagucaaaaugugguuauggaggagagcugagcauagauauauggagccaagcuugccugucaggucacaggugaagaauacagugugcagcuuggaauuuuaaaguagacugagggaaggcucucuugugagggagggagugguagccuguacuuggcaguugauacagacuugaagauaugggucagugacuuuaauguagaaaagucaguuuggaagacagcuguaaaauagugugggacagagaacauuaauuaacuaggaaaaaaguggguggcagccugguauagaucuuggagacacugcccaguguugguugccuugugcacaagucuacacacacacacacacacacacacacacaaacacacacacacacaaagacacgcaugcauguacucacaugcauauguaugcuugaaggguuaaacaguaggaaauuuagugauauccaaacagaguuuuaauuuaaaaguauaaaugagaaauauuuuucuaggaugaaauucuggauuagaaacaacagcaguggcaaaagaaauauuauagaaauauuauagaaauuguguuuggcuaggcagagaacucuaguaugaauucccuaauaaguagugggaggggacuagagagauggcacagggucuaagagcacuaagaagaucugggcucaauucccagcacccacauggugguucagaaucaucuauaacuccaguuccaggggaauccaaggguaccaggcacacagguggugagguguacaugcaugcauucagacaaaacauaaaaaagaauaaaucuaauaaaaauaauacacuguauaaauauugaauuuucaaagaauaaauaaaaauauuuuuaaagcaguagaggaaauaauaacuucccacguauaagcaaguaauuaguuugucuuauuuguuuuggguccuggccacucaugguggcuuguuauuaauagcagaacaaguguuuuaugcugccugugguuuguaauguuaaauuuauguuucauauuugaggagauuucuauuucucauauacauaauauuucugauauauacuuaaagcuuuauguugauauaugugccugccaugagauugaguuuucaaguauugguaagcaagaauacuaguuuucucuuucaaauuuaaauaauuuuugguuuuguuauauaagaaacuuuuuuucugaaguagaaaaagaagacauuaaauaauuggccuuguguagacuuuuaauuugauacauuaaaaauaacugaauuuucuagcugcuguauauauguccugguuccauaugauaauguuugagcaaaaggcacuguucauuaugcaguaagaagcagggguccugagcaugcagggaacguguaggauugcauuuuucugaguguguaagauacuuuucucaaccccagcucacagaaaccuuuccaaaauuuucuaucacaacaauuuucuuuuuucuggcugauugccauaccaacaaccuguaccguuuuuagggugauaagaaauaagagagaucuagaugcuacuuuuccuacuguuuuucagaugucauaagcagaacuuaccagaagaacuuucuuccugucuaaacacaaaaccugaaguaccgagaacaaaaccagaugucugcaaagaaggauuacuuucuucaaaaucuucucagguuggagcuggagacuugaaaauucugagugagcccaaagguagcuguauccagccuaaaacaaacacugaucaggagagcagacuggagucugcuccacagccagucacuggccuuccaaaggagugcuugccugcaaagacuuccucuaaggcagaacuggacauugccaccacuccugaacugcagaagcaucuagaacaugcagcuuccacauccgaugaccuuucagauaagccagaagugaaagcaggugucacuagccuuaauaguugugcagaaaagaaggucgaaccuucacauuuagguucccagucacagaauuuaaaggaaacuucaguaaaaguagauaaugaaagcuguuguacaagaagcaguaauaaaacccagacucguaaguguuucacaucucaauugguaaaugauauguuucuucccugugauaaaaauaugagaaugacuagaaauuucccccugcgggcugguauacauuuuuauuaacauuuuaaugcugcagggacuccauacucugacuuaaaauggguuaaaucuuuuuuuuggugauuucuuugucuucauauuguugcugucuuuguaccugugcucucacacagguaguucaaguauaugucguuauguugugucaucccuacccccuguguucaacacugagcaguuuguaagguuaggccuuggcguacucaguuuucaaccuaagugcucuuagugcagagaagaugguacaccaugguuccuacuuccaaguugaacuuuccuaauccaaaaguucauaacuguuuuaaauucagaaacuguuugagccaccaacaagauaccccaaguggaaaaguggacucugacuucaagugguagaguuguacuagccguguaggcacacuaagaaacaugugaauuguguuuggucuugggucccaucccaagccaucucaauuaaguauaugcaguagucaagccccaagccagcaaauugccagcacuagucauaagcauuuuggguaaggauuauucaccguauacugucaguagauguccauucuaauaagggcaucguaaucagaagugcugcuacuaugauuagaagaucaaaaggaccgcagcacgucagaagguccagagcucuuacaggaagguaaccuuugacaccugacuuguuacuacuuaaaaacgucaguguggauuuuauaaaguuauuuaaacccuugaaaugaacaacaaacuccauucagaaaaaagcaaaacaacuacagugucagcgagguggcucaguuggguaaagaugucugcugccaagccugaugacccagaagccacauguuggugggagacugauucccuuguuguccuuugagcucuaggugugcugagaugcaugacagcacaaccagacccacacuaaugugagaggcuucugacagcagaaggcagaaugguuagguugacuggugaaucuuuuuugucuaguguugguuaaaauagagaaauccuuugccuagggauucuuccaacccagcuuugucauucuugagguucagguuagauagagcaguuaguuugcauaaaguuaauuacguaaaauacauaguuucuuaggaguuauguaauucccaagagaaagugaauauucauaaccacguaucuguucuauuuaugcuuuuugagucaucaguccucacagcucguuuuugaagcaagucauuuuaguuucugugaagaggcagugaaaauccuaguugaguaaacacguggcagguaccugaguaggcugcggaguugagcuuuaucucugcagugcagcugccccuuacuuaucuggacuagaauggggucagcagccaacuaggaucgcugcguugugcccacugcaguuaccuguggaaacagaaagacucuggaaaaggauucuguucccuugcuuugcuuaggggcugcaaaggcaaaagccaccuacaaucaaguaccugucuuuguguucaguuuggcaccucagaaaugugcuuuggcaccgggcagugguggcgcacgccuuuaaucccggcacuugggaggcagaggcagguggauuucugaguucgaagccagccuggucuacagagugaguuccaagacagccagggcugucucuaaaaaccaaaacaaaaaagacaaaaaaaaaaaaaaaaaacccagaaaugugcuuuggcgcuuuuucucuucucucuaccuaagagauugcuguccuuauuaagcuccauuuggacaguuuaauguaaugaccuguccuuuuaagccaggucaaauaaaauaagcuuuggauuucacccaccuauauauaauauguggauaccuggccaacucuaaaaagauggugucuuucaguaucugaguaauuaaaauuguaucacugcuucuauuuuuuuguguuacaggauauuugauuauuguauguagaaaaccuaauuguaaaauauaaaaagcuuaguuagucugauacaguugggugugucccagagagaagcaauuugggugugccucuaaaagucuucauagaaaagaaugcuaaagaauggaaauuuccugccuauuuuaaggcaaauugcuugggggaacuuagggagaguucuggucuuuaugacuggaggcaaaaauuugcuggauggccuggagcugccccuccuuauaggugaaaugguuuggccccuacugccuuggcuuagagcccccucucucacccaccccccaccccaccauaaaggugacucaguccagccugccaaggguguaggggaggagcuagagacuucuuuuguaacaguuggaccuuugagaucuuucuggccuuggcucucccucuauguuuuggggggacuggaagaacaucauggaaggagcuccugguaagaaacagccauuggucggggcacaaggugaagcagucugcuaggaaagagcuaaggaggccucucagguuugaaggaacuuaagagaaagacugacuccauagaaugacacagauaggaagauuucuaaagagcuagcagcuuaguuguaguuguagcaucaggcuuguaauuagauauuuuguauauaguuaagaaaguuaucucgaugaacuaucauguuuuuaaucuuaaagacaccuguguuuuaauuaguauaaauauuaguuaaacuguuacauacuacaauuuuucccucuuuugcucucuuucacucauaauauaaauguucauuggagugaggacugacagcauuguuuagcacuuuauagugugcuuuuguuuugaguuuauuuuugucuaagaacucauauaccccaacuccuucuggaccccuagggaaggucuuuuucugugagacacuuccgaagucucuugggguauggauguucuccugcguuauuugggugaccacaguaacugauucucuuuguugcugugacaguucuaccuuuuccuuuagaaacuacauuaacauucccuuuuauaauucuuaugccaauuaccauugacacaacauagaaccugaguuuacuuaggguuuuguuuuuuuguuuuuuuguuuguuuuuugagacaggguuucucuguauagcccuggcuguccuggaacucacuuugugaaccaggcuggccucaaacucagaaauccgccugccucugccucccaagugcugggauuaaaggcgugugccaccacgcccggcuaggguuuuguuuuuaaccagugcucuuaauccuauaaaaggagguugcacaugcaccaaggguaaggcaggugaucccucgggaaggcauuuauaaaauagcuuuuacuuuguggacuaggaggaaaacaauuagguucuuauuuugaauagcuuuugauaagguuguuuuaugaaaaauauuuuaacuaguuuuuugagcaugcagauggaucaacagagcugucuuuugcagaggcaggccugugggcguaaccgaacccugcagugacuguacugaguuugauuuagaggaggucuccuggcagguugcuuucaacuagccuguaguuguaaaucuggcuguugaauuuggugguuugguuggccacauuuuuguuguuuguuucuuuguuuacaaagaucagaacuuugcuaguuguugcuuugauuaucuuuucuuggacuauuuuucagaaauuuuagcugaaccaaaaauagaagugucuuuacuuugggaauguugacucuuacuuuccuagaauuaagccaaauauugauguucuauucagagaugugaaaauuuuauuuccacuuucuuacuuuccuagccccagcccggaagucaguuuugacagacccagauaaagucaggaagcugcagcagagcggagaggccuuuguucaggaugacuccuguguuaacaucguggcacagcugcccaagugucgggagugucgacuagacagccugcgcaaggauaaggaccagcagaaggacucuccuguguuuugucgcuuuuuccacuucaggagguaaggcauuuguuaggaaagacuaagguagucuggucucugcauacuuuuucuucucaacaggacaucuagaauauagaaauuauauuuuuuguguuugauaauguagacuuuucuguaucuuauucuguaucuuauucuuuuacgcuuuuccucauacaccccaggcuagccucaaacuguguauagccaaggaugaccucaaacucccagucuuucuaucucugguuccagaguacugggauuuccaggcaugugaaaccacacuugacuuaauaaggugcugagaagagaaucuagugcaugcuaaaccuaagcauucuacaaacuaauuuaaauccccagaccucuguauauguauuuauauacugagcuaaauccccagcccucuuuauauauacuaagcuaaacccccaacuccuuuuuauauauauagcaaaaaacauauuaaaaguacaaacuuuucagauaguuuucauagaaaaauacccagguaauuuuaauguuuuggucaggaaguuuguuugggcacacuuaauugguguauuguauaagcuguuuugaaucuucaccaaaguauaagaaggaguauccaucuucugcaaauauuuuggauuucuguaccguaugcauuagaauuauuauauagcacugugucucaggugaucaguuuguugcacacaccucugacccuguauucugaugggaugucuagcaguagcauugcugggucagguguaugcuaagguucuccugccagacugcccugcagaaagggugcucuuuugcccuucacggaggggcguguguauaauuucuuguuuucuuuuuuauuuucuuccauucaaauuuguucacaucauguuauuuguugacuuuucucuuuguguguugcacuccuauuuaaauuagauuaauuacaauuauuaaguacauuugucaguacuccagugagauaaaguagacacggucacuguuugcuucagugaacccuacaguaaccagaagaaauaaaucauuaauaaacugauguuuaaaaauagacaaaaagaauauguagcagaagauggccuagucggccaucaaugggaagagaggcccuuggucuugcgaagaucauaagucccaguacaggggagugccaggaccaggaagugggaguggguggguuggggagcagggcagggggaggguauaagggacuuuugggauagcauuugaaacguaaaugaagaaaauaucuaauaaaaaaaugggaaaaaaaguaaacaaaaagaaauaaaauugcugcuuuucccaaaccaguauguuaacaauguucuccucgcacagauuguuaacaauuaaaaauaauuuauacagcuucacuagaaugacaguuuuauaacagaagugucagaaaaauuaauugcccuaggaguauagauaauauaucaguaucuaauagcuugacagcuguuuauaauuuaaguuuuaaaguccucuucaccuucacuucugauugcugucucuuacucuaccagucauauuaucuuacuuuucccauuaguguauauucccacuguacaagcacaugaauuuaugauguccuuaucauacuugugugaaaaugcuaugcuuuucuccugaucccucccucauuucccuuuauuuagucccucccacuucacaaagaaucccuuuuuggcuggccuuuuuuuuuuuuuuuuuuuuuuuuaauguuugcaauuuuauagagaaacuugcauguuuuuauuguguuguuuaaaaaauaaagauucauuuuauuccaauccuuugucuaaagugaagcaacuuugcuuucuguuuugagacacgauguucugcauauaagcaaagcuuacauaguacaguuuuuuuuuuuuuaaagauuuauuuauuuauuuauuuauuauauguaaguacacuguagcuguuuucagacacuccagaagagggagucagaucucgugaucggaugguugugagccaccaugugguugcugggauuugaacuccugaccuguggaagagcagucgggugcucuuacccacugagccaucucaccagcccccauaguacaguuucuuagauagcaagggauuucauguucagcaaguucuuauaagcaaggggugcucuugucuucuucucauugucuuugucuauuaaucuaauuuaaaauauaguuuuagaugcaaguugaaaauuauugcugagcuagauuaaaugaacaggccauuuagaucacacuucuguguuuuauaucaacuuaaugcuuccagcuucaaguaaaauguuagguuuuaaaaauauucaaaacugggcuggagagauggcucaaugguuaagagcacugacugcucuuccgaaggucccgaguucaauucccagcaaccacaugguggcucacaaccauccguaacgagaucugaugccuucuggugugucugaagacagcaacaguguacuuacauauaauaauaaauaaaucuuuuaaaaaaauauucaaaacuaaucuauagcgccgucucaaaccuuccacauguuaagagugcguuuugagaauauucagccugccuaucuguuuuuagguucugaguuucauccuuuuuuuuuuuuugaccacuuauucuguaagacuuauuugacucuucugggugccuuuuccaagauguaccacucacuugaaaauacacuacauuccuugggaaacugcuuuagguagucagggaagacucaaagagaaagagcagggucauguagcugucagggcugaguuucaucuuaacauugccuuuggaaagacuuaggaacucacgcucuaaugagccucgaggguauguguggacagcagacaccuucaaaucugugagguccuagcugcagugcuucuaauaagaugucucucuuucugcuguuguugguuuacuuauuuuuacuuguuacugucuuugcugucaagauccaguucuaggagagauugucuaugaagguuacaugauaaacuugggucaaguacaaaauacacaucucucucauauacccuaucuagccugccuuuuaagagaaaaacagugauuauuguuuguuuuacuuagguuuuuuuaaauccuuccaagugacuagcaagucauugucugccauuagccauggagaguacagaaaaacaggacaggauuuauugccugaaauaauauuuaugugguaauuagaaguuauuaaucaaucuuguuguuuucccacuuccagauuacaauucaacaagcaugguguguugcggguagaaggcuucuuaacaccaaacaaguaugacagugaagcgauuggcuuguggcugccuuugaccaaaaauguuguggggacugauuuggacacagcaaaauauauccuggccaauauuggagaccacuucugucaaauggugauuucugagaaggaagcuaugucgacuauugagccacacaguaagagcaucucuuagggggcaggaugugugaguccuacuugaccucuguuucuuucugacaccuaaguugcauggauuuuauuuucaccaacauggugauacuaucgugacauugcaguuuucuuuuuauaguagguuuccccugagauguucugucuagaguuuguuguggaagaggucuaagguguagcaucaccuuuugguuugaagggucaaugugaguuguuaguugcauuugcacagccuuaaccagauauauaggcucaccagaagcugggaucagaccucggguugauuacaacaaaagauucuuaauucgugguacauaguaaagacgguaagaccagcuaggcauacccuaagccuccugagucccacaaugucaggcuagguuccaggcauuugaauggaaccagcucagauggagucaauucuucccacauccugguuugaaaggauagcugcagcugcuaccuuaguuugagacucugcucuuuccucuuuaggggcacuccuucacuaucaggaagccuaguaagcuaccagggucaguuugugacauaucagagauggacugccuuugcgucacacaagauagugucuggaaggauaacaccuuuuuuucuuuguacaugcucuggagaaaugagaugccuagcuaaaaguaccaugggacucuuaugucugucauuuuggauuuugaauagccaaguauguuugaauggcagugucuacacuauucuugaagaauuuugguugcaauaaacaauugaagcuagcucuggcacaaaauacuuucgauaaauguggauccugucauuucuuucucaagacuuuuaagaagauuuauauauuuuuauuuuguguaugaaugguuuugccgacauguauggaaaugcacuacauaugucccucgugcucacagaggcuagaauaacuccuggaacugugauguuagauggcuguaagccuccauguggguauugggcuaaaccuauaugcacuaagugcuaggaacugaaauuguacuauguaaccuucauuuauacucagcacagcauucauucaugucucaacaaaacagaaaacaaaguugcuucacucuagacaaaugaauuugaauaaaaugaaucucuuuaaacagcacaauagaaauauauguuucucuauaaaauugcaaacaucaaggaaaaaaaaaucagguuuucucuuaaaugcagaccuuaagugaaaaaaagugacaugaaagccacagugggauuccuugugaagugagaggaacuaaagaagaggaugugagggagugaucaguucuuuacaagagcagaaaguacucuuaacagaugaggacaaaccaucucuccugaccuacuucuuagauuucaacaauggaauccagacauguucccggggaucagaaacuccaggagcugcuggaguuauugugaaggggguagggggcagcuuuagaauuaugcuucucuucauguguucagaagucagagguguguuucaacuucccucuuugcucuggauagaauaagugacacaaguuucccauuacgcugauggguuucuucugacauagaucuggguaaagguggcgcguguaaagaaacuugauuacacuuacugcuuugugccaggcugcauuugacugcagugcauaggcacuucuuugaaauguguuaguuguuuucuuccugauaaaucagaccugcuuuagguuuuaaggaagugauacuggaguuuuucccuuuuuuuguuauuguugcuuuuuguuuucccauacagaaaaaaaaguacagguaguugucuuuuaagaguauaauuaaggaauuuucucuuggugguagauuuuucuuucuugguuuuaugaucauccuguucuguuacauaagaagcugguugcauuagagaaggaaaugaaauaccauggaugauaaugaaagagaucauccuaccaagaaggcaguaagagcagguguucaccacaggccuuauucucuaguaaguaguggcuaggaagucuaaauauuuccuaacaaaacacucuaauacaaacaaauaggacaaaguucauaaaaccucaucaaaugccccaaguucuugauauugugccuggcccauuucauuauaguauaguaguaguucuuuguuggaaugagucaguguaaagugaaaugucauuugggauguauucgggguaaagaauuaauucaccacagacaugguuaugaaaaaaaaagucucuguggaacaagaaugcaacaguguugaaccaguggacaccgacuugaccuccugccauucacaccaguguucccuuguuccuacuccagaaagcuuucugauacuugauaugggucaucuuauuacacuccuuccuuuuuaggggaggggcuuccaauugguauguguagucaugaaaccccuuccuccagucaguguggucuugccuccuggaauggaaaauguggcuuuguagauuccuagguuguuucucauuuugcuggauauuugaguuaguguggaucaguccuguguaucagcaaaugucaguugugggcauggcauaauaagguuucugauaagugaaggacaugaccuugguacuuuauacccuacaguaacuuaauucaguguucccuucaggaccuuuuagucuuugugaauuuagagcaucugugaaaaugcugaugauugguuugcaguuugaauaauacauuguaucccuuggagaaaguguagcccgugcagccuugagauucuaaaagaauuggugagguuggaacuguggugaggauaccuguggcugaguuccaccucuguaccugcugcuuaggcagucacuuccuccaggaggaagaacagaguaugagugcuuggugcugcuuacacacuuggacaggcaugcugagggacagcagagcuucauggguaaaguggacagacuaagugggaacucuaagcacgggaagucucauacucccaccuauguuugguuucagaaacccucuguaccucaggccuaaauggcuuauugauuuuugcaggacagguugcuuggaaacgagcugucaaaggaguuagagaaaugugugaugugugugacacaaccauuuucaaccugcacugggugugcccucgguguggguuuggaguauguguagauugcuaccggaugaagaggaagaacugccaacagggugagugagaacuugaauauccuccaccccgguacacuggacuuaaguuguuugucgguuugugguugaugguuucugaagcacugggguuuuaagguucauggaaaacaguuaccacaaauccauuauuuacaggugcugccuacaagacuuucucuuggauaaggugugugaagagucagauacaugagccugagaaccugaugcccacacagauuauuccuggcaaagguauuuccuaugaggcagggaucaccacccccucaccuccagccacgugucuuggguaacuuaaggggcuuuagcuugcuuuuacuuuguguagucuaauugccugauuacuuuuaguauuguccuaaacguacucaagaaacauguuaaauaauaucgccgcgcuuuuaaagcucucagggacugcauaguagaaagaaaggaagugcccauuucaggaaggagggauaaaaaggaaggauggagcagaccaucuugcugcugagaaaaacaucccugugggaacgucuucuguguugagacuguacaugguagcugucuuuagcauuugccucuguccucuguuuuagcccucuacgauguuggagacauugugcauucugucagagcaaaauggggcauaaaggccaauugucccugcuccaacaggcaguucaagcucuucucaaagccagccuuaaaggaagaccugaaacagguauugcugcuagugcuuaguugacuguccuuaugauuucaucuguuucucagcaaacccaagggcuucuguugcuguguuggaaaggaauacagacagcggucagucugggagaggcuucauugaugugugcugcaguucaucucccucucccucgucgugccacuuugugugcuuuauuugugacuucuuaguauguuugaaaguagacacagaucaaucagucaaucacuuuaaagccacuugguguuuggggcuguaggaauauguguauuccuggcugauaugugagggcaaauaccaaaguacguucauuacuaugucuuuuguuuucauuaguaauacucauaagcuaaaaguuaaaaucucugucuuauccuuguucuguguuacaccagagguuacuauuugugugagcuauguauuuuacuggcaggcuuucagggaagaaagaaaacgucagucuucagcuuauaccuaauucuccuuuuacauuuacagacauccuugucuggagaaaaaccaacucuugggaccaugguccagcaaaguuccccuguuuuggagccaguggcugugugcggggaagcagccuccaagccagccagcagcgugaagcccaccugucccaccagcacuucaccuuuaaacuggcuagcugaccuuaccagugggaaugucaacaaggagaauaagggugagugucccccucccuccugaggacuggagcacauucacuguagacuucuuggugagcuugcugugacacaggaaguguuccugcugucauucagguacaaaccccugagaagggacugucaccuccucauacaacuuaggugaaguugaaaucauguuuggcgagagguggugaugagaauucuuacuaguacuacugacagcguauacaaaaauagcacauucugguuccuuuccccuuguuuaucucccucccuggcaguccugccucuucccuacucauuucuuucagugacuuucuguuuuguguccuauagagucuaacuaggacuguauauauaaucauugguuugaaaccagcuguuagaaccuggcgagcucuccagugguugcucuagaauuuuaguucaccaaguagcagagcccugugaacuaccacacacacacacacacacacacacacacacacacacacacacacacacacacacacacacacacaccacccauagcuaauuguuuguguggccugaugugugugcccaguuccaguaggagaaaaggcuagaaaauguguacaugccgagugauagguagaugacauuucguaggccuucuccguguuuucugguucuuagggguuuuuuuuuuuuuuuuuugugcucccucuuccuucuguguucugugucccuggaccugaguuguuggacauguuucaaauguuuguuuacuugcugcuguccugucuugucuagucucaguguacugucuucucuugcauucuucuacaacagcuggacuuugggaucagauaaaguuagacaagaauuuaggucauuuugcuuucuagaaagagaaaaauugaaagucaguuguuuugugcagacaucuuaaaauuguucugaaccagccucaugaugguggugcaugccuugaaucccagcacuugagaguacagagugaguuccaggauagguaggacuacacagagaaaccuugucuuuuuaaaaaaaaaaaaaaagccuuaaugagauuugaauccauaaaggauuuguaagaaugaccauccuauguacauauguacauauaacugaauauguaaaaguuagagaggaaaguacugugaugagauggagaaccuuugagguuuaacucuggguauuuuuauacaucagacucuaaaauuaagacuagaaggggacaccguuaaggguuucuccuccugcaaaagcacucagagcagacauucuauuugggguugaguuacugugcgguuuagucugagcuuaguugauccuguaucauccuccugaguagcugggacacaugagaacaccacuacacuuggcaugacuuguuuugaaacuguuuuaagugauucacucuguauugggaguaagauaaagguucuuuuccuucuaagcacucuacuaggaguacugacacaauaauaaauaauuuuuuaaaguacuauuugcagugcuggagagauggcucaggguuucagauugcuugcugccuuuucauaggaccuagguucaauuccuagcauucauguggcagcucacaaaucuggaauuucaguuuagggauccaauaccuucuucuagccuucacgggcaccagacauacauacaggcaagauacccacauccauaaaauaggaauagaaaauaccacacuguuuccugguuucaccuggguauucgauacuguuguagaacaucaacuaggaacucugaccuaacgcacaccacuaguuuuuauucuucuaggguugguuuugguuggugggugguugguugguugguugguugguugguugguuuuacaagaagaaagcuacacccuaaguuauucugcuaauagaaacuaguaaguaauuugccuuaaaugcauaucugaauguuuucauuuuguuuuagaaaaacagcugacuaugccaauuuuaaagaaugaaaucaaaugccuuccacccuugcccccucugaacaagcccagcacaguccuccauacuuuuaacagcaccaucuugacaccugugagcaacaauaauucagguuuccuuagaaaucuuuugaauucauccacagcaaagguaugugcucauuuuauuacuuguaccccuuaugaagcugaguagagaaaaugacaugaaucaugugucauugugggugcuccaugggcucauaggaauggguugggacacugucaucuucuagcuacaaacauuuuuccugguuuucacuuucuuaaaccugagaguaucuagcuugaggacuugccucuuuaccuggcuucucuaauuuggucucuuguggaaauucgaugugaugugugcacaucauacaguuucagagaugggguuuuuucaauaguagagaguggcauauauaaguuuuguguuuuuuauuaaauucagacagaaaauggauugaaaaacacacccaaaauucuugaugacaucuuugccucuuuggugcaaaacaagacuucuucugauucauccaagaggccucaaggacugacaaucaagccuagcauucuuggcuuugacacuccucacuacuggcugugugacaaccgccugcugugcuugcaagaccccaacaauaagagcaauuggaauguuuuuagggaaugcuggaaacaagggcagguaaugcuggcuucuguccccucugugcuccuuuguggacuccuugguguugcuuauuuacucuccuccuggguugguauuguuuguuuuggguagauguauuagcacugucuggcuguguguuacuuuguauaaacugagucaacuauacuucuucccacucagaauuugagugcuuucagccagcuauuaguugguguuugaugagcgagacaggccugagugaucuuguguggucaaccucaacugaagaagugaaagugacuaagacacuguugggauuugagggauuugacaaaaugcaauuuaaaaacaaaccacauaucccacuuuuaaggauuaaaacccgugccaggggcugguaagauaacucagugguuaagaacgccugcugcucuugcagaggaccugaguugguucccagaauccauguuuguauugccacugccuauuacaucuccauguuuaguauaucuaacgccaucuucuagcuuccaaguacaccugaacacggaugacaagacaugcacagaggcacacggguauacacauaaauaaaaacaaauguaaaagaaaaauacaaaggaaaaaaaacccaugcucugaagguaguaguucugcaugggucacagccauguagugucaucuugaaauuggugugauaccugcugucaggaguagcacuguuggcucuucaguugugguugauccaucuacaguguucauagccuuguggguaacacuuguuggccuauaugucauguucguacacuccuagccugauacugugccuaagcgggcaucagaagaauggucucuucucuagcaacuuaauaaucaagccggagagcaaaguguguagcagaugaauaaugaagauauagccacuguggaugcucagagaacuuagcugucauuucaccagccgagacugagggccagcugcuugaagaggggaagagcuaguagaggucagacuuaaucuccuccuccuuccuuuagccagugauggugucgggcgugcaucauaaauuaaacacugaacucuggaaacccgaguccuucagaaaagaguuuggugagcaggaaguagaccuagucaauuguaggaccaaugaaaucaucacuggagccacagucggagacuucugggauggauuugaagauguuccaaguauguauuaaagacuucucaaggggguuaaagcuguguaaaguggacacaagaauagcaggagcguaaagauucaggacuucaagaggaacucuuuuuuuuuuuuuguuuuguuuguacaaaguuuaugcuuuugaagugguauauuucuucuaagaauaguucugaguaauccggaucuguagaguucagaagguggggguauagggaagaggacacagaugguccuucuuagucccuguacagaauaggaggugcucucaaccucuaucagagcaaaacaaguccuuuccauuucauugaguuugagccccugagaguuuuguugcugaggggagauggcagugagugacacuggcagugggcagugagugacugcugauacuuucacaaaacuacgaggaaggcaaagucaguccagcaacaagcuuuguguguucaaaaacaggaucagucuuuauuuugcuuucucuaagauacagcuuuauuucuuguggccauaaaaauaagaguuggcaauuggcagaaauagugaaguaguguuuguaugccaagugaauuuuuuugauuuuugaaaagguucagauaagccaggcgugguagcgcacgccuuuaaucccagcacgcggaaggcagagaggcaggcagauuucugaguucaaggccagccuggucuacaaagugaguuccaggacagccagggcuauacagagaaacccugucucaaaaaaaccgaaaaacaaaacaaaacaagaaaagguucagauaaaauacuuuauuugcaauauuaagauauuaacuaacuuauccuuuuuuguuucugaauuaugaauaacaauuccuuuauucugguuaaucucuccagaccguuugaaaaacgacaaagaaaaagaaccaaugguguugaaacuuaaggacuggccgccaggagaagacuucagagacaugaugccuuccagguaugcuuucagauacagauugagcgaacuccauccuucacuuggggaaugccaaguuucucagauagcaggaaaguaguuuuuaaggaaguauaagacagcuucaugguuuuacugguucugauguuuuuauauuguaugcacaccuuuaggagauagguacauuucuaaugagauggagaaaauagugacuuuagaucuagguaggaauggucugcacauuuaauguggacgugcccuacccugaagacucucaggcugguuuucagacaguccugggaucagacacacccagaguaaugugucaucccagagucuaguuccucucaugagauacuuuucagcucuauaaccugaaacauuccagaucauuugagcauaccuguguaguucuaaauaucaaggcuagccaucucugucucagauuuggucuuuuuuguauagaagguacaaauguccuaguauacuaaaguagaaaggaagcuugcuuugcaaauuauuggguuucuuguucuagguuugaugaucugauggccaacauuccacugccugaguacaccaggcgagauggcaaacugaaccuggcuuccagacugccaaacuacuuuguacggccagaccugggccccaagauguacaaugcuuaugguaagaaggaaauaaaacauaguggaaauaaaacaagauguuuggaaaaaugauuagauagaaagcggcuggacacugcuuucguucuugcacauuucucuauuucuuggucacauguguguguguuuucauaauugcaguuuuaaggcagguuacaauuuuauaguuuuguuuucuacgccuauaauuaauagaacuucauaauguguggucauuucagucuagguggauaucuaggucaguuuugcuauuguuucccacuaauguuauuguguguguguguguguguguguguguguguguuuugcagaaguuaugaugcuauagaagaaaugaauaucugagaagguuuugagaucaguuucuggcuugguuuaaguauuuuagccagagguagagcuguguguccuagacaccaauauauggcagugcuuguaaaagcuuuccuuaugauuugggguggggguuguuguauauaaucuugguucuaucugaguugaugcuuccucaagaguuuagagucugguuguuuuagcauaauaacccaugccaguauggguaggcuguguuaagagucaguuuauccuucuuuuguuguaacgcuccauuucacaguguugugcagccacaacagccugcugucccaguuacucuuugggcacucuucuuuggagcuuuacucccagucucuuauauuuaugauuuuaucaauacaucauugggggcuggagaggugguucagugauuaagaguauugcugcucuuccagagaaccugggucaguucacagcacccugaucagcagcucuuacgcuaauaacuucagcucuagagggucucauaaccccugacucccgaguauauguacacaugugacauacacucaacacagacccaaaacacuaaaaaaaaaaagauuuaaaguauuuuuuguuaauagucugcuuuuauguuuuaaguagacugacuuuucagauacgcuuucauguggccguauguaacuuguuucauucaccuugguuuugacauguuaauuccuuuuuguacuugcauuuuguacuuuuuuuuccaccagauaaauaccuuuuaaauucauugaaagcugcuaugucuaguacaggugcucuuaugcucaccauccaguguaaaccacugucagcucuuuuauuaugauugucuauuccauugucuucccuuuauauguucuuuuaccauuuuaaagcacaucucaaauuucauuauuugaaccaaaugcccaaggcuuuaccuauuuguagggcuguuauuucagcacauuggaaacaaagcaaaguagagcuagguuuuaggguccuaggugacacaaauggaaacuaccaucccuuaguuuuagccccucucaaauagcauccaccaagcaagcuagaagugaaaccuuucuccaaacaguacagcccccuuucugagguugcugugcuucguuuccuacccaguacaagagggagagugcuggugucaagaguggccacagagcaaggugagccuccuccuguggacacacuaugaacacggaagagaauucggugcagugggcaguguucccuccugccugcaggucauuuuaccacucugauuucuuguauucuuaguucuaagcauccugguauacucagguuuuuuucuuucuuucauucauuuuuaaggauugaucacuccagaggaucggaaauaugggaccacaaaucuucacuuagauguaucugaugcagccaaugucaugguuuaugugggaauucccaaaggacagugugaacaagaagaagguaggaucugaauauugaagcugggcuuacugucuaagccaggauacacuguucacacuugcuuuuucucuuaucuagaaguccuuagaaccauccaagauggagauucugaugaacucacaaucaagagauuuauugaaggaaaagagaagccaggagcccuuuggcacauauaugcugcuaaagacacagagaagauaagagaauuccuuaaaaaggugaguugcuaaucuugugucauguggggggaagcauaagaauagcaauacuauaaauucccauacagugcaaauccguaucaauuggaugggcugucaguaguugcuaagaaacaaggauucuaaaaaaggggcggccucgucuucuguguuuauuuucaguuuuaaugcacuuggagauuuuugcugccuugaguuugccugaucaucauauuauaccuuuuguuguuguuaauacugccuugaaaauaggagcauuucacuaguucaugaaucaguccuuggccccaaggucucauguucugaauaaauugcuaaagucucaauugguuuuguucucauuuggugagagacucaccuuaagugauugucauuuaaaggacuagcaggagccgggagaacucaguuucacuguaguugcagaaguuauguggaaguucccagcucuggaaagauagagcugucucuccugaaacuuguucaguguugaggcugcugauuacaaaccagggauuugugacuaauacucugaagucauaccugagucauaggaacauuccuagcccauuugugguccugacaccagguagguucuuuaauauccaguugcuaaaaaucagacuauuugacuucuggucaccauauucccuuaaugaugucacuuuuuuuuuguaguaugguuuuccagacacugaauguagaaaucuuugggacuguuucauaagucagacaguaaaugcaagacaaguugguucaugaggaaucuguuuacauuuaaaaagaggaggaccuaaauauuguccaagagaguacagacuguaggaagugauagcaggaagcacgguucuguguuucucuugauugcauucuguuagugagcuugaacacuauuucuaccagugggaacgcauaacuugaagacggccugauguuuauugacuacuuguauuuugggaagggaaaacacucuuacuggguuugacauuugcuaaguugcaugcuauuuuuacuguauuguagguaucagaggagcagggucaagacaacccugcagaccaugacccuauccacgaucagagcugguauuuagaccgaucgcugagaaagcgccucuaucaagaguacggcgugcaaggcugggcuauuguacaguuucuuggggaugugguguuuaucccagcaggagcgccacaucaggucagaaccuguuacuaauuccuguuuauugccuuucugcugugaucuuguggacuucuuacagacguggcuugaugucuuccagguucauaacuuauacagcuguaucaaaguggcugaagacuuugugucuccagagcauguuaaacacugcuucuggcuuacucaggaauuccguuacuugucacagacucauaccaaccaugaagauaaauugcagguaaaaauagcaccagguccaggcauuugcugccuauggcucaugauucaguagugaccuuagagagucagccuaucuggccaugucaccguugggauagcuuucuaccuaguccuaccaugcgcgugagugauaaagcuacaaggccagagaaagccucacccuggucauugcuuaggcacugaaaguccuuaucccuggcuuagccacagccaguguucuggaacacaggacuuuguacugcagugcuuuugcuacuugugguugagcaggauuggaagaacugaacauugggaucagauggggcuguuguucagagacuucgaguaguggugugaauauguguguguggcagcucacauugcaaucccagcuucacuaauccagagucugaggaggguuugaaggccaccccgagcuauacagcaacaucacaauuuaaacuaaaucaacagugaauuaaugcauauugcuucagguuugaaaacuacaagucugauaaaacacuguauacucauccuuggccaaaacugauuguaaguucuucagagaaggaugguguagguauggcauacuggucuccaggagccagaggcccucaaauuacauguugagcauuaauuuaaguucuaagagaaguuuguguauguggugaaauuauucuuggugagagauuuuagguuuuaaugaaacaaguaauuuuuuuucuucuguugcuuuaggugaaaaauguuaucuaccaugcagugaaagaugcaguugcuaugcugaaagccagugaauccaguuugggcaaaccuuaacucuucucugcacaauggagaugaauuauuggcagcugaucaaacucuucaggcaggauuccuguggacuuugagauuuccuguuaccucaucuucuuuuuuaaaguacaccugacuugggaggguacugucucuaauguauauuucuaguguuuacagacacuaaguguguauauguaguaacuauuuacagaccacgcauccuuauacugugacuucaccuagaucuucuaccaagcugaagacccugcuggcucugaaacaauccuugcaguuacuccccagcuguucgucuggacagcucauucaaguggauuuuuaacuauuagggaucacugcgaaguuucguuggauuuuauuuuauguccuucagagcacccucccccacccacuaggguccagaagagcaauggaggaagugacagcuaauggugcaguucuaaauauauauugcauaggacuggcauuauauagcagaaauaacuacuguauaauucuugggguuaaccaucuuuaguuaauggaauuuuaauuuaaaugaagcuuugcuaauuuuaagugguaagcauuuugcauuaaaauauuccuauaauauuuugucgcuguucuuuguccuuuauucuuuguuuacucucucgaaaauaaaagggcuaaacuauugaauuagauaaucauuucuuagugacuaauacagcgcugaucuguccugcuuuuguuaagagccaucaccaguuugaaaaugggaacuaaccaaaacccaaauagugacuguuaacugcuaggguuaggacagcugcaccuaaaguccucaucucugugaagggacagcauugguaaagaaggcuaccuuguggucccucuccugggcugcagaaggaauuuguucauuagugcuaagcagacaaggccuagaguguagguguuaaccuuccaaguaauaauacauuucuaagucuaucgaaacaguuggugaauauuucuuaaaagcuccuuuguagauuuggaucuagaagcuacacuauugcuuagaaaucagcuaugucagaacagcagcguagggaagccaccuucaagccugcugucaaagguucucauacagaauuacaagaacuguuacccagaguugaacuuaccuuaaugacaaaaggcaagagccagcaagaacuuucacauccucauauauaccugaaguuagauuaugaacugaucuaguucuuacucuggaaucucuaguguguucaaagaagaauguaagaaaugugucaaagaaauugucagaauggccauguuuagaaaaaaucugcaugcaacuuaaaaugaagcaggaugguuacaguuagaaauucaaugugagaggcagcaagagggcucugguuacuuaaguguuuuuccucuaaugggauuagaggaggagagaaagccccauacaguuguccucugacuauuucacauaaaagucacacaugucccauaucaguuaaaauaaugaaguauacaagaauaaaguucuaugaauuacaucacggggggggggggacgggacggacgggacuuuacauugaauauuaggaaacaaaaaggaugcuaauuuuccaguuuuguuuuuucuuguuuuugguuugguuugguuugguuugguuuuucgagacaggguuucucuguguagcccuggcuguccuggaacucacucuguagaccaggcuggccucaaacucagaaauuugccugccucugccucccgagugcugggauuaaaggugugcgccaccauagcucggcaauuuuccaguauuuuaacacaugccauuagauugagcaaaccuaucuaaaccaauaaggauauauuucuaaaauguaacaaccuaaacuuugggggagacagcugagucuaaaguacuugaucugagaucagauucccagcacaagcaaaaaccugggcauggaaguaccuguagccccaguuugcugagaacagccuaaccaccuucuaacccccaagucaaugucauauccaugauagagaguaauuucuaagacuucuccaaguagauggggacagaaagcacuuguugcagaggacccacagagcugcuuccacuugcuugcaaccugagcuccauucacugugguaccauuuauuucuaucuuucccagacagacaaagcacucagacacaugaaauaacguuuuaagcgaaguuuuuaaaucuaaaguugcuaagagaaugacugaggaagacauccaccauugacauagcuuucacauaucaaggaagauguacuuuauacaaaauaaguguaaucuaaaaaugguucccuaaugaugccuccaaaguacuucuauguugaaaauauaacagccauucuguagaauccaugcuucaaauguuaagaauaaauaguaugaccaaagccaucaauuagaggaaaaaaaaucagaaugaaagcaauguauuuggaacugauauauaaaaguacaacucaggaaaaauggugauucaauuuaaaacagugccuggaauuuauaacaugaauuagccauagcucuccacagaaacagaccuaagggagacuuacuagcauugcuuacaggcugugugguacuguaguccaauggcugucacccacaaggcuggaggccucuguagucacaaucuggagcugaaguccuaggaaauuucuggggaguugcuggucuuuagucucuguuggaauucugaagaaguuggauguaaaacuggccucagcaaaagaacaaaugaaugugccuucaacagugaggccaaguacacaaagaacaaagcugcucuugacauccuuuuauuugggcugccacaagaaagugugacccagauuuaagggugggccuucacgauuuaaauaaucugguuaaggaauucccucacaaaccagcccagcaacuuggauuuuagaugacuuuagcuguaagcaaauuaacaaccaagauuagccaucacagacauaugagaccaaacuuggcaaauaaugauacaauaaugcauauucaguaggaaaguaguagugcacuccuugaaucccagcacuugggaagcagaagcagguucgucucugugaguucgagaacagccagagcuauguagugagacccugucucuaaaaauuaaaaaaggucaaagaaagaaguguguuuguucuuaaaucucuaaagacuuuuuuuuaaaaaaagugacacccuuccaauucuacagauuaaaguuaggaguugcugaaggcagccaagcgugcuugccuugcacaaggcccuggccuuccucaguucagaagccuaaaguacaguaguuucccccagcccaaccauacauaccagugagucagcagaacagggauuugccgcugucaaugaaguggugcuacugaugggaaucucaaagccucgcaagccacacaaaucuguccucuuuucaaagauggccuugauuggccucuaacucaaauccaccuaccucugccuuugcugggauuaaaugugagccaucacaccaguucauuuucuauugcuguauucuccagguagguauuuuaaaagaaaagccuuguuuuggggcuuaagucauggaugccuaaccucugguaaagguuacaugggaggcaaccguaacaggacugcauggaugcaggugagaacuagcacagugagaaccaaugccaagaagaaagacauaaagcaaagagguuucaaaaaccucaaccucacacagaguauaaaaugaaaauugcagggcuguagagauggcucagcuguagggauggcucuugcagagguccugagcucaauucccagcagcuacauggcagcucacaaccaucuguuaugagauucgaugcccucuaguguauaugaagacagcuagcuacaauuuauucacauaaaucauaaaaaagaaaauuacaaaucaauacuaaaaauaguccuagaugagaaauauuaaguucaaauacagcaagauguuaaaaaugggaugacacaaauugaauugugcacggccagguuaauauaagaauaucugcauaaaccaguuaaacugagaguuugugcucuguagaccaggcuggccucaaacucagauccaccugccucugccucccaagugcugggauuaaagacaugugccaucucuacccagauuuauacauucuuuuugagucaucuucaaaccuacaguucagacugaacauaaacuauuguuuaaaaguacacacauauacucaguaagcuggugaaaugggcucgugauaaagcuacuugccaucaaaccuggaacuccuauugguagauagagccaaguccugcauguuguccacuaaccuucauacaugcccacacacacacacacacaaaauacauguuaaacuccaaaucagaaaugacaagauuugcugcucugaacaaacacgcaaaugguaaugcauccaguuggguaggaaacacuaguguguauuucucaucacuucauaaggaagucugggcccagcaaugccccauccucuuguucuauuuaccucuggcugucauggaacuugcugacuagauccaccugucucugaagugcugggauuaagaguaugucacugcugucaccagccuacuccacacccuuuucagcgcucccuucccucucccacccuaccccuucauuggcuuaguuuuaaguuacugucacaucagccuugaggacuagacauuuuuuuccaggggagauacagggucaccaaauaccuuuagguuuuguuuuccagcaaaugugugguuuuuccuuuauucugaagggacuacugcugcacagacuuuuuucaaccuuuuuuuaaaacacccuagaaauguuaaccuacuguuuguuggccacaggagacuguggcucugugaucugcuucuucugucaggacgacuagacacugcggcacgccaggcuguaaugaucaacaggagcccugaaaagguggggucugcaugggcccuucuccgaggauuuuuacugucacaguucuuuuagauggcauucagugaaacaacuuguguguauaaaccagucggggcagacgggcuauaugugagccuuggagaggggaaaguaguuuucagggugaauguaagucauuagcuggaguauuuaaaguauugggaaugccucauuugcugggcaguucuuaugguggaguggaguuugagcuuguagguuugccuacuugauuuuccucagauaaaggaaaagcucagaggagcuaccugaacauggcagauggcaaccuuaacuauccggcuuuccccacaguggccugugaucagaaccuguguuacaucuuacugaagauccuuuggcucuuaaagauucuuuuucuuaugaggccucuacuguuaacuggcccagugugaguccugcagaguuuagcaugcuguuguggggauugcuuugggauaagcacuccaacaccagggaggaguaggccaggacagcuccugaaaggccucggugcuguguccaguuugaauucuuguuuuaugcucuaaaccacaagguagggugggcaggcaagcgagagcugccagguagcaaggaaagccauggugggcagaggcaguacagacagcuucagugaaucgcuucaagucaggauguaauaacuguaaugauuuccuaccuuccuuuuucaacgcugacuuuuugcuuccugcagaagccuuuucggaggguuucaggcauuauuucuuuaaauacucucuguuaagacuaccaucuguaacauugagcucaaugcagucacucuagaccguugucuuuuauguaaauccuugagaacagaaagcaggauaggaaguuugaaguuuuuuucaucugccuuuaugacaugagauggagaggcugggacgggggcagaggggcaggggagggcaugacugucugccucgggugaacaaugugagcacuuuggacuggaaaagugauguuuccguuuacaaagugaguggggcuggggcugcaccaugguaaucgaagugcccugggauuaagugccaauuuuauuggcagcaagugaguccugauggggugguagaaaagccaguauuucuguugcugcaccuccuuuaaccacgugggauagagggccguguugcagcuguaaacuguuuccagcgaugccaauagaaacaaaggggaaaaagaaagaguacaugcaagcauucugcucagcaugaaagcauggccuguucacugagggcuugggagagagcugugagucuccucuacccagcuaaagucugauuagcaacauacaaagcaaagugcccagggauaugggcaaguaaugccagugucucuguaaagaaacucacuugcucucuaucaagcacuguggcguuccaacacaucaauucuuccccauggaaaccacagauucaaggcaaucccaguugacaggagcaaacuaucuuuugaaucucaguaaauuaauucuaauguuuaaacaaagaggcaagagacccagaaucaccaacacaacuuuaaaaagaaaaaaaaaaaaaaag

SEQ ID NO: 3058 - RNA, 103152 nt, Mus musculus
aguccagauucagaccucaguuuccccacuucaccuagugaaggugaggcagcccucccuggggguucggaggcccagugcacugagccaccgcaccacacgguuucacaaggagggcggaggaggacccgcccuggcugcagcucuggggcugggacgaucggagcaggggcgggucgcgcuggugcccucaccgcuagccgcccaaucgccgugggcccgcggagccccugggggcuggggcagcgggcggaacgugccgcggcugcgccaacgcgcgagcgcggggccggaccgggcgggugcgcucagucuggcggcagcggcggugcacagacagacagacgugccgggagcgcagcaccgcccgcagcccagcaauccgggccgcgccagcccgcccgcccgccauggugucguggaucaucuccaggcuggugguguaaguggccucuucuccugugucccuucuucccuucccucccgauccccauguccccuuagggccgcgcgccccugcgaaccaccagccccgggucgcuagcuauuaauacccggcggucgcuaaauuuagcagguacaguagcugccuggggacgcgggcagcgcgaggcggcguaggacgcgcgacgcuacagacccauggguagccgcgggcgcaggcggcgccuugcagggagaccggggcguggguccccgcacgaugguggaguugccggggcugggcaaugggucucgccuucucucuguugcuuuguuccauuccggguggggcggauuugcagaggccccgagugggugcuccacgcguucucucuccuuuggaagaaaaugccuugggcucgccugccgccgcgcuuugucgggugaaaaugacauacaguccagacaagccaggggcgcugccugaaggggucaucgcggagaugaguagccagauggagguggggcacucaaugaagugggaaaauacuccuuuuuagguuuuucaaauagacagaggcaaaggcagguggcaaguacauuagugugcaucuuggaguagaugucuuccuuccucuugccugcucuccuuugcagggguuugagagacaggggcaggcaucucuaggaaugcacagggaaauuuccgagugacagacagcaccccuuccccccaccccccaagggcgguggcagugauaccucccaggcggugcaggagagcagagucaucuggggugaggccuguaugaaguccuugggggaugugugauggggacuuuuguuuuauuuccaauauugccucucaccuuucuuaccuggaucuggaagauugauuuagcaccugcuuaggggaccugggacugaaaugggucugggggugggggggcuuggaugaggaacacgugcccagcauuuucuuugucuaagaaagaggggcuauuaacucccuuugacagugcagggcacacacaucucuuuucuccucuucugaacugauuugcaaagccauccaggagagccgucuuuaaaguccuggccauugucucccaggcaucauucugcccauugcucccaaagcccaucaaguuacuccacaagggucucuccaacagcuguugucagcugcuggggguuuguuuuguaccuucagguggcaugugaaauauuucgauuucuguggcauggcuggcaucaauaauagggaagccaccggcaugccuugccacgccucacgccugacuaaagcuugucuucucugcagugucaguuucuuuccuggggucuuuggauuugcuagugaccccuggaggaccucagggcggggccauggagcacuugcuugccuggugggcuuucucuguaaguccucaaccaggaucaugcaaccauucugguuuucuugucaucucccacauaggggguaacugaaaggggggacuaagaugugggaugugggaggggcugcaacaguguguugguaucuucugaagcaaccacaccuugaagaacuaagacuucggaugacguaaaugaccaagagaauugcucccggucuacaacuacccucuggcaccagagguuggugggauuugaagcaccuuuaaaagaucaaggauucuuccuacccuguuccuaauucacaacuaaacccaacaugaauuauuaacaccaguuuuaaucacauuucuauuucauauuaacaaugccuguuauauaguauuagcugguguaaauagaccaaaauccagcuacaucucugcugcagaaggaaaugucauuguaaaauaggggaguuauagucuuaagaauauuacuuauucuuauauauguguuuugauucagcucaauauucuacauagguaaagggacauuuuauggugcagugccaaggcacgggacugggagauuguguuuggaaccaagaaaauaaaugguucaaaauccaaaucugccucuugccagcagauccuaguucauagcccugauuacaacagaucucaguucccaagcuaguucacugcacauuacuguugcagagguuucgaucacacgugacauguggauucccaagcacuguggcgaacauaaaucaauggugaucccaccgauccucaggguacacugcaaaaggauguaagcacugcaagaggacggacagcuuccucuuauuuuauacauugagguucuagaugaaacaaaauuuggacaacauauagguuuacuacuaauaaaaaaaaaucacuaauccaguccucuacccucaucuauaaaacugcagagggaaugacccuugaccaaggucaaaagacuagaagaaacugaguucaggauguucagacugguggauccauagccaaaggccccugaugguuaugcugaggcuaucccuuuaagacccccccuuagcccucuggucugaacuugugcuacaauuuuguucauaaaucccauuuccuuccugugaguagucauuuuaagguucuguaacuacaucaaagaauauuuaaggaagaccgaucacuguguuugaggaugcggagggagugucuuccugucuuuauggucccagucauccaacugggacaagcugcugcugcugcugcuguccuuucugccgcuggccauaaguguugugagggcugauuuccuccacaacuccuuguccccuccaaaggcaacggcuccugccucuccgccguuuccauccccgaccucccacuuuaauuuaaguaccuggcuucuaggcccacuuagcaaacauugauuuuggggauggaacccagaggcgcuagguacaaggaaagagccuggucagggcugcccugugaugaugggugucucugggcauuagggcagcuuguauccaguggacacaaugagugggcauugguuugacaaauuuccuucuggucgcccauguuccuccugacuuccuggguucacuuagagagaacuuaccagagucaguguagcagcaagguggaccuuguuggacugaaccugcuuagugucuucaugggcauggagagcacuuacaauaugccugcuugccucuuuauucguucuuaaacagggccuuauguggcgaggcuggacucaaaacucugugcacacuaggcaagcacuguacuaccugagccaauccacagcucucgccucuuuucaaacauguaguuuucuuuacaaauagcucaagaccuaaacaugaaugaaguucauacugggagacgaugcucauggguaaacugauggaggggaacacagaggcugcucugugacucgggagaaugugcccuuaugaaguaucccaagaagcaaguacucauugucucuggcagaauuuuggccaagguccagauguuggcagaauggacccagagccucccacgcagugugugguuacaagacgaaagucacuccucacuacggaagaaaaggagacucucauucagugaaaaugugugaauaucuaauggguacacuggaaaaaaaguuauuucuuccuugcacuauucuagaaucacuucuuuucuuugcugugcugaggauggaacucauggucuuguauauggugggcaagggcuagacaggggcuaggcaaggaccacaaagggacuaggcagaguggcaaaggcccuaccacugacuacaccuacaguccugccuuaguuaggguuuuacugcugugaacagacaccaugaccaaagcaagucuuauaaaggacauucaguugaggcuggcuuauagguucagagguucaguccguuaucaugaaggcgagaacauggcagcauccacgcaggcauggugcaggaggagcugagaguucuccaucuucgugugaaggcugcaagcagaauacugacucccacaugguuaggaggagggaauuaaagcccacuccgacagugacacacuucucccaacaaggccacaccuucaaauagugccacucccugggccaaacauauucaaacuaucacaagcuccuuugcagauuuuuuuuuaauguuaguuucugaggcuugggacacagauaaauuuuuuuuaaagaguccuugccaagcacacacuaaacugugcaucucauaaacaugguguggcaucccaauaaugccuguacugagaagauggagacaggacucaggaguugaagaauauccuugucaagcuuaaguccagccuagaacacaggaaaaccaaucucaaaacaaaacaaggggccaguaagaugacucacuuaguaaaacggggcuugccccuaagacugauaaccugaauuugauucccaggucccacauggugguggaaggagagagccaauucccaaaaguuguccucugagcuccacacaugagccauugucuauauagucccacaaaacaaaaucuaauuuaaaaaauaggggcugguaagguggcucaucagguaagaguacuuucugcuucaaucccuggaacccaugguggaaagaaagagguuguucucuuaccuuagugcggcacacacaugcauaagaugugguaaacccuuuacaaauuaaagcaaaacaaaacguuagcuuuagcaaaguacaaagagaagcugaagucuggcuggcucccaggaggaggauuuggaguacagcagcauucauucugggucagggaugugaaagagaggagacuggaagaaaugccugugggcuguccucggguauuccccuuacuggugcaaaacaaauggaaagagacugugaauucucaaacagaaaccugccuuucuuugcucuuaaaaucuggaaugcagaaaaauaacccagcuaauagaggguucagguucauuggggauauauuuccugguacagcucugugggacauuguagaaacuggaugaaugcuuuagucacauugggagaggaaaggugcugacuuggaagacagccuauggguucuagacuccacaauuauccuucccagugcuagaguccagaguugguggggaggcacuuccuaucugagagauuaaaccugagaggugaccugagagaugauggccagcaucaccugggagguccuacuguccucaagggagugaaaauagcagcuuaggugccacuccugcugagcugccccucuugguucccuaacccugcuugugugcugagaggggacacaugccugacauacagaacaucaggcugggcaaguuacacauaccacucagaggagaauggaugggacaugacuggaaacagaagcugcuaugauaggaguuauugauccuggaguagauuucuaagaacucacuaagcugggcaguggugccacaugcaguuagucccagcaguuucgaggcagaaguaggccagccugguugacagaacaaguuccaggacagccaaaaggauacacagagaaacccuaccuuaaaaacaaaaacaaacaaacaaacaaacaaaaaacaaaaaacaggguuggagagauggcucaguguuuaagagcaccaacugcucuucuuaaggucgugaguucaaaucccaguaaccacaugauggcucacaaccauccauacugagauaggaugccgcccucuucuggugugucugaaaacagcuacaguguacuuacagaaauaaaucuuaaaaaaaaaaaacagaaacaaaagaggaagaagaagaagaagagagagagagacagagagagagagagagaagaggaaggaagacagaccacacuaggacuucuucuugugagcauaugaaacagaaccacuagucuaugugucuccccugagaagauugcaaaguccagcagcaucugagcauacccaaggcuaagcccccagugcuguguauccccuuagcucuaccuucaaaaccauccagccaggacuccaaccccuauuuaacacccugcuucuuaauguucacgugaaccauuggaugugacuugcuggcagugagcaaugcccuggguuugcucuccagcaccaccacgcaaaacaaacaaacagaaacaauucaggaaagcacuccaaagcuugcccacuucagucccuggccaucuaaugauuuauuuaaaguguucaagaauguagccaggcacaguggcacagaccuuugauacuaggacuggggaggcagaggcagguugaucacugugaguuuaaggccagccuggccuacaagucaaguuucaggccaaccuaaauagugagacuugaccuaaaaugaaauauuugauuucuguuucuggaaauacuggcgggggcuggggggcaaagccuaaaaacuuuccuuaauaaaagugaauuagaaaauuaaaagaaauucuaagccaggcagggucauucacaacuguaaucucagcacucaggaggcugaggcaggaggauacccacuuguuugaagccagcuuggguuacauagugaauuccaagguagucuggacucagagugaaaccauauuucaaaaaccaaaaauaacaaacaaagcuucuaaaacuaugagauaaaauauaacagcauaccuuuuaaacgggauagcugagggguuuuuuguuuguuugcuuugguuuggcuuuuuuaagacuuaucuauuuuaugaauucaagugcucuguuuacauguauaccagaagaaggcaucagaucacauuucagaugguuaugagccaccaugugguugcuggcaauugaccuggggaccucuagaugcacagacaugcucuucaccgcugagccaucuccccagcccuauggcugaguuuuuaaguaacaaaagaaaagaccccaagucaggccguauagacacuugaauucaagcccugguuucuauucacuggcgaagugaccccaucaauuucucaaagauggaauuacgaaucaucuuuauguccgugguacccagcauagggccagcaccaaggaagugaucaauaauggacaccaaauugguuaauaauucaagugaugaaugaaugaaucgucuugaggaaggaugggagcuugguucuuuaauguccccaaaggcucauguguugaaagccauguuugugccuagugccugaggaggccagaagagcuugccaggucccuuggugcugagaauuaacuuggauccuuugcaagaccagcaaguacucuuaacugcuuaaucauugcucagcccugacucccccugauucuugagacgggauuucucacuggcagaguuugccaagcaggcuaggcgggcugucccgugagcucuagcacuggguuuacaagcaugugacaccaugccuaacuuuuuuaaaaccuggguucugggcauggaacucuggucuucauuaucgcaaaguuagcauuuaucaaccaagcuaugcccccagcucuuguuagggcuuuguuucccauuuuccugaacccuuaaugagacuaaguuguuaaggcuguguguuuaucgccuguuuaugcucucucuccugugaagcgccuguucagauguggcuaauguuucggcacuuccucccuuccuguagaaggaguucuuuaaauuccugcauguuauucugcuggcaucuauguguuacaaauguugccucucuaucuuugccuguccucccauuuucuuugugauauauuuugacuugcagaauuucuugguauucaugucauagauuuaucaacucuuuugauucauagcauuguuaaauauuuauuuauuccaugugcaugugucugagugcucagagaaaccaugggcucagaggugcccuuggaagccagaagauaugauucccugggguggggauuuccagaugugagcccuccagugaggaugcugggaacugaagcccgcuccuuugcaagagcagugcgugcucuucaccuccaccucccagccacgucuccagccccuacuugcaguauugcuauugccuacgaagccuucccuugcugaacucacaggcuacuguacuguuccugacaguccuacgaucucccuauucgcauguugacuucugaugcauccugagcugggcuuauguaucccagcaaguaggugccuguuucuuccccauauagaacaauagccaguccaguagcauguacuagaggguagcccuuucucugcacuucugcaguguccagccuaccauaaacugguuucccaaguguguggguguuucuggacucuguucuaccagcaagugcuuugucuggcuuuacaccagcaccauacuuuuaauuaccaaagcuuauggaaagccugagaucuggcaugacaguuuuucaccucauucuuuuucaggaaugucuuaguguuugcuucugcguguguguguguguguguguguguguguguguguguguaaauaaugaaaagcugauauuuagguucucuuuuaccucagaauuauucauuguuuuaaaagagaaaguauacuguaguguagugcaguguacuguaccauaguauaguauaagguacuauagcguacuguaguagaguauacuguacuguacuguaguguacuguagcauaguauauuguaccguacuauacuguagcgaaguauauuguacuguacuauaguguacuacaguauacuguaguauauuauacuguaguguaguauaguauacuguagcauaguguaguggacuguagaguacuauaguguaguguguuguaguauagcguacaguacuguaauguacuauauuguaguauacugugguguacuguguaguacuguaguguagugugguauauuguagcauaggguauuauacagaguaugagugcccacggaguccagaagagagcacuggaucuccaggagcuagaguuacaggugagccaucugacaaggacgcuggagaccacacucugguccugggcauaagcucauaacccucuuuagucccuauuuaggucaucuugaaugacuuucaauacauuuuacuuuaguuuugaaacaaauucucacacgauaguccaagcugaccuggaacucaccacguaaucaaagauacccuugaacucacggccuggaauuauuccccugccucagcguccuuccugacucacaggugugacucgccaugccuggcuaauuucacccuuugugcugugaaugcuaugcaagcccuuuguuugguuuacucucugguguuugguguuugucacugccagaauuuagugucuuagagaacuuguuauuuuccaacaugauuauuagguaauacagccuugauaagugcuagguucuugaggguucuugccuagcgugaccuucugucuucugaggauagugcacugcuugucuuuccagucaugacuccuuucccucccucacagcauggguaggucccucagugccugagauuaaaacuggggaagacagacaugcuugcuuuguuccugauuuaaaaaggaauguuucuggauuuucacaugcuauuuggguucuucucuucucuucucuucucuuuucuucucuucucuucucuucucuucucuucuuuucucuucucuacuccagauuuuauuccccucccaguccaugcuccgaccauuccacaucccauaccuccucccuguccccugucuccaugaggauguccccaccccuacccuucccuaccucuaaacucccugggccuccauucucuugaggguuaggugcaucuucucugacugaacccagacucagcaguccucuacuguauguguguugggagccucauuucagcugguguaugcugccugguuggugauccggugucucagaggucuugggaguccagguuaauugaaaaugcugguccuccuccaggguccccuccuuggcuucuuccagcuuaucccuaguucaacaauagggaucagcagcaucuauccauugggugguuguaaauaucugcaucugacucuuucagcugcuuguuggaucuuuuggagggcagucaugauagaucccguuuugugagugccccaucgccucaguaauagugucaggccuuggggccuccccuugagcuggauccuacuuugguccugucgcuggaccuucuuuuccucaggcuccucuccauuuccaucccugcaguucuuucagacaggaacaauuauaggucagaguucuugcugcacguuuuucuaaagugaccacuuuaaaauaguugggugcuaagcaaaaaauagcagauguguucagucgcucaauagauauauauggcugauguaacacacaagcacaaauuuuccuaaaaauguuaaggaguccuaaaaugaauaaggaguucuaaaagaauauugaccuaagaagagaguguggagauucauuuaaagauauugaaugaagccagagugcucacaucuguaauuccagcacucagggaagcaaggcaugaguccaagguuaaccuuggcuacaaaguacguuccaagacagccugaacugaagagugagauauuaagucacaucaaaacuaaccacauccucucccacugaggccagauaaggcagcccagcuagggggaggggauccaauugcaggcaacagagucuaagucaaagacagccccaauugcuccaauuauuaggggauccacaugaagaccaagcugcacaucugcuacaucuguguagggagccuagguccaggccauacagacagggcagauuggaacccgggguagaggagggauggaagcaggagggugauacuuugaggagaggccagaggaggcugcaauugggagguaaggaaaauaaauaaaucaauugaugaaaagcaaaacaagaagccgggcaugguggugcacgcuuuuaaucccagcacucgggaggcagaggcaggcggauuucugaguucgaggccagccuggucuacaaagugaugucucgaaaaaacaaacaaacaaacaaacaaacaaacaaaaacaaaaaaaauagaaaggaaaaacaaaacaaaaaacuucaaaauaaaaaggagugagaccauauuuuaagaaagaaacaagccaaaaaccacacacauacacagacacaacaaacaaagaaacaaagaagaaaauaaaaaagcaaaggagaaaaggaauuaaucaguccuuuaaaauauuuccauaaaaaaaaagcauguggccccagcagccuuacuggcaggcuuugcucacuaguccaaaaagaaauuaaucuuucagaaaggcaaugaaggcucaaugguaagauuaaucuguacccuuugccacuuggcaaucuaggggauagucucacuagaggcacuaaauuaaauauaauauauucauucgugucuauuauuagcaaacuaucauuuaauuuuuaaaauugcaucuauuuauuuguguguacaugcaugugcagguuagaagacaucucugggaguugguucuuuccuuccaccagggacggaggacagguuaucaggcacagaggcaagcaguuuaucugccgacccaucgcagcagcccacauugcugaguuuugucugucugucucccuucccuuccuuucuccuuccucccucccucccuguacuuugaugcagggugaaauauuuuucucuaggucauccuuuucuugauaaugagguucuuuuauauauuuuuauuauagcuuuacuuauucauuuauuuuaagagcauguguguguauacaugccguccaacaugugggucccagggauuggccucaaguaguuauguugguuagugggcuccuuuaccaacugagccauccugaggucuuugaucauggaguucuuuggagucaauaucaguucccugaggcugcuauaacaaagcaccaugagcuacauagccuaacaugaaacaaauuuauucucacaguucuggggccaaggaagcugaaguuagugcgggugaagccagccucauugaaacuggaggcucagggucggggggggggggauuccuacaccugagggacugucaacagcacugcuuccucugccucuguagccaccugaccuucuccuuagaugucugucuccuauccucuuugaagggcuccagucacacuggauuuuaacccucuguaauggcauugccuuuacccuguuuccaacuaaggucauauucaaaugggggucaggacuuuagcauaucuucuggaacauaaaguaaugcauggcaaacucuaauccauggagagagauguucaaagccaguucuauacaagugugcucuugggcccauaucaccuuaccuggaaauggaucagaacagaaaauucucagcaccgcaccuccagaacacggaaugaaaauaccuguuaauaaacauaugauccaaacccacugcacacugcccuagaucacaucgccuguacuugacacacaugauggccuguacucugaaguucaacaccuuagaaagcaucuacuuuuucuuucuagggcuuguguugccuugagucuggccuccgaggcgucccuacguuaauacaauugcuuagcaaauuguuuauacugacuacaucuucaaauccaaaaacaucuucacaauugauuuuuuuaaaaaucugaaaaccaguacuacaacagcaacacuauuccuuucugcauaaauacacguguuauuucccacaggaccaucugaaaguagcugcggacauccccagucagcaugucacucaaggacaggauuauuguccuaugccaggggcauuuagauauguucaucuccaugcuucuuauagaaaagaaaaaaaaaaaaaacaagugggggagaauguauguuccuuuucccccaaaacuuuugauuauauagcuguaucuuccaggauuuaccacauuaaaaugaaaacggaggcauucuggaauauguguuuauguuugaauuuuugaaacaaggcagcauuuggcccaggcugcccuugaaccuucuauguaguuaaggaugucuuucaauuccugaucugcccaccucuauccuuuaaguggugggauuacauguguguaccaccaagcuuccuuuaaaacguguuuauaagcuaauuuaaaauaaagggcgaguuccauggcucagcaggcagaggcaguugcugccaaggcuggcuaccugaguuugagcccagggacccacaugaugaagggauaaaaaacaguuccccauagcuguccucuggccucacacaaguaacaugcuaaacacuaguacacaccuaacacacacucugauagagagggagagagagaaaauaaauacacucugauuuuaaaaagaaaaucacauuuaccagaacacaaaaaauguuaaggaggucauuuuuccucucuucaugucucuuucauagugagguugguugccgugugaaaucugaaaccuuguuaaugaaggcugaucucugcuucacuuuaaguggaucuucuauccacacauaauaacaucacacuuuggucacuuggaaacuaugacauguuuuauuauucagcauaaagaaugaaguucauaaauaucaccuuuaaucucaucaggaaagucccuaagggcuggagagauggcucagcaguauuuacugagcaagugugaggcccuguguucucuucccagcauccuuguugccucucaccucaguacugaggaggcagagaugguaguauccuugaggcuuacuagucagccaaucugacugaauugaugagcuccaauuugucuaaggaaauaagguagagaggcuggcgagauggcuuaucagguaaagggauaguaaucugaguucaaucccuggagcccacauggugaacucuucaaaguugucauugaccuacacacacauauaccaggugacugugcacaugcacgcacacacacgcacacacgcacacacgcgcacacgcacacgcacacgcacacacacacaaauuaaaauggccuuuuuuggcuguauguaacugggugggcacucugcaucaacuacaucuccauccccaaaccuaaacaguugcugaaauuuuugcugcaguuguuuucugugcgggaguaagucaggauauccugucagaugcugcuggaaaccauugucccuuuuuuuaucuucuguguuugagguuugaagauaccauuuuuauuguaaaguaugaaauacucacucaaagaugucuggaacaacacuggcuucuagggagucuugauccaacagcucagcccugguaccaaauuagcagguugucuguucucuccucuucagcccuugguggcuccuauaucaauacuauguugcucauggcaaccaaugggcuuuggauucaucuauagcuaggagaggccugagagucuccuuauggaagaaggcaagaugcuccuucuacagaagucccccagaaagcaucuucuaguuugggcaccagccucuccuucuaccauuccuguggcagagaaaugggauaugccaagugacuuaaaacagcgaggacccaccaaacaucugaggauagucagcugcucuaagcacaggggcuacaggaguugagggggcagggcagaggaggagaaaauauuuguuugacccuuuccaaaguaaaaaccagcugaauggugggcuauggaaacugcaaacaccuacaaaggaauccaucgguauccacaauacuauaaaacacuucacugggcuagcaaaauggcucauucaauaaaggcacuugcugccaaguuuggugaccugaguuugaucccugggacucaaugugguggaaggagaggacugacucccacaagucauccucugacugucacgugugcugugacacucaugugcccacaccacagcuuuacugagccccugcagugcagcagauacugcaccacacugcuuuucacaaugcagcaacugcacauagcuucguaagccaccacugugggcaaguauaggugacaggaagccaucugcagucacuggugucauggcauuuccuauguaaagcccuauaauuucauacaaggucagcaugacagcaucuuuaccaagugauggacuuauaacccagaguuucauaaccuucccugggccaucuuuccagucaaaugcagccaagucacgauggggucaguagcaccaucuggccccagacugaguaguacucuugauuauagauucaggucccugcugagcugugacacgcugagcaaauaacugagcuucucagagccccacaggguaccauggggcuguaccuccugcugggcaagaucucuaauugcucacucaugccaacaucaaaucuccagaagugaccauugcucagagcuaagcaaacccucucaggcucucucuagcaucucagggaaucuuggggccuuugauguuuauugugaggagcuguugaagacaagagcccaagggagaauccucaggaacuguguccccuugcucacucuggggaauagaaacaggcaaaaagucaggcuuagcaggcaagugguuucuguggcauuuacccacacaggccaggaggacacacuuagggacugcuggcaaggccuugaccauccccuuugugacaggcuagcccuuuugcuggauuuucuauucugaauggcucagcucuagccagccugcucugcauaccugaaccagccucgucucagagaggcugggauccaaagucugaggucauccuggaccagcccauccccugcaguguccucagaggcacagcaggcucagcaacucccuggaggccaacucauccaccuuaaugaggcucuggguagagaggugguuuccuugcagggccuggcaauuccccagcugccacggaugccuuaggcagcugagcugcugacucuacacuggcaggagcauaaggucagccgugguugucgcaugcuugccaccaggcugggugaaguugcuuagggguugaagcuugaaucccaggaggaaauuuuggaaaaguuuccuggguagauagucagaaccaauugcuguggguuugucuuuuauuggugugugacuuaguuucuaaacuucucuuuccuauguugugggauucagggucaugguuacgcugguuggagagaaaaauagcuucaugggcuugcaggguuuuaggcuggaaucagcaacacuaagaccgagggguacaaccccagaaauacaaauuggaacaauaagcagcucugguuggagauguagcucggagaguugaguacuuauuuagaaugugcaaaagcccugcuucugauggcuuggauauccuacacuagacauggugacacacaccugcaggccagcacuagggagguggaggagggaggacagagguucaaggucuuccuugacuccaguaggagagcauugguugggcucugcguggcugccucuggggcacaagcuccccaagggcagugacugcaggcugagugccccagcuccuaccucacuuuuccaucacuagccuggcccuugggucugcguuugaaaagcaagagcaauuggggggaggggaaacagagagcagaaaaacaacuguguugcaccaaugaggucacaauggcucaaacugguuuaaacauguuacguagaaaaauagucagucguggcucugccgauuaaccauuugguuacuucagugaauggcuugccuuaucugggucccaggcucacauucacagaaaugaaggaguuggggacuaggaaacauauuccuccauaagaaauagaauccugagaaacuaaggagggaaagggagagaaaagggggaacugaacagcaccaacagaaaggaaagacugucaacucaagggcugggagacggcucagucgggaaagugcuugccuugcaaauaggagggccuuaguuccaccccagaguccacauauaaagcugggcauggggguucagugguuaagaggucaggaaugugugcucuugcugcagaggacaggaguucaguucucaucacccacaucuggccauucacaaccaccuguauugcagcaacaggggaucuggcaauccuggcuucuugggcagcaauuucauguguauauacccauaaacagacacauguacaccuaaaaauaaaauaguuuuuaccaaaaaaacuagguguggcagugucaccuauaaucuugguggcgagaugggaggcagagaugguugauucuuagagcuuguuggccaauucacuucaucaguagcguuccacuuggcggagggcuaggccaauaacagacccugucucaaacaaaaggaggcagacaccugaagaccaauauuugagguuguccucuugacuucacacaaauuugcgcacauaagaguacacacacacacacacacacacacacacuucugauguucugguuuugguuguuuuccuuuaaauagauuuuuuucauauacuguaucaugauuaugguuucuccuuuccuaugacucccaggcccccaccucgccuccaucccaagccacacccuuucugucucuccuuaaaaaccaaacaggcaucuaaagaauaguaaucaaauauaacacaauaagauaaacaaaaacaaacaaaucagaaaaggacaaaacaaacaaaccaaaaccaaaagcacaugcaugaugcagauagaugcaggggcacacguggguuugcauacacguggaaauuccauaaaaacacaaaaucagaagccauaauacauacacaaagggccuguaaguuaacaacaacaacaucccugacuuaacagcaugagccaaagaaacuccaaagaugcuguugaguuuguuuuguguugaccaucaacugcugggcacagggccugccauuaagagcaguguguuuccccagugagacuccauuggagaaaacuaacuuuuaucuguaaguagauaugaauuggagauagcuucuggauuagggauaggaguguggguccacuucuuucaguucuaaguucccacccagugcagaucugugcgugcccugugaaugcugccacagucuguuucugugaguguguaugugcaccagacagaccucuuguguggagaaggcccugauucccuuguguccuccaucccuucugucucuuucugccuccucuucugcagaguucccugagcccugaggggaaggcuuuggcagagacaucccuuucagagcugaguaauccaagcucucucacucucugcauagugccuggcuaucuacuacuaggaggaagagcugaguaacccaaggucucucacucucugcauagugccuggcuaucuacuacuaggaggaagcuucuuuuauaguggcugagcaaggcacuaacugaucuaugagaauaucagaaugcugucaggagucauuuuauugcuacauuccuguaacagaagaguaguauuugcuuuuccccuaggucccgggccuaucuagucuuagguucuuugccacccaagcaacacagggauggguuccaucucauucugccuuaguccauuugcuuuccuguuacauugacucaauuuuccagauccuuccauaaaguuggccauucacucuacaagggaaaaagaaccugggguagcaaaaugcucacugcgguuccuaccuacauggacacucuugucagucuauguggucauggguagugugcagcuaggucaggaaagacacaggaccagugccuuuucccccagcuuagaggcagacuuagauauaguuacuauaauggaaaugaguacuaccaucaacacagcaguuguguuggcaguuugcuuauauuaucucacuuacgccacauggggcaggcaguauuuacaugcucuagaggagcaacuggagacuugcaaagguugaggaaugugccuagcucauaaaugucccagacaggaaucuaguaugagucugcauaauaucacagucuucauacgguccucgccuggauguuuacaucccuagucucuacaaagggaucauucauaaugcagggagaugauaguacugcgcuccccgccugcacuaggacaugcagauauacuguggagugcucaagccgcuccagccucauggaagaggcguaggucaucuuccaacugccuuugggauucccucuuguagggagggaggcauguuggcuuugggcuguuuggaguuagggagagcagggagaaugugcccguugcauuugucugccucugguagggaacuggugugaugcuauuugagggaauccauugggagcuuugagagaaggguccagacuuuuagguaggggccagccagguagagcuuugacaggagugaggccagacaguggauccacaucaaguuugcugcccuucccucuccaugucucuccagagcuucagauugugaccuuauuuggaguagggggucuuacaaguguaugucagguuggggugaguuccgacuggacuaaguucggucacaauccaaggccugguguggguaugagaaggaggacauucagacagauucaagacauggggacaccaugggacagcugaggcugaggagugugaccuuuacacggugaugaugaacagagggcggggcaagggagaagccaagccgccaagcuugacaggucuaagaaaccaugugccauccauuaguuugaagcagcuguuguucccuccuggcccccugucgcaaaagggacaaagaauaacucagcagaauauguccuuguggagucaugcaggccaggaauggucaugugaucuagaauuuuugcgugguguucagaauccuccagaaucgaaacccagaugacauuuucucacucuugccauggacauccguguuaguuacuuuucucugacaagaacuccuuaaggaggaagguuuauuuugguucaugguuugagggcacauugcaucaugacagggaagucauggugguaugaguuugaggcagcaagucacacuucagccacagucagaaaacagagugaaggaugcuugugcucggcuggcuuucuccucuuuaguagacuuggccuuccucuaacaauuugcuauuaagacaguucccuacagacaugcccacaggccaacuugaucuugauuguugaagcucuucccagaugauucuaguuuguguucuuaacaguuuaaauuaauuauuacaauauagauuguauauucugcauauaucacuaucauucaaauucuuauccuuccagcaaucccagccuuguuuaagcagaaaucaaaaggaguaauugagcaucucuugugagaccccucuguaaugaaccaauugcagcccuguaaaauaagacagacaugacucuuuuccuuaauguguguguaguuuuuuuuuuuuuuuucagaaaauacugacacagaacuagugagcguuuggaauuaguugauuuccuacggcuuuugauuaaugugacacaguacaggcagguaugccaaucaggcugugcuccuggaagccuuguuuguuuuucauggccugaauucuccacuuagcggugacuaauugaagcuaagccaacuguacuucaucucuccuggaaacagaugagugguucaggaguagccaguugccaugaacugaacuguguucuaccauaauuccuauucugaagcucugacugcaguguggcaguauuuggggaugaguccuugggagauauauacaggcauaaauacaaucauguaggugggacccuugaugggcuuggugucugcauaggaagaggcucacuuucccuccaccucuuccuuuccaccaucuggaaaccagaagaacagucaucagaacccaguagugccaaugacccaauauuuccaguguucauaacuguagggaaguggauuucuguugguuaagcugcccaguauacaguaucaagccauggcagcuaggccuggcuaaagcagugguauguauacaguaaguaugaacuguaaaggguaagaaguagcagggggucuggggaagcauggcucaguaggcagaguguuugucuagcaugaguaaaacccuagcuuugauuacaaacaacacauaaaccaaaaaaaggugcuacauacguguaauccagcuguugcaauguggaggcaggagaaccagaaggccauggucauccugcacuauauuacaaguucaagagaagccuuggauacauggggcccucugucaaaaaggaugagaggcagguguagaggguagaaagaaguucccaugaaaagcaugugcauuugauuuuguuuguuuaaagacuuuuuauuauuuauuauauguuauguguguguauaugucugugugaguacaagcacauguauauguaguuucuagacaccuggcuuauuucgugggugcugggaucugauuccagcccuuagagugcacagcaagugcucuuaacuguugagucaucucuucuguccauugaacuugccucucccuuauuuagucuugaggucucuggcagauguguccaagccauggccaugcacaucauucacuucagaauaucuauucauucagcacaacacaaaacugugggauucuuuucuuucuuuuccuccuuucuuucuuucuuucuuucuuucuuucuuucuuucuuucuuucuuucuuucuuucuuccuuccuuccuuccuuccuuccuuccuuccuuccuuucuuucuuuuuguaguuuuguuuugguuuuuuguuuguuuguuuguuugagacaggguuucucuguauagcccuggcuguccuggaacucacuuuguagaccaggcuggccucaaacucagaaaucugucugccucccgagugcugggauuaaaggccugcgccaccacgugcagcucuuuuuuuuuuuuuuuuuuuuuuuuuuagcucuaaaaaauagaaacucaauugugugacuuuugagaaugaacuuuguagaugacaaugucaugucuugguaucaaaaguuuagacauccuacaagaauggccauaagccaagaugguugguauauaggaauccugauaugucaggagagacacaaagggaaagagaaaccaaaguacaggaaccauauggaaugaauuacagaucccaaagagauuaggggugccagugugaagccaaugggaagccugggcauacggggagcccagccuuaaaggcaugugugucuccaggggauaaacugcgggacugcauuuuuauuaaggaguccuccacugugcuuucaggugggaaugguggaucugggccgguggcuaagaaaauacauggugagaaugauguguccuuggcuccauucuuggugacuauguuuuguugugguuagcagcuaugggaucuguuaggucugggggucaaugggaugaggagaaggcuacugcagaguguguguguuggggggggauuaauuaggccacagacaguggaguacagcuggguuaaauccaaagauggguguugagacagcaacugugucaaacacauuggugacaauguagaggauggcaaagagaaagauggcagccagagagacucuaggugggaggaauccuggcuucuccaggacacuucuacugcugguuuugaugccuacaaguccaggcugcugugugcuugugugucacccuagcauccucccccacacacccucauuaguucuugagcccaaaagacccacuaucacgauccuuccaugugagggacgaaagccaacacagagaggccagguaucugguacuggacaugucagcgagccauggcgccuuagcugcaggcagcuuuccacacacauucucugcuuuuccuacccuucagacucaggaaagcagacccgaggugacucugaagccaccaggagagcacauuauuccauuaccaccagcguggaugccagggaugaucgcauccaccuguaauuccaguauuggcggguggagacaagaggaucaggaauuccaggagagccauggcuguaugguuuaaggacagccuaggcucuaugagacucaaaacacaaacaaaaacaaaacccaguugaguauggugguguacaaccuuaucccagcacuaagcaggcagagaaucuguuaguuugagcucagccuggucuacauagcaagguccauccagccagagcuacauagcaagacauaaucuauguuccgucauacccaauaguaccuuucuagcaucaaauaagcuuucccccuguucugcauaaugcuguuagacagagagcaaagcccucaccaccuacauugaugcuuuuggaucuugcaucuaaauuguguuccuggcccaucaccaaauccucccauucuuuugugugucuuuuugcauuuguccugacaccaaacccuauuugguucucuuauucaaagauacuugcacucaugcauauaugcaugcacacacacacuuuaaccaugguaggagcugaaccuaaggccucgcauacaauaagcaaguuucuucuagcacugagcuacaccucuagccacugguucgcuaagucagcgucucacagugugucccaggcuagucuugaacucaugauccuacugccucggccuuccaagucagccaugugccaccaugcuuggcuuuagauaucuauuuuggggacuggagaggggacucagcacuuaagaucacuuguugcucuugcagaggacaccgguuugguucccagaaccugcacaguagcuuacaaccauucauaacuccaguuccagggggaccugacaccugcuucugaacaucacaugggcaccagauaugcacaugaugcacauacacacacguaggcaagacacgcauauacauggagacuggagagagacucagagcuuaagagcacuugcugcucuucuggaggaccuggguucaauccccaccaugcacaggauggcucacagcaaucuguagcucaaguuccaaggguucggauacacucuucuggcugcugugggcacugggcacacacauugugcacauguguacauguaaagcagacaccauucucauaaaacuuuuauaaaaccacucauauacaugaaauaaauauaaaauuuuaaauacauauuuuauugguacuuacgugugugggauauguauguguucaugagauuuaaugccacauguguauaggcacucucagaggccagaagaggauguuagaucuaugggagcugaaguuauagguuauugugaggcuccugacauggaugcuagggacugaacucugcuccucuggaagagcagcaagaacucuuaaucacugagccauccuucuagcuuuaagauguguacuuuuaaagugaguucauuagugcugcacuauagauccagccuugauguccaugaacagaagacaaagcaaggaaaaauguggaggcuauacaugauggaacuuacugagcuguaagacaaaugaauaggacauuuaaagaacaaaggaagagcugggcagugguggcgcacgccuuuaauuccagcacucgggagguagaggcagguggauuucugaguuugaggccagccuggucuacggagugaguuccaggacggucagggcuacacagagaaacccugucuagaaaaaacaaaacaaaacaaacaaacaaaacaaaggcugaaacugaggaccauuguguuaaaggaaauuauccagacucagaaccucagaacaacaaaucauccacucuuucucucauauauggaaucuagauuaaaguaagaguguguguguguguguguguguguguguguguguguguguguguguguuugcgcgugccacagaaggagaagcaggacuacaaaaggggagccaaaggucuaaaggguggagagaggaaaaggaugguaauggaauacaggugacaggaaaagggcgggacuguagggggaagacagggaaagaugggaaacccauaagaacaagguguaauuauauguaacuaugaauauuuacauauucauuuguaugugguuguuuauuaaaaugccacgaggaaagccauuacuuuguauguuaaauuuaaaagguuaauaaaaugugaaacaugaauucaugaauuggaauguuucucuuucuacgccacacuccagugguauuuuagaaaaauccuccuaguguucucucuucauaaagucaauuuguaaaaucauacacuucaauuaagaaugucauauccacaugcuuuauaagugucauucuuguuugccuauggucauucugguaaguugagcacgauuucauuaagaacaugcuaaaccccugagcauaaacugaccguaaaaacauagaggaaauguaagauuuaaauagaguguguuagacauuugaguugcugguggcacugccugcaccuuuguacuuuggggcuucucuuuauacuagguuuuauaagcagauaaacacgugugucucauccaugcccucccaacaaggagagauagcgcccccucuccagcagcacaaaaggccugucagaaucucaccaggugcaugucuguccuaacuccaugucuuucuacccuaaccuccaaugagcaugugagagucaagacacaaguuuuucuuggcauucuuugagaugcauuaugaaaccaucaaccaccaauuugcagaccaaaugauacuacagaggggaaaauguauccuuuuguucauuugauacgauuagaguaauugucucacauaaaucgccucuaguugacauguuugaacaaacuaguaaagacugggcaaagacauggauaaacuuaguuuuccugagacaaggucucuuauagcccaggcuagccuugaauuuacuguacagcccaggcuggcuuuuaacaccuguuucuucuaccuccacuuccugagugcugggauuagagguaagcaccaccaggcucugcaaacuuuuuuuuuuuauuaucauacauuuuuaaacauuuauuuuagguguuggagaguggcucaccacccgcuugauagcucacaccuguaaacuucaguuucaggaauccgacacccucuuuuggcuuuuugugagcaccaggcaggcaaaauacucauguguauaaaauuaaaguaaauaaguauuuuauuuuaguuaguuaguuauaugugucugucucuguauuuguccaugugcacaugugugcaggugccacagaggccagaagacggugucuuauccccuggaacugggguuaccagcgauugugagccauggacaaggacucucuggagcguuccuaaccacugagcaucccuccauucccucaggauuaugcuuuuuaagcaaagggcuaaaaacuugauuaucuuuacucugguguguuugaguuuauguuuggggaaagucuuuguucuuuuuuuuuuuaagauuuauuuauuacauauaaguacacuguagcugucgucagacaccacagaagagggcaucagaucucauuauggaugguugugagccaccaugugguugcugggauuugaacucaggaccuucggaagagcagucagugcucuuaaucacugagcccuucagugauuaagagcacuccagcccucagucuuuguucuuaaccugaggugguggaauggucucaugggagagugaggcuugaucugggcuguaaagggauuuaggaggcagucgggauacaguuugggcacagugcggaguuuaagaggaugugcuuggauacaagauccuguggagucaagccagagaccagaaaaugucugacacucuauauggagcaauuuuaaagcuguaaacaggaaagggagggaaaagugcugagcuacucuaaauaauagccagaucguuuuugaaugggcaucaauauauacuuaucaccuguuguagcaauucuacacauaagcgcuuauccaggggaaaugacagcauaugcccuaagaaacacuggacucuggucaaguacuccuagcagccugguuccucauagcugaagauuuugaggagagugggcugaagaguucugccuuccacauagcucucucucucucucucucucucucucucucucucucucucucucuuacacacacacaccacauacacacaggcacaugcaugcacuagugaagggccauuugcucuucucaaugcacuccuuuagagccccccuaagugugagacaacugcuuccaggaaggacggagugucccacagggauggguggguguauagugaugaaauggaaauucugauuugggggaggagcuugcuggugcaaaagaucagcucucuguguaugggggacaggauaggugacuguuaaaguccuccacugugaaggucuaugaucccaaaggaaacuagaaaauccaguuauguuuggccaaaggcuguguucuuggcuccagacaacaggaagauguuccucuguguuccuuccucuuagccagagcaggcucaucuuucauguagcuggugcuguguggagcugggauacacugucuuuccuugcccguuaauccagggccuggccgcuagugguuuuacaggaacuauuccuucuuuucacuggaguauuuaugagucuuaggagagcacagcaagugugaugggaccuuuucucguuuccucaccaagagacgucaccucacuggcucccuccagucuuagcuauaaacuguuucucugaccucuuccccucaccccaacaauccaucauccagccauucauauucacagcauaccuacucuacuuugugucagucacucugccgggaagccgaggucuccuguuucacauuaucagucacuagccuccucuucagucuuccugcaccccugcccuuuggacaaagagagcaugugcccagggagugagaggccccucacccuagcuucugccugacucaaaugcaucgagccauguguggcuuaaagccaacccacuguccaauguguuuuugugguuugcccaugcugcuguccuugcccugcccccacccucucucccugccuggggaaguugcugaguuagaagccccugucucagccagcacaagguucccuguggguaugaugguuuuucuugugcuacauccagcuagacuugaacucugcaaggucugggacucuuccacucaucuuuauaucacaccaaagauggauaaaggacugaaggucacuguggucagcaggaugggaggccaguuggaagaagaaagcagaacucucaucauccuuaggagauguugaacauagcagcuucauggguuugaagucacuacagauuucacuuagggugucgauacuuucuuacugucaacgaguguucucuaugaguguagggaacuucuuguggcauggagcucacuuccucuuauuguagacauuuauuucguauuugguuuuugacacaaagugccacggaaugcauuuaugccuucgccuuuacuucauuuggaugaauucccaggaagacaauuaccaucagaggacaguaacacuguuaaggauugagagacaauagcaauuuggcucccagggagggugugccagugucugcucccaacuacaguuuuagaccagacccuacgcuguaggccugggaagccuggaacuuacuguagagcucaggccaggcucaaauucaugguuguccugccucaccuuccaaguacaaagaauauaggugcaggucacccuagaguuuguuuuuaaugauugaguuuauggagucucauucauucauucauucauucauucauuuuuguucuuucccuacugggaauagaacccaugguuuugcacgugccaggcuaggcaacuguucuaccauugagccacaccucccagcuuagguuuguggauucuuggggggggggggggggggaaugagggcaggcugugagauggcccagcaccagcuuaaugaccugaguucaaugcccuaaaaaucacauugagggagagaauagacucugaaagcuguccucugaccucaagcuguccucugaccuccacaugcuaaucauggcacgugugugcccgcacacacacauacuacuaaaagaguuaaauuuagauuuaaaaaaguaaaacccuaauaauacaaggaauggguaggaggacauggacaaacaaaaccauagcaccacuggcugcuuccaccugaccguggcuucaacuuggaggaaacuuucugugcaccuuucauuuugagagagacccaucaugcuagaguccuagggccaaucgucuggcguucagugacaaggccagccuuaucaguccagcugcccuuucccauggcacucuggaagagagagccucuggagcagggaagggaaggaagcugguacugaccucagcucucucugcagugcaagccauucuccaucagucacacauuuauuaaugaggagcucggcacucuggcuucuggaagccaggcugguuucaggaaaccucuugggaaugaacggaaaaugggacguggaugaagcauuuucugcugucuccgguggggaagucacacugugcauuuaucugcauagaaccuccuggcagcuuagcugagucauuugccuguaauugccgagaacugaauuuguagccucugggaccuacacgucuauggcaggacuaaaaaugcucacucuugcugacuuguacaaggacaaggacauuugugaagcauuauuuucucgauggccauauauagugagaauggcuuuuccuaaauuauggaaagggaauggguguguauggguguguguguguguguguguguguguguguaugcguauguguaugcauguguguagacacguguacuugcaugcauguaugcagaggccagggguugacccuggaugucuuccucagucacucucuacccuacacacugaggcagggucucucacuugacuccagagcucaccagucugauuuaucuagcuuaccaaugggaucccuugucucccuauugcugggauuauaggugggcuaucauacccaccuggcauauuuauuuacauuuuacccacugggccaucucuccaacuucaaauuaugccuuuaaguuaauaucacagugucucuuuaauuaguuuuaaaaugaauuaggcuggggcugaggcaagagaaucaccucuccuuugaggacaguuugagcuacauaguauauucuagaacagcuugggcuacagaggguggccuucucucaaaacaacaauccaaauccaaaauaaauaaauaagaguaaaaaaugauuuagggauuuugauuguuugguauugguuuuuuugagacagaguuucucuauguagccccaacuggccucaaacucagagauuugacugccuaaaugcugggauucaagacaugugccagcagggauuugaacugagcacgauaagaugggacaccgugagagugcuaucaugcugauccuguuaagucucugguuucauuucauugaugaagugagaguuccugcuggagugggcuaggugacuuuaagguaccuggugaccaugaguuaaugugguccuggacuguggccuuugcagcauauaccuggguugucugagcaugcuaucuugggaaggacacaugcacuagguuuuuauuuuguagaugaagaaacugaaacagagaaguuuaauaacuuaagaucauaaagccaauaccugguagaaaugaggaaaaaacacuucccucuaaagcccauauccugcuuagcacucaaggggcugcuugcucuggcaggagcuggaaguuagcccacuucaucaucugcucgagaggaggauggacuguguccucgacuccuggcuggcuaagauggugccugcuggugaugugaucuguagaguugcccuggcagcggccccucagggugagcuucagagagaacgcuuuagagaugugccacauuuccuggcuuugaugcucucagcuguccucuggaacaacagagaaaguagaugaguuuggaucaagaaguagaauuuggacuggaccaaugaguggaggcucccaggcaacagauuuagggcaacaaauggcuccuuugcuaaggccacccuggacaacauuagugguuuaaaaaaaauaaauaaauaaaaaagagaggaggaugcagcuuagugagaggaugcuugcuaauguuuauaagguucuagguucaaucccaggaccaccaaaaacccaaaaguaaaaccgcuccuuagagugggcucugugggcccacugagcugcugccggggugagcuagguggcuuucaagguaccugugaccaugaauuaauguggcccuggacuguggccuuggcagcauauacuuggauuaucugaacaugcuauauuggagggacacauacaauaguuuuauuagcauccuuguguugaggaauagagccagcguaucaauauucucacugugaguucaaggcuggccuagucuacauagcaaauuccaggacagccggagcuacaugauagagagacugugucuugaaaaauaacagcaaagagaaagguguccuuucucguuauccugccuugccuccucgcccucugccuagccagagagaugaaacacaccucucuuuuccuguuugccucugggaucaacucuuuguuuuccaccaugcaaaggaaagcugugucagcacucugccuugcugacccggauuuccaucugcugggacaaagagaugcaggaaaaaaaaaauucuuuuaagccugaaauuuccaggaauauaucauagcaaagguugacugcccaugagucuucuggugcccuauagaagcuuugcuuagccucaucauuguuugggugccuggcaccaucaccccacuaacucaggaugcagagcaggugugacucaguccugcucuuugguguccuucagggaagacagaaccucacagaacaaaggcauagcccaagucacgugaaagugagaggaugcaugccugagauggaggacacacuagucaguacccaguaugguagcgcccucuguucacuguggacucaccagugacacagcacugugggcacucacugcaccacagaugcaguauccagagaugcuucagaguuagcgcuuuaauuucagauuuuggaaugcuucacacacauacacacucaugcacacacauaugcacacacacacacacacaccugcauacacagagacacacauauacacacucaauaucacuuguggguagaacccaaguugcaacacaaagucaucuuugggaugguccugguugaacacgcccaugaucccagcuugugagaagcugaggcaggaggaccaggagcucaguaaagcucaccuacacagcuaguccuaagacaagcuuggguuauguuagacucugucucaugaaagcagaagaaaaaagaaaggaauucauaugggggugggugagaggguuagcugguaaaaguguucuuagcuacuaagccaucucucuaccccagcuccaaagcuaacucuucuugauauccugcuucucuccuuuucucuccuuucuaguaaccuaauugcauccauucuuuacaaagcaagugguaugguuguuaaagaguaggucucaccuaugguacuugaaggaccagcuuuauuucccaaguaagcaaaacaagcugccugucguuuauaguguaaccgucucagcagggagcaguauuuuucuguaaagauuugcuuuucugagcugaagagaugguccaaguuaaaggcauuugaugcucuuccaaaggacugaaguugaauucccagcauccaugucugggucacacaugcuuacacauacacacacauaaaugauaagaugaaucuuaaaaauaaauuguucuucaaagcauaauaucucugagagccagauacaugggugccuuaggaagccugcaugaagaggcccccuugugccagcagaccuccggaggcccgcaucgccugcaggaaucaauccccugugauguguucuuaucccaccgcgcccugcugccugagccuccccagcagggagcacacaggaggauucuuagccuugaccuugguggcuguguuugcuugcuagcucuucugcacuugcucauaauuaagacgugcuaggagaucaccucagauuuucaguuuuguucgcugaaggaagcuggcaguuuuccagcugguuuucuuuucgcggguuuguggucuaaugagagcggcauucuggacgugagccaagcaucccucuuucacaggaucuuuguccucccaggagcaggugagacgaagcuuccagccuguacauaauucaccucccuucguucuuccuccauuccagguuaggugauagcacagcuuuuguuggcugcccuucauauaauagagaaacauagcagugguccuccucugagaaucccacacccuugcucucagguguuuuacguucuucccaagcaacuuucauugcuuaagaaauucaacuguuucauuagagagagaggagacagagagagagagagagagagagagagagagagagagaaagagaaagagagaaagagaggaaagagcaggaugccucuguggguaaaguacaugccugcaagcgcuguggucuggguuugauccaagggaccacaguaggaggagagaucugccccccaaaaguugccuucugacaucuauauguauacuaugacaugcauguucuugcaccaauaucucucucucucacacacacacacacaaauauauaauauaauauauauaauguguauauauguguguguguauauauaguauguguguauuuaugauuauauauaugugauuguauacauauauauuuguguauguguguauaugauuauauaucauuuuuaaaaaucaaauaaauauauaagaugacaguaggaacauguugggcuggggguauagcuugguuuguagagcccuugccuagaauguucaaggccugagguucaguccccagaaccacauaauccugucuuaguaguaaauaccugagcaccugggagguggaggcaggaggaucagaauucaaugccauucuuggcuacauagugaguuggaguccaaccagccugcaauacaagagauccugucucaaaaacauuuuuuuuuucuaguugaaacauauacuucccccaucucuuuuucuuccuuuucuguuuaguacuagacauugagcccagggccuggaacgugccaaacacguauuguaccacuaaccacacccugagcuccaacagaagucuguuugcuggggaacuuccaaauggaaagaaauacauaggcauuuuuccuucugaaaaaccagaaccacuuaaaaaugucuacauugccucugagcuuguucucaaaugucacuucccuagugggacauagcuagguuauacaagcgcucagcagaacuuugccccuugugagaucagacacugaaacacucuccauacuuaucaaucaucucccacuguguacacgguuggcguuuuguuuguuguuugcuuucugugaauuuagcaguagacagacuugguaagccuuguaagucgacucacugggaaucuaccuuuucugcuuggcucauuucacuuaguguaauguccucuugguuguagcuugugucugaauuuccuucccuuuucagacugaauacauuaauaccuucuauacacagucuagaguuugcuuauucauuuauccauugaugggcauuuguauugcuuccauuucuuggcuguugugaauuguggugcuaugagcacagguguguaacuaucucugcgaggacuauuuuugguggcucagcugccugcuacuuuguuaacuuggaugaugaugaugaugauggugaugggaaaucuugccauguaccucaggcugaccuacaacucauaguccuccugccucagcugcccgagcaaugggcuuacagauguguaccccauguccaguuagcagauauuaaccgaugaggaauucagcaauagaacccaucagacuagccucacuuaguaauauuuccacauugucauaggcucauaugcauaaaggauggggucccuguuuaugagcgaggagauggaagggacuggauucauacaugggcagaugucucugacugaugguaugaaacucugcugcaagggaagcugcaaagugaucauaaaacuugaucacucuagguucauaggacaaaaaaacuuuccuaccuggggcaugccaaacacuucucacguugguuaugugcacucaggaugcucaccuccccuucugucugccuagaaugacuugcugugguggaagagcacccggcagaagaugugggcuggcugucgaguagaugcuaaccacaggcuuacaauugguuacaacaaguuugcagcgaauuccuuccuaauggccaugugcuaacgguucaugaggagaacuuccccugucauccaugauggucccacucuggucaccucucugcccuucugcaagaucccacaugaacccgacuauucuugggaagauacauucuuccuuagucuacuuacacucagagauucaugagcuauauuuucuggggccuaaauuuuucuuuucaauguacauguguaugacuccugugugugugugugugugugugugugucugugugugugugucugugugugucugugugugucugugugugugugugucugugugugucugugugugucugugugucuguguguguguuaaggcauuaacauuuguuguuguuuguuuauuuguuuguuugguggcaguacuagauauugaaacuagagcuucacccaugguaagcaguugcucuaccacugagcuauauuuccaucccuaggucagaaacauuuuggugaacauacugcugagaccugcuccuagaccccgugcugcuggagcugaagucuccugcuuauccuuguuccuuuaccuuugaaaaauggaguguaauuugugcauaguggaaugaaccuuauuuuuuuuuaaauuucccuguauaguuccaugagcuucaacaaaugcauacagucauuaagcugccaugcacuauaaagaaagagaaaguauuugacuuccaaaagacaacuuuagcccaguccguucccagucuuuggcacauuguaugauuuccauuuuggugucuuugccuuuucaguaugaaaacacauuagaaauugaccuauaccauguggucuucugagcuggcuucuuccaugcugccugguauguuuguaucucauccacacugcauguugccuguccaugcccagcacuggcagugccgauagcugagcacucagagagcucagagccuagggauggagaaggcacucgaaccauugcucuaggucuuuagauggguuugccucacugcuaacccagccugagacuucacucuuuuggaaguaucaaaugggauuggaaagagcauuuugaagucaggcagauuguuugaagccagcucacccacuuagcaucgaaugaccuuguguugaccaugauagagugaggacuggcuugucugauggaugaaugaauaugugagugaugaauaaccuacugaagucuuaguugccuucuguguuagaagcuccuuuacacgacugcuguaucauugucugguaucaccugugguggacauccguaagguuugucuuguuccauggcuguccuugaaagucaguccuucagacuggcuugugcugaggaugcagaccucaaaggugguuagaccugagcaccugcugcgugucaugcauaugcuaugaagaccagauaaaugcagagcagauaaauacucaggaagccccacaggcaucugcuggcuugaagcucacaaguccaguuuagagagcucccugaacguucucccuccccuuccuuagugauacagaaaagauucgauggguucuucccuuuccccaaacguguaccaaucgggggcucuagaagaaguccccuggaguaaagaagcacgguccuuuuagcagaugaccccuuuccucccaaccaggagucaucucugacucucgcaucugagaagggaaaugggcugggaucuagguagccacagagcugucacucaaaaagaauguguucuuuucuucaaaguagacccaagaguguguggugacucaucauguuggcaaucccagcauccaaguggccaagauaggagcacugcugugaauccacagccacugugggcugcagccugagacccugaccaaaacgcuaagcaaacagaaacaggacugucgggacucaccaugcugacuuuuauuaaucaguuauuuacauaauuaucuguuugcugguuguuuucccugccaggagacccagggcacacaguaauugcuuauuuuuucuuauauauauauguaauauauauauaagcauuauguauuuguacagguauguguguguguuugugugugcaugugugugugugugucacucgcacauguaguacacgcaugccauagugcuuuuguggaggucagaggauaacuuugccaagucaguucucuccuuccugcacuguguaccaugggcuaccuggcccugugcuucuagcccaucucucaggaggagugcugggacugcacacacgcaccaccauauccagccuuguguguggguuccagggauggagcucaaguugucaugcuuagaugacaagcacuuuuacccacugcaccauuuccccaaccauuucccaauaaguacuugguuguugaaugaaaaggguuugugguuuaaaaaaaaaccaaacaaacuggcauuugaaguuacuauuucugagaggaaauaaauagagaaagaaacuagcaauugugagucauacgcaauuuguuuuugauauuaagucuuuuccuacagccuccuucuuuagcuuacagcggcucuuguacgucguuguucuugcccauuguagucaaggaaacagaugcaaaacagugaagagccucguucccagucucauagcuaguggagcuggauucaaacuuaggucugauguccaagccuagcuucuuucuacccacaaacaaguaagcgucuuaaaaauggaacucccuacaauuuagauuucaaaacaaaaauggaaaaaaaaaagauucagaaacuugagcaggaguugcguggguuagaucagaguuuaacagagcuaauuaagaauucacacaacugucaguuuccuacuuacaucagauuucugggucuucuguuauccuaaauuggauugagagcauuuccauaauccaauuuagauguguguuuucuucuuuuuucuuuucuuuucuuuagacacaaugcaauaaaacccucuguucucagagaggcuagauaggcuuuggaguugaguccuggguuucaguguuacagggcugggggagggucuuagcagcucccccucacucugaaacuccaguuuuccuuuguacgugggaaaggaaccccagcaauguuagcaucuuagagguugucaccuggaucaaaggagcagaugguagaacauggugugugacagggcuagccuagggagaaguguguguccauuagucagugaagaacugcagagaacaguaacaggaacuuggaacaguuugggaaggagggcugcuugcaggcuggcagaagcacacaccaagguaagaaagaaggacauguccucuuucuguucugccaagauuggcucaggcugagaaagccugaccugcuugggugacccuccaugugcuuagggccuguagucauaccucugugcagugccaggaaaucgauauuuaacauggggccaaagaagacuuguguuagacaagauagcuaaaagauagguggccacauucucucugauuuuuuuaaagauuugcuugcgcacgcgcacacucgugugugugugugugugugugugugugugugugugugugccugccuaaguaugugugcaccagauaaaugcaugugccagaggaagccagaagaggaugucagacgcccucaaacuaguuacagauugucaaccaccugguauggguguuggagaccaaaccuauauccuguucaagagcagccagcacucuuaaccaaugagcuagcucuccagccccacucucucccuccuuuacuucuaugccuuccacucagggaccguuugcaggcaccgagcuacacaguaucaggagggcggaguaucauggugugaggagacaggcaguggacucauacugcugggcuggagcuuggcgcccugucuaagugugaaacuaaaugaucuaaauucacuaaacuuuaguuucuucaccugucuucagagaaaaccaguaaugauaccugacuucgaugaagacuagaaauuauguuuguugguaacuuugccauuucuccuguguaguaaacauucagcagaugaauaucuagagacccagauacgcagggcgcaagggcugcuguuuuccuguuucuucccccagccuauuggaaggccuucauggguuaguagaaccuggaggguugggaccacggcaacggaggcccagguggcuuucugugccaugggaaccugaagcucugugcucagagugagcaacuccaccccgcagaaguuucuggugcugcuagugagcgagggcauuccccguggaggggugggaaaggccagagucucacagaagcauccuccuaauguaucugagacucucggaacucagcgggccuugaagaugcaccauaguuuuugugagucuuugcuuuguuacaccugggcucucugacaucaccauauccugauuaucucagcauggaagcugaaaucaagucagcuuucuccauuuuuggaggugugcacacacagcucacuaaugaguaugaauuccacccaaaguuucuguauuuguuuuuaguuuuuagauauaaagccaagggguuucucuugcucuccuuccccaacccuuacccccuuccuguuuuccccacagaguagaacccacuccucuuccaugucccauccauucugcugucuucuuuucucccucuccaauccucccucaugacuuuuuuccucucauaguccccuuuccauuuaguuucaugacuuaggccaacuuagauacacacacauucacacacacauucauauacauacucacacaugcucacagucacacacacacacauucacacacucacucauguacacauucacacacacucacagucauacaaacacacucacacagucacacauacacacaaauuaaaaguccaagauccacgcuaaggagaugucucaaucuguuaagugauuauucacuguacagccauuaauauggaaguuucuaaaaaacuaaaaauaaaaccaccauaugacccaucuaaccacuccuggacacauacuuaauggaaugaagucuuaucaugagauaccaccacaucuuuauuuaucacuggacugcucaccacaacuggaaauggagccagccuaacuaccugucagcagaggaauagauaaagaaaaugcaguccauggauguaacggaauuuuacucugucauuaauuaaaaugaaaucaugacauuugcaacuuuuguguuuuuaagugucuaauuuguggagccaaguuaguaaaugcacccacccuuaucaaugagaggccuuuggggggguuauuuaucuguuuguuuuuacugugaacuugaaucugaguuuuacaagcccguaccauugaauauccaccaucacagucaagguccccaaaguuccucacaugccuuuguggccauccuuucuggccugagaccaugucauuguguuuguucuuauaauguuccacucucagaacaguauggaaauaggauuguaccacacauugccuuuugaguuuguuucuuuuguuuccauaaugcauuucauaauccaaauguucuuuauugcagugagguaagugguucugagauuggccugguaaaucaacgcauuccuacauaccguugauaaucaaugagagaucuaacuuaaaaauugacuguauuaggucugcaagcuaguucagugaguaaagaugcuugcugccaagccagugugaccccaguauccacugaggagaugacgagaagcacauccugacaauuguucuuugaucuccauagguaauccacggcaggguacacaugcacacacacacacacacacacacacacacacacacacaccccuguggcucacaccuguaaucccaguucuuagagguggaggcaggacgaucaggaguuaguuucuaggccagucuggguuauaugagaccuugucucaaacaaacaaacaaacaaauguaagcuucuauagaaaaacaaaaaguggggcugggauggagagaguugacccuggcugcucuuccagaggaccuggguucaguugccagcacucacaauggcagcuuacaacugucuguaacuggaguuccagggacacccucaugcagacauaugugcaggcaaaacacuaaucaaugcucauaaaauaaaaauaaagaaauacuuuguaaagaaaagaaagaaaaacagagccaagacuagccaggaaaguuuuaagacuaucaggauuuacuccaaagcuuuguuuaucaaguucauguuuaucaaguuauuauuaagauaccaugucaguagaauaaacuagacagcugaaaaauaaauacucaacauuucagaauauuuacauuugacaggguagcgcuacuuaacaaugggaaagaguucagcaaaugugcaggagagaauugguauccaagcagaacacuggaauuuucugcuuggaucccaauucaauaacauugaauauucaguaacauugaauccccaauugauguuacauagaaaauauauuccagaugaguuaaaaaucuaauaguagaaaagcaaacucuaaaagauuugugugugcacaggaugugugugugcacauguuugugugugugcaauuuuaugugugugcguguguuugcauguuuucauguuuacauacacucaugugugcacauauguuugcguguguguacgguugcauguggguuguaugugcaugcacguggugcccagaaggcuuccucugaccuucugucugauuuuuugacauagucucuuacugaaaauggugcuuuucugacccagcuguccucaggccucugccucuuuagcaauugaauuacaggucucacugccguguacagcuuuaaauuguuuaaaauucuuuuuauugugcauuuguguaacgugcgauacaugcaugugaguucaagugccaguggaugccucagcuccucuagagcaacaguuaugggcagccgugagcugccugaucugggucugggaauugaacucagggcugcugcaagagcuauacaaaaucuuaacugucaagccagcuccccagcccccauguccagcucuuuacaugguacuggggauccaagcucaggaccuugucuuauauagcaagcauuuuaucaaaucuguccagccuuuuaaaguuuaaaacuuuuaaaagaaaagguggaccaaacuuucuuuaaaauauaccaaaacaaguugucaaagagcaggguacuuguccauauaaaaugcccaacuuguggacaacaaaauacauugcaggcuaaguuccuggagcugauguucaggaaggcauuugcaaugcacaaguccaagaaaagaccuauaugcauaauucagaauucuuuaagaaucaguagaaagguaacuuuuuagagggcugugagcaggccagcuaagcagcucccuggggcgauagucagaaacaguugaugaacuuguacuugagagagugucagcaaggacaccauuucacauuccucgaacuggcagaagcuucagucugaugguaucguucugacaagaauggggagcacuagaacacucacacuugcaggaagagguagacacugguacuacugccaagugguuucaugucacauaguggaagaugcugcgcaugguuacccaauguccacaucuguuaaggugaggagaugaaacaccuuguguguugagagcucaguccuuagccagugcacgauuguggaaaggugaaggguugcaaaggcucugacuaauugaugagcuaauccaaugauggguucauaacuccuugcaucacugggagguaaugggaacuuuuauggaggaaccuuguuggaacagguaggucaaggugaggaugacccugagauucauccccugcucugggcuucucccuggcucccucuacuuccuggaugccaccagcuaagaggaucaugacuaagaucagcuuagacuauacagcuagacccugucucaaaaaucaaaggguuucugggggcugaagccauggcucagcuguuaaaagaacuuacugcucuugcagaagacaagggucuaguucccaacacccacccagugacucacaaccauucauaacucugguuccaacagaucagacuccuucuucugacauccacggguaccagucacacaugcacacaugcagacucauacgaguaaaauaaaaauaagcaaauccuuuaaaaaaaaccaaaagcuaauaaauagaacaucuaugucacaucucuuccaagauucauggaccauagaggaagugggagggggaguguaaaagauugggaggauugcaguguccuggacaugccuagacagcuucacuccugaacucaaagcaucuguggucucuugcaaaagacuggcauaagaucaagccaguuagccucccaacauagagugauaagggacucgugagccccaccccuagcugaagagguauugacaguucgugcucuuaggagagggagguuuugucccuauuagguagacuuagcuucaguggaugaccccaaacccaggaguauauggacaguacaaaauuggaugguuauuaaaaaccaaaacacaugaaguugggaagggguagggacaagcaaguggauucuuucauuauaaaauauggccaauguacauagaaaaguccaagaaucugaaaaccauagaagcugagcaugguggcacacaucuguaaucccagcccuugagaaguagaggcaggaggagcaggaguucgaggccagccugggcuacacaagacccuauauaaaaggaaggauuuguaaaaagagaaccagggcugaggauguagcucaguguguagagaggucaaauaguguucaugaaucccugaguucauccuaguaccacguaaacagucagaaugcaggccaggacucccaguauucaggaggcagaggcacaaagaucaggaggcuggggucaucuuagcuacagagagaauccgagguuggucuuggcuacauaagacacugucucaaacaccaaauauagcuagaauauggagaggcuucugagggggugagcaggauacacugaaguggcucuuuggggggaucuuaaaggauuaugggguucuguuaaggaaaagaaaaacuccugggguugauugguggcacuaaagauucgggaagcagagagaacugaagacuccaggccaccuggcuuaucaggaaagagcucugagacaggcugugaggcuggggacccaggcgugaggaguccuuggaagauggccuucuaagagacauuugauccugagcagacaugaagcucuagggcuguauguagcucaucaguagagccccuggcuggcagggcaaggcccuggguuuguccccuggcauucucccugcuuaaaucuccucagaauaguuuauuugguuuaaacagaagcagaugccaaaccccuucagcauggaccuguucuucaguucaagaaguaauuugcucauuacuucuugagaacuagccuuguugaucccagucucucuucccuggggaggugaaaugcuaagagcucuugaguuugaagagauucaaauguaaaugugucuguggaggacccuucuguugucaaacuggucucagacaaggagugcuagguacaaguccaugucuggagagauugucugauggaggccaggccucccuggcuagguaccucuugaguuuuucagcucuggcuucuaagaggguguuguggcucacuggaguucaccaaggugccacucaacaggccccuggauccaucuuucacuguuaaugugcugccucugaacaagggcuggaaaccagccugacagacauggauaaagacugcggcaucugugcgggggagcagcguguuuuuuuccgcagaguugcuggcaguaugcccgaggccuugcugauucagcauggugcugucugguauacaccucauugcagagaccucgugcaaggucacagguguccccugaaagacgcugacuuugaugucuccacugucuaaaacuucaugccauggauacauauuuacuggccucucuccuccaugccaggaauagggacauagauacaaauaaaacaggugcaagcucuggcucugggaugcccccgcucuaggaugccccaucuugugagagagacagaccuuagagagacugcccaagucuuggauaaggaugaggaagagaaacugcugguagcugugacaguggaggcaggacagggagaggagccugaucucagggaaggugacaaggccacgaaaggcuucaguacucucugauucccaagagugcuugggagugggacaggccaagagagggacaaaguaguuagagagacuccaccauugggucagcuguacuugaacccggggcuccucuggcaggccacacacuccuuggcccaccuucuuauucuucuuuuguuuuuuaaucacauuuauuuacuuacuuaguguggggggugggugggcaugcuggagggcaucauggcgcauguguagaagucagaggacaagugggagagucaguucucuccuuccaccccuaguuucccugggaucagacucaggucaucaggccuggagcugucucaccugcccuguuuugugcucugagacagggucuugcuauguugcacugacuggcuugagacacacucuguaaagcaaacugacuucuaccuugcuguaaucauccugucuuugucucuuaaguacuagaauuacaaucauuacccacuaugcccagcaucagcaccaugcccagcaucagcaccaugcccagcaucaccacuaugcucagcaucagcaccauacccagcaucagcaccaugcccagcaucagcacccaugcucagcaucagcaccaugcccagcaucagcacccaugcccagcaucagcacccaugcucagcaucagcaccaugcccagcaucagcacccaugcccacuaucaccaucaugcucagcaucaccaccaugcccagcaucagcaccguguccagcaguaccaccauacccagcauugucuucuuaaauuccuucacucccauugccauccuuacucuuccuuccagccccuuuucuuucguccccuuuucuugcuuaucuggauucuuaugccucucaucucagccaauggugacaggaaaucaggcuuggaagaggccagacuaucuggauucagccccugcuuuacuccuuccuuaaugauuaugagaccuugggcaagcaaguggccagccucucugagcauugaggcucuaugugcaugagggggguucuuuggccagagaagucuaagauauaagguuuguaaaguacuugaaacaggcauuuguguacacacacacacacacacacacacaccuuccuacugugucagaacugaccugguucuguuauuuuccauagacauugauguccccagccacagugcuccugguaaagcuauccccugcuugguuaacugcaucucuuuucuaugacucuaaaugccuaauagguauuaacuuuggauauucucagcaugguaucuuuaauaacaagaauggaucaccaaguucugucugagguugccagcuccuuuaagaucugagacuguguagcuuuuguacccagucuguuugcacugaggugacaauugcaaguggcuuugucauuugaaguaaaaguaugaagcccuucuaggucugacacucuguucauuuaaaaauaccuauuaggcugugugugguggugccaccuugaauuccagaacucaggagacauuagcagccagaacucuugagagucugaggccguccuggucuacauaggccaaccagagcuacaaagugagacucuguuucagaaacauaaauauauacuggguggguaaaauggcucaguguguaaaggugcuugcugccaagccugaugaccugaguucgaucccugggacucacauuguggaaccaaaaauacugacucucacaaguuguccucugacuuccaugugugugucaugguacccauuugaauacauacacaaaugaauaaauuuuuaaaacaccuguucucaggcauagaguugcaugccugcaaccccaguacucggcaggcugagccaaggaggucuucagguugagguccgccuagagcaaauaaugaggaccugugcucagcccucggugcauuuauaguucacuggugagaugccuaucaaagugccaagugaaagaacaccaugaugcuauguacaagaugcugagaaaguucauugggaagaguugagcuagucugggaagucagagggguguccagagaaucaugugggagucgggaucuaauggaugagcagguauuaauaaaaaaaaaaaaaaaaaaaaaaaaagacagggaagauuccagaagaaagcagcauugacaaagguaagguaucaagaacgggcagguagagcuuccccugaagauggaucucagaugcaggccugagaguuaacuacucacugacccuagugagagaagugaaggcagaggaggugugcugaugggaggagauguggaccugguuagauuugugaauaugaaagcuuaugcuggcugcaagaugcugaggccaaauucaaugauccuaggcuuccagcaucugcugguggagaucaacaucaggagaggaagccauccuuccacagagccuuagcugcugucuccuccugucuuaaccuccauaauucuuggucgcccuuccauauugcccaagccaagauagaaggaaguguguggguggcugucucaggaaaagguguuucuaagaauuauguagcagugaacgggaaaccuucaggggaguuauuucccuggcuugaaugguucccuggauaugauguuuuaugauuuccaucaagcaggaugggugaaaaucaugucucucuuuuuccuuugucucgucucugcaggcuuauauuuggcacccuuuauccugcauauuauucauacaaggcugugaaguccaaggacauuaaagaauauguaagugaagccgcucacugggggcggguggcucagcgugaaugguggaggaacuugucccuuagucugggucuguggcagaagggaaccuaucacccuucucaugugacuccucagaaguccuguccccauccaaagcuguccccuguccagacccuaaguaucaaagugaggaaagcagcgaacuguaaggagaaacugaaucugggacucggggucaggugccauggugacuucaucucucuggccaguucccucacccggggaacugcagaccacagaccacagaccaccuucuucccccagagacggcacacagguuugagaagccaugugaccuggguuauuaccuggcucgcugguucugacccgcuuccagucuguccuccgacaccaguuuuagccugguugacgugucagcucuuugaggguggggguguuccuaaucagcucucugcagcacuuggcagagagcugagcccauggcaauggaaaagcaaaaucuuuuaaaguaugaauggauuaauucagagcuagcuugaaagucauuauuuucguggauuucccaagaagucuuuaugaugaacaccuccaguucagcugcaaccaaagcccagcccccuugcucccuguucccagaaccacuuacuucagcugcuccuaacaggggacccagagugggugacuucuggaggcccaucccugguaugugugaggacagcccugugcccaugcuauaaauagccaaaaagcugcaaacacagaggcucccaguucucaacugacacagcccaggcuaaagcaauaggcagcuucuucuuccagugcuucccccucccgagcccuccccaccugugguacucagcagcugggccugggagggaggccuuacugaggucucuguaauucaaggcugauccgcuccagggcaggggcugagcacgcuugcucgcaggcagcugggcgagaucaaacccugguaaaucguucugugcugacucagcucacaggagccugguguauggccagaguggcagcucauucauuuugagugagaccuaacugacaaguagaacagcugucuguuggcuggggugugcacacuuccccaugggggagcuuggcaguuaagguuagaagguuucuggguaaaacuggcuuugggagaugggagcugaggagaaucaggggagacuugccuccuccugcugccccucacacacgcacacugucacauauguucagugcguacucucaaagcccccacucuagcaugcucagugccauaucacaugugcacucacacgguucauguuuccuucuuguggucuguuugauuuuauuucuguugcugugaugaaaugcucggacuaggggcuggagagaugguucagugguaagagcacuugcuguuuuuccagaggaccugaauuaaguggcucucaacaccuguuacuccaauucuagggcaucugaugcccuuuucugcucucugaaagcaccuaaacacacauuacuacacacucacgcacacacacacacacacacacacacucacacgcagagagagagagcaaggcacagagacacagacagacagacaggaauuaaaaaaauaaaaagaaaucuuaaaacuuuaaauaaggaaacacuuugaccaaaagcaacuuuggggaagaaaagaaguuggcuuaaacgucuagaugacuccaucacugaugaucuccaucacugagagaagcaagggcaagaacucaagcaggaucuuaaaggcaggcugcuugcuagucaugcaggagugccucuaacauagaaauucacucacagccaaggaagucuagcagaaccauggcaaaugcuguuuugauggcucacuugggcucauggucagcuaacuuccuuauaccaccuaguaccaccugcccagggauuggcgcugcccacagugggcagaucccucccauaucaauuaacaaucaagacagucucucauaggcauggccacaggucaauuugaucuagggaauuauuuuucuuuuuuucuuucuuuuuuauucuucucucauauauuacacccugccugcaguuucucuccccccccccccacccaccuuccccuuucuccaugaucaacccccuuccaccuccccucagaaaagaccaggcaggccucccagggacaucaaccaaacacuggauaacaagcuacaguaagacccagcaacagugaggcccggcauguaccaucaucaaggcuggacaaggcaacccagcaggaggaaaggaguugacaaaagagucaggaacagccccugcucccaauguuaagauucccacaaaaaaacacauccguagcacauaaguagaggaccuaggucagacccauacagguucccugcucucuuaaguucccaugagucccagucaguugauucugugggcugugugucccugacccgucuggcuccucugauccuuccuccugcuccucugcagggcucccugggcugcccaaugguuggcuguaggacucugcaccuguccccaucaguugcuggaugaacucucuccggacucuuugauguuuguuuuguuaggcucuggucccagaacacgcugcaggcaggacaagcuauagguugaaggucuuguggcuggguuggugucccaaucccuccacuugaggccuugccugguuacagaagauggcugguucaggcccccuguccuucauuacuaggagucuuugcaaggauuauucucggagagcccacgggguuuccauugcacuggguuuccaccuugccauugaaaugccccccaauuccagucauuucucuaaauauuuucugccccccaacacccuguucccaaccccacccacccucagugcagcccugaaaucuagucuauuucgaucucuugaauuucuugaugaagauuuucuuccauaugauucucagcuguggcaccucauaaccccauuuguacaggagacgaccuggaacuuucccgggacuccagccucuccuucacuauccagcugcaucacuucucaugcccaguuggugacugugcccaucauccucagggccaugucaucucccaacgcagaucuccugucguucucuacagccgcucccuggggucugcuucagaucauuuucccugagaagagucaguggucucuugaacuagcuuuuaaacauauuuauuuauuguuuuuaaauugguuauacccgaaauuauauucauuaucuauaauuuauaaaauauguacaaaaacauagguuauugaauaaugcuauuuuauuuuauuuuauuuuauuuuauuuuauggguauggauguuuugccugcuuguccuaguguaccaugugcccgcagugcccucaguagccagaaaagggcaucaaauccccugggacuggaguuacagaugguugugagccaccauguaauuuaugggaauugaacccagguccucuggaagaagagccaguacucucaauggcugagcucucucuuuagcucaggaugaugcaaaauuugaagacuguaacaauaacacccuugugucuacuaauauuuauaacgcugaauaacuccuuuuggcuauacucucauuuuuauauucuuucguuauuauucuaaauuucguacaaaguaucggauuagcuuauugucacuguaacaaguuaccaugaacuucccagcauagaacagcauacauuauuagauuccauugcugaagugacaggcaaggcuguuucucuuugcagucucugaaggaaagagugucucugccuggucuguggcuccagguggcagcugcucgccagcacacaccgcuuccucauucuuuggagccagugguuuugcaucucugagcagucuuccacaggcauggcucccucugacaucacugggaagaauuccuuuuuaaggaugcgugcaauuacaguuguugaccuuccuaucccaguguccugaauaacucuguuaauuccuauuggcuauguaguggucaccauccucggggagccacuaauauugagugagacccuuucucaagacugaaacuguuggaauuaauauuucacaaauuaauuauuauuaauuaguauaauuaaguacuauuaauuaaauauaauuaauauguccacuaauauuaaacauagucuuugggcaggaauaagugaaaguucgggugugccucccagggaauaaauuauucacauccuuauagaaacaacacuuugacugagagguucucucugaccuaugaaggauaccugaagcaccaggauaauuugaaacuauggcauccauaggacacccagucagucuucuccaaguuuuccuaauccugagccuuucuuuaaaaguuucauuuauauacauacugaagucccuguuugaaaauauuacuuugguucuuugcaguucaagguccagccaagagcguuguuauuuuugugaaagauuuuugcucugucguccaggcugaccucggccucaugaucccccugccucagaaucuuaagcacugggauucuggccaagacuuugaaguguccauuuuaggaguuuuccucuucuuggcuucccuucuucucugagguucucccuuccugaacuugucgccagucuaucaggcuccuuccccagaacuuugggguuuuggaccucaggcauagugaaccuagauuuaaaucuaugauuccuccaaggguuguacuuguaagcuugcucugucugcggaccagccauuugcuuucagcgucaaggugugguggagcagaacugucccugaguuagggaagugugacaggugcagguggcacugccuggggccaccucaguguccaccgccuuggcacugggcagccaugacccugucuaccaacucugccuuccugucaacaggucaaauggaugauguauuggauuauauuugcccucuucaccacggcagagacguucacagacaucuuccuuugcugguaagugcuccagggacugggauauuuccaagggcauggugguggggagaggugggcgggaucuccaucuuuccugggaccacaggagcaggaccagcguugggguguuaacuggagccucuugagaucccuaagagcccauguuguauaaggcacuugggaaguagcauagacuacacaagcaguuucuccacaaaugagguugguaauguauccacgugugaaagaaggaaagagacgguauauagaagaaugcaaugacaggggccgagccuauagcucaggaguagcucagcccaacaccacaaauuaaguaugcaguuaaaacaccacguuucccucccaacccaugugcucuuuccauaaccacuauccacacuuguaucuccucuuaaaacauugugggugccagguauaguggaacaugccuuuaagggcagcacuccugaggcagaggcagaggcaggcagaccucgugaguucgaagccauccuggguuccagugacauagacagacccugucuccaaaaaacaaaacucaaaacaaaauugcugauauguuaacacacacacacacuuacacagacauuuuuaauuuuuaaaauguauuauucucuguguaggcauguaugugugugcuugccugugaucuguaugugguauguaugcaugaucacaggcaugccauggcauacaugugcaaguuagagaacagcuuuguggggucagcuaucuccuuccaaucuuauguguguucuggggaucaacucgggucgccagcccugugucgcaagcaccuuuacccaccgagccaucucccauguagccuagacuggucuuuaccacuccagcccucucucuaugguuccuaagugauggaguuacagaugugugaugcuuacauuuuucauuuucuccuuuucaauaauaauauuaggcauaacaguucuauuugcuuauugaauucauucuagaaaugcuuucauaugagcauaaauguaucuacuuguuuuucaguggucacauaguaucucauggucuagaugaaguguaacuuauauaauuaggguccuuuuuaaaaggguuuaaagaucuauuuuguuuuuaauuguguguaggucucuggggaguggguaugugcauaugaacauggguuccugugaaggccagaaguggaccucagauccccagguagccgagaguggccagcaagggugcugggaaccacauucagguccucugaaagaacagugugcacucuuaacuacugggccaucucuucagucccaauuaccguccuuuggauggacauuuagugguuggcuuuuuucacuuguaaacagcacacuugcuagacacagcucuuuagucugaacacuugggaggcagaggaaggaucaagaguucaagauaagcucuggccaccuaauaaguccaagaccagccuaggcuaugugaaacguugucuuaauucucuacccccaaaagaaguuaauauagcuauuuuuuagcaauggugcaauuaaaaacaugacugauauagagcucucucucauagauggugaauaauaauaucuaguguccugucauauuuaagggaguugacagauauuuucauuugcacccuauaguuuuguuucauacugugacacaggauggacuaggccucggugaguagagacggacccugcuaugccaucccuuaucuuccucagaacacagacgcugucacaaggaaucggagcauugugugcagcuuacacaagcagccucugugucacguguagagaugagggugcuggggcccgggacagcaaagaguggguaguccauuaauaguguguccuaccccugagucauccaguccuggguccuuaaggcucccuccgucuagugcugugugguccugcuguccuugcuccuucucaugauuacaguguuaguaucaggagcgccuccugguauaucaacaugauaaccuugcuacuuuugcuggcuaaugguggcuuugcuccugucuaguugcugggcuacccacugaccaugguacaguuuuaguuuccuacauaguaagaacucaacuacuauguuuuuuugccucaauauaauuuuuucagcuuuuuugagacagggucucacgauguaucccuggcuguccuggaacucauucugucaaccaugauggccuugaacucacagagauccaccuacuucugccucccaagugcugauuaaaggcauuccaccacaccuaacuccgccaguuugauuuuuauuugguaaggcauauaagauugcuuuugcuaacaugauaaauuaucacaauucucaccccucaaaggaacacacgguucuuauucugccauuucuacaagcuagaagcugggguggggugauccgaguucccugcucagacccucagaaguccaggaucacaguguagggcagcggagcucggucugaaggcucuaagaagaguccagcuucccagucuuucagguugcugccugcauuuuauucaugguguuuguaggaccaugggcuccauuuccuuaacaugcacugcucccuucuucugcaaguucaccauggcaucuugauccuccucaggcuucagauucugucuucuauuuccaacagaagaucuggguuagcucuguaacauguaauuggauaggcuggccccaauaauccagauaucuccccaucuuaaagucagccgcgagcaaccuucauuauaucuguaaguccuuuugccguguaagguaugcauucagggacaaaacaccaggaggaggucaugggcaaaacccuggcuauaguaggaauguauuugguaccaggugugucuggaguauuccugcaggauggguagaacccccacauacccugcuugucaaguggaggccucaccuguccccuucuuuggcucucuuaguugguggcauuuagguguuuaugggugggaagugagggucucuugcccuucuggaggccucagcucugcagagaagggauuaagggaucucuaggacucugcacccguuacccauccccuucuguuugcccccuccccaggcaacccucuuuacaguucucucucucucucucucucucucucucucucucucucucucucucucucucucucugucucucuguguguguguguguguguguguguguguguguguucacgugugugugugugugcaugcauguguguucuaucuugauggaggaagcagcuaaguagacacagaauagguaggacaaugauuugcccaccccuugugggggugauuucauuacauccuuuuaaaacuauaaagugguuuauucacauggcaaaauaaauugaaacuacacacugaaauuuaaguacaggagcugagggugugguucauuggcagagcauuugcuuagcaugugugaggcccuagauucaguuccaacagcaccaaagaaaaacagggagggaggagggagggaggagagagggaggagggagggaggagagagggaggagggagggaggagagagggaggagggagggagggaggagaggaggaggagggagggaggaggggugaagcagaauagagaagagggaagaaaaaaaaguaaaucuuugggauugggguauagccucaggggaagaaugcacacuuaguuugugugacgcccuagauccaaucacgagccuuuccuuucccccagaucaaccacugucuaccuaggguuaucaaugaaaagguaccuguguuuucuucuagaaacacuguacaauuaaugugcauguauauagaugguuuuguccuaaguccugugcucuuaugaaaaagucaggcgucucuccagagcuuguggagaccacaguuaccauguccuuugaggccaccuuagaagcaauugaggaagugggggcagguuucucuucagauacauacugggggucaugguucuucaaaggcaucuuagugggcaacccuuucuaucccugggcuagauguuaggaugggcugaucgcagaugauuuaguuggccaagauuguguuagcgaagccaacagaucugaguggcucaacuugaaggguccugugacaccugggcuaggguauuguucuauaugugagugauuauucuggaggcuucagcagcgcgcacgagcacgcguuugugugucuguguguguguguguguguguguguguguguguguguguguguguguguguguaugugaaggaucagacuggaaauacuuugagcucugagaccuguauacucuugauuauagcugcucaggugagccaugguagcacgaaaacagcauagacaauaccuaaauaaguggguaagcaguguucuaauaaaucuuuauucauaagaacaggugguaggcuuuggcuugugacccaugaguuauuagaggucuuaaaucuauucuaacaaacaacggagacuuggcugacuuaagaagaacucacaaaugggaagaaaagaacauucugaaggggagcagagagcgcccccaaggcccucccacugaagcuuagggacuccagccacugccaguuguccccucucugcugacugccaugcuguagaccuucucgguuccaaauuucacucuccugugaucuggauaugacuuggcacuaguacuuaguacuucuuuaguaguacuuaguguugugaucuagagauugguuaguauaaacaggaccaccacaggucugucccucuuuguauagaaugaaggaagcaggggagucucuacagagcucuuacugugaguguuuauagaacccggugugcagagucuguccaggcacuagcgcugugugcagcccucaggaggaaggacacccagucagggcacuucccaacccacugagguguggguacuaguacccaucucauuacuuuuguccugccugaagugggugggcuuugccccuugaccccuucucuaaggucuuguauuccuuucauguauguauacacaccuuccuccacacaauucgucccugccuuuccuuucuucaccaaggccuuuacuuuauccuucuacucauucaugcuuuuaaguguggggccucaagaacagcucccagcccaggguggagccaacuucucagggaguccucucauguggcugggagaauccauucuauucucacuagaaacuucaacuuccuccccucucaaacuuaaggcucacucagucugaguccauuuccucacugguacccaccagaggauaaacuucugaagauuucuuagaaguuugcuuuuaacaugugauguuuggggugauaccaaagauauagcaaggaaaacuugggagagagguaagcaacaagagugaauuggguaggcacuaaugccuuugugcccacaaggacuguguccacccuuccacuguaguauguggccuugcuaugggcucacccauuugucucaguucucuacuaaggucaaggacuugucuaaccuauuguccuaguuggcuuugucaacaugacacaguuuaagagucauucgagaggaaggcauagauugaggaauugccuagaucaucaugggccuguggacauguuaguacgggguuauagugaugccggcuaccuggugcaggacagcucagccuaguguggcagcccaccucuuggcaagugguccugcauuguauaagaaagguagcugacucuucaauuccucaccuuuguuacucucuaucccucuuucucucuuucccuucucccuucucuacauguggcuauggcuggccucacucuaccuucucucuuuucucccugccuuucuacaauaaagcucuaaaaccaaaagaaagggagagagagagagagagagagagagagagagagagagagagagagagaguugaacaugagccuacaagggagcaagucagcaagcaacagucuuccagguuuccacuucaagcuccuguccugacuuacuccagugacaaacugugaguguaaggcaaacgaacccuucccuccccuacguugcuuagauaagaaagggacugaacuaaaaccaccuguccugcucugccuaugccuuucuaccugcaccucuacaagauuuuucucaauggaacaaacacauguauaaauggaucaaucaacugaccagucagcagaaacauaucucaggaaauucacagagcagggcaaaauggaagggcacugaugguggcuaagaggauaaagucuugagauuccagugugacugucaagaagacacuugacaaagacaggaaggagcuuccuucucagugacucuggagacaaaacugagcuuuaaaaucagggaacuuuacaggcagagcuuguugagaaggaaguguaggcuggaaguaaggaaauggaaccaggacugggcuuaucccgggacaaagaggaagggcuggauuuccauucgugugcaccguuuggagagguagauuaggucuguucacucuuccuuagccacagaacagcuugcucugccuguaaacauccuguccuugaggagggcuuaucucuggagcuuuugcccucacacaccagcaucccuugccacuuuaauguccuggcccugugauaaggaugggcugccauggcuaggagcacacaugggagaccgggaguguggaagaacccacaggcagcauugucuucuaaggauacuucaaaggcccaggaacuugccuuuuguuucacucucucaucuuacuuucagagacuucaugaugaucucacccuaacugacuuucagagcaccccaguuuugagccuaagauuauuugggagcacugaggaguuggagaagaacguauaccagucaaucauucauuuuuaauuuuaauauauauuuaggacuauguauauaugggaguauguauuccagaauggccuagagcucucuauauaacugaagaugaccuugaacuuuuuuuuucuuuccauuuuuuauuagguauuuagcucauuuacauuuccaauguuauaccaaaagucccccauacccacccacccccacuccccuacccacccacuaccccuuuuuggcccuggaguuccccuguacuggggcauauaaaguuuguguguccaaugggccucucuuuccagugauggccaacuaggccaucuuuugauacauaugcagcuagagucaagagcuccgggguacugguuaguucauaauguuguuccaccuauagaccuugaacuuuuuauccuccugccuccaccucccgguugcuggguuuacagguguacagcaccuucugugccaggauggaggaacucaugcaugccaaguaagcacucuaccaaccaagcaucccuacuccuuaauuuuguuuggagacaagguuuugguguauagccuaggauggccccaaacucaugauccuucugccccagcguuucgagugcuaggacuuacaggcaacugucaccaugcccauuacacuaccccugacuaucccaagccuuucgagggcuuaagggcugaagccuggaaguacauccuccucuuaucccuccucuuaucugagcucuucuacaaaccauugaucacccuaugccuggguaucaucaaagcagucuccaaccccacagccuuuaaucccaauccucagaaggccgaggaaggcagagcucuaugaguuuaaagccagucuaaucuacguaaugaggccugugucaagggagggauggagggagggagggagggagggagggagggagggagggagggaggaaggaaagaagauagaaggaaggaaagaagagagggagagaggcaaaaaagaaaaagagacaaaccaggcuccaucaccaggauagacaugacugccuaauaguggccuccuauacagucuagagcuacuugguaucagguuggggacagugcucaaaaggcagaccuacuggccacaccaaacacugccaccugaaucuucacuguacuaugcucuguuggucugccuagugaaggcccaaggaaugaaccaaaagguccagaaacaggaaacuuuuuauuguugcuuuuuaaagguauuaggaguguauuugcgugugagagaguauacgaaugugucugcacucguuauaggcauaugugaagaaggagugucagauucuccagagauggagguguaagcauuugugagucucccagcauggugcugggagccaaacuccgguccucuggggagcaagggacaucuuuucagacuucuugcugaagcuuuuaaaagcugcaucaguguggguggauggauuaugcuaaaaagauucuaaaaaaaaacaagugaucuauauagcaaaugguucagggaaucaagguaggcugggcaguccagaggggccccugggaaggucaaauagacauauguauuuccuaaaugcuaaugcuguagccugggacagaggcucuuaguuggcugugcagugagaaugugguuacucagaucuaaaugacgguuuccugcuaucuacaaagugcauacagaucauccacuccugaguacccggaccauagccucacuggugugcauacagagagaagcacauacagggagguuugcuggaagcuuggcuuaugauggaugcuugucaucaaucucuuuccccgggagaugcuuacacauguauaggaagcuaugaaagagacgggagcuuuccauguucugguaugagaugguccccaauguauacuguugauucugggcagauuagggaaagcaaggugucggggguauagagaacagagaaugccaccaacaggcaguuaagggaaucacagguacccaccugauugaauaggccuagcccaauaaagauuaagaagagagucuagagggccugggugggagggaagcucuguaugcucucggauucuuuagcauuucuuaacuaugcgcaugcaugaccuacuuuuuaaaaauuucuuuuacacaauaacuaggagagcucuagugugauugauggcuguccuugggacugucuguguuucuuaggcugguaugugaacuugcuggauucaguagcuuuccccuuggacuggcuaauaauuugucuucaaaacaaaaguuccuccauucuuaaugagcgcugugucccacucuggggguggggagcaucgaucacgccuccccucuuucagcccuggucuuuuguagcugugaaagaugaaccgacuuugccggggaagaaccccacccucaccccaguuacuggugaauauucaggaagagccugcuaaagccagaaagcagaggggcuuuggugaggugggccgcugucugaggagagggagcuguaugaguuuggaagggcucugaaaugacucgcuagggguugcuuucauuuuuagcuucuuucaucugggaaggaugccugggaaagacuuacuuuuuggucccucagacuagcguaagagacccuuuuacccaccgcaucuuauuuuaaguaaggaugucugggguuuguuuuaaguagguguggucagacuugaggaccugaaaauggcuggcaggagggagauguuuguccacaucaaagaucccuaguaauaggaagugcagcaccacacaaggccacuaggggagguaccaggaugguucuggaggcagaggcuugcugucagcaugguuccgugagaaggauuuggguucgcuauuguaagugguucugagagauaggagcaucucuggcuaucugguccugguauggggaaaugcaagcauaugcacaguggcugagagugugagauccugcaggcucuagacuauugaccugcauguaaaagcuaaaggucuuugagcauagaccuuuuccuuacucaccagcccuuucucauuuccagggucgggagggugcuagagagaaggcucagcaguuaagagugcuugcuccucucgcagaggacuagaauuagguucccaacacucauguuagguggcucacaaucuccuguaacuauaacuucagagggaucugacgcccucuuguggccuccagagucacugcacucacaugcauaaaccuacacauagauacacauacacacaauuuaaaaguaaaauauuagaaaaaaaaaguaagaaaguucagaaggagccugugcuaguacugggagcucuuucuuggcuagaucuaggaaguggcuuacccuggcgaggacacuuccuccagagucaacaaagccucgagaugcugucaaugcaauugugcagguuauucacagcaccagcuagagacuggagaggugggguugaaaucuggguuaaacucugcuuaccacaccauggccccagugaucugcaucaaccugaggggcuuggcuuuuccauuuuuucaaagacuugauguagaguagaagagacacaccaggacacuugucucagguugauguuauuuuaucagucaaucucuaacuggaccccuaaauucaaggacaucugacuauuucucccccuuccccuccccucccccucuuccuccccucauaucuccauccucuuucucugugucuugcuguuucugaaggaggguguguguguguguguguguguguguguguguguugguguuucuguagguacacauccauguauuuauauaccagaaaacagcuucagaugugguuccugaggcacauagacuuuuuuguuuuguuuuguuuuguuuuguuuuuaagacagggucucaacggccugugacucgaguagacuaaaguggcuggccaguauccuagggauccgccugucucugccucucuacugcuaggauuacaaguacacgcuacaccaucuggcuuuuuuuuuucuuugugacaucuguggaucacgcucagcucaucacacuugcaaaagcaagcguuuucccagcuccacucccucuucagcccaagcugccagaaucuugucucugucuggaagcuccaguauugcagggagucucugccacuccuccaacccccaccuuauauaagauggcacagauaggugcagugggggccaguguuuguaggacaaauggaugaaugggccugagggugugugggaguccagcauguauguuaucccucacucuucuuucuuuuggcacacacaaaaaagauuaagaucucugccugacauugaguagaggaagcaggacuccuugguaggaguuggacuccucucccugccuuuauugaaacaagaaagaggugccuggccauuguggagacacugccagcuucacccugcuguaauucccccuggccuggccuggccuggccucugugucuccuggccacaaacagugaaggcugaaugaccagugcccagacacagacuugaccuucugagucuacaagcugcagcuggaucaacgugccaaccccaguuagcauagcccugcagaagcuguuagcugcugccaggcaaggccaugcuguaacugcugaagugagccugccuuccugcuucucuugagaaacagaaucaaaacgaaacacgaguuggcuuuuagggcgaggucucaaguguguagaagugcacgugugugcacaugccuuccgcagguggaggaugaggacucugggaaccuggccauaccuguaugagaugggggcauccaugccaaccccggucuuuuuuuuuuuuuuaacaggcuuuaaacagugcuguggagaaccuaauggaagguauauuuucuuauuuuuccagguuuccauucuauuaugaacuaaaaauagcguuuguagccuggcugcugucucccuauacaaaaggauccagccuccuguacaggaaguuuguucaucccacauugucuucaaaagaaaagguaacugaugcugcuucuagcaagggaaaaaaucaaagcccuguguagaaaggguuguucuguugcaggagaccccuugugguucuucuuuauuucaacggguaagugguuuccuuuaauagugauauauauauacuucuguagugagacuucugcaauuuuaguuucuuuuauucuuuuaaaagcacaggaauagggcuggagagauggcucagugguuaagagguccugaguucaauucccagcaacagcauccaaugcccucuucugguguguuugaaaacaguuacaguguacucauauacauuaaacaggcaaacacagaaauauuaugagaaucuguuuccauuuuaauccccugcagguaguguuuuugauugugugaugcuuccaauccugugaaguuuucagaagguauauaaaugcuagggccccaagagauggaguugguggucgguggucauucagggggauguuggauguuuguuaguagucauuaguuuguuagcucaaagaagaaccaaaagaaaagaaauuagauugggauguugugauagggggugaaacuggggagugggguuaagggugggaaaaagaaaaaccuacaaaguagcaaagaccaacuacaaucucauucucucucucucucucucucucucucucucucucucucucucucucucuccccccaucuuucucucauuuauuguguaugggugcaugcacgccauggcacaugcaaagaccaaugguucucuccuuccacgugugucuugacaacugaacucagauucuaaggcuugacacaugccuuuauccacuaggaucuugcucuguagcucagacugucccugaauagcccagguuugccuccaacucaucucgcuccuccugccucagccucucaugugcugggauuaaagcuugcaccacugcauucaucuccaaugccuuuaaaaaaaacucccugaaaauagugguauauagcuuuaauuccagcacucagggggcagaggcagguggaucucuaugaguucaaggccagccuagucuacaagguaaguucuaggccagacaaggcugaacagcgagacacuaucucaacacaccuccaacauuauuccuguaaacuuauuuuuguuuucauauuucacuuucauuauucuauuguaugugugcauggaguacagcaggauaauuucauucaugcauauaacuugugcugauuaaaaaacuauuaguacacaggacuuguacauauuuaugagguacaaugugauauuucagcauuugcacaaugcgugcugaucaaaucagggcaauuagcaggucucauuccuuauuacuuugucuuugaaaaguuccacggcuccucgauccucaccccacccccgcccuuucucucuguuucccaccccuacccaccuccacccccacucuaccaccccauccccccacccccacccccguugugagcuccugucaccugcagugcuucagaacacuagugcucauuucuucugucuguagcacuguccaacuuccuaugucccugcucccucuccucuugaacucugcgucuagacugacuauucuaacacccacauaggaaagaaaacaugguguuuguauuuauuucacauuacccagugugcuccauuucgguccauuuugcuuagaaagguuaucauucugucuucuuuugaguuaaaugaguaauuuuccauuaugcauauagaccauauuucugcauucauccacugaugagcaucuggguuaauuccacaucuuaguaucaugaauaggacagcaauaucugauuguuucaaaaucugcauaguucucucaacacaugcagguaaaagcaucugauagaauucaguaucccucgggcuggagcgacggcucagcaguuaagagaccucuugcagagguccuggguucuucccaucacucaagcaguagcuuacaaucauaauuguaauuccagcuccaggcaaucguacaucguuucugaccucugcaggcaccacauacacauacauaauguuuauacauacaugcaggcaaaacauucagacacaugaaaagaaaauaaaucaaucuaaaaauauuuuuaaaaggauucauauucauggcgaaguucaaggaacaugcaucaacaugauaaaaacccugugugacaagacagugcuggcugggagaagcuuucagcuuugccuuuaugucucggaugagaucagcgugucugccuucacuacucuuaacacaguauuggaagucucuccauagcagucaggcaagauaaacaaguaagagucaugcauacgacaggaagagaggaagucacaucacuccugauuacauaugaucugauucaauauguguaaaacccuaaggauuccacaaaaagacuauuaaaacugacagauuaauucaauagucaaaaaauuaaaagaaaucaagguauaaaaucaguaacauugaggcuggagagauggcuccaucaguaaaguguuugcguucugugugagggcuugaguucugacucugaagauccacguggagaaacaggcuuggcagugagugccuguaaccgcagugcugggacaggggaggaacagagacaggcagcucccuggaacucccuguacagauagucuagccacaucuguggcucucuguggcuagucuacugaguuucaaacuucaguaaagacugucuuaaaaagaaaagaagguggagaaauaaagauauggcuuccacaaucaugucauccacauguacacucacaugcaaaaccacaugaauauacacacacaucuaacacacacauacacacagucaguaacauuucuuccucauugugguacucaagauugagcccagggccucaugaauguuagguaaauauucuaccgcuauauauccagcccauaaauugaauucuuaauacagugaugacaacauuguugacaaggaaauaugaaaguaaucacuuugguuuuuuguuguuguuuuuuucuaaguguauauuuagccaggcggugguuuuacacgccuuuaaucccagcacuugcgaggcagaggcaggcagaucucugagucugaggccagccugaucuauauagagagaguuccaggacagucagggcuacacaaagaaacuguaucucaggggggaaaaguguauauuugcacauguuuagauauaguggcuggucaugguggcucacaccuauaauccuaccucucaagaugcuaaggcaagaagauuacaaguuugagccacaaaauaagagccugucuccguaaaagugguaaaauuauauaaaaauguugucugucauuauugauaaaacuuuucacaaacuagaaaaagauaaaaagauuagcagucuaacuccucaaagauuacauaucuccaguucuaauacucagaaggaggaagcagguggacuuccugacacacaucaaagacugacaagaauggucuaaauagugagucucaggccacccagggucauccaggcccuugacucaaaaaacaaauuaauuaagccgggagugguggugcacaccuuuaaucccaguacuagggaggcagaggcaggcggauuucugaguucgaggccagccuggucuacaaagugaguuccaggacagccagggcuauacagagaaacccugucuugaaaaaccaaaaaaauuaaaauuaaaauuaauuaauuaauuaacuaucaaaacaaucuuuuuuuuuaaaaaaucacauuuagccccagucauucugcagauaauaagaucucuacauguacuguuaaccacuuuauauagacucuuuuuucaauaguugucaaauuuagccugagaacagugguacacaggcaugcagucccagaccuugguaagaacaagagagggaaauuuacagagcuaaggacuuccagagcagugcagcuagcauaagacgaguuggucuugugcugaagagauggcucagugcuugagagcauuggcugcccuuccaaagguccugaguucaauucccagcaaccacauuguggcuaacagccaucuguaacagaaucugauuucuucuucuggugugcaugaagacagaacacucagauauauaauauaaauaaaagaagagcccaucucagagaaacagagaaacaaaaacucagcauagaggacugggaagguagcucggcuaguggaaugcuugcuuagcaucacagagccagggguuuaacauccaguacugucuagaaccaggcacgguggcacacaccugcaaucccagcacuuagaagguggaggcaaaaguucaaaggacauccuaaguugucuuccaggccagccugaguuacuugaaauccuaucucuagguaaauaaauacauucuuaauauaaauaaaauaguugcauucaagaagauggcucaguguugugcaagcaugaggagcuguguuuauaagcccagcagcauguagacaggcagggugggaaguggggaggggugguagacacaaacagaugccaggggcucagugucggcugggcuagccaacauggugagcuccagguucaaugagagaccuugccucaaaagcuaagguagaaggccagcuaaauggugcacaggauacauaugcucgccaccaaaccugaaaaccugaguuugagccccagaacccagaugggagagaaagagaacugacucuugcagguaauauucaugcaccaaggcuguauacacacaccuaaauaacuguacauuuaaaauauuuauuuuaguagagagcaguagaggagacacgcaaugugcacacaugagugcauacacaccccacagacacgagcauacagcacacguaccacauaaacgaauaggaaugagucauggccuagugacucagagcaacagaacuguuuucuucuacuaaauacugagauuguuccaauguucuuguuacaggcaacucugcccugagcacuaccacucauucagauccuucuuuugucuuaaugaauucccaagagugggauuaccgggcuaaaugauccuagcaguauauacuucauuaauugcauuauuuuucuaaccuaauuguguaguagaauucuuuaaaauaaaauagguaccuguuacguuuugaauaggaacuucucugccuccagucucuuggguuugaagaguuuguagugcuguguugggaggcugugaaaucuuuuaaacauggggccuaaggggcaaauguggguuguggggcaggaauucaaguuuauauuugccucugguccucauauacugagaccucuauuuccugguugugccauauaagaaauaguggccacauguuccuaccacuaugacuuugagcagcucccaccaacgugucuugcccaacaugguggacuacaccaucucaaaccaccaaggaggaaaaacacucuuuccugaguuugucaggaaucucucacaacaccaagaaaugaacaaacacagaguuagcuccugcugguucacuagugucuguacuuucugaaguucaaugcuuuggacuucuggccagcccucaacagcaccuuuggaaccaagcccacagcugcccccccuccaccucagaaagguggggguuagagaucuagauaccucuucacuugcucaucuccuucuccccaaauguugucuucuuugaagcuguauccuguccacuggagggaaaguggugucuuaagagcugccaagaaucacuccuuagucugcuggaucacagagccugggcccuccuggggaggcugugaagagggauagcagcuggggcugccugagccccccaaccccaaccccccgccccaaccccagaccucaaagcaaaggaaacucacuaugggagcagagcuucaaacaagacugaggccacaagucuuacugaacuguuaaacgaaccacugugacuaccauacacccaccuucucaggacaacgaaagguguaaaacaaagaaguaaacaguagaguugauccagacccaagcugaauuugcaguauugcaccucgcuuuggucaggagaccuccgugcuguuucccaucuugcuacacuggaagacuuuaauuuccuuuauuucagcaucuguuaaacuuaugucccuucuccaccaaaauaaugccuguuucuuucuuuacccaauuccuccuaucauugcucacauggggcaguaucucagaauaccagaaugagaaaauugcaagguuuccaucaucugucuugaagaugaagaugauggagacugucaugugugguagccaaggugcucaccuuguuaacccucgccaugcaccgcaagugaagugccaucauuacugucuguuucuagaagagaaaacuguuaagagggucuggagagauguauugcuggaauuuccaaccccaauaagcccauauaaaaaacaugcaauccaguuauuauaauuauaagucauaaaccuagauugggcagauauaacauacuaacuuauuccccagcuauaagaccccuugccacuugugguuucuccuggccaccugguucugcucuaucauggcuuccuccuccucucuccuccuccuucccuucucguccucuuuccuucucccucugcccccacucucacacuuccaccuuuccccuccacugcccaaucacaggcucuagccuuuauuaaccacauaaaauggggacaaugagaucaccugcagaauuaacaucagaauacgaacagcaucaggacaacucacagcaagauggcucagcaguuaagaucacuggcugcucuuccagaggaccuggguucuguuucuagcacucauaaccaacuguaacuauaguuccagggaaucagacucccucuuugcuauccacaggcacugcaugcacacggugcaccuacauacaugcagacaaaacacuguuaaacauaauauaaaucuuaaaaauagaacaaacccaaacaaaauaaacccccaaguuuugccaccgauuagcugaggucagagcuugaagcuuuguucucgguaucccagcaugcuggaugcugucugucuuguggagcagcuucucggggaaaagcaggauugucugcaucccuaggacugagaggaccuuuagagauaacccaggacuuaggucagugaguuauuauuggaugcuuacuuauucagaauuccccuucgcacuuggcaauagcuaacccaucuuccuccacccuccuaucuaugaacauauauucaaaaugucuaugguguuucaggccagugagagucacccaccaggcaagcugccaagcccagugcuugggaagagaggaggagaagagaaguauuugaacuugccaacucagugcgccucugcuucuucuccgacaggaaaucgaugacugccugguccaagcaaaagaucgaagcuaugacgcccuugugcacuuugggaagcggggcuugaauguggcagccacugcagcugugauggcugccuccaagguauaguaccacaggguccuggcucccguggcuggugaacaucucagucccccaguugccucuggcugucacuuauguagauugcacaggagaggauaaaggccaacuggcaacucuuaauauuuaucuuuuuaagucccuuuaaagguaugagggaggacgauggugacuuuuuccuucagggcauucuccuuuauauauaugcaaguguauauacacucauacaugugugauagcagaacuuucccagagcccuugaaacuccuuguggaucacagguaggcuggagagaugguucagcaguuaggagcgcaugcugcucuugcagaagacucauuugguccccaccacagucagguagcucacaacugccuguaucuccagcuccaagaggggguacccgcacucaugugcacagauccucacacagacaugcacauaauuaaaaauaaaauaaucuugggggaggggggaacauucuaaucuaccugaaacugaggugugagagaagaaaauaggaaaaggggagggaaaagacgucuuuauucuguuucccagggugcaccaguagaaucaucuaaacucaaaguggacagguagagagagaucgucccuguucacgugguccaucacauccugagaagggauucggggucuuagagugaguggaauggugaugaugaugguggugaugacgaugaugaugauauguguguauaacuggcauaauaaaguggaggagguuaaaaaaaaacagggccaguggacaauugugaugcagucauuacuucuuucucauuuucaucuggccuggggggggggggaguucucuuaugucccuuccugguuucuucucacaugagacuuuaucauuguguggauugcuaugcucguggaccugaacaacugaaauagucagacaucuucucuuagaguaaauucaucagaucuccuuaguguucccuucccugggaugcagacccaggcuggaggugucagccagcaguuacaccacuguuuggaaaacccacuggcugagagguaaucuagcagagcaaaggagaagugauaaguccugaaggguuaucuuggggucagaugugacagagccaugggugggugugggacaggcugauggauucacaccucggugcuccuggguugugaaaagguggcaggaugcaggaugcugaggaccagcgggcauccaagauggcuucccugugcuaggaaacaaggaaaggcaugaugagagcguuugcuggagagagcacaggagcugagugcuuguuccaaaagagccuucugccaguuuugguaccuuuaaucccagcacucgggaggcagaggcagguggaucacugugaguucaaggccagccagguugauuuacauaucaaguuccaggccgggacacacacacacacacacacacacacacacacacacacacacacacauagugagaagccaucucaaacaauaacuuuuuuuuuuuuccgguuuuuaaagucccuuuugucugaaguggaggagugcuacagaggccugggaaggggaggagaaacagaaggaaggauucugguuaagucaaggcacaacccgucccguugcacgagcugugggacuccauuacacauaggcgcccuggccgccuugggguaauaggaacagucauggugaucgaucccagauagcaucuuuggaagggaacucugccuggggaccugaaaucuaucaggguuucucuguacagcccuggcuguccuggaacucacucuguagaccaggcuggccucgaacucagaaauccgccugcuucugccucccaaguacugggauaaaaggugugcgccaccacgcccggcuuuggguuggaauuuuuaaacaaaagaaaagagaacaguccaccaaacccuaaagucaucaaaccaacccugcaacagagugacagacuccaucucuuggucccucucucgacugcaucuucucugccguggccugaugcucgaggccacccagguccucggcccugaggccgcaguaacuuccagaggcucccucucuuccagguuggccucgagcuggggacuccagagccucagugccuuccuggcugcucauccccucacuccacuaccaagauggcugugagcccaggacuccuccaacgaggcgucucgccucagcuaaaacccggaggaugcuccugauggccuagaccuugccucaggaaauaguuucuugucaguuccuuuagcuuaugugggaaaagacuuucacuuucugucuaaugcuuucaaaugaggagauuuuucugcuuugugggagccuugcuuuuccuuacuaaauauaaaugucuaggaagagaaaacacaucuccaccaaaaauaauguccucuauuuuugaaacaauaugugcuuuaaaaaauaauaauaauaaaaccuaaaaauccagucaggcccagggcugcagcaugguuuccauagcaaccacagacaacacccagcagucucagagacugacucaccagugggucaugaaaucugccuuucaagccugaaccaccuuggcggcuuugaguuuugaguuuuaguucugcugaauccgaaccucaggcagcggagcgggccugugggucucuguucuuaaugacuuccccaggugauuugaaacgugcacccuuggauaggucacugccugaaguaccauccagaauagaaaacaugggugacugagguuaaaacagcuuuuuccuguauuuuuccugugaugcaaacauaacaccuuagaacauuaaccuugaagaugagaagaccuguauguguguuuguguauguguguguguauguuuguggcauguguguguuuguggcaugagugugcauguuuguuuagagguguguacaacaugaguuugugccacagugggacugccaauccuucugccaggcuaugugccagaggaaccgguccucucuccuucuagaacucuuugguccgucuucccauggcucccuggaugcuacagagauaucaauggaagagcgaaaaaccacauuauggcucagugguuaagagcaccucuuccagaggacccagauucaguucccagcacgcauacaacagcuuagaagugucuguuacuccagucccaagggauacagcacccucuucuggccucaggggcccuguacacgcaugguacacagacacacauguaggcaaaucacccaugcaaguaacaauuuuaaaauaaaaauaauauugagccgugagcaucuucccuaauaaaaugaaugccuguggaggacguuuuuaucuuccugaagcacggaaaccugcaugagcucaguccaguaagaugccucagcggcuucugcugcugagcuuaugaugaccugaguuugaugccagaacccacauagcaaaaagaaagaaccaacuguugggaaguugcccucucggccuggagagguggugcaguaguuaagagcgcuugcacuugacuauucuuccagaguccugaguucaauucccagcaagcguguaguggcucacgaccuucucuaaugggcucuggucuucucuucuaagugugcaugaagacagagcacucauacauaaaacacaugaauaaauacauuuuuuaaaaguugaccucugcaugagcaugacacgcacacacauacauacauacaaaaugaagaaaugaaaaaugucuucaacuucuaaacuaugucauuaugaaaacauaauuucuuguuagugcuauuauuuuuuuuaucuugaaacuagaaaaacuaaaacaaaaaauucagccaugggaacuuucuucccagggaguuuaccccguccaagccauuuucuccgagacucuguuccuauaagugucuugguggcuuugcuggcuucaggauuccucacaggaggaagacaaucccaacucuuuuaaagacuagaauugguaauuucucuuuuucaaaaacaauacucuugaaguucuuguccagaagagcccauccucacauucaagagggcccccgugagaaagaaaugagcaaaaguucugccaccacucggaccccugccaccucagugccuuugaaaccuggcuccuacacgaggcccugucccuucuuaggcuggcuaagccaacuuuucuuuuaacucauugcuuaacuugaaaagugcaugccuuucaucccagcacucagaagauagaggcagguggaucccugaguucaagguuaaccuggucuacagagugaguuucaggaaagccagagcuacaaggagaaaucuugucaagaaaaagagaagaaagguagaaaugaaaggaaagaagagaagagaagagaagagaagagaagagaagagaagagaagagaagagaagagaaaaaagaaaaggaaagaggaaaggaaaggaaaggagaggagaggagaggagaggagaggagaggagaggagaggagaggagaggagaggagaggagaggagaggaaaggaaagaggcagacaauguuguucuaauucccaagaguugcccugggcacaguccuaauuauaccaaaccuauuauuaaagucagccuuugaagagagaugcugcaaguaagauuuguacucugugaauuagagauucuccaggugguuugcaguguaugggggaggggggcacauagacauuugcacucaugugcuugugugugccuuucuacagaaccccauggucuuuauuagaucauuagcuucuuuccuuaaaaacauuuucuauuuuaaauuaugugucuguguguagguacuuguccaugaaugcuauugccccggaaggccggagguguagggcuccccuggagguugcgagccauuugaugugcaugcugggaaauggacuuagguccacugcacuggcacucugugcuacuuaacuguugaguucugccccuagguuucuagugucuugagccaagagguugugccuucuuucucuucguuucuguguuaggaaauaaccagaaggggaaggagagauggcucagcuguucaaagcacuggcuacucuuccagaggacccagguucaauuccuagcacccauguagcaacucacaaccauccauaacucccaggagaucuggcauccucuucugucucugcggguccugcaggcacagcacaaacaugauacacagacauacauucagacacucauacauauaaauuaaaaauaaauaagaucucaaaaaauauuuaaguaaccugaaaugcuuuguuucacggugcuuuuacuugcauugcucauuaaagcugauuaaugugcuggucuugguggcacacaacuuuaauccuagugcuuaggaugcagaggcagggggaucucugugaguucaguccuacccuggucuacacugcaaauaucaggacauccaaagauacauagagagccuguauugaauaaaacgaacacaaaaaaaaaaaaccuuagaugaugugauauauacaccccucuuuauuucuccaaccuuauucugucuaauacaauagccaccugcuacauaggucuguuucaauauacauuaauugaaauuaagaggcucuggaguugaguuccuuaguuggccuugaguuccuugauugacuggcaucacagaggggaauucuaauggacagcugccucaagcccucugugaacacucuuagguguuccuuggucguguuuucacucuuuuuuucuguagcuacuccagcuuugaugguauacuccucucuuucaccaaggucuuuggagcuguguuuacgaggcucccggaaaaacagagcuggaagcucuugccuauagcagcacccauguagcagcuccuguuuccucauccccacccuugugcuagcccacuuuucacaccacagacuacauccacucucuugacuugcugcuggaaacauaacuuugccuuuguaaccaguaaccacaaggaggcaguuuuggcaacagccugcugucugacuagaugggcaucauucacugggaaaucgaauuauguuuucucauuccuuuauuuuauucccagucagucagucugaccuuuuaaaaauaggacucagaguugcuauuucuaggaugauaagaggacguucuauagguguaaugcaagaaggcauggaaagauaaagaugagacaggaagggaaaagaaacagucagccacuugcauagcuccugcaacaacaguccauguuagaagggcagaugaggggaaagaaggaagggaugcugaaagguuaaggcuugagaaggacgugggaaggggugaagcuuuauaaaugacugugacuuauuaccugagugcccgagaguucagaaauguggaagaaggcugaagagauaucucugaagaauucacgugguaggcagggcuucgaacugagaacuacccuuacagcuccguguuccaaguuccugaaccccuguuuccuggagaugcucgauucagauaugauccggauagccugauacagagaucaccaggccauuugauucugccuguuauuucucauuaagagcacuuuccaaaaugaaggucaggaaacagaccuuuaucccagacauuccugucccccacuguaaaaugaaugacacgaaagaaagauauuggaauacuaaggcuaguuuucagcacacaccacaaacuguuucuagaagguucuuacuauccuaacauccuuuucuuuccuuuccuuuucuuuucuuuccuuuccuuuucucucacuacuccaaagccuucaguggagaacugagcucuguuuccugcccuuugcuuccggggccucggcccucacugugcacaacugugagccaaugugugaggcucagacucaggccagccacgcugcccuacccagaaccgugcauguuuugucaacuuggucguuuguacccuuauaggaauuucuguccugaugcccuggucggacugagguccuuggcagcaggauccacuucacacugaccgguguucgauccucuucaggaccucguggagcuuugucagcuucccaccagcgcuuguugugugugaacagagaaacgcauggcugaguggaugagcgagggagggagggagggaaauggggaccgcguggcucucuucaguaucuugguggcuugugcccauggcuuuuuuuuuuuuguccccuuuuuacccuuuaucagguggcucgaaucuuucauuuugucuccuccuuggaucucagagaagggcagguaaccccguugagaggugugacuaacuccaaaccgauccagucugguagagaggcucugcagccaucucugcccaccagccucuggucuggaucagagggagguguuuugcugccccgacaccugugcgugacacaugugacuccaugccagacacacggcuggcugcacuuugucaucauaccagagccuuuuagugugcuugguuggcagcaucuaacacgugacuaacuuacucaguccccacccccuuuggucaaugccuggagaaugaauugaauuuguacugaugcucucaugaaauccucaucucuuuccguuuuguuaauccaggguuuuguccuaaauacagcccgaccuccauguggcaugcuuagguggggcugcugggcccugcugucgagcacguucggcuggagaggcugucagcgggcugagugugacgugagguguagcaggaagcacuaacucuucuugaacuaccccugggaaaugugguuaugccagaggcuuuguugucaauugccugacucacuaaaaccuucacuuccacagugggcacugggucucuggggacgggagaggagcuaaacuuugcacuucuuugugccuuccccugcgacuuggugggucccuccagaaccugcacagggccuuaaauuguuccauuucugagaguaucuaucuuaccucucagaucugguacacaacuguaauccugccuuuaggaacuggaggcaggaagaucaggagcuagagguuaccuugacuauguagugagcuagaggcuagccugggcuaugugaaacucuguuuccaaagucaaagagaggagcuagagaaguggcucagagguugagggccggguucaguuucuagcauccauacaguggcuuacaaacaucuguaacuccaauuccaggggauccaauaccuacuucugaccuccacagccaccagacaugcauguaguacacacacauacuuacaugcagacaaaacacucauacauguaaaauaaaauaacuagauauuaauauuuauuauuaaguuccaggcaguagugguguaugacuuuaaucccagcauuugggaggcagaggcaaguggauuucugaguucgaggccagccuggucuacagagugaguuccaggacaacugggacuacacagagaaacccuguaucaaagaaagaaagaaagaaagaaagaaagaaagaaagaaagaaagaaagaaagaaagaaagaaagaaagaaaggaggaaaaaagaaaaaaagaaaaacccugucuugaaaaaccaauauauaaauauauuuuauuaauuaauauuaacagcuaauauuaaaacaauacaaaacauagacugccuaaauuguuugggguuugaagacauuugucacugucaugaaugcccuguguucccagaggaauccucaggguugucucgggagacugcuggguguuacucgacuuucaguugcacugccuccugugcaagaugcaaaaguacaaagagggugagguccccguggcccuaccacccauaaagccugccacuugaagcaugcuuccauugagcaaagacagucaugggcauuaacaacgaaaagcaggaccccauccacccccucagccaucaaaauugcaaagauucugucugggguggaauaaagcggugaugcuuagugguggaaaaguacuaaaaccugcccagcaaauguaccgcucuuaggcugggguagggcaugguagaaugcuugcccagcauccacaaagccuuggauucaaauuccuagcaccacaaaauugagugugauuuuacauaccugaaaucccagugguucggagguggaggcaggaagaucuauccuuggcuacuuagcaaguuagagguuaaucuuggauauaugaaacccugucuaaagaaaucaaagcaaccagguacaauggcauaugccuuuaaucccagcacuugaaaaguguagccaggcagaucuuugaguucaaagcuaaccuggucuacacagaguucuaggucagccugagguacacaaugaaaccccaccucaaaaaaaaaaaaaaaaaaaccacaaaacacaaaacaaaaacccucuuuccaguuaguuuacauauuuacacacacauguucuucaaaaggggcccugcucuggagcacuuugccucacgggugugccacccgccccugugccccacacuuguggacacaucccaagccaugcccaauagaacgccccuaaggucugggaguggaguaggaugguaaacacuucacucaggcagcaagaugcuggguguccauaugcuuauucuuuccacacugacaccuaaugcgugucaaguggaaagggagacggaugcaagccugcaauaggaaaggaagcuguaggaggggaaggccagcagacaauguccagcaucaaguacaguugcauggagaacaugggacaggucggacgccaccgagagcaaugucgcagggaguuuucauugucaagaagucguuaucucaagugccacuaagaaaggagaaauugcuuaugaaauggggacauggugccuuucacuuagaaugcuuaccacuucuuacuuaaaacacuacuagacugagaguuuaaaaaacaaaacaagggggcuggagagauggcucagugguuaagagcacugacugcucuuccaaagguccugaguucaaaucccagcaaccacaugguggcucacaaccauccaucaugagaucugaugcucucuucuggugugucugaagacagcuacaguguacuuagauauaaugauaaauaaucuuuaaaaaacaaacaaaaaaaaaaacuaccuuuguucacaaaauuaaaaggagcccagaaucugacaugguggugcaugccuuugaucccagcacuugagacgcagaggcagguggauugcugcuaaccuaguuguucaaggccaaccuagucuacauaaugaguuucaggacacucagagcucuguagagguagguaucuagauaucuagauaucuagauagauagauagauagauagauagauagauagauagauagauagaugauagacagacagaccaggcuaagguccucugacuuacacacacacacaaauauacacaugucccaguacaccugcaugcaauccauaugugugcauauuuaaaagaaaaagaauagcaggguauggugguauaucccuuuaauaccagcacucaggaagcagauacaaauagaccuuuaugaguuugagaccagacuggucuacauaguaaguuccaggccagccagagcuauauagugagauccuggagaagggggcagugggaacuuagaaacauauuugaaugguuggcucucaaccacagaauauauuuuaccuuggcauuguuuuuuggagacaggguuccucugugucacucuagcuauccuggagcuugcccuguaaaccaggcuggccucaaacucaagagauccaccugcaucugccucccaaaagcuggaacuaaaggcaugugccaccacugccaggcuauuaugcuuuuucaaaaauacaaagccagaauuguuuccccaguugagcccaaauguggcagccagaagauguuccagaagaugacagcucccaaauaacaagauggggguucucccaagcacagcucaaguaggccuccgggaagguaaauaggaaugagguggaauagccugagccgggcuaagggguuuucaaugagaggccuguugguuucagaccagcuguuccgauuuguucucagggcucuuguucccaugcuucugcgguucccuccagcacgggacuaguuuggugcugagccaucuucaucuccucucuccuaacccuugacacucaaaaucuuccugaugcuggugauauuggagcuacccuggcugggcuucucugaaugaaagugagccacuugccaaaugggcauguccugcuggcugcuguuuucccucagaauguuugcugcagaacauuuacaagaucugggaaauguugauggaguuagucccuggccgguuuuauuugggcugggggucaugaaagcccacucuguccuuuuggccaugcacugucuuuucuuucacugauuucaguggccaacuuagaugugacaggcaguagcagcacccaucauuuaguuggcucuggcuugcucuacacauggguaucuuaaggaugaaauacuuuacacuuuuauagauuaauuguucuaacuauagauauuugguuauuuaaaucauuuucuguuugugguuuauguuuguuguuggcuuugggggaguaacuuugcugcuggagauagacucaaacuugugacaguuuuccugccucaacucuuaaaugcugggaucccaggucugagccaacaugccuugugugccauugcuguuaguuuccuugagauaugguuuuuguaucuuuggugaguuaagaauuggccuguuucacuuuucagugugccaucuaacccugugcuagccccuuuucagugugucaucuaagcuugugcuagccccuuuucacugugccacuuuucagugugccaucuaacccuguguuagccccuuuucagugugccaucuaagccugugcuagccccuuuucagugugccaucuaacccugugcuagccccuuuugcuugccccuccccagcucacuccuucuguugugguugcuuaugguuuucuuguucuuauuauuguuauaauuuuugagauuauaauauaguuauaucaucucccuccuuuccuguucuccuuccaaccucucccauguacccccacccacucuuuuaaaugcauggccucucuuuaauuauuauuacacauguguauaggcauuccuaaauauguaacacaaccugcucaguuauuguuuuaugcccuggccuucuuuuguucccugucacacucagaccuuccauuuuagcaaguggcugugcuuugcucauccguggggauagauuuuuuauuacugaauaaaaugaaacggcuucuccagcccccuccggauggcgaaugccucugcccugcgcuugaaugccucugcccugcgcuuggccccugcucauuuuccugcugcagccccuggaucugccaugcauugacugcuagggcugccaugucugcccugccuuguuauucacagucccugaaccacgaggccccacacucuuccuucauugugaaaauaagacacauugccacccugaugucccaaauucucugguucccacuggcucccccuguauucugagcacacucgaguucauugccuggcagcugcuugcucccaaccccaacacuauucucaguaacaccagucucucgccagccuccuaaccccacucucaggugcccuugcccaaacaagucucuccaaacuucauguacuguuuguuuguuuauuuguuuguuuuuagcccacucagucugcuuagugcauggguauaggaccagcuacgagaacaugaaccucauucaucaggggccucguuccuguagaaaacuggcuugagagauggcucagugguuaagaguauuugcugcucuuccagaggaccuaaguuugguucccaccauccaugccuguaacuccagcugcagaggaucugauacuucuccuggcucagccaacacaugcacacacacacacacacacacacacacacgcacgcacacacacacacaaauaaucauaaaaaacuaacugacuccccaccccugccugcagccaucaguugccaagagcuccuuggcaagaauggggcuuccauggauuuggucaaaacacauuaaacacguguaugaaagucuugaauaauaaguuaaaaaauaaaacuauaugaaauaagauaaaaucaauucuaaacaacaagauuuaucgagccucucuccugcccugaggcacaccugcaacauccagcucucugucuucaccuugauucuuucucuccacacagaccugccacucaggaccagguaguggagggaagauuugcuuuuccaacccucuaacacauuaaucuugcuuuccuaaacaaaagaauacauucacacugagauccacuccacagccccgucagcauaugaaguaguuacguugacagcagaggguuggguuuuuuuuuuuuuuuuuuuugguuuuuuguuuuuuuuaauaucaugucuuccuuccugacucauuaccuuucuuucugguauuuaugugcccguggguauggcaugugccauaugaguaagugugcuugcuuuguuaaccaucucaacugcacagaaauguuuuuaaaccacugcuggcaugcauuaaaacaacacugucugccuuccauaguguuaggaagaaggacggggugcacagacuguuagguuuggauuuuaucagcagauuuugagaacuggggaaaauguggccacauauuuacuuuuacugaugggaagcugaggccuccagccagcucugucgaguugggacugcaguggcuggggaugucgcugagguggcagaguaccugccugacauaaaauccugaguuugagaccuuccauauauaaaccagauguggucccccuugacuguaauccuagcauuugggaaguagaggcaagaagaucaauucaugaucuccuaacagguauauuccaauacugagaagcagcaaguucaaggcuagccucaaacacgugagacccuaucucagacaacaaaauggggacugggggaacugcagaggauugucauccuagauacagauuuccuuuugggggugucugaaagagagagggagcaaaaacugagccccagaaguggcccuagaauacaugucaccugucaacaaguauaccugggacccucaacagagguaaaccagggcuuguuucugccuugucuacucucagagcagggucucuuagccuuugucacaucucauguccccauuaugguccaaacgccuaugguuaggccucugacauaugcucuccuguguuguguccagggacagggugccuugucagagagacuccggagcuucagcaugcaggaccucaccaccaucaggggugauggugcuccugcucccucgggcccuccuccaccagggacugggcgguccagcggcaaacacagccagcccaagauguccaggagugcuucugagagugccggcagcucggguagguuguucccugucccuuugaucauuaagaagcacaguguuggauggcacacaaggugucccuugccucacaaaccugucaccaacagagucauuuguuggauuguaccaggccagaugaggaacgcaucaucgagugggccacucagaaagcugggcuggggacugugccuugggcagguuaggucauaagcaucagauaguugcugcuccuucaucauugucugaggaaucaagguguugggugcuauaccugggucaagucuggagcaggaacaagucugggccuugggaguccuuucuauucuccuuagccccacacucaggucucaugacccccuucucccacuccccaggccuggugacacugugggccuccccucuccccgaguaguuccucuccucacucugcacugucuccaguucaucuccgaccaccuacucccuaagcgugcucacaucugcgacuaccaaggaccacacugggccugagguuccuggggaggccaaguccuuucaauaacuggaaaucgaccucucaugguuaagcacuuggcaggagacugcccauauggggcuuaacccuguuuaaugugugggaucuugggccugucuucagaggucucaaaagguuugcgugaaacccagcuguguagguugaggugugaauccaguaucuaaucuauccauauggacuuggagcuucuggggggggggugucaguguauggacgggacgcugucaguuuccaagauggacucuuagaagaugacaguuacucgggagcagagccaaagcuguugauagaaaaugguggacagcaggacguguggaggaggugccaagucaucaccuuuacccuccuuguaaaaaagaacuaggauuugggcuguuuuggaauauguauuauguacccagugucuuuccugcccuuaaacaugcagaccaggaccuccagggcacucggacccuuauuguguacuguaagaggcaccuccaaaggcucuugggcucugagggcuugcacauggcguggaccaucaacccugcuugguaccccucagcuuccucucuacucaggaccugcaccaccccuagguuugaaggucguauauuuuaagugggagauguuuacccccuagaagcaggguugcaggacuggagaggaggaacguuggcuaugaggauucaauuggaauaagcagucagagugcucagggcuguccaugccuggugucaguaagcaguaaguaaaguaaccacuguuguaaacccuguuaugucuucaucucauucaagaaaucacuuuagaauccugaaaggguucaggagacacaagggcuucucucucugugaggcagugugagcccugauucuggaauggcccacaccaaaguugaaagggcaggcagggaguccugcuuuggcuaggacgugaacccagauagcccugcaaaccugucccuuuaagagucuauuuuugccauacaggagagaaccaaguagaggcugcaggcacagagaggucacgcacucugccaaggccacacaggaccagaaccugggccuccugcccagaccuccucuuguuagacuuuucaggucagggcucagaaugaacugagaggagcuuggcggcaucucagaggugauguggaugucucugaggccggaagcggcuuccagcccagccauggacagggaagguugggggugcuuuguuuugaugcuggcagagggggggagauccuuugccacccugagaccucccuuaagagagggaggugcuggccugugauggggaggccagggaagguagcacucuccccagcugcucugagccuaaaucaaaagucaccucagacagaaagaugagagcccacuuccuccccucugcucugugugccaccagccucagaacuuuucucagaaagaugccuaagucacagcagaguaucugaccuugugcagcucccugucccuucagcuuucucuggaggaauggccccaccguguccuagacaucuugugucuugggauugugaggggaacgagagagaagaaaauaaagaccauuuucagacuucuaaugggagacaggagcugagacaacucagguugagguagauagauagauagauagauagauagauagauagauagauagauagauagauagauagagguagauagauagauagauagauagauagauagauagauagauagauagauagauagauagguagauagauagguagguagguagguagguagguagauagauagauagauagauagaugaaagccugggggaggguugggacugcucagcugguuacugcuuacuuuguaagcaugagaacggaguuuggauccccagagucuguguaaaagccuggcgcuguagcaugagccuguaacgccaggguacugacuggaggguacugacacgaagauccugagacuucguccagguugaugagccagugaaccccaaguucagugagagcuccuuucucaaaaaaauaaaguggcaagcaagacaaaaaaaccaacaucaagcucucaccucuacacgcacaagccggggugggcucaccucccacacacacacacacgcacacacauauauacacacaacaauacacauauuauacaaaagaauauagaguuugcaagagcacaguuaagcaaaggaauguguguagauguuggaguucaugcuccuugaggaaggggaguuagugaagugcuggauaaaagcaguggcauguauggguccaggaaacagaggauggucugaagagaaccagggacaugagcguucggcccugugcaucccaaggaaagaaauaaaggucgggcagugguggcacaugccuuuaaucccagcacuugggaggcagaggcaggcggauuucugaguucgaggccagccuagucuacagagugaguuccaggacagccagggcuacacagagaaucccugucucgaaaaacaaaaaaaaaaaaaaacaaaaaaaaaagaaagaaagaaagaaagaaagaaagaaagaaagaaagaaagaagaagaagagaaggaggaagagaaagaggagggggagggcgaagggaggggggaaggaggaggaggagaaggagaaggagaagaaauaaaggagaaggcaggaccuccacuugcuugccacaggccuagcacacacaugguccugcacguaggugagcacagcacaucauccaagcauugggaagcagaguucuuugaugccaccgucagcacucagggugaggcugggccacacgccagagcugacugacccgccugguguuugcccucugacuugaaggguuagggcaggcaaggggcugacugcccucucugcagacugaacagagagggaggguucacacaucgaauggcugccacuagcuaccaggaaguguccauggaggugagagacuucuauagauucagagucacugggucagcauggauuuagugagcaccuacuauagucuaagagguuucucagaggauucgcugaaucaaaaggucuaggagagguuuugaggagggaugguuauucccaggagaaacuuaaacagcucucaccuccuuagaacuacgggaaucggggucugacccuagaggcagcugaauuacagaugaucccguucaacacuguagugucuauaaagaccgcccucuuccugggcuuccaacucaacggaauucucaccuuccccuggggccucccugguugcuggggccugguuccuguugagggggggggggcuaucucugacagcgcccccaccugaucgauucccacaguguguaccugcugcuccaccugccggacccggaaaggugaguagccagccugccugcagccugcuggauucagcuugcuucaggggucgcuaaccaacugcuggacucugaccuuggggcucccuuucagcugaaugggucagaugagggacaagacccuuaggggaagcaaaaauaaugucuuaacauuucuguggccaaacuucuggagaagcggcagucaggaugcuggcugggcucagucaccugagggugugacuagaccugguagaucuaucccaagauggcuccaggggccacugccuggaguuccuuaccaucugggucucucucaagcucuuggggagugcugaaacaucgccaguggcuuggcccagaaugaaugguucaagagagaggcuaggcaggaagccaucaugaccuuuaaugacuuugccuuugaagucaaguuagcucucggucuguuugauggccaugagucaccacggaaccuguguuccaugagaggagaauuauccagccucuuagaaggaauguuagagauguaugugugaaucuuuaagccaacauauagcagugcacacccagugcaauggguccugaggacagagggccuugccaugacccucugaagggaggaagcccugaguuuuuaggggauucuaccccuacuaagagugcucuggcuugccacuuacuagcugcgcaacuuugugugagucaccuaacugcucugaaccuguguuuucaucauaaaauagagauaaaggucccugcuuuccuccuuccacuauaauggaaauggcuguuaaaggggcuuuugaagggcgacuauuauuuuauuauauucuuuauuuguguauaaagggugauaugugaucaugccauggccucuguguggaagucagagaacaacuugggagagucgguucuugcuucccacaacaugaguuuuaggaagagucuguccuugcuucccacaacaugaguuuuagggaccaaaaacuuggcgaaaggugccuuuacuaacagccaucucucuggcccacggcuacucuuuuuaaaggcugugauagccagaugaacccaggauuuugggucucccacuuccagauaaaaccccuugauguugcugcugguguaugugagugacggcugguggagcuauggcucucuggggccugcuauauugcucuuacaagaugugccuccacuuugccugagggagggcacuggauuuugaaagccguaaguccaagacaagugacagacaggagcacuaagcggggacacagugggagagcagcauucaaccagucuugggcagcccauguccaacuggggccucccaggccaucuuggaagcuggggacucccauugguagacacugguagacuuccuaguuccugggaaacagcucuucguuguccccagauggccauggucaugucugucccccauucuacaugaugaguuguaagaaccaugagccaggacagcaucacccagggaccagguugguuaacgucccauucuuucugauuccugccucuaagauaccuucaccuaugaggacaccaguaguaguccaagucuauguagcagacaauuaaaucagcagacaguagggaucuacagacucugcagaccacugcagcaggugucuaggaauggauggcauuuggaggaguggagcaguagcagcagauagcuggaagcauccagcggggauggcucugcuuggagucuaggccugguagcuuuggcucaagccuuggcuuuugcauucccuacucuccuaagguccugcugccaaccacuacucuggaaucuucuuccugcccccuagagcuccuugcaaggacccaauccaugauuccuccacagugggaaccucuauguccuuagggacaacucuccacuuucugggucuccuucucccuucuguaagguggaagggauggguuaguguuucuguggucccucuagcucucugccagugaagggcacucuacuggaaagugcuggcaagugggcuugacucacagcaggggcggaagcugacucucaagcuucugcgcuuugagaggauuggggguggggguggagguggguccuguggaauggaugguguuccguucagaacaugggaagguucuagucauccuuagagacugaacuuucuaaaggauuugcaaauccaggucuuaauucagauaguggagaaaggagaauugggaauuugggggcugacagucaccuuacagggcagcaacagccauagcguuagaguucagagcccagcacgcagcaguuguuagucagguucuguucuaaucuaugccucccagacacuagaaaguucucucccucccucucugcuucauucugauugucagucggcucccugcuguuuccugcauaguucugucucuuuggagaaucuuccuguccaccaccuuuccuccccuuuuuucucucuuccucccugagcugccugucaucagucagagagguguaucgggcccuuuuaaagucaagucagcagggcauaaauuuaaguacacgcggguuucguuccaaagccccuucucuaacagguuguucuuuucuuccuccuuggugacugcugggauccuggauguaaguguucagacaggcaugucccgucagcacaucugcugccuugcaucacuaaugugugccgugugggauguaugcuaaccugggugucgugcugcacuguggguggguggcucagcgccuagggcuggcagaucuguucaggucuuuaaaggacugagacuacccagccccuccuuucuauccuccagugcugagccgacacuaacacaugcaggugcccgauuguggaagacaacagggaccccugucuuuaaguagaaaccaucgaccuugacccaaccaugacaguucagugagcuccaggcuugggguaccuuugcuaaaggguugggaggaccucuuaugggagagcauauauccacacaaguucucagggucuuggagucuuagccauugggcagaggacauauuagaucacaagucuaugcaaaucuacagauacacucuguaguuuccugcccagucacuuguccuugauuaucagauuaguaccacuccucaguguggacaaauccagugugacuuauuucuuauuuacucugcugcuuguuccaaaaaguauauguguguaugcacguauguaugaauguauguaugcauauguguaucuguaugugugcaugcaugugugugugugugugugugugugugagaaacagugagccaaaguaagaaagugaaagugggaagugagaagaaaggaagauaggaucaggagaaaauuguaaaugcaugcugccuggucauuccucacacccugaagagggaaauacaguuaaccagcguccauggugcauuggcacucagaggcauggcuaucccaagagugaggcagauuauacaaacaagggacuagggacuuggcugagugguagagcaucugcccggcaugugcaauggccuggauuugauuuccaucauucagaaaaguaaagauaagacaguaaauaccggggcuugagagaugguuaagagagugguuaagagcacugacugcucuuccaaagauccugaguucaaaucccagcaaccacaugguggcucacaaccauccguaaugagaucugaugcccucuuuuggugcgucugaagacagcuacagauuacuuggauacgauaauaaauaaaucuuaaaaaaaaaaaaaaaagauaguaaauaccaacagcacacuuggcagacacacaggaccauccuaacaauugggguguuuuuaggcaggguucugugucucucuuucugucucccagccacccacacuggccuccugugcucccagccucugcccagaucaggccaggcuucuacuccugccuagauaucuguaaugaucgccacuccugggagucacagaacuacuucuuuucaaacuacgcuucuuguucaagguugcagugggaagcaugcacaaagcccuguuaagaguuucagugccgagaugggcccugauuuuuguuucuuucuucguuuuauuuugcuuuugugucugagacagggucuccacacuggagccgagacuagccuggaacucacuuuguggcccaggcuaacccaaagaaaauuucugccuccguuucccagaguuagggguacuggcaugcaugcccaccuaugaggugguuaucauugugguuagugugugguuuagaugcucagccucaggacauucuggugggcagacugaggaauuauauacccaaggauccugcggugucucuggguuaucauaacaacuggcaggggaaaacucuucauuuaagggaacagcacacaccuguucagaggucuaaacucagcuaggaugaacucauccugaagauguagguuuuugagggguggagcuagccaggaugcuucugcauuuuuacuuuggccugagagccuuggguccuaacuaggucuggaccuuauucuucuuuccagacaggaggaaucugugucuagagggauguccugguuagugagagccaugcuccaguguggagcagagcugaacugucuaaaaugacaacaggcuuccauugagaucacuagaugauccggaccagcugagugcccaggccuuccucagacacucagaggacaagggaugagcagccacagccccacaacucaggauguuuucugcugagacacuguggcccacaagagaaccagggcauauggcaggagcugcaggguauagauucuaggcauuaucuggggcucaggcaacuuuggaagaccagaguguucaagaaagguggcauuacugcucucaaguucaacaagcugauuuaggcagggaaggacaagaaagcaacuauacucggaguaaacagucugcgagaggcacaaagugaagaaagaaagaaaaaaaaaucaaggcaaauuuaugaugucaggcugacaaggcucacacagccugagcagauggcucuccacccacggcucagcccuauaaggccggcugacagcagcuaugggcucaugcugcccucugcuggcugcuauggagcacuggaaacuggaaacacgaaacacucuuaguugcagcuuuuaguuaauuccacaaggacuacuguuacacagcaacuagcccguucugcgccugaauaggauuuuagaagcaguagcagggugucccaacaagagcucaggagucuguauguagacgucagagugguggaaucggaugaguuguggacccucuagcucuaucuucuguaacucuggaugaagacaacauaccaagaauagaacuauguucuggaugaagauaacagaccaagaauagaaccauguguccguggauucgagauaaacuggguauagcagaaaguaauuugcauucugccuaagcuaggacauucuggcucaaugacauggcugcauucaaugggccaacuuaauucuggagcuuugccuauagcucauucaaguuucacugaaguaagaaucuugcugucgcauggggguggggugggagauacauucagauuuugcaucuuuaugaggguccucuucuaucuagcaccagguauuuugaaaugaaaaaucugcauccauuaggucucuaggccuacauuuuacauacugucucuuccaggaugccuggugcugcauagacaaggguacugcacugucagcaucuccuguguguacgaguuagaaagcaucaccccucggaggcacaguucuugucuucagagaaggcuauuucuguuguccacucuuccauuguccagucacagaucuaagaacagggcauggcaagucucagaguuaaggaagugucuucuauccuccugggagcuguucaauggcuucugagucugcaguugauucuguacacucugcuaaggcuuccacuuauaccuucacuuuccugaguccccccuaaagacaguacggcuucuucagauagggggcccuggcuguccuaacagguuuguugugcuguguaccuaaucacccuuccugccauccuugcucccuuccacacugaccccuucucgcuguccuuugucuccuuuguuagauggacauuaagugguugagggagaugugaaugaggguggugugaagucaugggagccccaccagguccgaaacccacuggcguuuucugacgaggaggaggaggaccuguuggaguucauguacaaguauaaggcaccgaggaggagcgaguugccccuggagguacauagugucugggggugugggcuagaacauguguuugcacuagagaucuggggguccugagaaugacauuacuugugauacccaacacuuucugagugcuuaggggaaagaacgacuucccuccaaacagguaggacaaaccaccaguuaccugccaagaucuguguguguaugugugcgugcgugcgugcgugcgugcgugcgugcgugugugugugugugugugcagcuaccccauggaguccauaccccauggaguccaggacaguaagugccucaccaggugaguuauuccuccagcuccaguucuuuaguuaucaggaaacaauauacuuagcacuguggccaauuauggauauagacagggcuuuggcagcagaaggaccaugccugugacucguguucugugacaaagguggagaguuacuagucacaggcucagggaaaagccacucaauuccuuucugguucuuuaucuacuaaaccugauggccugcggguccauugugaaaaagucaugauuccggucacacacaaaauuagagacccuggugagaaucagacaggaugcucagaaacauuccccuucauaagccuaggcuccuagcaucccuguucucucugagauggaagcuacaaccaccucagauggaggaguuccucacauuccuggacaagauggaucauuucauauucucucauauauucuugccccccccaacccuucuccaguguugggaucaagccagggccacccacauaugcuagacagacauucuaccacugggcuaugucuccaaccggucaguguggauuaguucuggguacugggugaguccuaucugaccucaggaucugggaaaccucaugauggggagaguucucucucaaucucuaaauaugccagagcccaagagagucuuguuuuguuuguuuguuguuuuguuguuguuauuguuuuugagacaggguuucauuuuauagcccaaucuggccuccaccuuucucuguaguagaggcuggccaugaacaccuaaugcuccugccucuacuucccgaauacugggaucacaagugugcaucaugacaccuagcugugguuuuaaagcuuugcacacagcuccccuguuuacuguaauggccaagaggcaggugccuaaaaggggggauuuuauugcugcagucucaggcaacaucuguagugagcaaugagcauucccuaccagugaggcaauggccuggggcaucugggggagcagggagcuagucaucgggagaugguggguggagaagggggacaggccucaggaaguucagucugaugggcagggaagggagauaucccacagcugggcuuggguacaaagucugcugugggguguaugcaaagcacuaugaggaaaagaagcuggagguauguaucuuguggauagaguacuuguuuagcaauguaugaacccuggggucaacacuccaguaugggagggaaacagagaaacacucagcccuguguggagcacaucuguaaugucaacacuacacuuggaaggcugaaguaggaggaucaccccaaguuugaggccagccugggauacaaaaugaucucauggccacccugaguuacuuagaauaaccuugucucaaaugaaugaccaccaaccaaaccacuauaagagacaacaguggcuguguguggucaggcagaggccagagccaaggggucuccuagacuuugaagcuggugcucaaggggacuagaaauauacaagaauagggcuuccagucagaggggacaguggugugaaccccauucggugacaugcugggaggaugucauuucuuucauuucuaucgugaugccuccugugguuugugccuccucugagagaaaaggucucugcaaucaucuucagggagaugagguagugguggccuuccagguguggcuugcuggagaguaaaagagaacagagacuggacguuugugugaaagcacacgccagaaaaaaguucccauaggaacuauaaaacucagccaagggcuggagcuguccccugaagcaaggaagccaugccauucuguaugcccuuccuucucuucagccucaggaaggagcaguggccuucccggggggccucagccucaccucacagggugcaacgcuagaaucugauuccuguuguagggaacccagcucuacccaacaacagagggagcuggcucaaguaccccuaccugacgcuguuccccaagauuccacccucaagccccucucucugcuuucucucucaggcaccgccuagaacccuacgaucccgcuucaggaagaaaaguaccucauccucggccacugaaaccacgugagaugagccaacagccccggauccacacaugucugucuccucugccuuaaagagcuagucacuaguaccauggaaguccgcaggcugggugugcuucgagugugcagcccacggacauggccuuuacucgcuccccucuucugccuuuaagacucuucuguucuuuccuuuuuguuccugcuggggagaggcuaaagggaaaagguggugguggagggugaccuuuacgucuucugggguuagugauuuuccccaauuggauugucauuguggccgcaguguuuuuagaucuauaagcacucuuuccaugaugcugcugagauguacauuuguaauuuguuuguugcauaguuuuuaguccuguaaaugcaaacgacgugaucuuuuuuaaaaacccuuuuguuguucuugguacuaauacauuggacuaugguguacauaguuacagcuuuuggcuuaauguaaugaacucgcaagggcugccagaaguucuggugagagagcugcaaaaacaaaaauguagacaaauauuuuaauucuaggcaaugucuccaacuuccuuacaaaggcagugccaguaaggcaucccuucuccugcaggaaggcgguggugugcuucuggcggcugagugguugguaggucagagcggaggcaggagugcaguguuccagcaacaggaagaaaguuggugggcaucagggaagagggaggaagaguacggcuucuucaguucugggucccuggcuguccuaauagguuuguugugcuguaccuaaucucacccuuccugcccuuuggggucaagaacagaagcuuccgagcccuuuggggagcacuggcccugcuucaggcaggccagcucacccuuacuuagcacggccauuuagggaaugaagaucagcugcuggcagaauugugaguaucucagaagggcuuggcaagaguguuucuccuucagggaccagcgcuguggccgacuucuccaggagccuacaucugagcaccuuguuuuagaguacacaaggcaaaaagaaaagucuagaacuagcuuuuguuacagaugugcucaaaacacaugagacacucaaaucucaaauggucgccagaaggcagggucuagggaggacugaggcuaagccacaggcagcuguggcucuugcuccuuucuggcuuguguggaaggugaaugggaaggacugacacucaugcucacuccaugucuucguggauguuuuauacaagccaggacugcagugagaauuuugacaagucucugacuuagauaacauugcguugagggagcugcccucuccucugauagcugagccaaauuguagggcuagucugugugugcguagaguugguguuuucguuccauggaaugcaugcagcagucacaacccaguuacuccuauuuggauuauauuuguucacagcuaugcccugaaggcuagagaaauaguguuguauaccacauagaacugucaacugacugcaaacaggcucaauuacaaaccgcucugguaccgagcuaugcaaacaugcacugggagacugcuccaucagcugggccuuggccauuucacaaaggguuucaguugcgaguucauugcugccagauacaccuaauggaauuuuccaaaggugauuuuguauuucagaacuaacccaagagcugaugacugacgguaaauagucugccugggccccauauccaucugaacccauuaagcaaagcaucugcccucuucaagcucaccccacagcuccagacaagagaagugacacccuucaaacauaccaacgugucagcuggguguagccaggaugaagaggaacaggugcaggaaagccugagagaagcagcuuugcagcucccccuccaccccccgaaauaauaaauggcuuuagagacagaguucaaguccuaguguauuuucaucguuuuacaacaggaagucauaacacaucgaggcucuugaguuuguacucagccaugccaaaacccaguuugaagcacuccucagacaugcuguauuacuucucgcucaagauuuaaaauauaaagguaucuaaaucguugucuuauuguaaauguaacuccuuuuccuucaaguguugacuaaguuguuuccucucuuaaagacacucacuguacagccaaacacagcugucuuacuucuugagaacuguguuuacuuuucugacaagcuguguauuuguauguagacugacauaugaugugaaugaccuuguauguagaagugcggugcucugucuacgcaggauaaaugaauguuucuaguucgcugacuuaagacacaggcuguuuacaaaucgcuagcucgaaggucuacuugucgcggcuuugaguuacucuccauuucugcagaggugaggugcagucuccugcucaucaacuggagauuuagucauaaugccuccugaguuugugugaauagcuugcucacuuugcuggccuuugauauguauguucucugugguaaacuguccauguguuuguauuaagugcuuaucaaccacaaccaucacguagccaucccaguucuucaccuugcacaguauuugaaguauuagacgugguggaagaugugcuucauccucugacaguggacgcucgaagagcucauguuccagauugugacugugcgcauuuccucuaguuucuuucugaaaucucucuauaaaugaguacaauuaauaguauacuggacuguguaucuacaggauguaaauugcaguauuccaaaggcugaagcucugcuguuuuguuauaaugccugauaaacaucuugaauaaagucuuaacauuuuucuuuuaaaaaaau

SEQ ID NO: 3059 - RNA, 10920 nt, Mus musculus
aaguguggucgguucucuuguuuuuacaguacacagacuagaaacuaaagcagcagauucagagggcagaaaacaggaagaagagaugggaagaaagacuagaaauccauucauucauuacucauuuacuaagccaggguuaugcaccaacagaguugacagguagagagcaaagucacacaacucagacuugaacggguagaguauuuacuacuagugucagaucacagucauuuguugaucaagauaugaguauccuauguuguuagaaaaucaaaggaaguacacaagauuccaaagaguuagacaggggaucugggaugcauuagcuauauuuuagaguaauuuauuucagcuucuauaagcuuuagugccuucaauuuauaucagggauaaaugauagcucguguauaagauuguauaagguuggcaugaggugcagcagaguuuugcagauuugcuuaaauaugacaaguguucaauaaauuacauguaaauaaacaguuaugcauacacuugaacaucauuuaggcaggcucuaaagcaaacugcuuuguugucaaacuaaaaacuuggcuuugaugaaaggcuccccuacccacauacaaaagcuguauguaugaagaaguucccuuuccauccgaggugugccugcagcccuucuacuucagccuguggccgcuguccucugccuagccuguccuuggcuacaggggaagccaaggcacugaggccauguaacagagaucugaaccauccaugucgacucuagaaaagucuaaggcugugcagugucucccuccuuagcuucagcacagugccacagaugugcgggaagcaggaacugugcaggcgaggaaccucgaaagccucacagcacucagcuucugccgccucaggggugagcacagcacgagccaccggggcagagccauugguguaugaggugcucaagucacacgccugcucucuaucaccugcccccacacauacacacauacacacauaugggguuuuacgacauucuacaucccucuccauuuaaugaagaacuggcuucaaauggauaaauuaaaaaaaaauuaaaaaaaaaacaaaccuaagcugggcagugguggcacacgccuuuaaucccagcacucgggaggcagaggcaggcggauuucugaguucgaagccagccuggucuacaaagugaguuccaggacagccagggcuacacagagaaacccugucucgaaaaacaaaacaaaacaaaacaaagcaaaacaaaacaaaacaaaacaaaaacugaaugguccucaaaguccuggccuaccugccaucaaaacaccaacugauugccuuauucuacuaaaugggggacuucauguuaucaucaauggauuucaaacagucauucauccuuaauagaauuuucaaugaggcaggcugcuuuguuuggaaaugcuuccagaugguucugaugggagagcagagagucacucucucggccugcagcaucaauucugacucucuguaaaccacguguaacuuuugcaucuuucuccaucugacuacuaacaggcccgaccugacccuacuuagcuucugagaucagacaaagucaugugcauucaggauggaauggccagacucuuuucuaaaaugaaugauacuagcugggcgugguggcccacgccuuuaaucccagcacucaggaggcagaggcaggcugauuucugaguucgaggccagccuggucuacaaagaguuccaggacagccagagaaacccugucuugaaaaaacaaacaaacaaacaaacaaaaagauaaaaugaaugauacuguugccuucugagcacagcugacaucagucucauuaaaugacaggcaacuuucucccuuaguuuccacccugcguuuuagagaauucuggaaaaaaaaagcugaucuuuaccaaugaaaauaagaaaucuuaaguggauaaacuuuuuaaaaauucagugccuuugaaaaauugggcagaggccuggagagacaguucagcauuuaagaacuggcuguucuuguagagggcccagguucaauucccagcaccaacaugguggcucacaaccaucuguaauuccaaugccaguagacccaacaacuuuccucuggccuucaagggcacauacacacaugcagacaaaauacucauauguaaaaaauaaaaaguaaaguagaaaagaaaaacugggcaaaagaguuuauuauauagcuauguauuucaagaaggguauuugggaaggugauuuauuuuuaugaaaaguauccuguuacaauaaaauuaguaauaacugucauaaauacaaagaacccaggacacaagaugaaagugcccugcuacucuauguaccucuaaggaaaacagcucacaccuaccuuuuuacuccauaugaaccuacugauacaacuaagagagccuggguggaguccuagccacaaacagauaagcucuacauugcaugauggcauugauucagacuuacgaggaaaaggcaggauggcccaaugagaguucccuggcaauuaagagagaagagaugacaagaguugaggguuguaauguuaaagggaacccaaagguucaggcugaagggagucugagagauagaaacuuuacauaaacaaaagccaagacuaaagagagugauggugaguagacacacacacacacacacacaccacacacucucacaguagaaccaaggcauaaagucccaccaucucuugcuucauccaauuccugcccuccccaaagcuggggcagagaguuacagguaggagacagugaggagguuccugaguuccuagguauuuauuuuuuaaacacagcaugugucauauugggaauaggcauguaagaugucuguuuagcaugugcaaaaaccuggauaccaucucaauuccacacaaaggcccacuguugagcgucuuuucguguuuuuccucauccaagauuccagaaauaaggaaagccauuaccaguuuuuugaaauaaugcacaauaaauuuaacuuuuaguucuaugaccaacucugggaauguuuaaugcacaauggugguaaucuaagcuugccgaucagcugguacaguuuacaguuuaacgcauacucacuuugcaagggcauuauguacacaaagacccacauuccauagcugggaacuaugauagcucugaacuauacucguagguuuguucgaucgugguacaucugguaaggaucgccagcguaccaguugcgccucuuccagaaagaugucgucauuuuauccaggaguuuacucugggucuugcugcagaacacaaauucccucaagcgcuucuuucuugcaguugacuuuuuccauaauuuuuucuuauagccagccuaugagauaauguuccaaagacauuuuaaaacuugcaaaggcagcagcagaugcuccauaauuuaugguauauaggcccaaagagcaaagccagaccuacagagauuggguuguuucucuuugcaauaaguaacagguuaaaaagcauguguagaagaggauuaauaauuuaacacuuuagaaagauuauuuaaauuaaaaucacaagcuagacauaggguacauauguguaauucaagcacucaggagauugaggcaagagaacugaaaguugagagccaggcucugcagaugaaagcacgcaccacucuucagaggaccugaauucaauuccagcaccaauacagguggcuuacaacuauccauaauucuagcuccccaggacccaaugccucuggccuccgugggcaccccacucacaggcacaggcccacacauacaaauaacugcaaauaaaauaaaucucaggcagacugaucucuguuuaguucagggucauccuggucuacauaggaaauuccaggcuagccuggacauaguaagauuugucucaaaacaaaucuuucuuuuaaaaauuagaaauaaaugaaugaacacagacugcagagcaagagucuaucuggaaaaaaaacgaaaccaaaaaugggcuguggggauggcccagugggcaaagugcuuguaaugcaaccaggaggaccugaguuugcaacccagaaccuauguaaaagcuggacauggucguggacuucuguaacuccaccacuugugaggagaaaggcaaauggaucccagagcuuacuggucaggcugacuagaaaaauuggugagccccagauucagugagaaaaccucucagaaacuuaagggccugagagauggcucagggcacauaacgcucuuccagaggaccagcacccauguuggacagcucacaacugccugcaccucuaccuucaggaggaccugaugccucugaugucagcagcagcucuaaucguaucugugggacugagcauagauaaugaggcucuuguuaagaacaagccaacagcuuacaagccaaagcucuucacugacauuucucaaugccggcuaugagcucaguucuaauacauacacacuuuaucuacagauuucucuaagauaggggaaacccucucagcccuucccacagugacugcaccugccacuuugaacagugcuuuacucuauucacacucacacccuuucucugcacaaggacacagcaggacacagaagagcuaccguaagaugagugcacaccauggcuaggcucacgcagcacaaagacucaccuuucuccuuagccaaaggccagaaugaagucggaggaagcgaugcacgaccgacuuuaccgucuuucucuugccuuuccgugugcugcaguauguuagagcucugacugguggcuucaggacacugggaaccaauguggccacucuaaaauacaguuuuaaaaaaguagugaacagacugaucgaagggcaaggaacugacuuucaucacaccacauaaugucaagaagauuggcaaccuuccuacuucaagccuucuaaaaucugccccccacagggagagguagaaccuguguuuagcacauacaagacuuuagggucaauucccuaacacccaaaauaaagcccacccacuugaccauuaagagagaauguguccaccguauuuuaaucacacaguuucuuaucuaucugccuaccuagaggacuucagcuuaucuuuguguacuuucugcaaguacaguggugggaaccuaagagugcuucacggauuaccugcugacugacugacucccacauagcugaaccacauaagcugaacaucucaucugaucucugcuuugccugacauuuucuggaaacuguauaaacaacaacaggaaugaggccaggguggaggcagacaucacuaguaauacacuagacuaguucacuuagaccuuggguuccucccacagugcuguaagacgguuuagaaagccaggcaagguggugcaugccuggaaucaauccucgcacucaggagauuagggcgagaggaugauuacgaguuaaggcuacauggcgagauggaaaggaggugcucuguguaguccuguugugggcaucuagaaugccaaucauaucuccuccucagucagggaagguguauaccauaagccacaaguagggaaagacuaucuaccucuugaacacauuuuauagauugcaguacuagagauaaaagaaagggcuucacagaucuggggccaaguacucuaccacggagcuucaugcccaggcacaaauauuuuagaaaauuuuguguaacuauuguuuaaauguguuauuguaauguacuuuaccuauuaaggacuguugugguaugcccauaugccagguguccaacagaugugacaagucuuggagcagaggaaacaacugaugucugaauaugucuaaaaugaauggugcacagugaagaauuaagacaggcauuccuggcgcaguuccgauagguugaagaugccaagacauucaagggacgaaauauuccugcaaagacagagagaaguacauguccugaauauacucuaacacauauacccauauauucaaagcauggagacaaaaguagaccuaacagaagguuccugacgccagauucacagcgaccuauaacuuacguaugaugaaauuaacgauuauuauauacccaaugguuuuuagaaaaauuagaauccuaaagccaucauauaauccagauugaugugugugcacucuaugcccagaagugaggaacaagauauguguaagauuaacugcccuccaccaauuucauaccauggggaaacagccccuccagauccaauucaaugacaggucagagacaggaaagcuggaaagauugaguggagaggagauugaugaagaaaacagagcaggcgcuuccgugccugauaguucuauccugcuagugaacuaacugcuagacacaugaugcacaccuguaaucucaacguuuggaaaguggagggggagaaucacgguuucaagagcauccucuacuacagagccagucugaggucagccuaagcuacacgacuuacugccucagaaaacaaaaucaaaacacaaacaaaaucaacaaagggcuggaaagcuggaucagugguuagauaaauacugcuuuggcagagggccugaguuugguugcuaugcccacauuggaugguucacaacuaccuguaguccuaacuccaagggcucugccuacucuggcuccccagcaucugaagccauuugucucugcgugugaacacacacacacacacacacacacacacacacacacuuacuuuaaaauaauaaaacuaaaucuuuuuuuuaaagggcuaggugauggcuuaguggguaaacugcuugcuaucuaagcauaagaacuugaguuaggacccccaguauucaaguaaaggccagacauggugccacugcaguaccaggguuaagaggggguagagacaggugcuuccuagagagauccaacucaaaacaauaagcugaggagccacagaagacacucaaugccaaccucaagcuuccacgugcacgugugcuggcaugcacacucccucauacaugugcacacacaaaagaaagugaaagcaaaacaagagcauaaacagauccuccaaggaggagagcccacuuuggguaggacaaacaaccccuuggugcugaaacaaauacagcugugggaacggcagguucaggcuggccagaggcugugcauggcuucccaaccguggcagaaaugccuggcaacagccagagauggagcagagacauaugaacugaaggcuguccuccuuaucaguccuuuucccuaagaccacaugcagaucagaaucaaccucaguguacuucucuaguacauacuauccaccucuagugugagacugaagaacauacugaaaauguuccgugagauggaaaguccuaugacuggaauuuggugaugguuuuguuacuaaacuagcugcacaaaaaugaguauuuccgagcuagggaaauggcuugguguucaagugcuuccuaugccugagucugcagccaugaauucauguacaaagcugagcauauuccaacacuggguagggagagacaggcagauucuugggguuuguugcccagccagccuagccuaaugggugagugccacaucccagagaaaccuaccacaccaaccccaguagaaucuguaugacaaguuccacagacugaggcgaaacuucaaaagaaggaggccuccuggaaccggguguggaucucuuguccagaacaacauauugagccguaguucucauggcaacuuaucuguuuuguuuucuccuauuccuucucuuauuuacaacauguuccugguggccuagacuacgaucuuaagcaagaauaauggguaagaaaccaucccuugaaauggggucacuaacaugaccuuaucucuggggaaaccaaugcuuuacuuuauaaaucauuuacaaaauuauaaaauaguauuaugauagauaaaaacuuucccaacagcugggcagugguggcgcaugccuuuaaucccaauacuugggagguaaaggcaggcggauuucugaguucaaggccagccuggucuacagagugagaguagaaaaacccugucaaaaaacaaaacaaaacaaaacaaaacaaaacaaacaaacaaacaaaaaacccaaaaaacuuccccaacaauaaaauuucauauggcuacaagugugucauuggagguggcuuugguauaugguaaagaaagacuuaaauaaaaagaauuaaaauaguuuaaauuuacacauugaaaauuuauuuuaaaaaaucaagcauuagauguuaaacaauaauugaccauaaagauuuauuaaccugcucucagaaauaugccacuagccuuggaugacugcuccacugaauauauccuuucagaguuguaaugcuuggaugguuucuauuauuaacaauguuaccuguucuguuugugauucagaguuugcgugauuuuugugcuuuacugagccaaaugauaaugaugguauuuguaauugcuucacugaacacaucuaagaguuguaauauuuggguuuuuuuuuuuuaauguauaaaaaccccugccugagaccugcaaaaugcacucagauucaaacugccucuguguuuguuucuguuuguccccgcaaaauccuuacccacuuagcuuuccgggacccucauuccagggaccgccauacccgacugggguggucuguggcagaaacccaggcucuaaaagaaggauuacuccugagagcaaucucagacaugugccugcaugcacacacauguguauaugcccacauauacaaacauugccacaaauacaaauauacuaaauuguauuucaaugaaguuagcuuuaagaaaaacaaaaaacaaacaaacaaacaaaaaaaaaaaaaaaggaaaggccaagccuggcauguugguaauaugcuaguaaguuccgugugcaagaggcuaaagcagaccagaguucacaucuagcaugggcuacaggaaaugcuaucucaaaaagacagacaccagcaacaauuugaucuggguguaggguccuaugccugcaaccucagcacuccagagacaagggcaagagaaucccaaguaccagaccgacaugacuauuaauacagcauguuccugguuaaccugggcugcauagugagaccuuuccucaaagcaacaacaaaagcucuaccaaguugcaucuaccuaaucugaugcaagacuuagaccacuccacugucuucucuacugaucucaccaaacaaauggggcaguguggugaguaagggacagguuugagccagacuaguauucauuucagcuccuacuaacgaguggugugaacaggaacaacuuccuuaaccucucuaugcucauuuccucaacuuuaaauuagcuaauuauggagaggauuacaugagauaauauacuaaaaugauuaagaggccuaagcuugaagaaaacaucgaaacaaugcuaacaccagauaaagaugugcugaagaaaagcagguuugggaguccaagcaccuaaaaucucagcauguggaagcuaaggaggacugagaguuuaagaccagacugggcuccauaaugaggccuugucucauuaaaaaaaaaaaaaaaaagaauuuaaagguugugaugguggugguaguggugguagaggaggaggaagaagaguaggaagaggguuagagagauggcuuagcaguuaaaagcaccaacugcucuuccaaagguccugaauucaauucccagcaacuacauaguggcucacaaccaccuguaaugggaucuucaggugugucugaagagagcgacaguguacuuacauaaauaaaauuuuuaaaucuuaaaaaagaaaagaagauacagcagucagaaaucaaaaggguucacacacacacacacuggaguaaauaaaaaccagacauuacacuagacauauuguauauaaauuaauguaaaguucaaaacuagacaaaauaugcuuuugagagaugaagguauaguugcucaaguggcuaugggaauaaugaccggggcaaugcacgggguggaaaggggcuuggcuugaacugguguuaguuacacguauguccccuaauauaaacuuuuuauauacacauuucauaacucacaaaaguuccauuuuuaagcucuaauaccuggaaauuuuauaugguuacuuuuuucccucuugguccucugccuauuuuuccacaaauguuaucucuacaguauaaguugugugcaagucgcuuacugaucaccccuaucauacuugaguacuuuuaauuuccuaucugguucugccuucacuccuaaagcccgccccgcuaccaucagagggguguacuucaaaacgaauuugaccaggcuccugguaauuacacacgguucucaaggagaccagauacucgaugcuuuacacacuuguuuaacccacagguaggaggaagccccauuuuaccgcuagagaaccaaaauacucagagaaauuauaugacucucaaggucaaaguugagagaggugguugaaccucuaaaucagauuuuuuaaaaaagcggacuuuugggugucacccucaccuccucuaccucagucucgggugugcuuccuagggcaggguggauccagugaacgcgggucaugggcacuacacugugcaagguaucgcgcagcaaaccuccgaccucaagucaucuuguuuuucuuuccucguuaacauccaaacuaaauucccacucccucccgcgccgacccucuucucagugaagcugucaauagaacacugaccugaggcagcucucacggcgcccgugaagauggaagccgccaucuugcagccugccuacgguggccgcaguggacucaaaguuacaaagcaaaagg

SEQ ID NO: 3060 - RNA, 10920 nt, Mus musculus
ccuuuugcuuuguaacuuugaguccacugcggccaccguaggcaggcugcaagauggcggcuuccaucuucacgggcgccgugagagcugccucaggucaguguucuauugacagcuucacugagaagagggucggcgcgggagggagugggaauuuaguuuggauguuaacgaggaaagaaaaacaagaugacuugaggucggagguuugcugcgcgauaccuugcacaguguagugcccaugacccgcguucacuggauccacccugcccuaggaagcacacccgagacugagguagaggaggugagggugacacccaaaaguccgcuuuuuuaaaaaaucugauuuagagguucaaccaccucucucaacuuugaccuugagagucauauaauuucucugaguauuuugguucucuagcgguaaaauggggcuuccuccuaccuguggguuaaacaaguguguaaagcaucgaguaucuggucuccuugagaaccguguguaauuaccaggagccuggucaaauucguuuugaaguacaccccucugaugguagcggggcgggcuuuaggagugaaggcagaaccagauaggaaauuaaaaguacucaaguaugauaggggugaucaguaagcgacuugcacacaacuuauacuguagagauaacauuuguggaaaaauaggcagaggaccaagagggaaaaaaguaaccauauaaaauuuccagguauuagagcuuaaaaauggaacuuuugugaguuaugaaauguguauauaaaaaguuuauauuaggggacauacguguaacuaacaccaguucaagccaagccccuuuccaccccgugcauugccccggucauuauucccauagccacuugagcaacuauaccuucaucucucaaaagcauauuuugucuaguuuugaacuuuacauuaauuuauauacaauaugucuaguguaaugucugguuuuuauuuacuccagugugugugugugugaacccuuuugauuucugacugcuguaucuucuuuucuuuuuuaagauuuaaaaauuuuauuuauguaaguacacugucgcucucuucagacacaccugaagaucccauuacaggugguugugagccacuauguaguugcugggaauugaauucaggaccuuuggaagagcaguuggugcuuuuaacugcuaagccaucucucuaacccucuuccuacucuucuuccuccuccucuaccaccacuaccaccaccaucacaaccuuuaaauucuuuuuuuuuuuuuuuuuaaugagacaaggccucauuauggagcccagucuggucuuaaacucucaguccuccuuagcuuccacaugcugagauuuuaggugcuuggacucccaaaccugcuuuucuucagcacaucuuuaucugguguuagcauuguuucgauguuuucuucaagcuuaggccucuuaaucauuuuaguauauuaucucauguaauccucuccauaauuagcuaauuuaaaguugaggaaaugagcauagagagguuaaggaaguuguuccuguucacaccacucguuaguaggagcugaaaugaauacuagucuggcucaaaccugucccuuacucaccacacugccccauuuguuuggugagaucaguagagaagacaguggaguggucuaagucuugcaucagauuagguagaugcaacuugguagagcuuuuguuguugcuuugaggaaaggucucacuaugcagcccagguuaaccaggaacaugcuguauuaauagucaugucggucugguacuugggauucucuugcccuugucucuggagugcugagguugcaggcauaggacccuacacccagaucaaauuguugcuggugucugucuuuuugagauagcauuuccuguagcccaugcuagaugugaacucuggucugcuuuagccucuugcacacggaacuuacuagcauauuaccaacaugccaggcuuggccuuuccuuuuuuuuuuuuuuuguuuguuuguuuguuuuuuguuuuucuuaaagcuaacuucauugaaauacaauuuaguauauuuguauuuguggcaauguuuguauaugugggcauauacacaugugugugcaugcaggcacaugucugagauugcucucaggaguaauccuucuuuuagagccuggguuucugccacagaccaccccagucggguauggcggucccuggaaugagggucccggaaagcuaaguggguaaggauuuugcggggacaaacagaaacaaacacagaggcaguuugaaucugagugcauuuugcaggucucaggcagggguuuuuauacauuaaaaaaaaaaaacccaaauauuacaacucuuagauguguucagugaagcaauuacaaauaccaucauuaucauuuggcucaguaaagcacaaaaaucacgcaaacucugaaucacaaacagaacagguaacauuguuaauaauagaaaccauccaagcauuacaacucugaaaggauauauucaguggagcagucauccaaggcuaguggcauauuucugagagcagguuaauaaaucuuuauggucaauuauuguuuaacaucuaaugcuugauuuuuuaaaauaaauuuucaauguguaaauuuaaacuauuuuaauucuuuuuauuuaagucuuucuuuaccauauaccaaagccaccuccaaugacacacuuguagccauaugaaauuuuauuguuggggaaguuuuuuggguuuuuuguuuguuuguuuguuuuguuuuguuuuguuuuguuuuguuuuuugacaggguuuuucuacucucacucuguagaccaggcuggccuugaacucagaaauccgccugccuuuaccucccaaguauugggauuaaaggcaugcgccaccacugcccagcuguugggaaaguuuuuaucuaucauaauacuauuuuauaauuuuguaaaugauuuauaaaguaaagcauugguuuccccagagauaaggucauguuagugaccccauuucaagggaugguuucuuacccauuauucuugcuuaagaucguagucuaggccaccaggaacauguuguaaauaagagaaggaauaggagaaaacaaaacagauaaguugccaugagaacuacggcucaauauguuguucuggacaagagauccacacccgguuccaggaggccuccuucuuuugaaguuucgccucagucuguggaacuugucauacagauucuacugggguuggugugguagguuucucugggauguggcacucacccauuaggcuaggcuggcugggcaacaaaccccaagaaucugccugucucucccuacccaguguuggaauaugcucagcuuuguacaugaauucauggcugcagacucaggcauaggaagcacuugaacaccaagccauuucccuagcucggaaauacucauuuuugugcagcuaguuuaguaacaaaaccaucaccaaauuccagucauaggacuuuccaucucacggaacauuuucaguauguucuucagucucacacuagagguggauaguauguacuagagaaguacacugagguugauucugaucugcauguggucuuagggaaaaggacugauaaggaggacagccuucaguucauaugucucugcuccaucucuggcuguugccaggcauuucugccacgguugggaagccaugcacagccucuggccagccugaaccugccguucccacagcuguauuuguuucagcaccaagggguuguuuguccuacccaaagugggcucuccuccuuggaggaucuguuuaugcucuuguuuugcuuucacuuucuuuugugugugcacauguaugagggagugugcaugccagcacacgugcacguggaagcuugagguuggcauugagugucuucuguggcuccucagcuuauuguuuugaguuggaucucucuaggaagcaccugucucuacccccucuuaacccugguacugcaguggcaccaugucuggccuuuacuugaauacuggggguccuaacucaaguucuuaugcuuagauagcaagcaguuuacccacuaagccaucaccuagcccuuuaaaaaaaagauuuaguuuuauuauuuuaaaguaaguguguguguguguguguguguguguguguguguguucacacgcagagacaaauggcuucagaugcuggggagccagaguaggcagagcccuuggaguuaggacuacagguaguugugaaccauccaaugugggcauagcaaccaaacucaggcccucugccaaagcaguauuuaucuaaccacugauccagcuuuccagcccuuuguugauuuuguuuguguuuugauuuuguuuucugaggcaguaagucguguagcuuaggcugaccucagacuggcucuguaguagaggaugcucuugaaaccgugauucucccccuccacuuuccaaacguugagauuacaggugugcaucaugugucuagcaguuaguucacuagcaggauagaacuaucaggcacggaagcgccugcucuguuuucuucaucaaucuccucuccacucaaucuuuccagcuuuccugucucugaccugucauugaauuggaucuggaggggcuguuuccccaugguaugaaauugguggagggcaguuaaucuuacacauaucuuguuccucacuucugggcauagagugcacacacaucaaucuggauuauaugauggcuuuaggauucuaauuuuucuaaaaaccauuggguauauaauaaucguuaauuucaucauacguaaguuauaggucgcugugaaucuggcgucaggaaccuucuguuaggucuacuuuugucuccaugcuuugaauauauggguauauguguuagaguauauucaggacauguacuucucucugucuuugcaggaauauuucgucccuugaaugucuuggcaucuucaaccuaucggaacugcgccaggaaugccugucuuaauucuucacugugcaccauucauuuuagacauauucagacaucaguuguuuccucugcuccaagacuugucacaucuguuggacaccuggcauaugggcauaccacaacaguccuuaauagguaaaguacauuacaauaacacauuuaaacaauaguuacacaaaauuuucuaaaauauuugugccugggcaugaagcuccgugguagaguacuuggccccagaucugugaagcccuuucuuuuaucucuaguacugcaaucuauaaaauguguucaagagguagauagucuuucccuacuuguggcuuaugguauacaccuucccugacugaggaggagauaugauuggcauucuagaugcccacaacaggacuacacagagcaccuccuuuccaucucgccauguagccuuaacucguaaucauccucucgcccuaaucuccugagugcgaggauugauuccaggcaugcaccaccuugccuggcuuucuaaaccgucuuacagcacugugggaggaacccaaggucuaagugaacuagucuaguguauuacuagugaugucugccuccacccuggccucauuccuguuguuguuuauacaguuuccagaaaaugucaggcaaagcagagaucagaugagauguucagcuuaugugguucagcuaugugggagucagucagucagcagguaauccgugaagcacucuuagguucccaccacuguacuugcagaaaguacacaaagauaagcugaaguccucuagguaggcagauagauaagaaacugugugauuaaaauacgguggacacauucucucuuaauggucaagugggugggcuuuauuuuggguguuagggaauugacccuaaagucuuguaugugcuaaacacagguucuaccucucccuguggggggcagauuuuagaaggcuugaaguaggaagguugccaaucuucuugacauuauguggugugaugaaagucaguuccuugcccuucgaucagucuguucacuacuuuuuuaaaacuguauuuuagaguggccacauugguucccaguguccugaagccaccagucagagcucuaacauacugcagcacacggaaaggcaagagaaagacgguaaagucggucgugcaucgcuuccuccgacuucauucuggccuuuggcuaaggagaaaggugagucuuugugcugcgugagccuagccauggugugcacucaucuuacgguagcucuucuguguccugcuguguccuugugcagagaaagggugugagugugaauagaguaaagcacuguucaaaguggcaggugcagucacugugggaagggcugagaggguuuccccuaucuuagagaaaucuguagauaaaguguguauguauuagaacugagcucauagccggcauugagaaaugucagugaagagcuuuggcuuguaagcuguuggcuuguucuuaacaagagccucauuaucuaugcucagucccacagauacgauuagagcugcugcugacaucagaggcaucagguccuccugaagguagaggugcaggcaguugugagcuguccaacaugggugcugguccucuggaagagcguuaugugcccugagccaucucucaggcccuuaaguuucugagagguuuucucacugaaucuggggcucaccaauuuuucuagucagccugaccaguaagcucugggauccauuugccuuucuccucacaagugguggaguuacagaaguccacgaccauguccagcuuuuacauagguucuggguugcaaacucagguccuccugguugcauuacaagcacuuugcccacugggccauccccacagcccauuuuugguuucguuuuuuuuccagauagacucuugcucugcagucuguguucauucauuuauuucuaauuuuuaaaagaaagauuuguuuugagacaaaucuuacuauguccaggcuagccuggaauuuccuauguagaccaggaugacccugaacuaaacagagaucagucugccugagauuuauuuuauuugcaguuauuuguaugugugggccugugccugugaguggggugcccacggaggccagaggcauuggguccuggggagcuagaauuauggauaguuguaagccaccuguauuggugcuggaauugaauucagguccucugaagaguggugcgugcuuucaucugcagagccuggcucucaacuuucaguucucuugccucaaucuccugagugcuugaauuacacauauguacccuaugucuagcuugugauuuuaauuuaaauaaucuuucuaaaguguuaaauuauuaauccucuucuacacaugcuuuuuaaccuguuacuuauugcaaagagaaacaacccaaucucuguaggucuggcuuugcucuuugggccuauauaccauaaauuauggagcaucugcugcugccuuugcaaguuuuaaaaugucuuuggaacauuaucucauaggcuggcuauaagaaaaaauuauggaaaaagucaacugcaagaaagaagcgcuugagggaauuuguguucugcagcaagacccagaguaaacuccuggauaaaaugacgacaucuuucuggaagaggcgcaacugguacgcuggcgauccuuaccagauguaccacgaucgaacaaaccuacgaguauaguucagagcuaucauaguucccagcuauggaaugugggucuuuguguacauaaugcccuugcaaagugaguaugcguuaaacuguaaacuguaccagcugaucggcaagcuuagauuaccaccauugugcauuaaacauucccagaguuggucauagaacuaaaaguuaaauuuauugugcauuauuucaaaaaacugguaauggcuuuccuuauuucuggaaucuuggaugaggaaaaacacgaaaagacgcucaacagugggccuuuguguggaauugagaugguauccagguuuuugcacaugcuaaacagacaucuuacaugccuauucccaauaugacacaugcuguguuuaaaaaauaaauaccuaggaacucaggaaccuccucacugucuccuaccuguaacucucugccccagcuuuggggagggcaggaauuggaugaagcaagagauggugggacuuuaugccuugguucuacugugagaguguguggugugugugugugugugugugucuacucaccaucacucucuuuagucuuggcuuuuguuuauguaaaguuucuaucucucagacucccuucagccugaaccuuuggguucccuuuaacauuacaacccucaacucuugucaucucuucucucuuaauugccagggaacucucauugggccauccugccuuuuccucguaagucugaaucaaugccaucaugcaauguagagcuuaucuguuuguggcuaggacuccacccaggcucucuuaguuguaucaguagguucauauggaguaaaaagguaggugugagcuguuuuccuuagagguacauagaguagcagggcacuuucaucuuguguccuggguucuuuguauuuaugacaguuauuacuaauuuuauuguaacaggauacuuuucauaaaaauaaaucaccuucccaaauacccuucuugaaauacauagcuauauaauaaacucuuuugcccaguuuuucuuuucuacuuuacuuuuuauuuuuuacauaugaguauuuugucugcauguguguaugugcccuugaaggccagaggaaaguuguugggucuacuggcauuggaauuacagaugguugugagccaccauguuggugcugggaauugaaccugggcccucuacaagaacagccaguucuuaaaugcugaacugucucuccaggccucugcccaauuuuucaaaggcacugaauuuuuaaaaaguuuauccacuuaagauuucuuauuuucauugguaaagaucagcuuuuuuuuuccagaauucucuaaaacgcaggguggaaacuaagggagaaaguugccugucauuuaaugagacugaugucagcugugcucagaaggcaacaguaucauucauuuuaucuuuuuguuuguuuguuuguuuguuuuuucaagacaggguuucucuggcuguccuggaacucuuuguagaccaggcuggccucgaacucagaaaucagccugccucugccuccugagugcugggauuaaaggcgugggccaccacgcccagcuaguaucauucauuuuagaaaagagucuggccauuccauccugaaugcacaugacuuugucugaucucagaagcuaaguagggucaggucgggccuguuaguagucagauggagaaagaugcaaaaguuacacgugguuuacagagagucagaauugaugcugcaggccgagagagugacucucugcucucccaucagaaccaucuggaagcauuuccaaacaaagcagccugccucauugaaaauucuauuaaggaugaaugacuguuugaaauccauugaugauaacaugaagucccccauuuaguagaauaaggcaaucaguugguguuuugauggcagguaggccaggacuuugaggaccauucaguuuuuguuuuguuuuguuuuguuuugcuuuguuuuguuuuguuuuguuuuucgagacaggguuucucuguguagcccuggcuguccuggaacucacuuuguagaccaggcuggcuucgaacucagaaauccgccugccucugccucccgagugcugggauuaaaggcgugugccaccacugcccagcuuagguuuguuuuuuuuuuaauuuuuuuuuaauuuauccauuugaagccaguucuucauuaaauggagagggauguagaaugucguaaaaccccauauguguguauguguguaugugugggggcaggugauagagagcaggcgugugacuugagcaccucauacaccaauggcucugccccgguggcucgugcugugcucaccccugaggcggcagaagcugagugcugugaggcuuucgagguuccucgccugcacaguuccugcuucccgcacaucuguggcacugugcugaagcuaaggagggagacacugcacagccuuagacuuuucuagagucgacauggaugguucagaucucuguuacauggccucagugccuuggcuuccccuguagccaaggacaggcuaggcagaggacagcggccacaggcugaaguagaagggcugcaggcacaccucggauggaaagggaacuucuucauacauacagcuuuuguauguggguaggggagccuuucaucaaagccaaguuuuuaguuugacaacaaagcaguuugcuuuagagccugccuaaaugauguucaaguguaugcauaacuguuuauuuacauguaauuuauugaacacuugucauauuuaagcaaaucugcaaaacucugcugcaccucaugccaaccuuauacaaucuuauacacgagcuaucauuuaucccugauauaaauugaaggcacuaaagcuuauagaagcugaaauaaauuacucuaaaauauagcuaaugcaucccagauccccugucuaacucuuuggaaucuuguguacuuccuuugauuuucuaacaacauaggauacucauaucuugaucaacaaaugacugugaucugacacuaguaguaaauacucuacccguucaagucugaguugugugacuuugcucucuaccugucaacucuguuggugcauaacccuggcuuaguaaaugaguaaugaaugaauggauuucuagucuuucuucccaucucuucuuccuguuuucugcccucugaaucugcugcuuuaguuucuagucuguguacuguaaaaacaagagaaccgaccacacuu

SEQ ID NO: 3061 - RNA, 628 nt, Mus musculus
aauuuaauucaccaacgcuuuaauucuaagagucacagucgaacuuuacacagcacucuccggccaguucaccuaguaacccggucaucugcagacaaacuagcgcccaagcgcgacccggaaggagaaccugcccuuccgccuccuagucgccaaucaccgcuuuacuccccuuuucgcagccggggugagucccacccucagggagccgccucggcuguagcaggggaggaggcggcgcgugcgcaguggugccgguggcccuuccggugcgccggacgcagcuaggcuguacagacgcgggcacgcacaccagcacgcacgcccuccucucgugcggccgcggucguucccgcguccaccagcagcgcugucgcuucggcagaaaugcugcgggccugucaguuauccggcgugaccgucgcggcccaggugagcguggggucucuccgaaggggcgcguggucacgcugacugcggacugccaacggacaacgugagaggcauccaugaugcgcaccccccccaggcagagccaccccuagugcggggaaccgaggcaguccucuagggcggccgcuggacuggaaugacucgaggguuauugcugaagaagcgggcuggggug

SEQ ID NO: 3062 - RNA, 628 nt, Mus musculus
caccccagcccgcuucuucagcaauaacccucgagucauuccaguccagcggccgcccuagaggacugccucgguuccccgcacuagggguggcucugccuggggggggugcgcaucauggaugccucucacguuguccguuggcaguccgcagucagcgugaccacgcgccccuucggagagaccccacgcucaccugggccgcgacggucacgccggauaacugacaggcccgcagcauuucugccgaagcgacagcgcugcugguggacgcgggaacgaccgcggccgcacgagaggagggcgugcgugcuggugugcgugcccgcgucuguacagccuagcugcguccggcgcaccggaagggccaccggcaccacugcgcacgcgccgccuccuccccugcuacagccgaggcggcucccugagggugggacucaccccggcugcgaaaaggggaguaaagcggugauuggcgacuaggaggcggaagggcagguucuccuuccgggucgcgcuugggcgcuaguuugucugcagaugaccggguuacuaggugaacuggccggagagugcuguguaaaguucgacugugacucuuagaauuaaagcguuggugaauuaaauu

SEQ ID NO: 3063 - RNA, 46319 nt, Mus musculus
aauuuaauucaccaacgcuuuaauucuaagagucacagucgaacuuuacacagcacucuccggccaguucaccuaguaacccggucaucugcagacaaacuagcgcccaagcgcgacccggaaggagaaccugcccuuccgccuccuagucgccaaucaccgcuuuacuccccuuuucgcagccggggugagucccacccucagggagccgccucggcuguagcaggggaggaggcggcgcgugcgcaguggugccgguggcccuuccggugcgccggacgcagcuaggcuguacagacgcgggcacgcacaccagcacgcacgcccuccucucgugcggccgcggucguucccgcguccaccagcagcgcugucgcuucggcagaaaugcugcgggccugucaguuauccggcgugaccgucgcggcccaggugagcguggggucucuccgaaggggcgcguggucacgcugacugcggacugccaacggacaacgugagaggcauccaugaugcgcaccccccccaggcagagccaccccuagugcggggaaccgaggcaguccucuagggcggccgcuggacuggaaugacucgaggguuauugcugaagaagcgggcugggguguggagcgcggggaggcgggugugccgcugaggcguggcuucagggaccugguauccaaucaguaccuccuuaucucagucucggaccaauccuggcugcuggcgucugggccgccgguugggcacgugauagguuuccaaucgugaaggucggcgcgggagaacuacaguucccagcagggauugcuucucagggcuuguugcaucuuuaauaagcagguuccuggacugguggagagccuaggggucaaaguugcuguuaaucugggaguggguuccuuuuguuuccguagccgagagcgccuuugagcuagucuuauaguaaaaggugaaagauuuuucauuucucgagcuuaaacuucuggugcugaaggaggacagaagucaugaccuugugcuuauuucugagauuagcuuggggaucagugucucuaagcacuggaaccaugucugacauucagguaucuuaggcgcccuguuuugucucucuuuaauuuuucauaacugucaguauaacuuucuacaguugaaaauaaaaaccccauuuccauuacucagaaguuuuagaaaacuaacacuugaaagguuaugaggaacaugcugcaacuugagcaguaauuggauaaaguuucgagacagggucauccugagaugauugaaguuaagcaguuuuguucuuuauuuuugcuuuacuguuuguccuucagccucuugcauagggaagugagccccguauuaguuuucuguugguauuuauccaacagcacacauuaagcagccuguaacuacacccucauugauuaucuuccaguuuuuguaguagucuggacauuaguguuguggagucucagcuuagagucaugcaaggcuuuguugagaaguauuagcugugcuuugauucucauuuguagauaguacuuuuuacuuccuccaaauucauaauuagcuaaauccagccccuucagguguugcacuaaaguccauguucucuccugugucuugcagguggcugcucucagcuuuuagaaccuucuaacaauuucuugccacaaggcacuuacaggccauuccuaacaccaaacacgaaacacaacacauuuaguauuaccaugugcuucuuucugucuuuacuucaacaucucuucucucauugauuuauuuacuagacuagcccuaccugaguaacuucccuaauucagauuucuuuuuggggagcucaguuagagacuaaaacaugaaugguauucuagcucucaacaaacauuuuaaaguucccugaagucacugucaacaaauucauagguuuauugucauuaccucuucauucauucuguagcauuugauauugcugcuuauuugugugugugucuaucugucugucugagagagagagagugagagagagugugugugugugugaaugaaugaauauguguacauguacacaccuauggaggccagaagaggauacuguaucccccagugcuaagguuaaucagugguuguagacucccugacacugauacugaacucagguccucuggaagaacauuaaauauaagugagcuuuuccauuuauggcccuguuccuguguaaugacuugggaggcuuauuauucaugaauaaaugccuaggucuuaagcagggcuuguccccugacuaguuaguaucuuauaugucucauuuauacuauucuaugucugcggccuggcugguuaccucuccucgguuucauacccaguccagguugugaaucuucugugauuauuuuccugaguguucucauucucucucuuucuuucuuucuuucuuucuuucuuucuuucucucucucucucuuucucccaccucccuuccuccccuucugucucucccucucuccccuucuuccuccucucaauuuugcauuuauguuuuuacauucaauuuuguuuuguuuuuuccagagcugaggacugaacccagggccuugugcuugcuaggcaagugcucuaccacugagcuaaauccccaaccccucaaauuuguuuuuuaucaacuuaccaaaugauuccaguuuuuggcaaauuucaucugcuuucaugucuugccuuuuuaccuuucucuucaaauaaguucuuuaauugcuacuaaaggacuuuuaaaaagcaaacauguaacaucaugcucuucauugacauuccaucauguucagaauaacgucuaggcucuuuccacacucaccaggcccacaucuuguuuucuauucugccuccccucacugucuuuuacaguaguaccuccagcaagauaacucacuggugguuuuuuuuguuuuauuuuuguuuuguuuucucugacuucuucacaggucuuugcucaucccuuuaugcagggucuuucuuaaccccccuuccuuucagaguggccuuucuuuucuaaaguggacuaggaacugcucuucucuauauacaucacucccacuuuacaccuauguauuugugcaucuuagcacuaccuaacauguguauuuguuuuaaguuuccuguauuuaaaguaaguuccaaguuaagugugguguugcauaccugcauaccuaccacuccacaggcagggaacuccagccaggucucuaguuacaauuuggguuagccagggcaaugacuugcaugcuucugucccacaaaaguccauaaacuccacaacuagcuuguuccugugucguuugcugcuauauuuccaguagugacaguucuuugcuccuaauagaugcucaguaaaugugacaugcuugagugaucuaugauuuuuuuuuucuuacucucaauaaguacccugauuuucuuuuaaacccacuccuuaggcuaggguucuuuagagaaacaaaccuaauugugugcaugcauguuggcagaccagacacugaggaagccagggguaguagcaaucugcaggccagcaauauagagacuuaggagagcagcugauacaguuccaaucuauagacacuaugcuagagaaguccuuuuuauucuagucaggccuucagcuauuuggcuggagcucacucauguuauagagggcaaucuacuuaaaaaguucaccauuuuaauguuaaucuuacucaacuacaucuucccuauauaauacuuggaaguagucauuugcacaugucauacucauuugaucuaggccaaaauauugagaauuggucuuucuuugcuuauaccuuaaaagaagaggggaaggagcugcagagauacucugguuuagaguacuggcugcuguuucuuccagagagcauggguucuggucccagcacucauguagcagacaacuauaauuccaguucccaauaaucugauucccucuucuggcccucgaggccuucaugaccccuucaugccuucaaaaccaguaccaccugggugacucuuacacauuaccaaguccugcugcugcacaauguacgacuuuggcuaucucuggaacacagucucuuugugcugucagaaaacacuucccagaagaugucacuucaaagaugcuggucucuucuuuuuuuuuuuuuuuuuuuuuuuuuuuuuuuucgagacaggguuucucugaguagcccuggcuguccuggaacuuacuuuguagaccaggcuggccuugaacucggaaauccgccugccucugccuccugagugcuaggauuaaaggcgugggccaccaugcccggcugcuggucucuucuuaaucacugcuaauuucuuagcuccagcuaaccagcaucaauagucccaguaaugcaaagguuucacuuuaguaguuuugguaucuuguuaauuacagcugauucuucagccccagcuaaccagaaccacagaaucuuaaucaaaguagcaauggccuccaucuucugcacuguucucaacauuaucuuccaagcuucuacacaacaucccacagaauucuuaacaccgaauggaucuucuagccuaaaguuccaaauuccuuccacaguccuucccaaaacauagguuauucauaggaauaccccacuccugguaccaauuugucuuggucaggguugcuauuccuggacaaaacaucaugaccaagaagcaaguuggggaggaaaggguuuauucagcuuacacuuccauacuguuguucaucaccaagggaagucaggacuggaagucaagcaggucagaaaacagaagcugaugcagaggccauggagggauguucuuuacuggcuugccuccucugacuugcucagcuugcuuucuuauagaacccaagacuaccagcccagggauggcaccacccauaaaggguccucccccuugaucacuaguugagaaaaugccuuacagcuggaucucauggaggcauuuccccaucugaagcuucuuucucugugauaacuccagccugugucaaguugauacacaaaauaagccaguacaagccucccuccucauuuuuuaaaaauuaaauuuaaaacauuucccuuaauuuuauauguaugaguguuuugacuugcacgaauguguguucacugcguggaucaacucuguuugcaucagauauuccuugggguuggaguuacagaugguuguaaaucaccauguccuccgaaagagcagauguucuuagcacuaagcacuucuuaggccauuacauuacacguuuauuuuuuauuuugugcauguguguggaugagcacgugccauagcgcacauguugaggucagaggacaacuugugagaauuguuucuuucccaauaccgaccugagguugcugucaggcccuguaaccucagagccauccugccgugucggcuuuuucaggcagacaccuaccauuuggacuggucuguagccuaggaugagcuugcgcucucugcucuccugcccucccuuaccuucugcgugcugaguuucaguugcuugccaccacuccuggcucuuacaagguaguuuaacuguaggagaaguuaaauuguugcuuauaaauuuguauuuaaaugcaaauuuuguuaauaucuguagcugcccuacaccacccgaacuggguuccugagugggaggcuggagcuauaugggaggaaacaggggaggguggugguggugggggauaacaagaccaaaacaaaaucugaucaagggccaauauuuacuuaagagucugagcuuaugaagggggaaggcccauccccugccaugccaggcucuugaugcuuugucaccagccuguccgcacuugguccaggguuuaucucaggaagacagguuucagccucucacuggguagcccaucuugugguagaacacucguggcagaacaauagaccuaucuaggucagaagacuccacccuagguggucuuguucacaguaacagaacaggucugagccagccugcuccaggcugugggaggcuacaaauuuccuugcccugcaaaauuuaauguggaaucuagaagcuuggcauaggauucacaggugauuuuucuaaagugcuuguuuuccggcuauucuacuacauggugguuuuuaauauauucucuuuagugugguaaagcugagaaguugacgugugaaagaacaucuaugggaauuacauauuuuucuugucuuuuguuuguggaagucauguuucuguagguuagaacuaucagugcuaacauuaugacauuuauugcaagguuaugugucaagacaaauuacuguucuauauuauaggucauuaauaaaguggaauccuaaaauuaaguagucaauauuuugugugucaaaauagacgguuuggguuauauaauauuagagacacugcuuaagagagaguaaacuggaggcaaaccuuauauuugucagugauuuagguaaauaugaugccaaaugcauaagcaacaaaaaguacuuuugaagcugggcaugaugguccauaucuauaggccuuagcacugaggagauagaggcaggaagaucaagaguucaagauugggcuguggagaugacucagcugguaaaguacuuguacaccagcauuaagaccuggguucagguaaaagcauaaagaaagagcuaggcaugguaguguguaccuguaaucuuauugcaggggaagaggagacagagggucccauugagcccacuggucagccaacuagcucuagauuuggugagaggcugucucaaaaauuaaaugaagaaccauugaggaauaaaucugaccuugcccuuuggccucauguauaacugcguauguauacauauaugaacauguguacauacacauggaaaucacagacaacaacaaugugcaggcugacauaaaccuagacauuucugugaagagggaaucucaauugaguaauugcuucucagauuguccugcaaugcauuuucuuaaugauugaugugggaggguucaggccguugugaguagauccaccacugggcauauagaggaauucaaguugagaaaaaucaagggaaacaagccaguaagcaccauuccuccacgguuucugccucugcuacuguuuacguucuuguucugacugcccacaaugauuaacuaugauugugcuagggacaggaaaaccaaauaaaaccuuuccuuuuuaaauuguuuguggucaugguguuuuaucacaguaguagaaagcaaaugggaacaaccagccaauguugucugggucauccuaggcuacacaggcaguuugagaccagccuggguuacacgagacccugucucaaaaaacaaaacaaaacaaaacaaaacacaaaaugagagggaaaaaguaauuuugauuccaucagguugaaauuuuuacaucaaaggugugauuuaaaugagaaugccuccccgccccauaggcauauauuugaauaauuaguccccuauuggugggacuguuuggaaaagauuaagaggaauucuuggaggaggugugucacuaggaguaggcuuugagguuucaauagcucaagcuauucacaguuagcuuucucuaacuagugaaaguuagugcuuguuggugcuuuuugaucaagauguaagaucucaacuauuacaccaugccuuccugcaugcugccaugcucccuacgaugaaggucauggaugcacccucugaaaccguaagcccugaauaacuuucuucuauaaguugucuuggucaugguaugccauuauaggaauagaaauauuacuaagauaaaaggauacucaagaaggaaaaaaaugagggacuauuuuaacuauauauuagauucagguaugcagaaaauacaaagaauucuuauaguguuacaagaagauaacucaaaaacuuuuuaggagccuugcgaugguggcacacaccuuuaaucccagcacucugguggcacugcaggcagaucucugaguuggaggucuggucuacagagugaguuccagaacauccagggcuacacagaaaaacccugucuuagaaaacaaacaacaaacaaacaaaaacuguauaagacuugaguagccauuuaugcaaagccaguauaugaaacacauggaaaauuggucagcaucauugaucccaggaguuucaacucagagcuaaaugagguacucauuuauccacucuugugauuuuuuuuuuuuuuuuucaagacaggguuucucuguauagcucugucuguccuggaacucacuuuguagaccaggcuggccucaaacucagaaauccaccugccucugccucccaagugcugggauuaaaggugugcgccaccaccgccggcgcucuagugauuuuugaguauaguaaugaaauguuggugggaacauaaauuggguagaaguauaaaugcagcuccuuugguaaacaauuuggaaauccuggaacaaaaggcaguacauuguaugauuuccuuucuaggaauuauccagaauagacauuuaugaaacaaaaggcugccagauguuagaaaagaggggaaaguggcuggagggaugugugacgcuuaauagaaucuaggguuccuuuuggauugaugaaaaccugcugugauuucuagaacucagugguggugaugguaauuauuuagccuuguuaauagacuguauaccauuaagugguucauuaaguggugaauacuuaguuagcuuuaccagacacagaaauaauaccugcuaguauuuacagauggucagaaaggcagaguuagacaaacauuucaaacuuaaggagucaaggacaggacaggaugagauuuaaaacaaaacaaaacaaaacaaaaaaaaaaaaaaacagggcaauugcaacugguuuaaaccugucaaauguacucagauccuugaauuucaaacaauacuguuuuggagcagguaaaagcaccugcugcuaagcuugauggccuaaguucaguccaagggaaccacaugggaggagagaagcaaguuaguuguucucugaucuccauuuguuauauacauacaaauaaauaaguguaaugaaaauguauuuugguugggcuggagagauggcucagagguugcucugaggacuugggcucaauucccagcacccacaagguggcucacaacuauccauaacuccaguuccaagggaucugaugccaccuucugcucuguaugggcacuaagcaugcacauggcauacauacauacauacauacauacacacaugcugauaaaaauauauauaaaacaaauugaauaaauucuaauaagaauuuuaaaaauugaaaaauauuuuugaaaaauaacaauucugauuaacuacagcuauguaacaagucuuucugugucugggaaauagcauuuuucauugcuucuguucuaggucuuuccugaaaucaccugggcaauuguugcgcauugacccuuaagacagugccuaggacuaaucaguucccaguaucccuuacucucaugcuuggcugcugaugcuggcucagcagugacugcugccuuggaacuccugcuuuugacaucucuguguuugggauuuccucacagcuuagcagcagguucuuagaacagagucaggccaaagccaaguacauuuaugcuguagugugagaaggcacagagcaucacuuucacuacccucuguuagugaauuauuaaccaagccugcccuugcaccuuccccuaccccauccccucuucccuaaacccuggcagccacuauuuacuauuucuaugaauuugucuaucuggauaauccccauaaaggaaaucauacaacaucagggaaagacacacaauucauuuuugauagguagcaguguauuucuggaagaacauuuggcaugccugcauuguuacagucaguauugcaaaaugcacucagcccuauuuuccuuuuuuuuuuuuuucuuuuuuggugaagguggaggcuggaacaacugauuugccaacccccccccauagucaauaauguguaaugcacucagcucuauuuuuuugugggggguggggccuagagcaacugauauucccuucccauugcagcccucuuuuaagacacuacaaaaauuuuauuccacuaggaccaggaccuuaucguuuuaacuagaucuuaaaaugguuaagauaucuuugauauagccuuaaaguuuuuuuuuuauuggauauuuuauuuccauuuuaaauguucuccccuuucccgguuucaccuuggcaaaccccauauuccauucccccucccccugcuucugugagggugcucacccacuuugaccaggugauaguacccaguauuaaauccuuccuaugguucaggccuuguagccacucagagagacacugguacuuccauaacaguuaugccacuguugcaucugugggccaucuccugccaagcagguugguauuguaguaugcaaggucccauguuggggaagaccagugaugucuuuucucucucaggagccugcauagcauuaaguaauguagcaagaaggaagagaguuuccuggagauucaaggcugauuucucuauguuguaaaaauauuucuugaagguaagaagauugacggauagccuuuaccauaauugagagucuuucuuguuuccuuuaagccacaaugcacauagccuaauaaaaugauauauuacuaaucuguaauuuaauucuuuuaaaauuacauuuaccaaaagucauuucaaucuugauaaaauuuuauguuuccuuccucaugcauuauuucaucuuuuuaaaaaauuggauauuuucuuuauuuacauuucaaauguuauccccuuuccugaucccccacugcaaaacucucucucccauccuccccccccuucuucuaugagggucuuccuccacccacccacccacacccaucuccccgcccucuuuugggcauuuaucuagccuuuguaggaccaaggaccucuccuccuauugaugcaagacaaggccauccucugcaggguaugcagcuggagccauguguauuccuuuguugauggcuuagucccugggagcucuuggggaacugguugguugauauuguuguucuuccugugggguugcaauccccuucagcgccauugguccuuucucuaacuccucuauuggggaccuugcacccaguccagugguuggcugcgagcauccaucucuguauuuguaaggcucuggcauggccuuucaggagacagccauaucaggcuuuuagcaugcacuucuuggcauccacaauagugucuggguuugguagcuguauaugggaugaauccucaggagggacagucucuggauggcuuucccuucagucucugcuuuacacuccaccuuugcuucugugaguauuuuguucuccuucuaagaaggacuguagcacccacacuuugaucuuuuuucuucuugagcuucauguggucugugaauuguaucuugguuaucuggaacuuuugggcuaauauccacuuaucagggagugcauagcuuuaaaguucuuuuuucuuuuucuuuuuuuuuaaaaaauauuuauuuuauuuaugagcacauuguagcugucuucagacauaccagaagagggcaucagauuccauuacagauaguugugagccaccaugugguugcugggauuugaacucaggaccucuggaagagcagucagugcucuuaaccacugagccauuucuccagccucagcuuuaaaguucuuaaccucuucuaguuuuguucugcaaaccagaguacuaaagucaucugcuucccauuuuauaucagcaucuacuugggugacaggcacugaauaauuucuguggauaguuucuuucaaaaaagcagacucuuagcuagaggagcacagcagucacagugaguuccagaaaugaugcagaaucuagcuggauaugauggcuggacugauuccuugauuauaguucauuccugcugcuugggaguuucuguuuuccccuuuggauuuuuguuuuuacaucuucuauuguuuuucuagaaaauguagacuguaccuaaguccuaguuauggcugguuccuuuucucuuggagcauccagcaccuuuuucauauccucuuucuuuuguuguuuaaauucagucugguguuuguuuguuuguuuguuuguuuuuguuaaucuuguauugguaguuagguguuuguguugcuaugaccagauaccagauagccaaggaaaacaacuuaagggaggaaagauuuauuugguguacuguuucagagagcucagucaauauguaguuugugguucuuagguccauggugaaauggaacaucuuaggaaugaguacaaacaugcgauaggagauucuuaccucaaggugcacuagaaacagaggauuccaugauagaacuuugacaagacacagccuagggucaugcucccagugaccuauuuccuccaguaaagaaagcuuauggaagggacuggagagauggcucagagguuaagagcaaccacgauuccuagcaaccaccugguggcucacaacugucugucaugggauccaaugcaguguacucacuuauaaaaaauauuuaaaaagaaagcuuauggaaaauuccauuggcauucaagaaauaaguaacaugaauuuaaaauuuccaaugagucauucucauucucuuuucaaguuaaaaauugcuuguguaugauccuaguacuugggaguagaaggcagagagaucaaggguucaaugcuaaucuggguugugugagaccccgacuuauaaaacaaugguaacaaaaaucaaacuagggccaaccagauggacgagaugcuuacggugcaagccuggugagcuuugauccucaggucucacauaguguaaguagagaaauggcucccauaaguuguccucugaccucuaccuauggaguggagugugugugacuguguguguguucucaagugcacacaugcguaucugagugagugugcauauagacaauaaauaaauguaauguaaacaugaagaaaauuuuagaaauucaacagcacaagaauauuuaagaauauuuuuucuucauuacuguuuuugagguuucaggguuuguuuuguuuuuguuuuuugagacaaggucuuacugcaagucccaggcuggccuggaauuuauagcaguccugcuucgaucuucuaagugcuggugcagaacuguuuuuaaacauucagaaaaguguuuugugguagauugauuucugaaaguaaacuaauuuuuguuugaauauacuuuuaauaaaaguauuuuuaucuguauugucaauucaaaaccuucugagauuuauuuaaguguuuugcauuuugagguggucuggcuuuguaccuuagacuggccuguaguguuugaucguuucuagccugcagagugcuacgguuacuaguaugagccaucauacuuccagacuccuuuuauguauugaugugaugucuucuucuccuuuagaguugucugugugggaaguucguccuccguccacuacgaccaugccguagauacuccacuucaagcaguucuggguaugucgcuugucuccuuggaagcaagcucuuuacuauguacuaauaauagaaguaugcgugggccuguguguguguguguguguguguguguguguguguguguguauguguguguguauguauguauguguuuacuuugaauauauggacaugguugcauaaaccaacuuuuauuaagaaaaugauuuuugggcuggagagguggcucagcaguuaagagcacugacugcucuuccagagaucaaaucccagcaaccacaugguggcucacaacaaucuguaauggggucuggugcccucuucuggggugucugaagagagcaauggugguguagucaugcauuaaauaaauaaaucuuaaaaagaaaaagaaagaaaagaaaaugguauucagucaucagaggaaggcugaguguaguacaguaagauuuuucaucuauguuauuuguuuuugacacagggucucucgauauagccccagcuguccuggagcucaguggaggucagucuggccucaaacuuacaagagagcugccuaccucugccuccugagugcugggcaucaccaggaauggauuuuuaacaaaaucacacucacauaaccuuuauuguaaaauauuguuaaaaguguucuauuucauuauugucaucacucucuuacuguguuuaguuuauaaauuaaucuuuauccuagauauauacguauacagaaaaauacaguauuugcuucuaucuauggcuucugggguucuuggaacagauccuccccacuucaguaagagggaagugcugugucacacggaagcuuugcucuaagagcugaggagucccuucuguaccauuauucugggugaagcuuuagcaacggugcuccuuucuguucuuugguaccuggguggcacggagcagaguccucucuucaaguguuugcuucuguuuucugggaguucauuuaggucucuacuauaauguuguaaguuuaaaaagugcuuguuacuucuauugaugucuuacugacuuccuuuuccaauugggacauucugagcaggcccugaccuacaucuccagcucaguaauuuucaaauuuaaauuucauuuaaugugaagucuugcuuuguagcccaugcuagcuucagucucagagcaguuuuccuuccccagccuuuagaauguuagaauuagcuuucuuuuuugugaggauuuacuuucuuuuucuuacagaaaagcuuauagaggagcuuugaaagucagugauugugggacuucagaggaaaucucaaaauugcaaauaucugguuuuaagggucacaugagagacugcuucauucuuccuguuguaguuauugucuuuuaaaauuuuuguuaucugucuguaaauauuguuauuucauaaugcagacacuuuaaaaaugaucaagaaaaagugguuugcagcuguaguguuacucuugacugcuguggucugagucgaugguagagaaaaggaaguagaaaggucuauaagacucaguaggaaagcagaaagggaaacacaagaaaguauaauaucuuuccuauuucuuucuucuagguugacugcugguaagauugcuggagcuggccuuuuguucguugguggagggauugguggcacuauccuguaugccaaaugggauucccauuuccgggaaaguguagagaaaaccaucccuuacucagacaaacucuuugggaugguucuugguucugcgccuuauacuguuccauuaccaaagaaaccgguaagaauuuuuagacaguauuucaauuuauguuauagaaugcuuccacucaacuaauuuuuuuuuaaagauuuauuuauuauuauauguaaguacacuguagcugucuucagacacaccagaagagggagucagaucuuguuacagaugguugugagccaccaugugguugcugggauuugaacucuggaccuucggaagagcagucgggugcucuuacccacugagccaucucaccagcccaguuauuuuugaggcaguuuuauguagcccagacugggcuacacuccugauucucuggcuucaccuccuacauuuggggauuauaggaauguaccauuauaucugaguaugaaauauuucaucuggauaguauuaguuguguauaacucacugcaacuugccacauguauguuuguuaguucucuuaaacuugaacucacaguaauccuuuuuuaagauuuauguauuuauuugauguauaugaguacacuguagcuguacagauggcugugagccaucaugugguuacugggaauuggacuuaggaccuuggcucgcuccagucaaccccauucgcucucgucacccugcucgcucugggcccaaagauuuauuuauuauuauagauacguacacugccgcugccuucagacacaccagaagagggugucagaucucauuauggaugguuaugagucacuaugugguugccugggauuugaccucaggaccuucagaagagcagucaaugcucuuaaccacugagccaucucuccagcccaacaguaaucuuuuuaaguagaauuuuagccugugggaguuccauaagugcucuuaauuaccacaggaaaaacacaaccauacuacacaagggugaauaaaagagauacauuggacugagauaacuggucggccuguggcuggaggcacagcguggguuuaugccugacuuagugaacuaagaauauaauguagaguggucaggauggaaccuauuguagcuaguuauagcucccuucgacaagaaaacaaagucauggaauuuuagcucucugcuguuugguugauaggaaugucugccaguauuccuggaacauugugcauauucuucaucacuuuguauacuagcuuaaacuuuuuaacaaauaauuuauuaguuuaaaaauuauuuauuauuacuauuugugugugugugugugugugugugugagagagagagagagagagagagagagagagagagagagaguaugugugugugagaguguuguucuucugcugugggauccacggaucaaacucaaguugcaggcuuauacaacaagugcuuuucaccacuuggcggccuuagcuuaaaacuuuuaagcucgucuuuaaaagaaaggcauugcaccuacuggaauuagaauuacagguggaugggcuggagagauggcucagcaguucacagcacugacugcucuuccggagguccugaguucaaaucccagcagccacauggugacucacaaccaucuguaaugggauccaaugccaucuucuggugugucugaagacagcuacaguguacucacauacauaaaauagauaaaucuuaaaaaaaaauuacaggugguuaugaaucaccaugugggugcugggaauugaacucagguccucuggaaaagccucuaguacugagccaucuuuccagcccuguuuuaaaaauauuuuauguagcuggccagugguggcgcaugccuuuaaucccagcacagagugaguuccaggacagccagggcuauacagagaaacccugucucaaaaaaacaaauauguauauguauguguauguguauguguauguguguguguguguguguguguguguguguguguguguguguauauauauauauauauaauguauauugguguuuuggccuguauguauguuuuuguauuacaugugugcuugugccuguggagaccaucagaggguaucagauuccugggaucaguugugagccaccaugugagugcugggauucaaacccugguccucuagaagagcaaccaguguucuuagcugccaagccaucucuucauuccccaaucuuaaauauuucguaauucaaacacaacuuguuugcacacagauauagacacaagagacauacaaaagaacaugggcuuuuuggccuuuugcucuaaauauuucuuuaugccuaacuaggcaguucauucucauaagcuguggguaucugauguccggaaucuagcauggcugagaccaauucuaucuauucuaguguuaccugguucuuucauuauaaccaacuguuccuggcuggucuuccauuucauuauuucuuagaccuuuaaaaggucugcauuggcuaaaggagacaguuacacagcuguaauacucacagaaucguguggcuucaucuaaaauccuuggucaguuuuaagccauaugaucugggggagauagcuggaagcaacucuaggagcagggauccugccugagaaucugaguguaguguucauuuguuguuugcccuaaucacagucacaagugucaauuuuugugaaugaauuuuugaucucuuacuggcuuuugucuguacucacuacaccucaguugcuuugcugacuguuccacuugaguagcauacugugccuguacugaacucucucagaaccuacaugcauugugauuugcuucccuucccaccucccuggugccagagauuagugcugccacugagcccucagcucccgauaggagugacuaccagguugcuggguuggaauugcuagauucuucauuauugcuuuuauuuguuagcucuguuuugcuuaaucuaccuuggccuuuaucauuucauauaccaauugucuucugaacuaaagccauuguuuuuccugugcaccgggccuuucccgccuucaguuuucacccccacauuucuccuguaagaacggagacgaucuucaggucagaguagagucuucugaaauacaucaaguaaagcauuguugugcuuucauggcacuguuugccaggaacuuuuaaacauuuuuaacuuuuuaaaaacaguuuuaaugauuuauuuauuuuuauuuuauaugcauugguguuuugccucuguguaugucugugaagguaucacaucaccuggaacuggaguuauaggcaguugugaguugcuuuguggugcuagaaauugaaccuggguccucuggcagaggccagugcucuuaacugcugagucuucucucgagccccacauuuuuuucuuaacaaccaaauguaaaaucagauggugacacacaucuuuaaucccagcacuuggaaggcagaggcagguguaucucugaauuugaggacagccuggucuacagagugaguuccaggacagccagggcuauacagagaaacccugucucaaaaaaccaaaaaagaaaagagaagaaaaaugagacuguaaggauugucuggugggcuggcuagaugguucaguagguaaagucuugccaucaauacuaaugaucacuuguuggaagcagagagcugacuuuuccaaguugucuuaccaccgcaugagugcuguggugugugcuucuccaucccaccaaaaauguugaaaaugaagacuacugauugaauauggaaagguuaaaugucaguuuagaagcuagccauugguuccuuuuuuuccuuauuucuuuuuuuuugggggguggggugggguagguagagagaaucucuuguguacuguauagaagcaucaccuaucaggaguuuccuguagggagagaacaacuuugagauagagucaggaacgagaagagauuaucccugaauuucuucugaggagacacacaugaaacugaggauugguaaccacccguguggcacucauagagcagaauaaauaucuaaauaaauaaaacucuggccuggaguuggaguuugccccaguauguaugaggcucucucucagguuuaauuccugacaagaaaaggggaaaauaaaccaacaacauguuacauguuaauuuauauauguaacggguugcauguuaauuugcauuuuaaguaaguggaaaguuguguaucuuccucagcucaugcugggguagaagaauagauuuuagaguuuucucagugauggccugugagcuggacgagaaagggguagugaagggcccauugcaaucacugaugaucuugauaugugcuuguuaaacagugaacauguguuucauaaauucagaaguaacagugugguggaucauaucugcagucccaacauuuagaaggcuacuguagaagcauuggaguucaagaccagucuaaguuacagaguuagacccuguuucaaaaauuaaaacaggccagggcuggagagauggcucagugauuaagagcacuggaggcucuuccagagaacucuaggguuugauucccagcacugauaugguggcuuaucuguuccaggggaucugaugcccucuucuggguucccuggguaccaaguacacaugugauauacagauauauaugcaggcacaacaccaaagacuuaauaauauucaguuuuuaaagaaagcagccuaauucaaagaaaauggguguuuuucuaguuucugugacaaaguuucaaaccauuucuguuuaaguaaucaucuaggacccugugacccacuagcugcucuggucauuaauaaaaaggggaacaguaagaguggggaacaacaguuuucauuaucucuucauuuuccccagcaaaucucacagucucauuaauggacaguaguaccuuaaguuagucuggcuuuaacugggaaaggaaagcaguuacugcuuacaggccuuucauguugcuucacgcguaauugcauccuggaaauaagaguagcaacgaacacauguucaauuuuacuccaggccugucaucagucauuuguuccuaccugaaugcacacagaaaacuauaauuguauuaaaaaaaauagguagaaauagccuucucaguauuaguuauauaagaggaauaacaucaaaagggaugguaauguaucacaugcucuauuaucuauccugaagaagccuuugguaaugcuaaaacauggcuuaguccauugaaauuacauuuuuagaauguuuuuuguaguaaugucaguuucuuucuaugaguauauugcaaaauguugauaaccugaccuuuaaaaaagaauauuauuauauguuccuuuuaaagacaacauuauauccucaauuuuaaacauuuccauuuccaagguucagucugguccacuaaaaaucuccaguguaucagaggugaugaaagacuccaaacugccuguggcacagagccagaaaacgaagggagacacuccagcuucagcagguacugguuagagccacucuuuggaagguguaaugggaggaauugucuuaaugucugugcauuuaaaguuagaggaguggcuuuccuucauaggaagucaucuguuuucccccuguggguuucagugguugaguggccauaguauugaacuuugauuagcaguuaacuuuaauccuuguuuccuuuauuugauacccagccuuuuauucuguguauauguuaagagauaucuuuuaaaugagaacuuuaauucuuaaaacaacauuugucugauuuuccuguuuucauauccauuucaucucuaaaauugauuuuccucuuccaucauuuuuguuuauaaauuaaucuuucuuaaaauugucguuucugaagugauuuuuuuuuuuuaaugaauucuuuucuugacacacucucuuucuucacugugaacacacucuucucuguguuuggaacugucaucuuuuuccacaucuuucaugucuuccuucaucucugcuacucuucagaaugguuagagacccucugccaaaucgcuuucuugucucucucuccuccuuugacccagacuccuuuguauucugcuguucuuuuugauguuacugauguucccuuuucugugcuuagaguuagcacuguuucuagaagccuuucuugagguaagaggaauuaaagugucuguaggcauggagaagacuuugugucaaccuuugucaauuuucuguuucuguuuauuaaacacagggcaguagaaguauuuauauguuuaaguaguacagugaagagcucagcaguaguuuccuucguacagguaacagcaguaugaauaucaugcauaacauguauuuauagcaucuacaggggcagcucaaauuauuucugcagcaggugauacacuuucggucccggccccugcaguucagcaugaggacacuauaaaaaccgaaugucccaacacuaaugaaggaaaaucuacgucugaaaccacagguaguuuaauuauuuauauuaugcuauagauguuuugcucaccagaacuguauugccuaggcagcccauagauaacuggaaauacauaccuagacuguuuccagccuucaaacuugccuagggaagauuuuaacuucuaaguccaaauugauccauauguuaagagugaaucccuuauuuucuuuggaauccaugaguuuagaauccucaccacuuuuuguugaugucacugcuuucuuuguaucccuguuagcuguuaaaaaucuguugaaauuugcuuuccucuuguucacuuuugcugcaagaggaagcauucucaucuucuguaagggagcgaccacccgaagaaguugcagcucgucuagcgcaacaggaaaagcaagaacaaguugagauggaguguauguaaaucaagucguccucagugcucucuucauccauuagcuagcacaccuugugguucaguagccggugggguuucuuugguuucccuaugucacugcuuaguucccaccaucauuuccccauccgugcucuuuccacguaaacugcucuuacccagguaacaagcccuccugacgguguguuagugaacauuccaaauccacuucauuucuagaugaagcuauuuuagaacuccaggaaacagaaauggauuauuucaaccuuuaaugcuuauauacguauguauaggaaagaggguguucugguguugcuaguuuucagcaaaacaaguguauuuccucuuacguuucaauacuguguguguguguguguguguguguguuuagguucacucaccaugaaugucuagaacucagaaauugacuuuagauauuuccuuguauugcuauucaccuauuuuuugagacaagauugcucauugaaccuuaagcuuguuguuucugcuagacuagaaguucucaagaccugugggucaugaccccauugggaaucuccauaaaccaucuacauaucagauauuuacauucugauucauuuuauuuuuauuuuuuuugagacaggguuucucuguauagcccuggcuguccuggaaaucacucuguagaccaggcuggccucgaacucagaaauccgccugucucugccuccugaguucugggauuaaaggcgugcgccaccacugccuggcauuuuaauuugaauuuuaauuuuuuugguuacauucugauucauaacgguagcaaaacuacaguuugguuggggguuacuaccacauggagaacuguauuaaggggcugcagcauuaggaaaguugagaacuccugggcuagacaagccagugucuugggaucugccugauucucuaccccagcacugugguuauagaugaacuugcugccaugcccagcuuuuacguagauggugaggaucuaaacuccaguccuuacgcuugaucagccuuuugcucacagagccaucuccucagccugcuauuacauagauacuccucuuguacaggagauguaggcugucauuuacuguucuaugugcuggguauuagugacuuuggaaauaaugggguauaaagagcuuuuugcuaaacaggaaguuacuuucuuuuuuuuuuuuuuuuuuuuuaaaguuuuuucgagacaggguuucucuguguugcccuggcuguccuggaacucacucuguagaccagucuggccucgaacucagaaauucgccugccucugccucccaaaggaaguuacuuucaaauucuuuagcagcuauuaugaauuuccuuucuggccacaucaccuguucucacugcugcugcaucuggcuguuuccuuggcaccuuauuggcucuacccuaugcuaaggagcugcuguuaugagagggaguggaugggaaggagccuuaggucuagggcauucguggaauuguguguggugucuuauucuuggucuuguuauagauaguugaaaauguuaaauaaguuaaaaaauccucagugaaauguuuuugcacuuucucauuugucaguaauguuacuauucuuccuccuuccuuccuuccuucccucucuccaucacuccaucugucucugauacauuuugccguguguagcucagacugucuuugaccuguauacaccguagcucaggauggccuugacuucacaauccuucaggcucagucuucucagauauaagauuacauguggauucauguucucuacucaauuucauucuucugacaugaguuccuugguuuaaguuauaaauuggagaugcagagucugcugcuuuagcuggucucuuugggguuggucuaaauuuucuugauuugguuuagguaaacugaaaaaaaauuagcaucuuugcuuuugccucuuaauuuuucuuuaagccuuagaacuauguaugcauguguacuuuuuuucuuuuuuuaaaucaaagauuagagcauagucaauagauguccaaaaaggauaacauugcaggugacagucuuguuucuauauggucagucuacugcugucuggucuuggaugcacacuauuaaaaaagccgagcccaagagccagguacuacauuuucccucuucucucuugcuuucuugauaccuugcucuuuagauuaagcugcaguuugaucucacuuucuugguauuuuuugucauuauuggcuuucuuuacuuguaugcacaugccuacccuugauguuaaaaaaaaaaaaaaaaggacagccuuuaacauuugguguuuauuucuuguguacuuuuguggggaaacuauucauucuaagcccccuuuuggguuuuuuguuauguuguuguuaauuuaauugauuuugcuucuuuguuuuggauaaagucuuuuuaaaaauugcauuuauuuauuuauucauucauucagugcacauauauuuguauguguugggccacuggugccauggcaaguauauguggaaaucagagacagccugugagcugguucuuuauuugcaucauguguguuccagacauugaacucagguuguuagggucgaagcaagugucuuucuuuaucugcugagccaucggccuugcuugaauaaggauuugcuguauaaugugugguuauccuccugccucugucucuugagugcuaggguuacaaacaagcauuaccacacacagcuuuuuuuguacauuuuuacuggcaugucuuguuucucuuugauuugucauuuccuuguaucucggauauaugaguuguuauggguuuuccucuugcugagaaggugaaaagaggcaccuuuuuuuucuucuggugagccugugauuuuuauaaaaugaaaacacuaaugauuaugcuacauguguacccuucagaacggucuaaaccuuucucuauuugauuuguuagccuuucuaagaauuuuuuccccuaaacaaccuuuaauuuggaaaauucagacauuuauaaaaguggaaauaauacaguaaacucugacaagauccaucuguucguauuuuuuuuuuucuuuuuuugguuuuuugagacaggguuucucuguauagcccuggcuguccuggaacucacucuguagaccaggcuggccucgaacucagaaauccaccugccucugccucccgagugcugggauuacaggcaugcaccaccacgccuggcuuguucuuauuuucuuaaagauguaucguuuguuucuuuuuuagcugugugaguucuugccugcauguguguauguuuugugccugauaccuguagaggccagaagaggauguuaaacugggaguagaguuagauggaguucugagcugccaugugagugaaaggaaccaaaacccuugucucuacacaagcagcaagugcucugagccacuucuguaacuaaguucccaucuguaccuccacucccguacuuuuaagagaauuaugccuuccuaaaauugggucuuguguauaguuuauuuuguuuguuguuuuugugaauuaauugugcuggaauacuucuaggagaagaauagaaguuuaaagucuuuuguaaggaggauuuguuuuuaacuguucuuuccuuuuucagcucuagccaagaguuuagaagaugcucugaaccggacuucgucugucacucugcagacuauuacagcccagaaugcugcaguucaggcugucaaggcacacuccaacauacugaaaacagccauggacaauucugaggugcgccgaggaaggugaccuguaguagacagguugcgucugugugauaaaggcuuucuuacagaguaaagacagucuaugaugaucuuccuuuuuccuucuauaucuuuaagucugaaucuucuuacuguguguuucagacuagccugcauuaaggaggccaggcuggcaaaaaucacagugacuugcagugaucuucuugcauaagcuuccuaaguagggauaucacaggugugugcuagcugagaaaaaccuucagauacgcuuucagugaaccacggcacuguuaacaaacagugugagaauucagggguuugguuuuugagacagggucucauguaauucaggcugauacuuaauuuaugauguagcugauacauaagacuuacuaguaaugucaucaauauaauuuuuuaauuuuuaaagaaugugucacauuuauuuauuuuacacauaugaauacauuguagcugucuucagacacaccaaaagagggcauuggaucccauuacagaugguugugagcuaccacgugguugcugagaguugaacucaggaccucugaaagagcagucaaugcugagccaucucucuaaccccccauaauuuucaaauuuuaaaguguuuucauuuaauuuaaauaaacugcuuuuauuuaauuuuaucguuuugcuugagacagggucucauauaucacaggcugguaaugaacucacuguagcugaagaugaacuugcuucugucucuacuugaaaagugcuaagauuacucacuguuuacagucucaucuggcuuaguuuagauuugcuuuuucuuacuaccuccaccuggcuuuuuguuaccuuuaaaaaaauuaucuaucuaucuaucuaucuaucuaucuaucuauuuauuaauuuuuauuguuguuuuuuugagaaaggguuucucuguuuagcucugccuguccuagaacucuguaaucaggccaccuuguacucuaccugcuucugccuuccaagcacugagauuaaagguguguacuaucaucaccuggcccagccaaacauuucuuucaauaaaguuuaaauuuuaaauauuuuagaaugaugugaaauaguaguaauaaaacuccuucuauagcacacacauuuuaauguuuauguuaguaacuucuguuaaacacuuaaaaauaauaauuuugauuucugaauuauuacugggacucaguaaauuuccuuuacaauuaccuuugaguuucaguauguggaaacauaucucaguaccaaauuauuuagacuaaaguagaguaaacaugugaacuauaacauaaaggcugaagcucaagugaguuugccagcuguuacuguguuccagaaucaggcaugaugcauugugugucguuaauccaccagagaguuggauaugacuuuuaagagcucuugucugcucuucugaagguccugaguucaauuccuagcaaauauagguagguagguugguauaaccaucuauaauaggaucugaugccuucuucugacaugcagguguacaugcaaauacaguacucaaauacauaaauaagcuaaaaguaaauauaaauaaauaaauacuggaacccuuaaaaaguggcuggucagccgggcgugguggcgcacgccuuuaaucccagcacuugggaggcagaggcaggcggauuucugaguucgaggccagccugaucuacaaaguaaguuccaggacagccagggcuauacagagaaacccugucucgaaaaacaaaaaacaaacaaacaaacaaaaaaguggcuguucaugguggcagaccuuuaaucccaggcagaggcaggcuaaaucacugaccaaccuggucuacaaugugauuuccagauuagccagggcuguuacacauagaaaccaucuugauaaaaacaaaauaaauaaauaauaaauaaaugaaagaaaaacauuuacaaguuugaaguuuacaggggaauaguguagcuauccuaguuuagucagcaaaauggaaaagcaguagccauucucauuacaugggugugggagggcuggaauguccuuggugucagggcugcacuggaugagugguugucagagggacagcaguugguggcuuuggaguagagcagcacagaagaguuuugcccuauagggaaggugcacagcuuacuacugaagagccuuuacagagcaguucaugaaaaggagggguuaggccuguuacuacagaaaucugugcacauaguuuucaauuguuuuagacacuacguuuaaaaaauaaaaugcauugaacaaaccuguuuuuauuucaguuuacuuuuuuguuugagacagggucuccuguagcaaaggauggccuggaacuuguuauguaaccgagggccuuuacuucugcuucuccugucucuacaccuugauuguuggauuugcaggcauguguaccaugucugguuuuaugugcugcugcggauggaacccuaggauuguguaugcuagcaagcacucuaccaauuaaacaauaucccuaaccacauuuaaaauuuuuauuuuacuuguucugagauagucuuacuguguagcccccaccaguuugaaacuuauaaucuuccugugucagcauaccacugugccuucccaugguccauuuuuauaguuuuuuguuuguuuguuuguuuuuuguauuuuugcuuugaggggauaguaucucacugugugugcuuaucuugccuagaacucacuguggacagcagacaaacuugugacccuugugcuuuagguucccacccgaguguucagaucaaagaugugccaccaggccugguggaucuuuauaaaugcugaaaacgcauuucagcuccugcuugucuuaguaaagcuguguguagaccaagcucuauguagaccugugaucuauaauauauaacauuuuuuguuauuguguguauguaugauaagugugcaugaguauggguguguccaugccaugaugcguguauagaggucggaacaacuuaaggagucaguuccuuucuccuuuauugagccgguauuucugcuucuuguccguaucuucucuaggcuagguaccccaccagcuuucugaugguucuucugucucccgucucuguguaggaaugcuggcauuacagaugcauaccacugugccuagcuuauuuauauagauuucaggaauaaaauucagguuuucagguuguaugacaaucucuuuuaucugcuaaaccauccuucugguccccaaguuauuuuuuaucagaggagugcugggaaauagcuguauuucacuuaacuguaccuguuaugagcucuuucucucuggaccucucuguaagccugaauugccuucaaccaggcagauacaucuuugucuuuuagcuuacucuuuaugagccuauuaguuaugaagaauuuuguaauauaaggcauugcaguacuuggauaucauuugaaauguuuaugcucaucaauauuaaacuggggguauuuauuaaucucaucacuauaacuuaguuacuauuuuauacaauuuuaauuuuuuuuaauguguuauaauguaaaggaauuucuucauaguguuuuggaguuaaggauuuaaaaauuacuucugagaagcucauuagauugucacagaugucuagugcagugaaaguuaucucuaucuuaagagcauuggcuuuuaaguucuccauugguaauugauaugcccuuaaaauggagaccuuauuagaugucaguggggauguugccuggaaaauuggugcugaaagagaguccugaagucaguuguguugucuuaucuuagaaugcccuauaaugagcaggcuggcuagacuuauguauaauauucccccugaauuuaauggcacagaauucugcauuaaucuugaccuguuguaugagagcgauuaucuuuacauaacuuaaaauuuuguuuagauugcaggugagaagaagucggcccaguggcgaacaguggagggugcauugaaggagcgaagaaaggcaguugaugaagcugccgaugcccugcucaaagcaaaguaauuacucauggacuuuaacaaguaauuagggccucuccuggugacauucuuugggcuggacguucucuguacugucuuuuuauaaagacauuauuuuuuuuuucauuuauaugagaaaaaaaaaagcagagaaauccuucccucacuucaccacagugugugcucagaacuggccccaggaagguuuaagagaaugaacugugugaaucacaauuaagcuaaaauaaaaugaguagaaauuuauauaaaggagcucauauaaaauccagguuugcauuggauuauugcuuagaauaugugucuacacaguuaucacagugaagauaauuuccagauuuuagugaggauucucagaguaguuauaucagaauucagaauguauaucauaaccauuugccagcacuacaaaaccaguuaauuuauugaacugucugcaacuuugaucuuuuuuccuacaaauuggcaaaaccuaguaucuuaguuugcuuccuaugucaacauacaaacuauuaucuuaguuuggucauaaaggaaagcagcuuagggaggaaggggcucagucacagcccaucauugagggaagucaaugcaggaacuuggaggcagaacugaagcagaggccaugggggaauucugccuacuguuguuccccauggcuuguucagccuguuuucuuaaaucaaucaaucaaucuaucuaucuaucuaucuaucuaucuaucuaucuaucuaucuaucuaucuaucuaucuaucuuccuuccuuccuuccuuccuuccuuccuuccuuccuuccuuccuuccuuucuuucuuucuuucuuucuuucuuucuuucuuucuuucuuucuuuuuuuccuuuuuccuuuccuguccuuucccucuccuuccuuccuuccuuccuuccuuccuuccuuccuuccuuccuuccuuccuuccuuccuuccuuccuuccuuccucaaucaggacaaugcuucccaggcuugacugcaggccuaucagaugagagaauguucucaguggagguuuguuccuagauaacucuagcuugggucaagcugacagaaaacacagcuaaguucggacauagaaaccgacagaggucucuuguuccgaagcccgaauuggcucauguuccaugaccugaggauauucauguguuacacucacuucaaaacucuuuaauaaagguaguuacaauuauaaggagccuuuauauuuuuuucuuuuucuccacagagaagaguuagagaagaugaaaacuauaauugaagaugcaaagaaaagagagauugcuggagccaccccucauauaacugcugcagaggggagacuucacaacaugauaguugaucuggauaacgucgucaaaaagguauguuucuuuagucuuuguaauguuuuauaguuuaaaguaucuguuaaagcauuuuuaagaauucaggaaaaugacucuuacuaucucuuuuaaguuuuuauuguagaguguucauuauaaaguauggggcuggggagaaggaucagcacuaagagcacugaagaggcccugaguucaguucccagcaaccacauggcaguucacagccaucuguaauagacugugaugccuucuucugucaugcaggcauacaugcaaauagaacacucauauacauaaauaaauacgucuuaaaaguuucauuuuuaacuacuuuuaaaauuugugucagauggcugguagcagcauaagggcacuugccucuaaguaugaugaucugaauuggauuuuaggggcucaguuauugaaaggagagaacugauucucucaagauguccccugaugucuacucacauacugugcuguaugaacacacacacacaaacacagguauaacacgcuuucacaaaacaaguuguauuaaaaagacaaguuaguuuguauuuucugaucuucagguucuguguauugcuuguaacccccagcuagacugguuucuuaagaguguagauggugucuuuuguuccauuuagccagagaccccuuguaucugcuuagguccaggcugcucagucagaggcaaaggugguaucucaguaucaugaacuugugguccaagcaagagaugacuuuagaaaagagcuggacaguaucacuccagacaucacuccuggauggaaagggaugaguaaguacaacugauugccauuuucuuucuguauuuuagcaucuaaucaacuaaucuaaaccugcuucaacuccagucuuuaaaucccagugcuucuaugucccaaucagugcauagguguuauuuucucucugucacacacagcagguagaauacauuauuccugaaguucuaaucauggugagcagaaguuccucuagugcuuaauucuaugauucaugauuugauucugauuugcuacucaaaaauuaaaaguggagucugagugauuuuuauuuuuauuuauuuauuuauuuugguuuuucgagacaagguuucucuguauagcccuggcuguccuggaacucacucuguagaccaggcuggccuucgaacucagaaauccaccugcuucugccucccaagugcuaggauuaaaggcgugugccaccacgccuggcugaguucgagugauuuaaagugaugucuuaacauuaacucuguuaagauacguauguuuauauacuuauucaaaucauuuaguauuuaaaaaucuuuggaauggauuagugaaggcacacuugagaauucuguuagugaccccaguucuuccaguuguucucaaguucaucacuguucuguuucagccucccaaguacuggggauuacaggcauucacugcugugcccacacuagcuggaaaacccauucuugugagauuaugaaauugaauaaaaguagugguaugaugccuaagggcagagaaguugguuaaaaggugguuauagagccaggcaugauuguguagaccuuuagucugaguccuugggaggcagcaagcaggaggauccagccuggguugaaucuagucugguccacauagugaguucuaaaacagcuuaggguuacauacugaaaucuugucucagaagcguaaaguuaagaugcuacagucaccugagggugaagugacagagccgucuaguguguauacccagaacauugauaagaguaggaagauaccaggggccacuuguuuagcaauugguuuggagauguguauccuccuaacccagcauuucagcuccuguguauuugcuuaaggaaacucccaauguacauuaaggcauuauuguaguaagagcacagaauuugagcguagaggcguaauuuagugcucaaagaguaucuagcaugcaagaggcccugaguuggagccucagcauuaaaaaaagguaaaaagagccuggucuaguagcacaugccuuuaauccuaccauuugugaggcagaagagguguggaucucugugagcuugaagccagcuuggucuauaucucaaucaagcuccaggacagcuauguaguaagaccuugacucaaaaaaaaaaaaaaaaaaagggagaaaaguggcaagaggauuaggcuagagggucuugcucauugucgagcacuuggcuaguauguacaagcccugaguucaguccccagcaccaacaaacaaaaaagaaaauaaacuuugaaauagucaaaugugccuuauguguaucagugcaagugaccugguauugucucucuccaaagagaagacuuggugguauggauaccugcugccaaaacuggugaccuguguucuauccucaggacccacauggaggaaggagagaacagauucucaaaaauuguucucugaccuccacacaguugccaugguauacccaauccaaauaaauaaauauauguaauccuuuuuuaaaaauuauuuaaaaauacagaauagguuggugcuauugugaaguuuaagaaccuauaaacuaaacaguuauuuaaggauauaucuuuauaucaaguauaaaagugagcuuggggucuagagagauaguucaguacuuaagaauacuuacugucuuucugaggaccaagguuugguuccuaguacucacagaguagcuguugugagcaacuccaguuucaggggaucuagugcccucuucuggcuccuacaggcucuugcaugcacauagugcuuauaaacuugugcaggcacacauauauuauacauaaaaguaaacaguauuuuugaaaagugcuguggacugauaacccaaagcaugucuccuuuguugcuuauguacuauagcacauacuauuauguuuaugugcccuguuaaugaucuuuuacauugucucaacuuuguuuuuccuuugacauagaagcagauucuuuuaaugaaaaauuccuugaauuuaacccaagagguccuuuuuucuuuuuuaaagauuuauuuauuauauguaaguacacuguagaugucuucagacacuccagaagagggcgccagaucccguuacggaugguugugagccaccauuugguugcugggauuugaacucaggaccuucagaagaacagucggugcucuuaaccgcugagccaucucucuagcucccuaaaccaagagguucuuaacaagcuucauacuaaagacagaucugccuguacaggccuauacacccauguguuugaggaugcugaggcaagaggauugcaaauuucugggcuacaguguagaucuguuucagaauuaaaaaguaaaauuugauuggagacauagcuuauguucuaccuccagaauugccaggggggaaaacagaggcaagucacugagguuggcagcugucuacucucuugucacggguucguugggguuuguaaucaugauaaggaauaucauuuaaacuucaacagucagaguuuuugauuuaauuuuacacagguuaaauguaaauuuaauauuaaguucacuguagugcuuauuuaagaagcuuacugugauacacucccagcuuucaggagaaaaaauaacagaaagguaacagaaucugaaaagacuuuguuccaaaauugccucuaaagaaaaauguuaauucuagaaguauuugacaguuggaaguagccugccacuggaaacuaguacuaggauggagaaauauucuguaaauuaguucaguugacaguaaucaaagaauugugucuccuaguaaaguuuuuaguugaugugcagaugagacagugacagaccccuucuaacuagagcaguccuuguuguuggugauucuccucuuggaauauuuaacuucccuuagaaaugcugucucuagcugagccugguggugcacgccuuuaaucccagcacucgggaggcagaggcaggcggauuucugaguucgaggccagccuggucuacaaagugaguuccaggauagccagggcuacacagagaaacccugucucgaaaaaccaaaauaaaaaaagaaaaagaaaaagaacugcugucucugacucuguaaauauaggaacuaaacauuuugcuuucuagaaaccucuuuucuuggucuuucuggauguugcuauuuaaugauggcuaaccaaagugcgugcuuuccuuuuucacacuauucuucucuuucuuuguagguauuucugaccuaggugaguaauuauguauauucuauguuuaauggcauuuuuugggggguguugaaauagugaacucuuucuggugugugugcaugugugcaugggugcgcgugugcuacccaucuaaacuauagcaaguagaaccugaaugugucauaauucucaauugucauccauagauaaucaagaauaauuguguuaaguguaaggcuuuaaaugugagguaugugucuguuuauauacaauaaggucuuuguuuuacuuguuauuucaaagagcuucaaacauuaaaaagcaaaaaaaaaaaaaaaauacaaauaacucccauggauauuuuacccaacuuuaucaguuaucaaaacaaugcccaguuuugucucaucuguucauagcuuucaugucaaagcagacuccaaauauaucuuuuuccuuuuaaauauuuugaguguuuuuuuagaaagacaaucggaauacuauuauuaugcuuaagguuucauaauucucuaaugcuguuaaauauacagugcuuaagacuuuuuacuuauaguauuuuuaauuacgguuuuaauucaaaccaggauucagagaugucccacacauugaaauuacucaaugagucucaguguuugcuugcuuauauauuuugcuuuucacuuguuuuuugaugaauugaucauuuaucauacagaauugcccauauuuguauuuuauggcaggaaccuuccuucauuuuuuuaaaaagauuuauuuauuuauuuauuuauuuaguuaauguaaguacacuguagcuguuuucaggcacaccagaagagggcauccgaucucauuacagauggaucucauuacagagccaccaugugguugcugggauuugaacucaggaccuucagaagaaaagucagugcuuguaauugcugagccaccucuccagcccccuuccuucauucuuaaucucuaguaaauguuggaauacuguggagugugaaauuacuuccccuucuaaaacaaacaaaccaacaaaucgcaaugagugaguguaugugugcauaacugaguguuugggcaugaguauuaaaaaggagcaugagugaucccauuggguaucauugaucacagauuacuauucuagguagugugcauucaaggaaaggaacaaacagauggagagauagcucagugguuaagagcuauccagaggacagcuggcucauuucucagcacucacucggaggcuuacaaccaucuguaacuccaguuucaagggaucuggugccucuucucuggccauuuacaacaguagacacacauaugaugcacagacagauauacaggcaaaacacccauauacagaaaauaaaaauacuugugugugucuguaugugugugugugugugugugcuuguuuugggggggagggguagggagugugucugucaguguacuuguggcucacaggagaauuugugggaguugguuuccuucugaauauuuguuagggcuaaucauaguucuacauaaaauggcauauaguagugauugugucuacaagcugucuuuuuagaaguaaaguuaguaaauuagaaagccaggacaugaugaguucagauuacacugauuuggaguucuuagaaagagcaguguaugcugccucacacuuauuauuauuauuauuauuauuauuaucauuuuauuauagacucacccauuauuuugcuuagaauugauagugcuuuaguugcuggauaguaguuuuuaauugcuacuuugacuggaggauuugaauuuuguguuagcuucuuucugcaguauauuuucagugacagcacuaacacuuugauguuaccuguuuagcuggcaaacucucuacugaugaccugaacucacucauugcucaugcccaucgucgcauugaucagcucaacagagagcuagcacaacagaaagccacagagaagcagcacauugagcuagccuuggaaaagcacaagcuagaagaaaagcggaccuuugacucugcaguggcaaaagcauuggagcaccacagaagugaaauucaggcugagcaggacagaaagguaguggaggaagagaaugaccugacauuugaaguuaaccuuguuuguucugucacugccugcuagugguaaauauaauuugugccaagcuaucauuagagugguguuuuaggguuuuuuuuuuuucuuuuuuaaagauuuauuuauuuauuuauuaugucaguguucugccugcauguaugccugagaccagaagagggcaccagaucucauuauagaaggucauaaacuaccaauugguugcuggguauugaacucaggaccucuggcaauugaaggugugauuauucaaaggaaaagagauaccucuguucaccauuuguuuguuuguuugucuauuggcguggcuauguuuuugguuuugauaauuuuguaauuauauuuauauacagaaaacuuagugugcauuuaaccaaauuuaguggugaguucuuuagccuuuugccuuuuccagcuuggcaaagcgagccucagacuuaggacccaggacguugccuccccaguggcgauggaucucaucauaucugucauuaaaauugguccuaauagcuuccaccagcuuagccagagcacccuugucuuccgaguuaaccuguguaaaggcaacaguggugcaugucuuccuguggaccaggcaccccagccuggccuuucccuugaugaugcaguagggcgcccccaucuuucgacacagggcaggcaggaaaaccaccagcucauuggggucuacgucaugggcaaucaccaccagcugagccuucuuauucuccaccaagguggugacuggguugacuccugcucuugaggacagguggucucuuagucgggacauccccuuuugccagcagcuuucuucucagcacaggccuuugcuucuucucuugcuuugucucugaccucuacuugugggcaagcuuaagcagcugaguagcugucugccuguccagggccugggugaacugguuaauggcaggagguacuuuggaccgcuuauagaggauggcucuuugcugcugcagccugaugaaguggggccauuugaugaaguguguuagaucucuuuggggcuggauguccugcccaaugccgaaguucuugggccuuuccucaaacaaaggauugacccccuuuuuggccuccuguuucuugccaguaagagcugaggccaccuucuuccccuuggucuucuuuccuuugggcaucuugcuuggcugauggagagagcuuuugguggcuauuuuuuuuaucagagacucuuacauucagucugcauccacaguuaauuccuguuuuuuuuuuuuucuuuucuuuuuuuugccuaucuuaauccaauaguuucucagguucuugcuguguaaccaggcuggcuuagaacucccagcagucuccucgacuuuuguuuauuuaaaaauggcaccuuguuacuuagcugugacugauaggaacaaacgguuauagugcuaccuuauccugaguucuggguuuucaguauaagagcauuaguccagauucuuaaacaacgcccaaagacucuuaauguuauacuugccuucuguaaguuugucguuuauuuauuuauugaaucuuguuuagcuuuuguuuuuguuuuucuucucugugcagugucuuuuuguauuuuucacugggauguuugugcugugugcuuccaaccuggcucuucuccuuaaaccuuaguucuacacuuggacaucacugucucagcaacaccccucuuucaguuuuaagcagcauguaugggucaguuucugcuauauugcuguuuucagugaaagugggaguuagguauuuagggugggcauccugcucacauucacucuuggaaacaaguguuccugcuucaaggaucugugugugcauugucugagcagucauguauccaagaagauaguagguucuguccagcacggggcuggucuuaaauggacucauuguucuaaaucugagaaaagaugaguuuguguucaagguaguuuauguugaugucuaguauacccgugguuaauugcugagugaagcaggacggagcauuuccuaacuuguuuugacuggcccauguuaaacuuaaacucaugugaaaauaagcugcugguuucaaagaaauguguucaaguguaccuuuuggguacuaauuuucacauugauuucucuuaaguuggcacugucaccaugcaaaaaggugggaacaugaacaugagcaguuaugguuaaacaggguuugcacccagcuuagaacuagcuagguuucuuugcucuacauuuuggaauaaguuacuuccuguguuaugugugauucagcaaauaaugguguuuguuucuguguugggggccacauggcagcaugauggaaggaagcacaaguuuggaggccagagagacccauguuugaaguaggauuucuguguagcuaugugaccuuguuucaguugcuuuuggguguuuggcuuuguggcucuuggaaagcaugagauaaucguauagacaugccuggcacaucaguggaguugagcugcugcuacuguuagcuuccugacuagucucucccguucccuaaacgugcauauggacguuugagagcugcccauugcugcgcuugguuucacagguagaagaagucagagaugccauggagaaugaaaugcggacccaacuucgacggcaggcagcugcccacacugaucauuuacgagauguccucaaggugcaggaacaggaacugaaguaugaauuugaacaggugaggaccugugcucgggcuuccgcuccuuccuccccggggccucacacauguugccuguccuguacagcugcaccacauccuuccuuagccuuucuccuuccugugcacucugaagauaagaauaaagugguaccuagcuugggugaaauaggcuuuuuguuaguuauaaauuacagaaccaguucguuuuacaucagccaugcuguguucauggucagguauguagaucugaaaauauguguggguugcaauacaaaaaugucucauuuuuaaaagauuuuuuauuuucucuauauaaaugcuuacugcauauauggguguauacucugugcuuaccuagugccuacagaggcuagaagaggcagauccccuagaacuggagucacuuugugagugcucuaggaaaugcucuuaccuacugagccaccuuuagccaccccaaauuucuuuuuaaagauugcagucuaaaugcuuaauuaaaagcuuuucuauguuguaucagaaaauucagaaacuuauggaacaugagucagagccaggcauggugauacacgccuuuaauuucaguauuugagaggcagagacagauggaucucugaguuuacggucaucccagucuauagcguaaguuccaagacagccaggccuauacagugaagcucugacuugaaaaaccaauaugaguugauaaaaguuugaaaccuuauauacaacauugcagcuguuuugguuuaacauuuauuuuacguauaugaguauuuugcuuccauguauggcagugaauuacauuagugcuuggugcuggaggagggcagaaaagggcauuggauccccuggagcgggaguuaggaugauuuuaagcugcaucaagacugcugggaauugaaccugggucuggguccucugcaagaacaaguguucuucaccacagagccaucucuccagccccuuacaagcagcucuucugaaguuuuuauuuguuuuagauugguucuuccuguguaguccuggcuggccuggaacuugcuguagaccagacuggcuuggaacucucuugccucugccuccugagugcuagaauuaaaggcgugucaccacaccugguuauaauuugagauauuaaagguuccuuuuuuacuucaaaguuaguaguuucuggaagacuagcauguaguuagguggcaagcauggugguaacauuagauuucuguacacugucuguuuuauuucagggccugucugagaaacugucugagcaagaauuagaguuucgucgucgcagucaagaacaaauggacagcuuuacucuggacauaaauacugccuaugccagguugagagggauugagcaggcuguucagagugagcucccuuucauacgcuauggucugacccuguacaguuucucaggauacuuucuuguuaauaaugggggcauagagccacuccacuuuaugaugauacuccauucuugaagaguuggucccagacuggacaaguuuaaguauagaguuuugagaagaaaauggaaaaaagaggauccaaaaaauuaaauuguaauaacuuauaaaugacauaagaucaccguuuucaaggcauuuucucucauguauugaaagguuaucuggagguguaguguacuguugugaugggaguuacggugagaccuguguaugccacauugaaaagugaccacacauuucacaacaagcacauuaauaaaauaagggguuucuuuuuuguuuuuguuuuuuuuuauauugucuuaugacaauaaaaguaagcacaauacuuauugaacaucaaagucuauuuuaguucauuacauuuuuuuuguuaaaaugcuuucaaauaauuuuaccuuuuacauaauaugaguauguugccugcauguauauaaguacaccacaugucagcccaaggaggccagaagaggguguuggauccccugagauuagagucacagacaguugugagccaccauguggguacuagggacugaaccuggauccuuuggaggagcaaccagugcucuuaaucucugaguccucucucuaacuccuaguucauugaguuuuauuugaaaucuuugugguuugguuuuuuuccuugacacauuucugauggccuuaaaauucuuggcccacagcugggcagugguauugcaugccuucaaucccagaacucaggaggcagaagcaggcagaucucuuuugaauuugagaucaaccugaucuacagagugagccaggacugugaagaacaaccauaucauuugagugccccaccuccaaacacuaaauauaaaaaauugccugaauuagacagugccauguguagugccagaugccuuuaauccuagcucaggaggcagagauaggcagagccuggucuacauagccagggcuacauuacauagugagacccuuuugccaaacaagauagaaaacuggcaaaugugaauggcguuugcauacucuggauuucacaggaagggaaggguacuuggcugugguguggacuugcagucucccaguuuuuaguguuaguagaaucagguccucaucaaacagugucaucucuuguuaauuugugaaaagacugacucuggccaaguuaacaagaccuguuggaugcaguguauugaaggugcaucugguguauguguucgaggaagauagaaaguaucuuucuuugcuuuauaucauuuuauuauuauuauuuauuuaauuaauuaauuuauuuuuuauuguaggucaugcaguugcugaagaagaagccagaaaagcccaccagcucuggcuuucaguggaggcauuaaaguacagcaugaagaccucaucugcagaaaugccuaccaucccauuggggagugcaguugaggccaucagagucaacuguucugauaaugaauuuacccaggcuuuaacugcagccauuccuccagagucccugacccgggggguauacagugaagagacccuaagagcccguuucuaugcuguucaaaaacuagcccgaaggguagcgaugauugacgaaaccagaaauagccuguaccaauacuuccuuuccuacuuacagucccuacuccuguucccgccuaagcaacugaagcccccggcggagcucuacccugaagauauaaauacauuuaaauugcucucauaugccuccuauuguauugagcauggugaccuggagcuggcagcaaaguuugucaaucagcucaaaggggaguccagaagaguggcacaggacuggcugaaggaggcccgaaugacccuagaaacuaagcagauaguggagauccugacugcauacgccagcgccguaggaauaggaaccacucaagugcagcaagaguaaggccuaggaagaguuguguaaugucauauuucauaucaaagaaaaucagcauugguaucugcaggguuugcaacaagggucccagaauuguccagaagugagcagguuccaaguccugugugagauguuaacaccuguugcauuuaccguccuuacacugcuaucaugccaaugaacuccaggaggcuuuauuugcaacuuguguaacacuuccuguuuuuuagguuuuacugaucaggcuugugagccacucaaaauaauguuugugaucccuacuauugauucugcccuuggagcaaacugaauaaagcaacacaaugaaaacugaguacucuaucccuuuucaaagcugccauuuccaguuuguugugugagcaggaagcuuccuugagaagcagcaucagugguaggaacuuguggccacaguuugggucugugagcuggguaaccugaaugaaguccaggaccugcugcuuugggugaauggguccccuccugacagucacaaucaggagugaugcagaagccaaauaaaugccaguguguuuauaguugggaaucuagcacucagcgauugagaggcacaggaaacagucugccucccacaggaaaaguuguuuguugugcugggguccagcacacaugcaucucuaccucaguucucgagccaccacucucauuccugcuguggugcugcuucccaguaccugaagcucaugagccuggaaucugaagaaagggauugaaaauguuuuuuccgguuucagccagacugccugugaaucccaguuugucauaguugccauaaugcagacauaguaacaaauucuuacacucugaagacuaccaucacuacaacaucuugccaguuuuuacauuuguuguuguuguugaggacuuugcaguugagcaacauaaccagaaagcacgaaagcaguuuucugcauuguauuucuauaauugcauagccgcagccucucaauauggguauguugcccaucucguugcacaguucugaccuuguccuuugguuugcuauacacuguucacccugggcuauuguucacacucuaucuccauuuggagcaccugcauguggauugcccuguuucugaggauagaggcagugggcuaccuggcgugaggcuauaaagauuuuacucgaaggcaauggaguacuaccuaauaacuacuccaucucuaaggauaggauaaaaucucagaaguacauuaauuucuaauacuuaaaacguguuugccgagcugggccauugugguucaugcuuacuuacaaucaagucaggccagacugggcuacacagauacugugucaacaaccccuaccggggugggggaggacauaaacgauguaauucuucaagcucaccaaaacaauggaucguuuuaguucugaaucaaaguaauguagacuugagaauuuuuuuuuucuguaugugugugcauguccuccaguugguuuuugggagucuuuacuggucugaaacucaaguagacuagguuggauggccaguguugcaagcacaugcuauugaguggguuccagggaugugguccagguucugaugcugcacugcacagccugagcugucuuccuagccucuggcuuucacagaguaccuuuauuauauugaaaaagaaggaaacuccugcuuagcccugucuuugucuugcucauggcuuguucagauguucucaguaauugcuaaagugaaaaaggaguuuugaguucuuacuccauuucaaggaaauggaagcugcaaggcucacacuguagaguuuaaagugccccgcugucaggauggacauaaucggcuucaugaaagcaucuccuuuaaacugcaaauaaaagcaugcuaaugccacuuggaauugauggacaggaagcugagcugggccauugugggccucaccuugguucacucaccucacaccucauccugauugcugggggagcauucaaacuggguguaguggggaugacugacccuagcuauggagcuggcaauaggaaaaucagaaauccuuuggacuagaccuuauuuuccccccaggggggcaggggaggggaaaagccagcagaugaaaaccaaugagcuaugccaugcuccuaaacagaaugcaggcuuuugccucaaugauuuuuuuuuuuucaagaagggguucucucuguagcccuggaacucugcuucaacgauuuuuuuugaguucccaaaucaguaauuaaccugcaguagaaucuuuagaaaucuuuuaacacaguacacugaguuaacuuacauccuuuguucucucaacagguucuggauaaaagcagucuucaaaucccaaaugaguaauccuaccaguuucaaaguaacucgcuugaacucaguacagaagaacaggucaucuccauuaauauaaaaggcaaauaaaaaggcuugacugguaggaagccuaucuucauguggu

SEQ ID NO: 3064 - RNA, 28276 nt, Mus musculus
agaugacaaacuguguauguaugaaacuuagguggauucccagagcuggccaaccagucuaacugaaccugcagucucaaggccugucugaagaaauaaccauuguucucuggcauccaugugaauauguacacgcuuacaaagaauuagauuuuuaaaaauaacacaauugcuuuauuuaaugacuuuaccaucugggcagccuaaaccaguagcuugcuucugauuuaauuaguucuaagagcauccaucuuuuuaaguacucucaaaacgggauacgaucaacucaacaguaauaacccaucuccaugaaaaccaguuugaauccuugucucuaggccaaaggaccacacaucacagagcagguaggcagcaagggccuguggguucuaacaugaugggcguaguaggaaugaggccugcaaacaguguguuuauguggaauuuguucuucuccaaaagucagacuucacaaugcuuguugcugucuuggcaaaaaacuggccagaugugcaucuuagcgguacugcagaugaaccccagggucuuagguuuaggccaguacaauacaauacagagcuuauauuggaucccagcccuguaucuguuuauuuuuaccacuucuaacauuccagcagcuauugugagccaccucucucucucauuugucgucacugucacugucacugcugcuuucuccaucgcuacuguucaguucagugagguuacccagggcuucucuguaaggaagagaaaugauaccacacuucagcucacagggucaggguguuuggcaucuuugauuauacacagucauagcaguuuucaaagcagaaaaaggaucccccaaacugcacugaacuauuaugagaacaaagaaaaaauuccaaaaaccaaauguuuaugaugaagccuguaacagagcaaacaggcauuacaucacccaccaaacccuggcuuuguaagggaagcaggagagaaugcuauaagcaccagaagaggagauagacuuacuuuuguucugggucaacugugaaauccaucacuacucuuugggcaaggcucuccccaauaggcaagcugaaggcacuugccagcuuuacaaccucaauggccagagcagugcuaccggaugcuuucgcuguguccaugaauuccuccagcaauucauuucuguauaaaagaaggcaaaacugaacuguacccaaugcacuuuucuacugcagacuuauauauccaagagucuucauguacguagguguaccauauguccacagaggccagugcugacccccuggaauuggaguuagaaacgguugugagccuccaugugggugcugagaacuaaaccuuaggaaaagcagcaaggugagccauuucuccaguguaccaaacuuaauaacuuuuagucaaauauuuauagacgagauucagaauauauuaaucaaauucucauuaacuuuggacaaaagauagaggauaacauucuauauuccacccccccaccccacccccuucucaaaaugaucacugaauagagaaaaggauggcuuacaaugcccugaauggcaggagagaaacugcuugccugccuaacuggaggguuuaggcaugugaagaaauuccaaccacgcacccaagagucaaagcccaugugacuaacucaagccuguaccagcugaggcccucaacuuaccugggaaucuucuugugcuuuuugaagaguuccaacauuuuccuguggaagaagagaacagaugacugcugacagaaaacaaguggcagcuagacaaagcaagcuauccuuuucucggguucagaagcuacgugaccuacaagucaacuauucaaacuuuuucaauuccugugggcuccacuagcucccaaucugggugcacaaauucaacagguaaaucugagaugcagccgauuuagaagugcuaguuauaucccccacggagggaaucuacccuacacugcagguuagaagagcuaguagccugggcuuagccuaaucuccucuuaaagccugacucagucugcucuaaaucuccauuaugaagaacaggcucagauuaaggcaacagucucauguaugugaaugccaacagccugccacaugcaggacagaggcaaaacacauacauucagcucccaugacucagcugagguccguaccccugcgccaaucaucacagccugcuucauaguguguucaaccugccugaccaugaaaaacgccuuguugguuuuuuuguuuguuuguuuugugacaaaaaaggugcuaacaggucccauuuaagugagcuaacaagccaaagacauguuucaaacaucuauucuggagaauuggcaggcauauuuggacuggccaugaauauccaauacauucauaggcagggagagauaaucuuggugucucuaauuuuggaaaaacgaauaagccuaaggucuccacuuagaaagacuagauuuaguauauuagugaagcacuggaaaaacacaccgaagcagaauagaggcacaaaccaaagauagucuuguuucuggaaauaccaguugccagaagucuaagguccucagaccacacguaggucagggauggggacgaggagcacguaugcugaaucaccagagcauuuccaaaggugugcuucucucaucacucagaaccacgggggcagaagaaugaggcugaguuuuuugcccaauaagaugcagaaagccaaaagguauggaauaaagagaacucucagcucaccugaguauccucuuuucaaguacaucacacauacuggccuuagcaaguuucuuguuuaacugguauuugcaaguguccacuaaaaccucauguauauucagguuuguagagaauauucaccuaucaacccaaguaaauguuucagcucuaagcauuacuguuaacauguacacuuaggaacauguacucaccaggcuuccuggcuucugccaccucuuaaaaaaaggacagcuauauacuguaaaggguuggcuggccaaucaaaagcaggcugccgggcacucuggucuucguauguggauuugauaucagcagcacagucagcaaaugcaaccugaagcugagaggcucuaagagucagcagaaguguuuaguuguucugacaagaauuuaaaaucaagaacuaucacaugcauaccacacaaguaacacagcaacaaagaggccuucaccugucuugggauagugcaauuuaacuacauguaugaaagcuacgaugaauuuccuuuaaaagguuucaauuuaucgaucggcugcguauauacaugugcacacaaguaugccagagcccauguguagaggucagaggacagcuugugggaauugcuucucuccucgagguaggacccaggaaaaaaaacuuaggucaucagacuuggcagaaagcacuuuuaucuacugacacaucuuuccaggugguggugguguuaauaauaauaauucuaauaaauaaaaaagaaaaucuuauuuuguauguauagccauuuugccugcaugugcauaugugugccugaugccugcagaggccaguuucccuggaaguggaggcacagacauggugcugggaaucuaaccaggguacuuuggaagaagaacaaguugcccuuaaucagagccuccucuccagcucauaucucucuuauuuuuaauuaugugugugugguaaaguaaaugcauuuugagugcagauguuugugagugccugauguaaguacugggaacugacucccgauccucuagaagaagagcaagugccuuuccuaggaguccucucucuaggucaugaaauaauuauuaaauaaccuggcauucacugucacaacucuuccugguacccaccuuggacuacaggaaugagguuaacacuaagagugguauucugcuaaugguaauagguguuuaaccuaaaccuacauuugucaguggaacaucccacaaggaccuuaagaagauacacaggucaguacuccucuaauaaugauggcuugagcuucaagccagccuuaccucugguggauguuuaucccuggccaugagcaucaauacuucuucucuuagggcaucucggaaaguaugacuguauucuuuacuaucuuaaagcaagagaaaaggacagugauaucccaaaugcaaaacaccuggugagcuuuuauccauuacugacuuuuauccuccaguaggauuaaaauuagaauuauuuauuagaauuaaagaaaaccuuaauuccacuacucugggaggcugaggcuggucuacaaaaugaguaccaggauaaucagagcuauucagugagaccuguugccaaaugccaaucagaaauguuuguagucaauguauaacacagccuguguaagagauuuggguaagacacagagcuggacuuugguacuaauuucucuggcacugauaucagaaagaucuuauuuuccuguacuuaacuuaaccacuauaacuugagcaauggccuucaaguuugaccuuaacaaaaguguuaaccucuguuaagaauggaggcuuuuggaggcuggagagguggcucggcgguuaagaacacugacuguuuuuaugaagguccugaguugaaaucccagcaaccacaugguggcuuacaaccaucuauaaugacaucugacauccucuacuggugugccucaagacagcuauaguguacuuacauauaaauaauaaauaaaucuuuuaaaaaaaaaagaauggaggcuuucagucuuaaaauguacauguuaaucaucagucacugcacaaaacugccaccaaccuuuccaaaucugaggaaccaauucuagucuauuggccacauccaaugcuugaagaagaccuaugaauauuugguaguggggaaggaacaccugguggagaaauacaaacaugauuuuauaacauccaucagaaaaggcauucucacaaauucaucuacaaagacaaagaugaguaugaagucccuuacugaagguauuagguccuuauaccacuucaaggugacaucaauuuguuccagugaacaaaucaaacugaaaaacuucgaacuguggagagaaaaaguguguuuagauuaaagucuguguguaacaauaagauaugauuagugaaauuccaguagaauuauuacuguauuaaaucauacauuuuuaaaguuuacaacuuuaggucagugagauggguaaagguacuuguaauaaaggcaggagaggacucacuccacaaaguuguccuuuggcaccccccacccccaaugcuguacaugugcacacaaaauaaaaaaauauguaauuucaagucagaacggucaaugauugaccaaaugagugguaacuacuacauuucccagcugagaucuuggauccucagcuggacacuuugggcucccugcuuacuacuuauucucagucaccucaaauaacauuuguauucaaaguacucaguggggaaacaaggaccuggacacacaaaaacaacccucacacauaaaggcaugaaguguaacacaauaaaaucucuauguacauauaagagucuagucuuaauauuacugcuacuuuucaauuugucugcguauauguacacaggugugccugccuauagaugcucguaggagugggaguuguguuucagaugucgucuucaacugccucuccaaaaccucacugaaccugaagcuccacuguuguguucaccuccaacaauguguucagagguccaaggcggggcuggggguuggcgacaaugcaaggcaagcacaugcuuacacaccugcuggacgaaacaagcgccagcaacuuucuuuacacauacauaaauauuacacgcauauauuaauacacauucacacacuggguagauggagucaggcgccaaccucuuuacauacauacauacauagguauacacacauaucuauguguggcuggaguaagcuucaacaaguaagcuugaucaaacuucauaaauguacacauauacacacacacauauacauauuuggauagacaacuccaaugagcugacuccaauaacuuuuuuuuucuuagucuuuuuauaccaccuaagacuaaaguucuguaaggaaaaaccucagagucacaaguuaacauuaucucuaaaaaacaaucaccacaaaaacauuccucaaaacagaauuaaagccgggcagugguggcgcacgccuuuuaucccagcacuugggaggcagaggcagguuccaagccagcuuggucuacagagcgaguuccaggacagccagagcuacacaagagaaacccugucuugaaaaacaaacaaacaauuaaaaucacuacacaaaaggaaauuacaauaggaguauauauuauucuuuugaaauucauacuuaacuaauauuccccauuuuucuuucuuuccacaaguucaccauaaaccccaaagcaauaauucuuuuguuacuaaaauuuaagcaauccaguuuguaguaaguucuuuccuaugcugauaacaauuuauacuuagcaagagagauaaccuaucuuuuguucagauaaacuaacuaaucaucauuauuuauccuuauauucauaacagaauuacuuacucuuuauccauaacccuguuuuuucauagugcacacugaaaccuauggccacaucccuagaucacaagauccuagaacucagacccaaccuacaauguuuucuuugauaaugaccuugucccaagccuauuuuucuuuuccaaguacaauuauauguuuguaaugcaagaaaacucacuguauuuguuuucuaacagauguagcccccaguauuuuacaaaggagggcacacauuccacucauaguucuaacuuuauuacaccuucuggcaaaacaacuuaauccaucuccuuaaacuuucuaucaauuacccuaaacuuccuaagacuauuuaaaucaaaucaggaagucuguaaaauuauuaguucauuuaaacaauauuauuuuuggaaauuucauuuucauauugaucugcaggaaaguugccugacagagugggcugucucucaagaggcagucacaccuugcuagauguaugaggaauauagcaaugacaagcaugagaaggcauggcagcagcaagaaguaaucuguagaugaaggcugagguacagccauugcagcuguguaagauggugggcuaucucuaggaagcucacuugcccacuguaggucccucugcaugucauccgccauuaagccuugcuccaucuacccaauguauguauguauaaaguuguuggagcuugcuucacccaccauguauguguguacauguauauauuuaugugugaaguugauggagcuugcuuuaaccacuaaaugugugagcaugugcaugcuuuacauuaucaccagcccccacaccccccuccucggauugcugaacauuguuggagcuggucuucaacagauuugccuauaucuacuuccugcuucaucguggguuuacagaacacauaccaccaguggggccugggaacccaaaccuaaaaauguaugcucccacuuggagccauuuccucagccccacugcuuuuaucaaguguucaauuacaaguacaaauaaugggcccaucaccuaaaacuagagcuaagauauacagucuuuaagauccucccacugcugaaucuagcaauuaaacugaaaggaggggguuagaaagauggcucaagaguuaagaauccuugguccaaaaucaugagggcuagaguuugguuuggaucccagcaagcauuuaacaaaccaggcguuccuaccaaguauuuauaggcaauuccaaagcagggcagagaugggcuugcugggcuuccagacuagcugagucacaagccccagcuccaggaauagauccugccuuagagggacagguagagacugacgaagaauuccugguacccuucugguuuucgaaugcuugcauagguguguacauacacacacacagacaagcacacauauaauaaaauaaaucuuuuaaaauauuaaguaacauacuuacuaauauaccuuacguagaggaucauguccgaccaguuuccgguugucccccguguuuaaaagucuguguacuugguaagcaagcucuaaaucucugagagaugaacacugaaaauuugcaaacaguauuacucagacagucuuauaagccaauggcacaacaggguaaaaaaagaaaaaguuauugcuuuguauaaauacuuagcacuagauucaauuuauugauagcaaaaaaaaaaaaaaaaaaaaaaaaaaaaagcugagaaggaauuggguaaaauaaacccuagguucaugaaauuuaagacaaauuuauauuagcacuguacuaucaaaaucaccaugaaacagcuucaaguaccagcacugaaauaccacugaucaccuauccugcaaaauacaccaaagaggcugcaucugcguggccaucucagaggaaaagcccagaggacagacaccaacuaggcugccacacaaucaacaggauauucucuacucauccugaaaacaucaaaguuuuccugugaugauaaaaugaaaacaaacauaauaaucuauuuccaucacuuuacaacgcuaaugggaaaaaaauauucugaaaacuuaaaacaggcauaaaaaaaggcaacacuguaauagagauaggauacagauuguagagaaaaaaggaguagaagcaaaaacaggaacagaggagacacacagaagcccccaguuacaggcagaacaaggaacagagaggaagccuuagagcagggauaacaaaguaauaaagugguacucaccacacucauggccaacugaaaaaaucuaccuggaaaccaaaguucacaaaaaguuugguugguguagauguagcauuauuuucuuaucaauaacauuaauauauuauagauacccuuggcucuuucagaauguucaaucuaaauauuguuacucaguuaaauaaacacugcucaaaacauaaggccucuaacagaauucaggcaaaccaaccaucaugagcugggggaaagcacaagcaauuucuguaccuaccaucaucaagguccuguggagaaaauguucuucccucuaauucauucaugauaucauagaugaugagggauggcauuuuuauagcgcuuaaaucuacaaaaaagcaaggcaaauggguuuuuaucaagaguccacuacuauaagcacuaccaacuucacagccuaaaguuacaaacaccuccaaucuguugccuccaucuuuagccuaagaccuggcagaaagcugggcagauccaaagcccauccauccauccauccauccauccauccauccauccauccauccauccauccauccauccauccauccuuggguuaagcucaaauuucuuuggaaugggacaaaugccaacacccagagauccaaaaguaacaccuaacuaaauuauuuaggaguaccuguguucuuuuaaagucaagucagauaaggaagccaagaccaaauccaacugcaaauuuaauggauggggugguucuuagaagucacaugagcuauacauacucauuaaucccaacauuaagguaggaagauaggaaucagagauucaccugaacuacauagcaaguucaagacacuaugcuacacagccaaauaacuguguuuuaaaaaagacaacugaauacuaauagggcaauuacuuccuugcuacuucaacuguaauuuugcuacuguuaugaauggaaauguaaguaucugauaugcaggauauguggcauacgacucuccgguugagauccacugauaaacgugaaugugaauagguguucccaaaguccagacgaguaugccagauccccagagccugguggguaagcuuguggagcagaacacguguccucuagaucagcagguucucauaaccauuuaaaccaguaguucucaacccauugggucaaaaccccaugucacacaacucuuucacaggggauacauaucagauauuuacauaacaauucagaacaauaccaaaauuacaguuaugaaggagcaacaaaaguaauguuauggcuggggucacuacaacaugaagaacuuauaggguugcagcaauaggaaaguuaagaaccacugacuuaaaucaaucucuuuggcccucaaaauucuauuuuuauauauagaaaaaaauguguuaaaaaaaaaacucauucaaaaaugagucucagaauauaauguaagaccuaaccuagcacucuaaaauugcuagagagaaaccaucaaagggacaacacuucaagacagugccacaggcaaggacuuaucauggaccagagguuacccaagcugcuucugggauucccuagucccguccucccaucucaccguggaacacgggauuagaugcccacuaccuagucuggcuuuacauugguucuggaauucaauuuaaguucucaagguuuacaaagcaaacacuuagcccauugaacuaucaagccuuuuugaaacaggaucugucuuggugcuuugauaaaauaaaugcaaugacaagagcaagucaaggaaaaaagggcuaaguuggauugccccaaggugaaggaccuaccuguuucugcuaggacuguaaguguguaccuguguucuggagaucaaagucuauaguuuuuugauuguguaacaagcauuuuaaaggcuguccuaucuuccuagauccccucuauccccuuuucugagacucauauagcauuugcuggccuggaaaacaucuaacaugcuugcucugacuuaucaaauucugugauuauagacaggugccagcaggucugaaauacaugauagaggucuuuuuaagggcaacaguuaagucccauuuguaggaaaacagaauuggaaauaaucauauuaaguacaguuauguuacauucacacaaauauuacauuucucuuucaaauaacaucuagauuacagaggugcauauguucauauaugagaugugagaggagaagaggaaucacugaggaagauaacuggcaaagaguguagauggcagauuaagaaagggcacauuguggggcacuagauggcucggugucacacaagggcaacugcugccaagccugaugauggaguuugauucuuagaacccacaaaggaaagagaaugaaugguaagacuuaaugucaagauuuuaaaaauaauauaaacuacguaauuacuuauggcuacuaagcgauuauacugaguagcacaguucuaaagaccaaaagaaacccuuaauuacaacccaccuugccuauucuuuuuuguagugcaagaaugauauaguacacuugauagcccucuccaaguuuguauuuuauauugcaaucaaggguaccacuagucacaccaugucuccaaccuugauucugcuucucccuccuaagugcuggugcaggauuauaggaaggcaaccauguaggguugaauucuauuuuuaaauuauuauuuauuuuuauuucacgugcauggguauuugucugcuuaugcauguccuggaggccagaagcagcuuaggauccacugcaacuggaguuauagaugauuuuaagccaucacaugggugcugggaauugaaccugggucuuauggaagagcagucacuguuuuuucccaccucugaacucuuuuauuucuuuuuucuuccagaaaacaugguuuauguagcccuggcuguccuggaacucccucuguagguagaccaggcugcccuugaacucagagauccaccugccuccccauccugaguguucugauuaaauaaagguacucaccacuacgcccagugaauucucuguucuuaauucauauauagagcagauacuuuaacaauucuaacaacucaacagagauggucaauuuauauacaaaucaagauaauguaagguuauacauaccucuuggauaaaagaggugaauaauaugaugguauguugcaagugaggguucucaaauuaccagguagaugaaggggggaaaaaaaaaccaguaaaaacacagcuaaccaaaauaaagcugaaacacaauguuacuauuucuauuccucugaagauaguuuuagcucaucucauaagcagaugagaucaccguaaagacagcaauacuuugucauauucauacaaucagugagaagagcaaagcaccaugaagucaauuaaugcccaccuaaucuccaaguaauuacugaaguaucuacagcauguuagcacauaauuuggguuagagcaucuaaucaugcuagaaaaaugucauggaauuuaaagcuggcuaacaaagcaaucaguuuccaucaaaaucaagagagcuacagaaaaaaugucucucaaauguuaaaguaaccuuguauuuccuguagagaacaccaaguauaaggcaagcccauugcugcagacaguguccacuugguauccauggggauauagaccaagaaucccacugaugccuggcuacuauaugcugauauggugacauauuugcauauaacccacacauacccuaauguguacuucaaaacauuucuagaccaccaguaauaucugauaugccauaaaaucuaggcaaauacuucuuguauuauuuaggauugaaugaccaaaaacuguuuacaauuauuuuuuccugccauucuuaucugggguugaauucuaagauagauccaacagauacaaagggccaacagcaccugaaguuacagaugcaguaagaaaacccuaacagaaugauuugacguuaaggaugaagacacuuccugcuuuuguggcugagcccagcggccaccuauucacuucaucuucaguguggauuccuuaccuauuccaauauguuucauuucacguaguaucuguaaggcugguauccuuccaagugaguaacacuuccggagaccuuucaauauuguauuaaaagucugcagauuugguuucacuuucugugcaaccauauguuucaguagauccugggugaauccaaaacaggaaacauuuuuuaaucuaagguaauuugccaaaacuguugagaaaaguuuauucuguggcuacauguaaaacaaauuaacaaccauacucccaauuaaaaacuauaugcuuuaauaaguaaacagcccaguccacaccuuuaauccagcaccuaagagucagaaacaaaagaucucugugaguucaaagcaaguguggcucauauagcaaguuccaggcaaguaagggcugcacagugaggucuuuucuuaaagaaaaucagaaaacccccaaaccgugacuaagcacugccuugcacgggcagcauucccacccucuaggaaagccuaacacugucagggggccaaggagccucuuucucuccauccuaucauccaugcaagaagucauggugucuaucugcaaucuuccaccuaacugagauaaaacaaacaaaauaaaauaaccuaagaacuaugggacuaaaacguucuacuuuuaacuucugcccaaaauccuuucucguguuuucccuuugucaucucuggccagaauuuuaaugcauaugauaccuuuguaaccuacaacaagaacaauuacagugaacuguugcagcucuuccugaauucuugcuguauauggugacugaugaucagugcuuucuucccuccugguagauaggcucugaggagcugcuccacagaaaugcuaaguuaaccuuuacuaguaagguagcugaagguaaagaagcugcuugcuuaccaguauaucauuccauuuuuccucaaauuucucauugaguaugaauguuuuugcuucaaucaaugcauuaaagguauauacaucagcuguaagggaaaaguaacaaaacgugaggcugaaaauucaccucauaaaagcugaaaaugagauaauggucagucuuggugucuuagcuaaccucaguaaggccuuagaacuaguucuccacucccguuuuaauuaugagcacaagacaaacaaaaacacccucccaagccccaaaacaacuagagcaaaauccaaagaccucacugaaucuuaguaagagcagcaguuccccaucugugugggccaugaccucuggguucacauaucagguauuacauuacaauccaaaacaguagcaaaauugcagauaugaaguagcaaugaaaauacuuuuauggauuggaggucagcacaacaugaggaauguuauuaaaggguugcagccaucaggaagguggagaaccacugcguuagaggaagacagaggugugagggccuuaaacucaccacuaagucuguuauuuaauaacucuguguacacguucagugccugugcauaagcucggugcuggagaggaaaaagcgaacaucaucaaagucuccccaacugggaaggugagcacacaacacagaagacgccuacucuugggaagcuggcaucccagugaagcggguuucuuccaggaggcacuggcaaugccuagagacaguuucaguugucacaacugagaaugaggcagaaacaagucacucacaucuaauggguagaacuggggaagacaguacaccuggacaccuuccacacacaccggaaagcucccuacaagcucugcucuaacaugucagucucagugugggagcucggcucagucccuaagacagccuggugcucaaccaaaagcacuggcguucucauucccauaggaacuccaaaaaacccaacacccgcucacucacauaauaaaccuaaacacagacagaugcaugaauacaugcaugaaauuuaaaaacucacaaaacuuaaugaaguuuacuguucaucccuauucaaaagucugaaaugcuacuaaauucaaaaauuuuugaggacugacacaaagacaaaaucaggaucucauuuaacagguuguagacaacacaggcugacaaagauauuacguaaaaugaccacuaaguauuguaguguaugcccaggaucccaauuauucugggaagucuuguugagucugagggcaggacagacaauuucagagaugugucugaaaagggaaaaagaauuuuuuuuuccagguauuguggaauaccuguaaugaggcugggacauuuucaggaguuuaagccuuguaugcucauccauccaguuaagguuacacagagacccugucucaaaaaauauaauuuuuucauguuaugcuuauugaaaaauguaugaagcaaauagguaucuugcuuaaaacugacccccaaaauaucacauucugcauauauucgugaucccaggcauuuucuagcccuuuuagcauagggguggaacagaacaaacucaaugauacaaauaaacuucaagauacaaauaaacaaagaaagguaccuucaccaucccucggaucaucgugcaguaggagcgugcauucuucucuggcauuaaagcgaagauccucucagcauuguuuugugcucuagaaacagcagaggaaagaucaacuggaggcacagagaaaacuagugcugagugccaccacuuucuggaaauguuuugggcaauguacauaucaccucaaaauugguuaaagauccuaagcugucauagaugucagggccaugaucaggaaugacaagaaaucugccccauccaaaauaaaauuccacaagguaaccuugauccugagucuugacauauucuagcaugagcaguuuugccucucuacuagaggguaagaaaaugguaccuaccuuguauaaauguaucuguaugcugaagaccccaugauacuagcuaagaucuuacuacaaaguccaugugugugcaucuguuugagugugugcuagugcccauggaggucacaucucccugagcuggaauuacauacaagaugcugggaacagaacuuggaaccucugugagaauaggaaauucucuuaacuacugagccaucucucuaaacuagaauuucuagaauuaaugguagccuuucuuuucuauauauccaaucaaaucaaaucuuuaagaauuagggaucuacaucucaagguagcauuacuaauuaaacuauacacagaugaaaaacaacacaaaguacaaccaggccaaacccuaaauggauuucuguaugcuggcaggagguaacaaucuuauaaaacauaauagucuaagccacaagugaugcagcacacuucuuauaccagucccuggcaggaaugguccauguuugagguuggccugggcuauauaaguggaaucuuaaagaagcaacugagaaaccagguauaguggcacacacuauuaaucccagcacucaggagacacaaggaucucugugaguuuguugcaagccucuucuacauagugagcuccaggaaaaccaaaacuacagagucucugucucaugaaacaaaacaaaaaaggcaaaagguauaaaauauaauauacaaagacagauuauggaauaaaucuguaaaaugaacaaaaaaguuucuauuuuagaacauuuuaugggaucgcaacucuagaggacaauguagcauauuuuucauguacuguaaaauuccuauaacacaagauuuucauguuuaacauacuuccaaggaccagacuccaucuuggauguuugauuauuuuccucugcagcuucuuccuagaacagaugaaauaaaagguaagacaaugcuugcuugcaagcuacuuaaacaaaaaaggaaauuuaaaaaacuuaaauaucagaucaucaaaaggcaaaggaaagccccccaaauguucacaccuacagugaauuccuuuagugugaaaauuagugcacacugagaaagucaaauuuguuaccuuuguuuuaucuccagauaaucacucauuuaaaaucugaucaagcuggccucaaauucagagaacugcuuucugccucucugcugggauuaaaggugugcuagcacacucagcuaugaguagcuaggccuaauaaggagccuacaaggcagcuacuugggaggccaaggcauguggaauuuaauuuaaggcuaguccaagcaacaucuuuguuucaaaaaccaaaccaaccagccaaacaaaagaacaggguugggcauggugauguacaccuuuaaucccagcacuuggauggcagaggcaggcaaaucucaugagucuuaagucagccuggucuacagaguaaaugccaggacagccagggcacagagaaaccuuguuucauaaaacaaaacaagcaacaacaacaaaaaaauuccaaaacaaaaaaccaaccacaaaagugggggaagaagacacaguuucacaauucgguccuugccuacuauauggagggccuaggcucaucuccccccuaaauguguggaacauaagcacacugaaguucuacugagcuauaaaguugacaauuaugucauuucuaagaaaaccaguggaacuagagauuauagauuaaaaauaucagacguugcuugcuuuuucucaucuguacaaucuccuaaaacauauacgucauaaagacaacguacaaagggauaaauugggaauaugaaaaagaccacuggggcaaggaggggguaaagguggagggaguaugauaaaaaugcauuacauacaaguaugaaacugucguaacaaaacauacuauuuuguauagugcacauugauuagaagugacuggaaaacaaguucaugugucccuaucauguuuacagaaggccaccucaguauaaaaucuuuuaguacuaugacacgacacagaacccuaacccacugagaaaauauuauuuuagaaacaaaaaagccaaguuuuuaauuuuguuuaccaaguuuuccaaauguucaguuuguugaaaaggauagucagcugggggcucuuggucaccauaguaacacaauaaauccaaaagacuauuaguuguuucaagagagacugugguuccugugguugggagaaaacaaacaagcaaacaaauguucaaacacccaaagccuccugaaugaagcuuuucuauugaugguggcuuauuuccacuaccauguuaccaauuaguacauaaugaaugauuguuuucugcugauucugucacccucccccaccccaccccccauggcugguuuuguguaucaaguugacacaagcuggaguuaucacagagaaaggagcuucaguuggggaagugccuccaugagaucuaucaguaaggcauuuucucaauuagugaucaaggagggagggccaagccccuuguggguggugccaucccugaguuggcagucuuggguucuauaagaaagggagcugagcaagucaggggaagcaagccaguaaggaacaucccuccauggccucugcaucagcuccugcuuccugaccugcuugaguuuccaguccugacuuccuuuggugaugaacaccacguggaaguguaaacccuuuacucgccaacuugcuucuugggcaugauguuuugugcaggaauagaaacccuaagacacccuguaaacuauauuucugaauaaauucguuuggcauaagacucagguuguacaagaccucuugacaccagcuuuccuaucuuauuuucugauaccuuggucacuccucucuggaaccuaucacugaaggacaaccugcugguccacauccauucucaauucucuuacaccugauccacuauaauaaacacaaacaauuaucccaacuggauucaggcccucauuaaaaaugugcucagaacuacuaaaauagcuguguaauuguaauaaccuuaaaaacaaccuguuugacaggcagugguggcgcacgccagccuggucuacagagugaguuccaggacagccagggcuacgcagagaaacccugucucauuaaaaacaaacaaacaaacaaacaaaaacaacaaaaccccaaccuguuugacucccagcaccucaaaaauaaguaacaauaaaauccacaaaaacccccacuguucaaaaugagauaauucccacuucagcacucacuuuauagagagaaguaaaaaaggaaagaaaaguagaggggccuggagagauggcucaguggcuaggaacauuuguugcucuuugacagaggauccgaguucaacuuccagaacagccacaugguggcuuacaacccucacuugagucccagggacccaacacccucuucugcccuccuagaguguggggcaagcacaugcaggcaaaacauucauacaugcaaaaauauaauaaaaauuuuauuuaaaagaauguuuuccaaaaguaaauauuuuuuuaaaaacccuaaaagacucaauuuauuaagcuuaacauaagugcccaugccuguaauccuagcacucaagacacugaggcaggaguucaaggucacccuugaugaaccaguguuuaacgccugagugcugaggcuuccagcggugcccacagugguauaggugugugcagucacucaauagguuuuuacagcagguguuacuuaaacaccucagcacugaggaguucacugcagauccuuacuaacuguggcucacauucaggaagcagagguagaaccucaccaacauacuggcuggugucacccuucaguugugcgugugauagauuagaagcuacauaagcaaacucuugaaaaugaguguaagaaaguauuuuuggguucaaauaauauguucaaugauuuguccaguuuguuucucuuauguuuagcaaaauuuuuauucuaauucacuuaacagcaaaguagacuccuaaaauuuaaugauaacagcugaguuugaagagaccacgugcguauuuacaguagcauaucagucauguuaccuagaauuauauuuauuaauaaacucacccagaucuaauugaaaacacaacaggacauuaguuagaugcucagaaaagacaagaucuuugcuagacuaccaagugaggaagaacccuaucaaucaaagucccugauccccacugaacaagucuuucuuuuaaagcauuucucugcggcucaaaaaaugcucaggaguuaagagcacuggcugcucuuccauaggaccuggucugauucucagcacccacaacagugaucaaauauccaucuauggggcuggagagauggcucagugguuaagaacaccgacugcucuuccaaagguccugaguucaaaucccagcaaccacaugguggcucacaaccauccauaauaagaucugacgcccucuucuggugcaucugaagacagcuacaguguacuuagacauaauaauaaaugaaucuuauaaguacaguuaaggaagaucagaggcccacuucuggccuccccaggcaguaggcccacaaaugaugcagauauacaugcaagcaaagcacucacacauaaaauaaagaucaaguuuucucuuuuauuuggcucugccuucucacaccuaaggcuagaaacagaggccauguacuuccuuugccagugcacaggacagaagggaauaaaccugcagcucuacuucacuuauaauuucacggugaagcuaggagcagaaaaugaauuaugcauacuauaucaauuaaaucacaaacagcgccagcaagcagaguaagcauuguuugcuauuuuuacuccaagcuaacuggacuguauacaagguccccaugcugaaggagggcucugacugaaaagagucaccugcuugcaagagcuggucaaacauguccacagaagcucugacuuuucugagucugauucgcuccuccagggcagcuucgcuuacaucuucaaucugaggcucaaaguacucaggcauuaagcacuagaacaagaggagaagugaaugacuacgaacaggccaagguggcagggugacacuaggcgaggcuguucugguuccuguuuccuacaccacguaacaccuacaucuuaguacaaagcccacaacagaauauacaaguaagcgagaaaggccaguacacgucugcagccuggacagaaggcuguuuaggcaucuccuugacuugaugaaaauuuaaaaauauucaaacauaaauuuucacuccauauuuucaacuaagggccucaaccugagguugaucuaaauacuuugcuuuuacuccauuugcuaauguuucuaauguauuucaaaugagaacuccuuuacugcaaguacuaagcgaggcacuagggauucuaagaugcuuuuaaagggacugcucuaccuucaaagcacucccauucuaaugacaguuaaugcugucaacaugacagauucaaaaauagccaaaaggaccagccuccggauaugccugugaggaauuuucuaggucagguuaacggaggugaaaugugacugggaucguuucacacagguucuggacuguagauaaagagaaagugagcuaaccacuaggaugcauggcuucggcuccuuuucaauuauacugugacuagcugccuacugcucuugcuaaaauucuuucccuacuaugaugggcugcauuuccuuaaacucuaagcugacuuacaacuuuccuucauugcuugucagguauuuugucacagcaggaaaagcaauccacucagggcacagcuaauggcagagagcuuacaagagggucuauaguccaucaccaacacagaacccucgagacagagacagggcuaauuacagcacagugugcaaugacaccaccuccaaggcaggagacccaugcagcuuccagcaagcacagaagcauugccagccaaaagggggagugaugggccaacuacugagcauucuacaacugccacuguucucauauucuuacuauacaacuguacuggcuugccagucagucacauaagcugcaguaugaggaggacggcuugucugggggugaguuugggaaaggaaggagaagggagaggcugcaggcaggagcagcugccuaggauggcauuucccacugcuacaguuuaacugacugcaguggcugcuggguggacacucugcagauacuguacaauuccuguuccaaggggugucagaagaggaauguggguaagacagacaacaaugcaaauggagugcaaaaaugaccaaaacaccaagugcagacuguacaagagaaaaacggggcaaagaacccucauaaagacaauauuuauaaggaaaugccagaagccauuagaggucccugaaaaggaacugucaaagaguagaagauucacaaacaaaaaagaauuuuaaaagguuagcaaagguucucauucuaauauccugggcacuaaaauggcuaaaucugcuguggaaguaugauuuaauuuguauucauacuacaauguaaaagacacaaucuccucuccuuaccgguauaugaggcucagcuauauccuuuuggaaauauuugggauaugaauuaauaauaaacuuugcugcagucucuccagacuucuuugccaauaaaaaugaacgcuacauaagaaaaauacaaauuagcacuuacaaauaauuuagacucaaacaagacuacacccucagcaaaaauugcucccuuuuccccaggaaaaagaauacaauaauacaagaaguccccaaaacaagccaaguuacaguacuucacacaucucacuucugaguaugguacugauuucaggucauguuuuauauacaccacagacacacaugguuugcuuaaguguuaguuaagaccuuaauacuaaaaaaacaaacaacaaaaaaaacuaaacccaaaaccuuuuucagaaacaacuuaaauauuuuuugauaaaauuaagguucagagucuaccaauuugucaguauuuguaaacuuuucaauguuucuuauuuuauuuuaauaguuuagcuacuuauauauccuuacacaaaccaguaaggcuuuuaaaaauuccuagacaaguuacccaauaguacucacagacuccagagcagagguugguaugagguaaggaucaucgugaaauacauaaggugcagcuguaggauccuguggaaagggcacauucaucucuuuagauuuuugcuaaaaugucuaagcuuuaaugaucacaaguucuauaaaauaaaauuuuaauuaagacaggaaauguacacguagauauaaucaugugccugcauauauaaaaugaaaacacaugucaguaagacuuucccccaaguuggcacaacacaaagcugguaaguacaaacucucacggcuccaucuuaaaagguuuuuccuucucuuguugcuaggauagaacccagggucucagaaauuaauuaguaaucauuuuagcauugugcuaauuccucagucuauuucuuaggauaucagugugcugucaggacuaucacugucuuaaacucuaguaaaggacccaugaauuaccuacucccaccaacagcuuccugcaauaagauuuccuucacugcauagucauuaugugcccaugugcaacuuuacuugaagguuccuucuccaggggcuugagaauggcuaaccagauccagcacuugccaugcaagcacgaggcagaacucauauaaguaugggauggguaugccagcccucuaguuagcccacuaauucuagugcucagagugcagaaauaagagauucccagaauacuggcuaguuaaacuagccuuuuuaguugagcucuucguuuggcugagaccuuggcuccaaugaaucagguggacaguuguugaacaguuaguucauuugucuguaaauaggcaucugaaaugcuauucagaacuaugugugucucuuggaaacucaaacuccagcucccuaaccuauauagucaccucaccuccuguuagggcguucuauguggacuccaccuuaguccacgaugauuccaaagauuacgaguuugcacaaccaugcccagaaaaaucuguauuuugcuuuuuguuguuuguuuguuuuggucuauccuagaacucauaaugcagaucagaguggcuucaaacucagagauccuccagacucugccucccaagugcugggauuaaaggcauguucuaccacacccaucaaaagaucuauauuugaccaguguauuaccaccagcaggaaagacccaugucucagagucauauaaagacaauggcugugcacgguuauccucagaaacaagcaccuguuuuuuuuuaaaacuaauuucuaauuuauuuaauuacuucauuucaagaagcuuuuccaguaauuaaaaauuauuagugugagguggaccuggugaugcacaccuuuaaaaaauucuaacacuugggaggcagaagcaagaggaucucugugagcacaaggccagccuggucuacauaccaaauaccaggacagccagaacuauguuacagagagaacccguuucuaaaagcaaaacagcacaaacacacaacuaccaguaugcugcaaaaaacuacgugggcaucacauccuaaccaguccuaugcuggucacuucaaaaccugcuuucccauuuuccaaaggagagauuggauuaguuuucaagaaaauuucgagcuacacaacaguuuaauuauggugaauaaagagcuauaacacugaauguguuauuaacccuuaaaauccuacuuacccuguuuacuguggaugcaagugccugaagaacagccacuuuaucccuagaauaagaaccacaagucaaccuuuaucaagucauucuacucucagaagacacugggcauaaaagaagauggacacuucagcucucaccuagggccaggacuuauuucucaaauccacuacaacaggaauaggugagaagcaggcaugccugcaaauccuauaaucucagaagagggaggaagaggcuggacugaaguuuugagaccagcuggacuucagagcuagacucuaacucaauaaucaagugcuagagaauggagcuuagaguucuugugggguagacgcucagcaccacaagccugguucuccugacagauacacauuccuccuucccuuugcuuccuauguacuuaacuggucucuauuaccauucacuacccaggaaaauugacuuccucucucuccccauaaaucuaccuugcuaacuuccuucaacccacuuagagcaccucuggccuccugcuaacuauccaaacuaacggcucuuaccucuacccuggaacaacuaaagcaaagccacuacagcgccucgcuuguauccuuacuauggugccugaugucauauugugauccuacccaacaugauuuucuuauccccagaaaaaaaauuucuuuagggacagggugucaugcagucuaggcuggccugaaacucccugugcugcugagcauggccuuagacuucugguccucuugccuccccauccuuagugauaggacaggcacgugccacgacacccaguuucaagcacuaucaagaacugaacccaaggcuucgauuguucaaggcaaguucauuuucaacccuccauuuccaggaacuuaaguagauuaaaacaaaauaaaacaaaacaacaaaaacaaucaaaaccaacuuggugucacuuggaacguguuuacauggguuucuaugauccacgugacuaugcagauguaacuaaugccuuuaaauguuauagauagcacguuaucuagacuguuucaaccugcucuagagcucuuuggguacauaugcaaguauuccuucugcguggcuagccaguaagaugcagauacuuucuuaaauucugacccuauuucugcccaaauuauuguucaaauuuguucuuccaucaacaaauacuucugagcacacacuuucacucuuugcuaauauggaagauuuuaaauuguguuucuuguauaaauccuagguaggcugcuugcccucuuuaaaaugaccucauaaucuacacuaacccccuucacugucuuuaucaugucauccucauguaaggaaauccacaaaaaacuaaaaucuauucacguuuucuauggcauugugagauguggaagaucacagcuuuaaaggacaaauuuguagucugaaacucuaccaagccuacaaaccagaggacccuacaccauuucuuuuuauccacccuacaccauuucuuuuuugggagguggggugggggugggaaaggcaggacuguacacaauaaaacguaagauauauguaaacaaaguaagcugcaguccacacaaaauuugacauuuuuaaaauauaguuuucaaguuacuuuuuuuccuuuagccucucucccccagcuacacagaaaaauaaaagcacucguagcuuauaaacugaauuuuuaaaggccuugacuugcuaaccguuucuuauuuccuaacauuuuccacaggccugucugaacuaucaccauaaucaacaaucauauuacauccugccuuccugcacucuuuaccuaauacaucucacaagaacuaccaauaggaaaaagggaaauuuuaaauaaguggcuggcuggccugggacucgugacaauccuccaacuucugcccugagugcuaggacuacaggaguaugucacuacaaaacaacacucaauauauaccuaaauucugucuaucuauacggguaaaauugcauacauauaggacuauaagauacaacacaggcaggugacaacuagauuguagcacauuguaaauacucuuccuguugcauuucuugucguuuuucuggauauagaggugugcaaaggggcguacgcuggaaugcuguauucacagguaacccagucccuacucuuagcuccagugcucucucaucccuauucuuguuucuaaagacagggcauuacuguaugaacucaguagguacacuaguccuacuaugcagagaucccugugccucugccuccugagacuaaaggaguaugguaccauggucagccacuguuccuauucuuaugcagggaaacaaaugaaucuaaucauauuuauacaaugauaucaaauagccacuccaaaugaaacaaaaguacaccuaauaguucacuuauaaauuaaauguauaguuuacacauaaaauuauauaacaagacuuaaaaaauaacagcuaacaugguauuugucuaugugcuaggcacuauuuaaauccuuauguuuuauuuacaguaaauacccaaucaccugguaagugaauagcaaaauacucaccauguuuucuuuuuuggaaugacuauuucuucaaucccuuauguagaaaaaaaaauaaaaauaaacaauuuucuaacaacacaaagaaauacaaugucuuuucauuuuuaaaaacuucuauuuccauaguuuuaaaaauaccuguuauaucugauccuucaaccuuugggagggauucaguuccagcauaaaaucugcauuaaaaacaaaacaacaaaaaucccacuguuagcacugcucccugauggccucagcucagcuccuaccgcuagcucugcugacucagcuccacccgcaugcacacauucugagccacauuuauagaggcauuuagauguaguguaaacuuguaacccaguuuuauuuauuuuuuuguauugguccaaagacaucguaugagcuaauuauccacucuacaacugacuuaaaaccaccuccuauuuccaccaggccacugcaugaaggauguacaaagaaauuacauaaguauuugcaacaccaccagauggaaagaauggggucagacguuuuaaggcuuucugcuuuuacuaaagucuuagcuuauucuuagcugaagguucucauaacguucaguccauacugguaauauuagccugcccuuuauuugugaaagaucuguuacuuugcccuuucuuuuuugcaggguuaaaaugaauaaggggggggggugauaaagaaauuuguguaggggcuuguagcggcacucacggaaauguaaacuucacgagaacagggcccuaguuuaaaggguaauuuuggcuauacauaguauugcaaccaaccaauaaaaauuuuccgaaagaauucccgaacucgcagaucuaaagaucacuaaauacgacgcuaccucguguuacccuugagagggccgggccucgaccauacaaaugccuuugcaucuuaccuacuuucacgacucucagggaaaugcaagaccaaaaugacucugggucuucuuaccugcaacagaccuucgguucacacacacccgucccccgaguggucugcagcaagacaagcccgcugcgaaaggacaggcggcgagcugcaaccgccgccgccgccaucuuuggacucuucgcggagcacgucgg

SEQ ID NO: 3065 - RNA, 28276 nt, Mus musculus
ccgacgugcuccgcgaagaguccaaagauggcggcggcggcgguugcagcucgccgccuguccuuucgcagcgggcuugucuugcugcagaccacucgggggacgggugugugugaaccgaaggucuguugcagguaagaagacccagagucauuuuggucuugcauuucccugagagucgugaaaguagguaagaugcaaaggcauuuguauggucgaggcccggcccucucaaggguaacacgagguagcgucguauuuagugaucuuuagaucugcgaguucgggaauucuuucggaaaauuuuuauugguugguugcaauacuauguauagccaaaauuacccuuuaaacuagggcccuguucucgugaaguuuacauuuccgugagugccgcuacaagccccuacacaaauuucuuuaucaccccccccccuuauucauuuuaacccugcaaaaaagaaagggcaaaguaacagaucuuucacaaauaaagggcaggcuaauauuaccaguauggacugaacguuaugagaaccuucagcuaagaauaagcuaagacuuuaguaaaagcagaaagccuuaaaacgucugaccccauucuuuccaucuggugguguugcaaauacuuauguaauuucuuuguacauccuucaugcaguggccugguggaaauaggaggugguuuuaagucaguuguagaguggauaauuagcucauacgaugucuuuggaccaauacaaaaaaauaaauaaaacuggguuacaaguuuacacuacaucuaaaugccucuauaaauguggcucagaaugugugcaugcggguggagcugagucagcagagcuagcgguaggagcugagcugaggccaucagggagcagugcuaacagugggauuuuuguuguuuuguuuuuaaugcagauuuuaugcuggaacugaaucccucccaaagguugaaggaucagauauaacagguauuuuuaaaacuauggaaauagaaguuuuuaaaaaugaaaagacauuguauuucuuuguguuguuagaaaauuguuuauuuuuauuuuuuuuucuacauaagggauugaagaaauagucauuccaaaaaagaaaacauggugaguauuuugcuauucacuuaccaggugauuggguauuuacuguaaauaaaacauaaggauuuaaauagugccuagcacauagacaaauaccauguuagcuguuauuuuuuaagucuuguuauauaauuuuauguguaaacuauacauuuaauuuauaagugaacuauuagguguacuuuuguuucauuuggaguggcuauuugauaucauuguauaaauaugauuagauucauuuguuucccugcauaagaauaggaacaguggcugaccaugguaccauacuccuuuagucucaggaggcagaggcacagggaucucugcauaguaggacuaguguaccuacugaguucauacaguaaugcccugucuuuagaaacaagaauagggaugagagagcacuggagcuaagaguagggacuggguuaccugugaauacagcauuccagcguacgccccuuugcacaccucuauauccagaaaaacgacaagaaaugcaacaggaagaguauuuacaaugugcuacaaucuaguugucaccugccuguguuguaucuuauaguccuauauguaugcaauuuuacccguauagauagacagaauuuagguauauauugaguguuguuuuguagugacauacuccuguaguccuagcacucagggcagaaguuggaggauugucacgagucccaggccagccagccacuuauuuaaaauuucccuuuuuccuauugguaguucuugugagauguauuagguaaagagugcaggaaggcaggauguaauaugauuguugauuauggugauaguucagacaggccuguggaaaauguuaggaaauaagaaacgguuagcaagucaaggccuuuaaaaauucaguuuauaagcuacgagugcuuuuauuuuucuguguagcugggggagagaggcuaaaggaaaaaaaguaacuugaaaacuauauuuuaaaaaugucaaauuuuguguggacugcagcuuacuuuguuuacauauaucuuacguuuuauuguguacaguccugccuuucccacccccaccccaccucccaaaaaagaaaugguguaggguggauaaaaagaaaugguguaggguccucugguuuguaggcuugguagaguuucagacuacaaauuuguccuuuaaagcugugaucuuccacaucucacaaugccauagaaaacgugaauagauuuuaguuuuuuguggauuuccuuacaugaggaugacaugauaaagacagugaaggggguuaguguagauuaugaggucauuuuaaagagggcaagcagccuaccuaggauuuauacaagaaacacaauuuaaaaucuuccauauuagcaaagagugaaagugugugcucagaaguauuuguugauggaagaacaaauuugaacaauaauuugggcagaaauagggucagaauuuaagaaaguaucugcaucuuacuggcuagccacgcagaaggaauacuugcauauguacccaaagagcucuagagcagguugaaacagucuagauaacgugcuaucuauaacauuuaaaggcauuaguuacaucugcauagucacguggaucauagaaacccauguaaacacguuccaagugacaccaaguugguuuugauuguuuuuguuguuuuguuuuauuuuguuuuaaucuacuuaaguuccuggaaauggaggguugaaaaugaacuugccuugaacaaucgaagccuuggguucaguucuugauagugcuugaaacugggugucguggcacgugccuguccuaucacuaaggauggggaggcaagaggaccagaagucuaaggccaugcucagcagcacagggaguuucaggccagccuagacugcaugacacccugucccuaaagaaauuuuuuuucuggggauaagaaaaucauguuggguaggaucacaauaugacaucaggcaccauaguaaggauacaagcgaggcgcuguaguggcuuugcuuuaguuguuccaggguagagguaagagccguuaguuuggauaguuagcaggaggccagaggugcucuaaguggguugaaggaaguuagcaagguagauuuauggggagagagaggaagucaauuuuccuggguagugaaugguaauagagaccaguuaaguacauaggaagcaaagggaaggaggaauguguaucugucaggagaaccaggcuuguggugcugagcgucuaccccacaagaacucuaagcuccauucucuagcacuugauuauugaguuagagucuagcucugaaguccagcuggucucaaaacuucaguccagccucuuccucccucuucugagauuauaggauuugcaggcaugccugcuucucaccuauuccuguuguaguggauuugagaaauaaguccuggcccuaggugagagcugaaguguccaucuucuuuuaugcccagugucuucugagaguagaaugacuugauaaagguugacuugugguucuuauucuagggauaaaguggcuguucuucaggcacuugcauccacaguaaacaggguaaguaggauuuuaaggguuaauaacacauucaguguuauagcucuuuauucaccauaauuaaacuguuguguagcucgaaauuuucuugaaaacuaauccaaucucuccuuuggaaaaugggaaagcagguuuugaagugaccagcauaggacugguuaggaugugaugcccacguaguuuuuugcagcauacugguaguuguguguuugugcuguuuugcuuuuagaaacggguucucucuguaacauaguucuggcuguccugguauuugguauguagaccaggcuggccuugugcucacagagauccucuugcuucugccucccaaguguuagaauuuuuuaaaggugugcaucaccagguccaccucacacuaauaauuuuuaauuacuggaaaagcuucuugaaaugaaguaauuaaauaaauuagaaauuaguuuuaaaaaaaaacaggugcuuguuucugaggauaaccgugcacagccauugucuuuauaugacucugagacaugggucuuuccugcuggugguaauacacuggucaaauauagaucuuuugaugggugugguagaacaugccuuuaaucccagcacuugggaggcagagucuggaggaucucugaguuugaagccacucugaucugcauuaugaguucuaggauagaccaaaacaaacaaacaacaaaaagcaaaauacagauuuuucugggcaugguugugcaaacucguaaucuuuggaaucaucguggacuaagguggaguccacauagaacgcccuaacaggaggugaggugacuauauagguuagggagcuggaguuugaguuuccaagagacacacauaguucugaauagcauuucagaugccuauuuacagacaaaugaacuaacuguucaacaacuguccaccugauucauuggagccaaggucucagccaaacgaagagcucaacuaaaaaggcuaguuuaacuagccaguauucugggaaucucuuauuucugcacucugagcacuagaauuagugggcuaacuagagggcuggcauacccaucccauacuuauaugaguucugccucgugcuugcauggcaagugcuggaucugguuagccauucucaagccccuggagaaggaaccuucaaguaaaguugcacaugggcacauaaugacuaugcagugaaggaaaucuuauugcaggaagcuguuggugggaguagguaauucauggguccuuuacuagaguuuaagacagugauaguccugacagcacacugauauccuaagaaauagacugaggaauuagcacaaugcuaaaaugauuacuaauuaauuucugagacccuggguucuauccuagcaacaagagaaggaaaaaccuuuuaagauggagccgugagaguuuguacuuaccagcuuuguguugugccaacuugggggaaagucuuacugacauguguuuucauuuuauauaugcaggcacaugauuauaucuacguguacauuuccugucuuaauuaaaauuuuauuuuauagaacuugugaucauuaaagcuuagacauuuuagcaaaaaucuaaagagaugaaugugcccuuuccacaggauccuacagcugcaccuuauguauuucacgaugauccuuaccucauaccaaccucugcucuggagucugugaguacuauuggguaacuugucuaggaauuuuuaaaagccuuacugguuuguguaaggauauauaaguagcuaaacuauuaaaauaaaauaagaaacauugaaaaguuuacaaauacugacaaauugguagacucugaaccuuaauuuuaucaaaaaauauuuaaguuguuucugaaaaagguuuuggguuuaguuuuuuuuguuguuuguuuuuuuaguauuaaggucuuaacuaacacuuaagcaaaccaugugugucugugguguauauaaaacaugaccugaaaucaguaccauacucagaagugagaugugugaaguacuguaacuuggcuuguuuuggggacuucuuguauuauuguauucuuuuuccuggggaaaagggagcaauuuuugcugaggguguagucuuguuugagucuaaauuauuuguaagugcuaauuuguauuuuucuuauguagcguucauuuuuauuggcaaagaagucuggagagacugcagcaaaguuuauuauuaauucauaucccaaauauuuccaaaaggauauagcugagccucauauaccgguaaggagaggagauugugucuuuuacauuguaguaugaauacaaauuaaaucauacuuccacagcagauuuagccauuuuagugcccaggauauuagaaugagaaccuuugcuaaccuuuuaaaauucuuuuuuguuugugaaucuucuacucuuugacaguuccuuuucagggaccucuaauggcuucuggcauuuccuuauaaauauugucuuuaugaggguucuuugccccguuuuucucuuguacagucugcacuugguguuuuggucauuuuugcacuccauuugcauuguugucugucuuacccacauuccucuucugacaccccuuggaacaggaauuguacaguaucugcagaguguccacccagcagccacugcagucaguuaaacuguagcagugggaaaugccauccuaggcagcugcuccugccugcagccucucccuucuccuuccuuucccaaacucacccccagacaagccguccuccucauacugcagcuuaugugacugacuggcaagccaguacaguuguauaguaagaauaugagaacaguggcaguuguagaaugcucaguaguuggcccaucacucccccuuuuggcuggcaaugcuucugugcuugcuggaagcugcaugggucuccugccuuggagguggugucauugcacacugugcuguaauuagcccugucucugucucgaggguucuguguuggugauggacuauagacccucuuguaagcucucugccauuagcugugcccugaguggauugcuuuuccugcugugacaaaauaccugacaagcaaugaaggaaaguuguaagucagcuuagaguuuaaggaaaugcagcccaucauaguagggaaagaauuuuagcaagagcaguaggcagcuagucacaguauaauugaaaaggagccgaagccaugcauccuagugguuagcucacuuucucuuuaucuacaguccagaaccugugugaaacgaucccagucacauuucaccuccguuaaccugaccuagaaaauuccucacaggcauauccggaggcugguccuuuuggcuauuuuugaaucugucauguugacagcauuaacugucauuagaaugggagugcuuugaagguagagcagucccuuuaaaagcaucuuagaaucccuagugccucgcuuaguacuugcaguaaaggaguucucauuugaaauacauuagaaacauuagcaaauggaguaaaagcaaaguauuuagaucaaccucagguugaggcccuuaguugaaaauauggagugaaaauuuauguuugaauauuuuuaaauuuucaucaagucaaggagaugccuaaacagccuucuguccaggcugcagacguguacuggccuuucucgcuuacuuguauauucuguugugggcuuuguacuaagauguagguguuacgugguguaggaaacaggaaccagaacagccucgccuagugucacccugccaccuuggccuguucguagucauucacuucuccucuuguucuagugcuuaaugccugaguacuuugagccucagauugaagauguaagcgaagcugcccuggaggagcgaaucagacucagaaaagucagagcuucuguggacauguuugaccagcucuugcaagcaggugacucuuuucagucagagcccuccuucagcauggggaccuuguauacaguccaguuagcuuggaguaaaaauagcaaacaaugcuuacucugcuugcuggcgcuguuugugauuuaauugauauaguaugcauaauucauuuucugcuccuagcuucaccgugaaauuauaagugaaguagagcugcagguuuauucccuucuguccugugcacuggcaaaggaaguacauggccucuguuucuagccuuaggugugagaaggcagagccaaauaaaagagaaaacuugaucuuuauuuuaugugugagugcuuugcuugcauguauaucugcaucauuugugggccuacugccuggggaggccagaagugggccucugaucuuccuuaacuguacuuauaagauucauuuauuauuaugucuaaguacacuguagcugucuucagaugcaccagaagagggcgucagaucuuauuauggaugguugugagccaccaugugguugcugggauuugaacucaggaccuuuggaagagcagucgguguucuuaaccacugagccaucucuccagccccauagauggauauuugaucacuguugugggugcugagaaucagaccagguccuauggaagagcagccagugcucuuaacuccugagcauuuuuugagccgcagagaaaugcuuuaaaagaaagacuuguucaguggggaucagggacuuugauugauaggguucuuccucacuugguagucuagcaaagaucuugucuuuucugagcaucuaacuaauguccuguuguguuuucaauuagaucugggugaguuuauuaauaaauauaauucuagguaacaugacugauaugcuacuguaaauacgcacguggucucuucaaacucagcuguuaucauuaaauuuuaggagucuacuuugcuguuaagugaauuagaauaaaaauuuugcuaaacauaagagaaacaaacuggacaaaucauugaacauauuauuugaacccaaaaauacuuucuuacacucauuuucaagaguuugcuuauguagcuucuaaucuaucacacgcacaacugaagggugacaccagccaguauguuggugagguucuaccucugcuuccugaaugugagccacaguuaguaaggaucugcagugaacuccucagugcugagguguuuaaguaacaccugcuguaaaaaccuauugagugacugcacacaccuauaccacugugggcaccgcuggaagccucagcacucaggcguuaaacacugguucaucaagggugaccuugaacuccugccucagugucuugagugcuaggauuacaggcaugggcacuuauguuaagcuuaauaaauugagucuuuuaggguuuuuaaaaaaauauuuacuuuuggaaaacauucuuuuaaauaaaauuuuuauuauauuuuugcauguaugaauguuuugccugcaugugcuugccccacacucuaggagggcagaagaggguguugggucccugggacucaagugaggguuguaagccaccauguggcuguucuggaaguugaacucggauccucugucaaagagcaacaaauguuccuagccacugagccaucucuccaggccccucuacuuuucuuuccuuuuuuacuucucucuauaaagugagugcugaagugggaauuaucucauuuugaacaguggggguuuuuguggauuuuauuguuacuuauuuuugaggugcugggagucaaacagguugggguuuuguuguuuuuguuuguuuguuuguuuguuuuuaaugagacaggguuucucugcguagcccuggcuguccuggaacucacucuguagaccaggcuggcgugcgccaccacugccugucaaacagguuguuuuuaagguuauuacaauuacacagcuauuuuaguaguucugagcacauuuuuaaugagggccugaauccaguugggauaauuguuuguguuuauuauaguggaucagguguaagagaauugagaauggauguggaccagcagguuguccuucagugauagguuccagagaggagugaccaagguaucagaaaauaagauaggaaagcuggugucaagaggucuuguacaaccugagucuuaugccaaacgaauuuauucagaaauauaguuuacagggugucuuaggguuucuauuccugcacaaaacaucaugcccaagaagcaaguuggcgaguaaaggguuuacacuuccacgugguguucaucaccaaaggaagucaggacuggaaacucaagcaggucaggaagcaggagcugaugcagaggccauggagggauguuccuuacuggcuugcuuccccugacuugcucagcucccuuucuuauagaacccaagacugccaacucagggauggcaccacccacaaggggcuuggcccucccuccuugaucacuaauugagaaaaugccuuacugauagaucucauggaggcacuuccccaacugaagcuccuuucucugugauaacuccagcuugugucaacuugauacacaaaaccagccaugggggguggggugggggagggugacagaaucagcagaaaacaaucauucauuauguacuaauugguaacaugguaguggaaauaagccaccaucaauagaaaagcuucauucaggaggcuuuggguguuugaacauuuguuugcuuguuuguuuucucccaaccacaggaaccacagucucucuugaaacaacuaauagucuuuuggauuuauuguguuacuauggugaccaagagcccccagcugacuauccuuuucaacaaacugaacauuuggaaaacuugguaaacaaaauuaaaaacuuggcuuuuuuguuucuaaaauaauauuuucucaguggguuaggguucugugucgugucauaguacuaaaagauuuuauacugagguggccuucuguaaacaugauagggacacaugaacuuguuuuccagucacuucuaaucaaugugcacuauacaaaauaguauguuuuguuacgacaguuucauacuuguauguaaugcauuuuuaucauacucccuccaccuuuacccccuccuugccccaguggucuuuuucauauucccaauuuaucccuuuguacguugucuuuaugacguauauguuuuaggagauuguacagaugagaaaaagcaagcaacgucugauauuuuuaaucuauaaucucuaguuccacugguuuucuuagaaaugacauaauugucaacuuuauagcucaguagaacuucagugugcuuauguuccacacauuuaggggggagaugagccuaggcccuccauauaguaggcaaggaccgaauugugaaacugugucuucuucccccacuuuugugguugguuuuuuguuuuggaauuuuuuuguuguuguugcuuguuuuguuuuaugaaacaagguuucucugugcccuggcuguccuggcauuuacucuguagaccaggcugacuuaagacucaugagauuugccugccucugccauccaagugcugggauuaaagguguacaucaccaugcccaacccuguucuuuuguuuggcugguugguuugguuuuugaaacaaagauguugcuuggacuagccuuaaauuaaauuccacaugccuuggccucccaaguagcugccuuguaggcuccuuauuaggccuagcuacucauagcugagugugcuagcacaccuuuaaucccagcagagaggcagaaagcaguucucugaauuugaggccagcuugaucagauuuuaaaugagugauuaucuggagauaaaacaaagguaacaaauuugacuuucucagugugcacuaauuuucacacuaaaggaauucacuguaggugugaacauuuggggggcuuuccuuugccuuuugaugaucugauauuuaaguuuuuuaaauuuccuuuuuuguuuaaguagcuugcaagcaagcauugucuuaccuuuuauuucaucuguucuaggaagaagcugcagaggaaaauaaucaaacauccaagauggagucugguccuuggaaguauguuaaacaugaaaaucuuguguuauaggaauuuuacaguacaugaaaaauaugcuacauuguccucuagaguugcgaucccauaaaauguucuaaaauagaaacuuuuuuguucauuuuacagauuuauuccauaaucugucuuuguauauuauauuuuauaccuuuugccuuuuuuguuuuguuucaugagacagagacucuguaguuuugguuuuccuggagcucacuauguagaagaggcuugcaacaaacucacagagauccuugugucuccugagugcugggauuaauagugugugccacuauaccugguuucucaguugcuucuuuaagauuccacuuauauagcccaggccaaccucaaacauggaccauuccugccagggacugguauaagaagugugcugcaucacuuguggcuuagacuauuauguuuuauaagauuguuaccuccugccagcauacagaaauccauuuaggguuuggccugguuguacuuuguguuguuuuucaucuguguauaguuuaauuaguaaugcuaccuugagauguagaucccuaauucuuaaagauuugauuugauuggauauauagaaaagaaaggcuaccauuaauucuagaaauucuaguuuagagagauggcucaguaguuaagagaauuuccuauucucacagagguuccaaguucuguucccagcaucuuguauguaauuccagcucagggagaugugaccuccaugggcacuagcacacacucaaacagaugcacacacauggacuuuguaguaagaucuuagcuaguaucauggggucuucagcauacagauacauuuauacaagguagguaccauuuucuuacccucuaguagagaggcaaaacugcucaugcuagaauaugucaagacucaggaucaagguuaccuuguggaauuuuauuuuggauggggcagauuucuugucauuccugaucauggcccugacaucuaugacagcuuaggaucuuuaaccaauuuugaggugauauguacauugcccaaaacauuuccagaaagugguggcacucagcacuaguuuucucugugccuccaguugaucuuuccucugcuguuucuagagcacaaaacaaugcugagaggaucuucgcuuuaaugccagagaagaaugcacgcuccuacugcacgaugauccgagggauggugaagguaccuuucuuuguuuauuuguaucuugaaguuuauuuguaucauugaguuuguucuguuccaccccuaugcuaaaagggcuagaaaaugccugggaucacgaauauaugcagaaugugauauuuugggggucaguuuuaagcaagauaccuauuugcuucauacauuuuucaauaagcauaacaugaaaaaauuauauuuuuugagacagggucucuguguaaccuuaacuggauggaugagcauacaaggcuuaaacuccugaaaaugucccagccucauuacagguauuccacaauaccuggaaaaaaaaauucuuuuucccuuuucagacacaucucugaaauugucuguccugcccucagacucaacaagacuucccagaauaauugggauccugggcauacacuacaauacuuaguggucauuuuacguaauaucuuugucagccuguguugucuacaaccuguuaaaugagauccugauuuugucuuugugucaguccucaaaaauuuuugaauuuaguagcauuucagacuuuugaauagggaugaacaguaaacuucauuaaguuuugugaguuuuuaaauuucaugcauguauucaugcaucugucuguguuuagguuuauuaugugagugagcggguguuggguuuuuuggaguuccuaugggaaugagaacgccagugcuuuugguugagcaccaggcugucuuagggacugagccgagcucccacacugagacugacauguuagagcagagcuuguagggagcuuuccgguguguguggaagguguccagguguacugucuuccccaguucuacccauuagaugugagugacuuguuucugccucauucucaguugugacaacugaaacugucucuaggcauugccagugccuccuggaagaaacccgcuucacugggaugccagcuucccaagaguaggcgucuucuguguugugugcucaccuucccaguuggggagacuuugaugauguucgcuuuuuccucuccagcaccgagcuuaugcacaggcacugaacguguacacagaguuauuaaauaacagacuuaguggugaguuuaaggcccucacaccucugucuuccucuaacgcagugguucuccaccuuccugauggcugcaacccuuuaauaacauuccucauguugugcugaccuccaauccauaaaaguauuuucauugcuacuucauaucugcaauuuugcuacuguuuuggauuguaauguaauaccugauaugugaacccagaggucauggcccacacagauggggaacugcugcucuuacuaagauucagugaggucuuuggauuuugcucuaguuguuuuggggcuugggaggguguuuuuguuugucuugugcucauaauuaaaacgggaguggagaacuaguucuaaggccuuacugagguuagcuaagacaccaagacugaccauuaucucauuuucagcuuuuaugaggugaauuuucagccucacguuuuguuacuuuucccuuacagcugauguauauaccuuuaaugcauugauugaagcaaaaacauucauacucaaugagaaauuugaggaaaaauggaaugauauacugguaagcaagcagcuucuuuaccuucagcuaccuuacuaguaaagguuaacuuagcauuucuguggagcagcuccucagagccuaucuaccaggagggaagaaagcacugaucaucagucaccauauacagcaagaauucaggaagagcugcaacaguucacuguaauuguucuuguuguagguuacaaagguaucauaugcauuaaaauucuggccagagaugacaaagggaaaacacgagaaaggauuuugggcagaaguuaaaaguagaacguuuuagucccauaguucuuagguuauuuuauuuuguuuguuuuaucucaguuagguggaagauugcagauagacaccaugacuucuugcauggaugauaggauggagagaaagaggcuccuuggcccccugacaguguuaggcuuuccuagagggugggaaugcugcccgugcaaggcagugcuuagucacgguuuggggguuuucugauuuucuuuaagaaaagaccucacugugcagcccuuacuugccuggaacuugcuauaugagccacacuugcuuugaacucacagagaucuuuuguuucugacucuuaggugcuggauuaaagguguggacugggcuguuuacuuauuaaagcauauaguuuuuaauugggaguaugguuguuaauuuguuuuacauguagccacagaauaaacuuuucucaacaguuuuggcaaauuaccuuagauuaaaaaauguuuccuguuuuggauucacccaggaucuacugaaacauaugguugcacagaaagugaaaccaaaucugcagacuuuuaauacaauauugaaaggucuccggaaguguuacucacuuggaaggauaccagccuuacagauacuacgugaaaugaaacauauuggaauagguaaggaauccacacugaagaugaagugaauagguggccgcugggcucagccacaaaagcaggaagugucuucauccuuaacgucaaaucauucuguuaggguuuucuuacugcaucuguaacuucaggugcuguuggcccuuuguaucuguuggaucuaucuuagaauucaaccccagauaagaauggcaggaaaaaauaauuguaaacaguuuuuggucauucaauccuaaauaauacaagaaguauuugccuagauuuuauggcauaucagauauuacugguggucuagaaauguuuugaaguacacauuaggguauguguggguuauaugcaaauaugucaccauaucagcauauaguagccaggcaucagugggauucuuggucuauauccccauggauaccaaguggacacugucugcagcaaugggcuugccuuauacuugguguucucuacaggaaauacaagguuacuuuaacauuugagagacauuuuuucuguagcucucuugauuuugauggaaacugauugcuuuguuagccagcuuuaaauuccaugacauuuuucuagcaugauuagaugcucuaacccaaauuaugugcuaacaugcuguagauacuucaguaauuacuuggagauuaggugggcauuaauugacuucauggugcuuugcucuucucacugauuguaugaauaugacaaaguauugcugucuuuacggugaucucaucugcuuaugagaugagcuaaaacuaucuucagaggaauagaaauaguaacauuguguuucagcuuuauuuugguuagcuguguuuuuacugguuuuuuuuuccccccuucaucuaccugguaauuugagaacccucacuugcaacauaccaucauauuauucaccucuuuuauccaagagguauguauaaccuuacauuaucuugauuuguauauaaauugaccaucucuguugaguuguuagaauuguuaaaguaucugcucuauauaugaauuaagaacagagaauucacugggcguaguggugaguaccuuuauuuaaucagaacacucaggauggggaggcagguggaucucugaguucaagggcagccuggucuaccuacagagggaguuccaggacagccagggcuacauaaaccauguuuucuggaagaaaaaagaaauaaaagaguucagaggugggaaaaaacagugacugcucuuccauaagacccagguucaauucccagcacccaugugauggcuuaaaaucaucuauaacuccaguugcaguggauccuaagcugcuucuggccuccaggacaugcauaagcagacaaauacccaugcacgugaaauaaaaauaaauaauaauuuaaaaauagaauucaacccuacaugguugccuuccuauaauccugcaccagcacuuaggagggagaagcagaaucaagguuggagacauggugugacuagugguacccuugauugcaauauaaaauacaaacuuggagagggcuaucaaguguacuauaucauucuugcacuacaaaaaagaauaggcaagguggguuguaauuaaggguuucuuuuggucuuuagaacugugcuacucaguauaaucgcuuaguagccauaaguaauuacguaguuuauauuauuuuuaaaaucuugacauuaagucuuaccauucauucucuuuccuuuguggguucuaagaaucaaacuccaucaucaggcuuggcagcaguugcccuugugugacaccgagccaucuagugccccacaaugugcccuuucuuaaucugccaucuacacucuuugccaguuaucuuccucagugauuccucuucuccucucacaucucauauaugaacauaugcaccucuguaaucuagauguuauuugaaagagaaauguaauauuugugugaauguaacauaacuguacuuaauaugauuauuuccaauucuguuuuccuacaaaugggacuuaacuguugcccuuaaaaagaccucuaucauguauuucagaccugcuggcaccugucuauaaucacagaauuugauaagucagagcaagcauguuagauguuuuccaggccagcaaaugcuauaugagucucagaaaaggggauagaggggaucuaggaagauaggacagccuuuaaaaugcuuguuacacaaucaaaaaacuauagacuuugaucuccagaacacagguacacacuuacaguccuagcagaaacagguagguccuucaccuuggggcaauccaacuuagcccuuuuuuccuugacuugcucuugucauugcauuuauuuuaucaaagcaccaagacagauccuguuucaaaaaggcuugauaguucaaugggcuaaguguuugcuuuguaaaccuugagaacuuaaauugaauuccagaaccaauguaaagccagacuagguagugggcaucuaaucccguguuccacggugagaugggaggacgggacuagggaaucccagaagcagcuuggguaaccucugguccaugauaaguccuugccuguggcacugucuugaaguguugucccuuugaugguuucucucuagcaauuuuagagugcuagguuaggucuuacauuauauucugagacucauuuuugaaugaguuuuuuuuuuaacacauuuuuuucuauauauaaaaauagaauuuugagggccaaagagauugauuuaagucagugguucuuaacuuuccuauugcugcaacccuauaaguucuucauguuguagugaccccagccauaacauuacuuuuguugcuccuucauaacuguaauuuugguauuguucugaauuguuauguaaauaucugauauguauccccugugaaagaguugugugacaugggguuuugacccaauggguugagaacuacugguuuaaaugguuaugagaaccugcugaucuagaggacacguguucugcuccacaagcuuacccaccaggcucuggggaucuggcauacucgucuggacuuugggaacaccuauucacauucacguuuaucaguggaucucaaccggagagucguaugccacauauccugcauaucagauacuuacauuuccauucauaacaguagcaaaauuacaguugaaguagcaaggaaguaauugcccuauuaguauucaguugucuuuuuuaaaacacaguuauuuggcuguguagcauagugucuugaacuugcuauguaguucaggugaaucucugauuccuaucuuccuaccuuaauguugggauuaaugaguauguauagcucaugugacuucuaagaaccaccccauccauuaaauuugcaguuggauuuggucuuggcuuccuuaucugacuugacuuuaaaagaacacagguacuccuaaauaauuuaguuagguguuacuuuuggaucucuggguguuggcauuugucccauuccaaagaaauuugagcuuaacccaaggauggauggauggauggauggauggauggauggauggauggauggauggauggauggauggauggaugggcuuuggaucugcccagcuuucugccaggucuuaggcuaaagauggaggcaacagauuggagguguuuguaacuuuaggcugugaaguugguagugcuuauaguaguggacucuugauaaaaacccauuugccuugcuuuuuuguagauuuaagcgcuauaaaaaugccaucccucaucaucuaugauaucaugaaugaauuagagggaagaacauuuucuccacaggaccuugaugaugguagguacagaaauugcuugugcuuucccccagcucaugaugguugguuugccugaauucuguuagaggccuuauguuuugagcaguguuuauuuaacugaguaacaauauuuagauugaacauucugaaagagccaaggguaucuauaauauauuaauguuauugauaagaaaauaaugcuacaucuacaccaaccaaacuuuuugugaacuuugguuuccagguagauuuuuucaguuggccaugaguguggugaguaccacuuuauuacuuuguuaucccugcucuaaggcuuccucucuguuccuuguucugccuguaacugggggcuucugugugucuccucuguuccuguuuuugcuucuacuccuuuuuucucuacaaucuguauccuaucucuauuacaguguugccuuuuuuuaugccuguuuuaaguuuucagaauauuuuuuucccauuagcguuguaaagugauggaaauagauuauuauguuuguuuucauuuuaucaucacaggaaaacuuugauguuuucaggaugaguagagaauauccuguugauuguguggcagccuaguuggugucuguccucugggcuuuuccucugagauggccacgcagaugcagccucuuugguguauuuugcaggauaggugaucagugguauuucagugcugguacuugaagcuguuucauggugauuuugauaguacagugcuaauauaaauuugucuuaaauuucaugaaccuaggguuuauuuuacccaauuccuucucagcuuuuuuuuuuuuuuuuuuuuuuuuuuuuugcuaucaauaaauugaaucuagugcuaaguauuuauacaaagcaauaacuuuuucuuuuuuuacccuguugugccauuggcuuauaagacugucugaguaauacuguuugcaaauuuucaguguucaucucucagagauuuagagcuugcuuaccaaguacacagacuuuuaaacacgggggacaaccggaaacuggucggacaugauccucuacguaagguauauuaguaaguauguuacuuaauauuuuaaaagauuuauuuuauuauaugugugcuugucuguguguguguauguacacaccuaugcaagcauucgaaaaccagaaggguaccaggaauucuucgucagucucuaccugucccucuaaggcaggaucuauuccuggagcuggggcuugugacucagcuagucuggaagcccagcaagcccaucucugcccugcuuuggaauugccuauaaauacuugguaggaacgccugguuuguuaaaugcuugcugggauccaaaccaaacucuagcccucaugauuuuggaccaaggauucuuaacucuugagccaucuuucuaacccccuccuuucaguuuaauugcuagauucagcagugggaggaucuuaaagacuguauaucuuagcucuaguuuuaggugaugggcccauuauuuguacuuguaauugaacacuugauaaaagcaguggggcugaggaaauggcuccaagugggagcauacauuuuuagguuuggguucccaggccccacuggugguauguguucuguaaacccacgaugaagcaggaaguagauauaggcaaaucuguugaagaccagcuccaacaauguucagcaauccgaggaggggggugugggggcuggugauaauguaaagcaugcacaugcucacacauuuagugguuaaagcaagcuccaucaacuucacacauaaauauauacauguacacacauacauggugggugaagcaagcuccaacaacuuuauacauacauacauuggguagauggagcaaggcuuaauggcggaugacaugcagagggaccuacagugggcaagugagcuuccuagagauagcccaccaucuuacacagcugcaauggcuguaccucagccuucaucuacagauuacuucuugcugcugccaugccuucucaugcuugucauugcuauauuccucauacaucuagcaaggugugacugccucuugagagacagcccacucugucaggcaacuuuccugcagaucaauaugaaaaugaaauuuccaaaaauaauauuguuuaaaugaacuaauaauuuuacagacuuccugauuugauuuaaauagucuuaggaaguuuaggguaauugauagaaaguuuaaggagauggauuaaguuguuuugccagaagguguaauaaaguuagaacuaugaguggaaugugugcccuccuuuguaaaauacugggggcuacaucuguuagaaaacaaauacagugaguuuucuugcauuacaaacauauaauuguacuuggaaaagaaaaauaggcuugggacaaggucauuaucaaagaaaacauuguagguugggucugaguucuaggaucuugugaucuagggauguggccauagguuucagugugcacuaugaaaaaacaggguuauggauaaagaguaaguaauucuguuaugaauauaaggauaaauaaugaugauuaguuaguuuaucugaacaaaagauagguuaucucucuugcuaaguauaaauuguuaucagcauaggaaagaacuuacuacaaacuggauugcuuaaauuuuaguaacaaaagaauuauugcuuugggguuuauggugaacuuguggaaagaaagaaaaauggggaauauuaguuaaguaugaauuucaaaagaauaauauauacuccuauuguaauuuccuuuuguguagugauuuuaauuguuuguuuguuuuucaagacaggguuucucuuguguagcucuggcuguccuggaacucgcucuguagaccaagcuggcuuggaaccugccucugccucccaagugcugggauaaaaggcgugcgccaccacugcccggcuuuaauucuguuuugaggaauguuuuuguggugauuguuuuuuagagauaauguuaacuugugacucugagguuuuuccuuacagaacuuuagucuuaggugguauaaaaagacuaagaaaaaaaaaguuauuggagucagcucauuggaguugucuauccaaauauguauauguguguguguauauguguacauuuaugaaguuugaucaagcuuacuuguugaagcuuacuccagccacacauagauauguguguauaccuauguauguauguauguaaagagguuggcgccugacuccaucuacccagugugugaauguguauuaauauaugcguguaauauuuauguauguguaaagaaaguugcuggcgcuuguuucguccagcagguguguaagcaugugcuugccuugcauugucgccaacccccagccccgccuuggaccucugaacacauuguuggaggugaacacaacaguggagcuucagguucagugagguuuuggagaggcaguugaagacgacaucugaaacacaacucccacuccuacgagcaucuauaggcaggcacaccuguguacauauacgcagacaaauugaaaaguagcaguaauauuaagacuagacucuuauauguacauagagauuuuauuguguuacacuucaugccuuuaugugugaggguuguuuuuguguguccagguccuuguuuccccacugaguacuuugaauacaaauguuauuugaggugacugagaauaaguaguaagcagggagcccaaaguguccagcugaggauccaagaucucagcugggaaauguaguaguuaccacucauuuggucaaucauugaccguucugacuugaaauuacauauuuuuuuauuuugugugcacauguacagcauuggggguggggggugccaaaggacaacuuuguggagugaguccucuccugccuuuauuacaaguaccuuuacccaucucacugaccuaaaguuguaaacuuuaaaaauguaugauuuaauacaguaauaauucuacuggaauuucacuaaucauaucuuauuguuacacacagacuuuaaucuaaacacacuuuuucucuccacaguucgaaguuuuucaguuugauuuguucacuggaacaaauugaugucaccuugaagugguauaaggaccuaauaccuucaguaagggacuucauacucaucuuugucuuuguagaugaauuugugagaaugccuuuucugauggauguuauaaaaucauguuuguauuucuccaccagguguuccuuccccacuaccaaauauucauaggucuucuucaagcauuggauguggccaauagacuagaauugguuccucagauuuggaaagguugguggcaguuuugugcagugacugaugauuaacauguacauuuuaagacugaaagccuccauucuuuuuuuuuuaaaagauuuauuuauuauuuauauguaaguacacuauagcugucuugaggcacaccaguagaggaugucagaugucauuauagaugguuguaagccaccaugugguugcugggauuucaacucaggaccuucauaaaaacagucaguguucuuaaccgccgagccaccucuccagccuccaaaagccuccauucuuaacagagguuaacacuuuuguuaaggucaaacuugaaggccauugcucaaguuauagugguuaaguuaaguacaggaaaauaagaucuuucugauaucagugccagagaaauuaguaccaaaguccagcucugugucuuacccaaaucucuuacacaggcuguguuauacauugacuacaaacauuucugauuggcauuuggcaacaggucucacugaauagcucugauuauccugguacucauuuuguagaccagccucagccucccagaguaguggaauuaagguuuucuuuaauucuaauaaauaauucuaauuuuaauccuacuggaggauaaaagucaguaauggauaaaagcucaccagguguuuugcauuugggauaucacuguccuuuucucuugcuuuaagauaguaaagaauacagucauacuuuccgagaugcccuaagagaagaaguauugaugcucauggccagggauaaacauccaccagagguaaggcuggcuugaagcucaagccaucauuauuagaggaguacugaccuguguaucuucuuaagguccuugugggauguuccacugacaaauguagguuuagguuaaacaccuauuaccauuagcagaauaccacucuuaguguuaaccucauuccuguaguccaagguggguaccaggaagaguugugacagugaaugccagguuauuuaauaauuauuucaugaccuagagagaggacuccuaggaaaggcacuugcucuucuucuagaggaucgggagucaguucccaguacuuacaucaggcacucacaaacaucugcacucaaaaugcauuuacuuuaccacacacacauaauuaaaaauaagagagauaugagcuggagaggaggcucugauuaagggcaacuuguucuucuuccaaaguacccugguuagauucccagcaccaugucugugccuccacuuccagggaaacuggccucugcaggcaucaggcacacauaugcacaugcaggcaaaauggcuauacauacaaaauaagauuuucuuuuuuauuuauuagaauuauuauuauuaacaccaccaccaccuggaaagaugugucaguagauaaaagugcuuucugccaagucugaugaccuaaguuuuuuuuccuggguccuaccucgaggagagaagcaauucccacaagcuguccucugaccucuacacaugggcucuggcauacuugugugcacauguauauacgcagccgaucgauaaauugaaaccuuuuaaaggaaauucaucguagcuuucauacauguaguuaaauugcacuaucccaagacaggugaaggccucuuuguugcuguguuacuugugugguaugcaugugauaguucuugauuuuaaauucuugucagaacaacuaaacacuucugcugacucuuagagccucucagcuucagguugcauuugcugacugugcugcugauaucaaauccacauacgaagaccagagugcccggcagccugcuuuugauuggccagccaacccuuuacaguauauagcuguccuuuuuuuaagagguggcagaagccaggaagccuggugaguacauguuccuaaguguacauguuaacaguaaugcuuagagcugaaacauuuacuuggguugauaggugaauauucucuacaaaccugaauauacaugagguuuuaguggacacuugcaaauaccaguuaaacaagaaacuugcuaaggccaguaugugugauguacuugaaaagaggauacucaggugagcugagaguucucuuuauuccauaccuuuuggcuuucugcaucuuauugggcaaaaaacucagccucauucuucugcccccgugguucugagugaugagagaagcacaccuuuggaaaugcucuggugauucagcauacgugcuccucguccccaucccugaccuacguguggucugaggaccuuagacuucuggcaacugguauuuccagaaacaagacuaucuuugguuugugccucuauucugcuucgguguguuuuuccagugcuucacuaauauacuaaaucuagucuuucuaaguggagaccuuaggcuuauucguuuuuccaaaauuagagacaccaagauuaucucucccugccuaugaauguauuggauauucauggccaguccaaauaugccugccaauucuccagaauagauguuugaaacaugucuuuggcuuguuagcucacuuaaaugggaccuguuagcaccuuuuuugucacaaaacaaacaaacaaaaaaaccaacaaggcguuuuucauggucaggcagguugaacacacuaugaagcaggcugugaugauuggcgcagggguacggaccucagcugagucaugggagcugaauguauguguuuugccucuguccugcauguggcaggcuguuggcauucacauacaugagacuguugccuuaaucugagccuguucuucauaauggagauuuagagcagacugagucaggcuuuaagaggagauuaggcuaagcccaggcuacuagcucuucuaaccugcaguguaggguagauucccuccgugggggauauaacuagcacuucuaaaucggcugcaucucagauuuaccuguugaauuugugcacccagauugggagcuaguggagcccacaggaauugaaaaaguuugaauaguugacuuguaggucacguagcuucugaacccgagaaaaggauagcuugcuuugucuagcugccacuuguuuucugucagcagucaucuguucucuucuuccacaggaaaauguuggaacucuucaaaaagcacaagaagauucccagguaaguugagggccucagcugguacaggcuugaguuagucacaugggcuuugacucuugggugcgugguuggaauuucuucacaugccuaaacccuccaguuaggcaggcaagcaguuucucuccugccauucagggcauuguaagccauccuuuucucuauucagugaucauuuugagaagggggugggguggggggguggaauauagaauguuauccucuaucuuuuguccaaaguuaaugagaauuugauuaauauauucugaaucucgucuauaaauauuugacuaaaaguuauuaaguuugguacacuggagaaauggcucaccuugcugcuuuuccuaagguuuaguucucagcacccacauggaggcucacaaccguuucuaacuccaauuccagggggucagcacuggccucuguggacauaugguacaccuacguacaugaagacucuuggauauauaagucugcaguagaaaagugcauuggguacaguucaguuuugccuucuuuuauacagaaaugaauugcuggaggaauucauggacacagcgaaagcauccgguagcacugcucuggccauugagguuguaaagcuggcaagugccuucagcuugccuauuggggagagccuugcccaaagaguagugauggauuucacaguugacccagaacaaaaguaagucuaucuccucuucuggugcuuauagcauucucuccugcuucccuuacaaagccaggguuuggugggugauguaaugccuguuugcucuguuacaggcuucaucauaaacauuugguuuuuggaauuuuuucuuuguucucauaauaguucagugcaguuugggggauccuuuuucugcuuugaaaacugcuaugacuguguauaaucaaagaugccaaacacccugacccugugagcugaagugugguaucauuucucuuccuuacagagaagcccuggguaaccucacugaacugaacaguagcgauggagaaagcagcagugacagugacagugacgacaaaugagagagagagguggcucacaauagcugcuggaauguuagaagugguaaaaauaaacagauacagggcugggauccaauauaagcucuguauuguauuguacuggccuaaaccuaagacccugggguucaucugcaguaccgcuaagaugcacaucuggccaguuuuuugccaagacagcaacaagcauugugaagucugacuuuuggagaagaacaaauuccacauaaacacacuguuugcaggccucauuccuacuacgcccaucauguuagaacccacaggcccuugcugccuaccugcucugugaugugugguccuuuggccuagagacaaggauucaaacugguuuucauggagauggguuauuacuguugaguugaucguaucccguuuugagaguacuuaaaaagauggaugcucuuagaacuaauuaaaucagaagcaagcuacugguuuaggcugcccagaugguaaagucauuaaauaaagcaauuguguuauuuuuaaaaaucuaauucuuuguaagcguguacauauucacauggaugccagagaacaaugguuauuucuucagacaggccuugagacugcagguucaguuagacugguuggccagcucugggaauccaccuaaguuucauacauacacaguuugucaucu

SEQ ID NO: 3066 - RNA, 75885 nt, Mus musculus
aagcgcaguggaaaaacacaugguggcucugcgcuacaagacucaaguggcguucucugcggcugacuggaacuucucucguagugacggaccucaaaacugacucggaagaugcuggccuccaagcacacaccauggaggcggcuucagggcauuuccuucggaauguauucggccgaagagcucaaguaaggaguuagugggaugcguguagaacaggguuguggaaguuggagcugggaacuacgauucccagaaggcuuugagccgagccaguccgggggcggcggggucggggugggggguggggggcuggcugccuagugcuugcuugcugguaaugggaaggaaugcgcuugcugcauuuucaucuguucaucuuccucauuaaucaacuaguuuuaugucauuuauaaucacauuacaucacacgcuuaucaacuuccuaauuagucuccucugguccaagcgaugaugaacuuuuaaaucuuggaucaagacccuggcuaugaaguccuggggacucuucucuaaugcuuuuugaucacgauagcauacacgcuucuuagacucccauuaauaacucaacaugcauuaaaaacucccagcauugccgggcagugguggcgcacgccuuuaaucccagcacuugggaggcagaggcaggcgaauuucugaguucgaggccagccuggucuacagagugaguuccaggacagccaggacuacacagagaaacccugucuugaaaaaacaaacaaaacaaaacaaacccucccagcauucaggagacagaggcaggaggaucucuguggguucgaggccaaucuggucuuacagagucaguuccagagcuucguggacacagaaaacccgucucgaaaaauaaaaaaacaaacaaacaaaaagguagaccacacugguaacaucagcacuacccccucuaggacacaucuugccauugcaaucuccauauguaaucagucagucuucauuucccugccccugccgcaugguaaccaccugucuacuuucuauuucaguuauucugacuguucaggccccuauucaaguaaaaggagucagucagccccgacuucuuguaacuggccaaugcauuuagcauacuguccucaaaauuauagauaaauagaucagaacuuccuuccuuuuuaggguuaaguaaauagaacaugauauagauagauagauagauagauagauagauaaauagaucagaacuuccuuccuuuuuaggguuaaguaaauagaacaugauauagauagauagauagauagauagauagauagaugugugugugugugcgcgcgcgcguacaugccgauucaucagcucaucugcugauggacauuugggcuauuuccaauuuuuggcaauugugaaugaggcuucuauuaaaguguguacacacccagacucagaauuccugguuuagacauuaaugccauuuuuaaccuuuugaggaaguuaauucaguuuuucauaauuucagcaccaucguauguucccaucaaucauacauaaagacucccucuucuccaaguccuuucuagcuguguguuugguuuguguguuuguuuugaucauacacugauggguuaugguaucucacugugguuuugacuugcaaugauuugaagaaugcacacaucuuuucauauguuuuugagcuuuugugaauauucaguggcacuaugaauauuuaaguccuucaccgccugugguuuuuaggaacagcaaggggccaaggugacuggaauaaagugagguagagaccaggaacccccacccccaacccccaugucauuuuaagggcauagccuuuacuccgaaggagauggaaggcuaccaguucuaacuugacuaaaaggagcauuaauuguuuagugccagaucccaaacuuucagcacugucucaucaagggaaacuuuuguaggacggcaguucucaaccugugaguuccgagcucuuugugggucaaauaucaaacacuugcauugcaauucauaaaagaagcagaacuauaguuauaaaguagugaugacauaauuuuaaguugggggucaccacaacauaagcaacuguauuaugcagguugcagcauuaggaagacagagaacuacuguuguggguuauagaaaguauccuuuuuccaagagcagacuccuaggaagguugugagggugauauuugcuuggcuacauuuucacuucagaauagaucugacagcuguuggaggguggacaggaagaggaaggaaggacaaaacaugaugggagaacugaccuagggcaguggcaggagaaagaaaagguaaaaugugauauguaggugacauagcagaugccugauagaaaccagguguuagaguggaaaggcaguuccuuuuaguuugugaaagagaggguauguguuguggggguuuggggcuuuuuuugguugguuuguuguuuuuucgagucaagguuucucuguguagcucuggcuguccuggaacucccagaugucugccugccuuugccuccuuaaugcugagaugaaaggccuuugccaccagcgcucggcucaguguuguguacuucguaccauugaacugcgcucuuaaacaugguuaacauguuaaguuuuauguauauuucauugcauuuucaaaaauuaacaagacagcuaaguaacuuguuuagcauuacugacuccaugcugggggaagagaccacacacacacacaccuuugaguuagauaacgugucuguugacauuagcuuagccagagaaaggugaccgaccauguugauaagagugagccacagcugcagagcugccucuguguucacaguggccuugacccugggagucucccagcucugcacagcuuuguucuuuguggacugcugucaguuuaccugaccacacaacucaaccauuuguuguuguucccccuagggugcaaaaucgggaugguaucuuugcccuacauuuauuuuucuaaccuggaccuggguccugaagaggaccugcgaugauaaaagcuggggucaggaggccuuguacaagcuaugucuaaugccaagcaaguuuagggaguacagcaucuacauacuauuuauagauuggggggaggagcggccaaggucaacagagaucuaaguuggaccauguuggcaaagagaauacuggauaccucagacacagcuaccauaggacugguaaccauagcccagagggaaggguuggguccaaagaagcugcaaccuugaccccuuuggggcacuggcuccuccccuagaauggcuuugucacucccugacaaggacaucagggccugccucugagaaagucucaggacagccuggcuucccucaaacuucuaaauuaggagagauuuaaaaggcaaaauuggcuuuguaaaaguauauuuauguaacauauaaggagacuuuccaacuguugcuuugcaugaacacccaaauacaguuggguagagcacauuuugcguguuuguuguuuacugucacauuggcacaguggcaugcucuugguggguacagggcaaguuauucgacaguuccauuaaacaaagugaagaaaccuugcaccaaguaaguucuguuucuuuaugauuuuauuuguguuucauuuucuugaaucguuauucugugcacaggaguuauuguuugacauuuccuucauugaacaaguugggcuuuuagucaggucuggcuuauaaccugccucucccacuucaaccucagagaagucaauaacuugagcuuucccugggucuuucuuuaaucuccucaggaaguuaaguguuaaauccauuacaaauccucgauacguggacuaccugggaaacccuucagcaaauggccuguaugauuuggcuuuggguccugcagauuccaaagaaguaugcgcuaccugcgugcaggacuucaacaacugcucuggacaccugggccacauugaucucccgcucacagucuacaacccuuuccucuuugauguaaguguugcccugggcaugugggucuugggacuuaggagguuguggggaucaccucuuuccuguuccugucucuuuagaaaaaagauccuuuauggaccuagaaacuguacacccugaguguccauuguccaaaaugcuugaggucaaaauugauuacaaauucagauuuuagaaugcuuauaagcuauguaauggugauauuguaggaagggaauguugcaggauuuuccuguccaaucacauuagggcaguggcaggccugugaguggacaggaaaagggaggcggagcuaggaauuggggagagcgauagagagguaacaggaggaggagagaagccaaaauggaggcagacaaacaggaagaagauucugaucccgaguaguuuuuuuuuuuuuuuuuuuuuugguuuuuuugagacaggguuucucuguguagcccuggcuguccuggaacucacuuuguagaccaggcuggccucgaacucagaaauccgccugccucugccucccgagugcugggauuaaaggugugcgccaccacgcccggcuccaaguaguuuuuaaaccaccacaaguagcuacgauuuucacaagguuagaauaauugggauguagcuuuuaucauuaucaauuggcucugaaauuauuguauugguaucuuguaaauugugaucuuauuguuauauaaaucugauuggauaauuaaguuuuaagagucauguuucuaccggguaacuagguguugagauagcugauugugggguguguggggcgcuguguggaagcaagaugaacucgcuagcugggagaguagcucagcggggagaacacgccgagcaggaccccgcugggacauaguguuguggccugccaguaccgguacuagagcgggaacaccggcaggcaggagagauggcugggcaacuuuuuaaauauuuccuuuaacaacagaacccaaguauaaacaaagaauucauucauaguuuauauaccucauacacacagucugauggaacauaguuuauauguaacucauauacacagccugaagagaaguauguguauuucuaaugugccuacaucuuuacuucaguccauaaccaugaagucagguguugaauuuguuuguauaucagggcucaagaaguugggcauuuuagagucucagaugagggauguuuauccuguaacuucagcuuacccuucagacuuacccagagaauuucagucugauuccaauugagaaaagcuacagcuugauucuguucauggaagagggaaagguuuagugagccccccaccuauccgaggcucagggucugacccaggcuuuaaugcacugauuuaucaccuuuugagucuagggcugggugcccaucagaaagcccuguggcagucaccucccuaguaauagagggaauccggugcuccugaggccacuggcuuuucagauagcucugcacugugacguuuuagcaggagaagcaaagccccaaaaggaagaccaguaacuuccaaaugaagcugcugucuagacggcacugguguauguucaguaucaaguaaccuaguccccaggaguucuuuuugaguuuuucagacugcgaugcauauacagacauaguuugucuguuagcauauuaaagaaggcuguuguauuaguuaaguauuauaacuauuuauugauguaaaacaaaaaacauuucuuuucucagaccacgcauccuauuaugaguuucaaauuugaaugcuuuaagaugaaaccauaaaagaaaaauguuugucugguuguuagagucuaaaagcuauugaggcauagaagcagaaguagaacucuuaaggaaauucuuaagggaagaaaaaucucuuguaugcacugaaaaucaccacggugucucugucuggugccccguuugcuuuuguccccacucuuuagaaacucuaccugcugcuucgaggcuccuguuugaguugccacaugcugacuuguccucgggcugcaauuuaccuguugaucucccagcugaggguccuggaaguuggagcccugcaagcagucuacgagcuugagcgaauucucagcaggguagguuguuaauaauggaaaccaggauaucaagagaugcuuauauguuguucuuaaaugccaccuaagcagucuccagaauguuuuggcccuugcaugguacagugaugccaauagcuagauauuuuccugggucuguauggagcagugguagaagaggcaggugacaguguacauguaaucuuccaggcauauuauuccuuguccaaggguuccuuaaagaaauggcuauuauaacccaggaucagagaaauuacaguagucuaugacaugccaugccagacagcaaguugguacucaaagucacccaaaaggauagcucaggugagggauucacaaucgccaaaucugggacaaucggaacaaauuauggcaguaaauaauuauaauaggaauuguagcuuacauuucucaaaaccuacuuuuaauaaggguucuuaaaugcuuuuuaaccucccuucuagcccaccgcccaccagagguaauggaaaggaaagguuaaagggcaaaggaggaugcgaaccuguuuagaaauaguucuuuggagcaaaucuggucugcagugucaggauccuaucggcaguucaguucaaguagucauacaaagugagcaccacccgacagaaaaacuuuaaaucaugcggcauguucugcgcugugguaaacaugaugcauugcuuugaggcuuuccuuccacaaggauguuggcugaauuuugcucaugagagaacaucagaauaaauccuuuaaccuucaagaauguaaaggcuguugguaacaaaggaacugcucuauucugcgucugacagucugcagcucuaagaagcaccugagaacuauucuccuaaugaguugacaucuguaagcuacaacaagcggcucuaacugacgcgauuuuucaguaaaagauaagaacuuucaagacuugaauggugucugggaguuagaugguaguaguuuauuacugcuaacuuuuuucuuuaaagauuuauuuauuuauuauauguaaggacacuguagcugucuucagacacuccagaaaaaggagucagaucucauuacagaugguugugagccaccgugugguugcugggauuugaacucuggaccuuuggaagagcagucgggugcucuuacccacugagccaucuuaccagcccuauuacugcuaacuuacuguuuggauuaucauaguaagguuuuauuagaugguaucccuauuaaagcccuagcuagccuggaacuugcuauauagacaagacuggccucgaacucagagaaguccucccuccucugccuacaugccuggugccuuggaggccaggggagaacauuggaucauuugaaacuggagcuacaggaaggagguagccacccuguagauucugagaauugaacucaggucuuguggaagagaaacucgugcgccuaauucccgaaccaucuucccagcuucaagaaguucucuauaaaaugcccugaaagaaagaguagaagaugagaguccuacaggcauuagauaggacagugccugcauuucacauuucauaguaguucugugcuaccagggagccuucaggauaugaucugggaaagcagagaagagcugggguuuucauuaggcacucagcccucuagguggagauucagccuaacaagucuggacagacuguugccauuagcagagauucucaucuuauuugcuuccaggagaacaaagcuaaacaauuaauacaugguuagauuugccugcaagaaagagaauugagaguaaaagaugcuccuaugccuuuaguuagagaaguuauguuuuccuaggauuuuucuuauccaaauuuuaucuuauuuucauauccuuccuccuaucuuuauuuuuuuucuucauaaauguucaaauagacauguaauuguguauacauuuggcagcccuugaugucacuauauguuagaaacccucuccucuucccuuguccuaggagacuuacuuuugauugcuggcguguaugcaagggcacggccaccuuccuucagagagggggcuuccugcuucacucggguggugcucccagucugaacccugcauaauucagguuuaaagcccuggucugcuuguacaauuguacaaguguuauuuccuuuggauccucgccuugcuggggccgggaaguggugaugucccauuugauaaucaucguuguacucauucuagguguccauuucuguuccugcaucauuugggggcuucaaaaugaaaagcauaaaauuaacaaacuacaaaaugaauuuagggcuauagugcuuuccacagagaugcauaaggaauaaggacacuuagagucccaccuaggugcauaagaauagugagugacccccagcucacauuuacucugagugcucugcuccaccaccaauggcaucccuagccccgcuucacugauuuaaaaauguagcacaguaacucuggauuucuuuccuggauugaucuccguccuugaaaaggccagucccagccauggugcucaccagacacuuacuuuacuguaguaacacaguaauuuuccucucuuucaguuucuggaagaaacuggagauccuuccgccuucgaaauucaagaagaguuagaagaauacacaagcaaaauucugcagaacaaccucuuggggucccagggcacacauguaagugaccagcgucuaccuguguaaugaucugcuuuuaguacagugaccacaguuucucuaucccgucaucugcacaaguuccucgcuuccaaggguagacuuagguuucagucccagcucugucucuuacgagucccaugacguucaguuccucaccuucauggcuauagcggggcugacuagaggguuagauggcacuaguuuaaguauagcauccagcaagcagcuguguugagagcacugucugccucgaccuccacuccauccccuacucuggacuuucucuuaaaucccugcugucuucucucucccuggaggcgucugugaaagaauucauuugcucugaauggaugggguagguaaucagguaagaggaggcuucagacugaacucacuuuaugaccaggucucauaccacuuaacuggucuagggcagggccccaugggaguuccagaagcuucuggggggaaccucuuugaggccaagagaaucaccacugugggaccccgagagccucuggggaagcaucagggagagcccagcuacacccgaggcuugucuuaaaagcuaaauuaaccugcacuuauuccaagcccgcuaauggguucaugaucuuucuuagucacagcuuccugagaaagcuuauguucuuggucugaugugauacuaugagugagggucauguuaaacagucaagauuugucuagaaagaugacauuacaguuaaagacaguagugacauuaaccccccuuugauuuuccucacguuucuuccaagaguugccccggaagagcucagaguuguugcugagagaaauggcucagcaguuaagagugccuacugcucuucagaagccaggagucugacuccccagcacccaugucagguggcucucagccacuugcuucagagagaucugaugccucuguggucaccaacccucgcaugcacacaccacugacagacguaacguucacauaauuucaaaacaaaauuaaaaaaaaaaagucuacauuaauuucuuuucaggaaguaccuuuuucuuaguuguguucuugaaaagccuaauccuggcaaguuugcauagguuugggacagugacguccuugauguucaggcagugaguauuaaucuggccugcaaugaacagcaccuggauccuggcagaggcuuuggggagcuggaagagcuuagccagguccucuccucaccuccagcucugcucuuccuccugcugccugcuuugcucaugcuucugcugcuauuaaccaguguguuccuguguucuuugugccuuggugcguuguaccugcugguccauagcuaacuauagauucuuguccgagugauuacugauagcgagacuugaacaaucuguguucaucugcuguagcugacuucuccagugccauacuaggauauggagcagaugugaauuuuuaauuacugucaguacaucuuuaaaaauacguccugggcuggugggauggcucaguugguaagaguacccgacugcucuuccgaagguccggaguucaaaucccagcaaccacaugguggcucacaaccauccauaacgagaucugacucccucuucuggagugucugaagacagcuacaguguacuuaaaucuuuaaaaaaaaaaaaaaguuguauccucuuuaaaguuguaucccuuuaggagcaggucuguuccuuuagcaagagagacccgagggcaguguacaugagaaugauggguucuguuauuuaguaaauaaaccaagaaugcagagauugcccgagugacaaauaaaccauagaguaagaacaaguacuggcccacauagagguauuaauguuucccgagucaaaggcucugcaucauugucagcggauacccggcuucaucaaagacagcaucaucugugugcuagggaaucggaugcaguuggcaauuucaagaccaaaaagugcaucuugaggaacaucagugccuuuuccuugauguuugguuuaccuuuaauaaggccacacagaaagcuauaugaaagacuauuuugugggacgcuuuugucaagugaggguguauuuaguuacuguuugcugcugcugugacgaaggaguuuuucugcacguacugcuccagugguggagcuguaauggcaggaggccccagacugagagaccagucucccagucgcagcugcaagcaugaagcagaaagcacaccggaaguagggcaggcccccacugaugcaccucguccagccagaccacaucuccugaagcuuccauaacgucccagacagugccaccagaaagggacgaaguaaguguucagaugccuggauuuauggggacauuucucauucagaccaccacagggcaaucuucuuuagucaaauaaaaaguaaaaaaccauucauaaaauccagauuggagucucuucagagcagcacucuggugcagguacagcaguacacauguauaaucccguuucgugagaggcugaagcaaggugacaaauuugagacuagucugggcuacaaagugagaccuuaccuaaaaauaagucauucuaauauucucuggcuuuugaaacaggugaaaaaugugugcgagagcagaagcaaacuugucgcucaguucuggaagacacacauggcugcgaagcaguguccacacugcaagugagugcuggcccucagucguucccguccccuguuugagguggccuuggccagucacucagcaguguuccugaaugucucacgcggcuuuguuucucucugcaaaucucccuguguguaggacgggacggucggugguucgaaaggagcacaauaguaaacuaaucaucacauacccagccacggugcacaagaaaucagaccaggagggcacagaacucccagguaagcagccgcgucggccacguucucaccuguggcuucaggugcuuucagccuccugaggccucugggagggagagcuuggggaagacccaccccagggcugucacugggaaggggcagcagcaaggccgugcuaugagagugcuuacaggugccuacguucucaaaucauuggcuuuggguuggguguuuugagacaagaucuuaggcugaugucagacucucaauccugccuuuuagugcuagcaggaugugguuguuucuuugaaagauuuuguuuuguuuugugauagcguuucuuguacuagauacagaccuuaaccuccugaucaugcugaaauucugggauuacaggcaugugucacaacacccagcaauccaaagguuacugaauaagaacuuuuaguuuugccuggcaaguguuuuaaguauuucacuauguagcaagcaaggauuuauuuugaauaauauuuaaaaauugaaagaacucaguaaaaccugaggacuuccuuccagucacuccugacaguucgccacggucccuguagucagaggugucuuaugcuccacauuugggucguagagaaaaagccgggaugagcaacuuuccuuuuuuaaugugguuuuuguuguuuaauucugaaaugagaauuaaauaagguauuuugagaaguccugagacgaguacguguuuugcugugcguguacuagacccuccgauuccuuuuuuaucguauauuccguaugccaagucagaaaaagcagccugagcuugcgguuggcucuggugugugccgugagaggcucagagaggccgcuucucagaccuguuggcagcucacauaguggcaguagcagaggccaccccgagcugaggccaccacauccaugacaaugcacagcagauaacaugggugagccuuguccagggcuugggacuauggaguaggcagggaaaugcauuccuggguacccagcccaugcugacuccagcaagguuugcuguaaauacaaaucugugcacugguuuuugauagaccuuuuauuguagagcaaauucaggguagcaagcacagugugaguucccaugaagucgucuuccaguugguucauuuguaaccuuuuagaucgccguaggcauccaucagcacuaggguggcacugauaacuuacaaaccuaauuugaaacuugccaguuauuuugcucauggccuuucuguauccuaggaccuagagugggauccauacccuguuuaggcacauguucuuugauagugagcagcuaauagcacaagaguggauuuuccuccacuuaccugcaaacggccauagaaacaucuucucuuagcaccgcuugacaguugcaaccaugacccucuagauuguccuagaaaaugcuaauacacuaaaaacagaaauguucagaauuuucaauaauaacuccaguuggggcacauguccaaagauaaaguagccuuucaguuccuuucauucaucugagguaauauuuugcuguaacuguaagaauaagguacauccagaagucuggacacuagaaaucuguagaagauaguccuuguuuugguuguuuuuuguuuuguuuccuuauuuacuuguuaguuuuuuauuuaaugacucuuuuuuuugguuagggaggagggaguuugagacagggucuugaugcauaguccuggcugaucugaaacucacuacauagauaaagccggccuugaacucacagagauccucuuaccucugccacccaagugauggguuaaaggugugugcuaccacacccagcauaaacaauucuuaaauauguuauuugcacacaauugggccggcaagaugguugguucaacagguaaagaugcuuccugccaagccugacagucugaguuagccuguagcaaccacagggugggaagagagggcugacuccugaagguuguccucugaccuucacccgcccacggcuacacacucacuccacaauaaauaaauaaauaaucaguguaauggagaagcuaaccaaaaguauagaacagggcaaaacagcauuguuuguggcuaguugagaauaugugaaguguguguaccagcuggcagucaucuguacuguaaagaacugugcugugauuguguuugccacacuugagggugcucaguacacacaugacaguggggagugaggaugacuauaggaaagacagaaaaaaagaaaaagagacacauaugggagggcugcaggucauuaccacaccagccucgaguguacuucucauugccuucuuguaccagagugccaugggaagcaaagccacaagcuaacagaaacuauuugcugaaguguacuccuaagacauuuguucucgcccaaaaaccucccuaguccuuccaccauggucaauagacucuucagcccucgccuugagccucaggcgcgccgccucauuccguggcucagcagggcugccagcagccuggacucugacuguugagcagacuuucuuccugcuucagagaagcagcuccagcaguuccuugauaaauccagaggagggaaaauugagcaaugcuucacuucaguuaaggcaucccagaaaaugcucacaauugugaggcuacagaauacuuaaauuaccuuuguuccucaucucagugucaagaucagcuucuuacacgggagccucaauacaauuuucuacuugaugugggcagagcuagcaaucagggucucagaggaucuugccuaguccaagaagccaaccucaccuacuagugugauauuucuuaaaucagucuauucagaucuguagacaucuucacacaggcgcucaguggaugaaagugcuuagggcccaaaucuauguucuagucccaggacucauaguagcugaagagaaccaacucccaaaagcaaugagaagacagcuucccugugugugugugcacaguggcacauauguccucacacucacacaauugaaaaaucaccuccccacauuuacuacuguuucccugacccucucugcuggguccuggguccaugagacaaugcugcuuguuuucuuccaaggccucauucaugcuaggugccuauucaacacuuaucuauauccuagcccaauaauguucauuuagaaaagcuaacacugaaaucaaucugaauguccaaauagaagagugugguuaaauaaauuaggaaaucuccucaguagaguaucgugcagccauagaaaugaugauuggagcugggcaugguugcauagacuaagcccagcacuugagagguggagacaggaggaucaggacuucaaggcuaaccugggcuacuuaagguugucucaguaacaagcaaaaaaguguuuagaugaaagcuauauagcaauugucuaugugucccucuuauagcaccaaaugaacagaauuuugaugaaaauaaauccaugcaagauuuucggguuuuuugaaguaauaccucacuguagcccacauuguccuagaacuaaugauccuccgccucguccuccuaaguccuggggugacaggccugugccaccaaccuggcacagucucaaugucauguacgguauuuacaugaaccaaagcacuagaaaagaaaguuuaaaagugaaaauaguuauguuaguaauaugagcgagugggaaugcccugguguauucuuccacucugguuuuauauaauagugucuuguguucguuacucccgaaaucagaguguggguggagauccgggcugaggagcugcuucucuguagaaugauguuuacgguuguugaaagaauggggggaauaugggucuaucucacuacagaaggagugccggaagcuccaggaauugacaaggcucagauggggaaacgaggguaccugaccccaagcagcgcccaagaacaccuuuucgccauuuggaagaaugaagguacuagagaaauugucugucugucuguggauuugauuuccuggaucauuuuauuaguccacccucuuacuaccuuaacugaaguucuaauuaauguagcucccaccuguaauuucuccacuggucuggggcaagcuucagggcacauugacuuagagccauuaagaagcaagguaggucacacccccuaccaagaacuuggugcagccgagcccagucacugcugcacuacugcauucuggaaggcuuauugucacucaucuuuuucagauguccacuaaaagggauguuuuagcugggcagguggcacacaccuuuagucucagcacuugggaggcagagguagguggaucucuugaguucaaggcauggucuauauagugaguuccaagaaagccaaagcuacuuagugagaccaucuugaaacccccccccccaaaaaaaagaucuuguaaacauucauucuaugcagauuccuucugugaaucagagugaacuuuuguauguuucaguucccugcaaaaagggaaaucuuccccuuucugaauacauaagauggccagugcagagaccucgaaguccucagccaucuuccaagauggugucagggcacuaacgauggucucugcaaaggaagugcucugggcacugauuggucucugcacaggaaguguucugggcacugauuggucucugcacaggaaguguucugggcacugauuggucucugcacaggaaguguucugggcacugauuggucucugcacaggaaguguucugggcacugauuggucucugcacaggaagugcucugggcacugauuggucucugcacaggaagcucauagacaaccaugguaucgccaggauuacaagaguggaaaaguaccgcauucguuaagugcuuucuguggcaggcuuuacucaggcuugguucauuuucuccaagcaguuuuaggucagcuuacuuacgucucugauccaguuugcagaagagcccucuucacauaccuauagagaaaggauguuccauuaucuuuuguuuuuaagagacuaaacuuuauuugacuugauuuuuuuuuuuuauuuugauuaauuuuguucagaguccaaaauagcaaacauuuuuuuuguuuguuuuuuguuuuucgagacaggguuucucuguguagcccuggcuguccuggaacucaguuuauagaccagucuggccuugaacucagaaauccgccugccucugccucugcugggauuacaggcugugccaccacgccccugcuugcaaacauuuuguuauguauguaagauuccacaccuaggagggagggugacuuaagcuuccuguuucuucauagcucauuuccuuacugaaguaccguuggcccucagcaucuucaucuuaucuuacugcauacaagcuguccuaugcccaggcugacuuuguuuguuuuuauaagaaguauuuucuuauucugcauagcaucccauauccuguuuugauuuguuuuuuuuuucuuaguaacauuuuuauguuuuuaugcauaaauggcuuaaauggucuuguugguuacuuuauuucaacacaggauucuuucugaauuaucuuuuuucgggauuggaugauauuggcccagaguccaguuucaaccccaguauguucuuucuagacuucauagucguaccgccauccagguaacuccuuuuaacuuacucugcaugaaaagggugggcugaggaauugagcagggucacguaggagggccuggaaggguugggccacugagaaaucaaacagcugucaaaccaagguugcagguaguggccugagcauucucugucauuugguuguccuagacauaggugguuguuucuaguggacugagcugugcuucuuucaguaaauaguuaggaggcugaaaaacauucaugaagccuguaugccacccuguagguaccgucccgucaaucgccugggugaccagauguucacuaauggccagacaguaaacuugcaagcugucaugaaggaugcaguuuugauccggaaacuucuggcguugauggcccaagaacagaaacugcccugugagaugacagaacucaccauagacaaggucagagcugccucgguguugauacaaugucuugguuaaggacagguuugguaagaacuacacacuugguucuaacuguguggacacagauguuguggcugcugcaagaugcuaccugcagugggcagcaccccugguuggcagugugacuuguuaggacaagugcaggccugauuauagauaaauguagguauuguuuggguucaauauccaaagaucaugccagugguuuuagucacuuugauuucuuggacgcaucuucacuauacaguguaugacauuuauggugagguuucacacccaggcuguucuuggaggucucaguagucaucuucccuccggcucuaaggauguguguguuggcucagaaaggucuuuagcaauggagccaggaagacgauguagaaugggauuuucuagaauaagaccauccccacugacaguuaccuagcccuuuccaggucuuacaucaaacucuguaaauuaaagcuaaauuggguauucaaagugacuugccaaggucacuccaucccugaacuguggucaggauguaaauagaauggcuuuuucuagcuuuggagagacagaccucucauauuccaugucauuugcucagacagugcugcuauaagccaggguugucccagggugacaccauugucuccugggcacauagcuuuggaugacuucuugacccuuugucugguucuacugaacuuuacugaugagucaguguggaugugcuuuuaacagcauaagaaagaguugccaucugcagguccugguccaguguggaagacugaagaccauaggauaaucaaauccaaugaguaggaaugagaauuuuauuuuagugacccuuaagaguagagacuagcuuuugucaauaguaacagggcucuaucucuagggggaaaaaaaaaaaacaaacaauacugucuugaucccucggcuaauuucccuuuaauuaauuagacauauucuuguuuuuuuccuauuuguguucaucauuguauucccauggcacugaucucucaggagcuguccccuagggacuagggacauaccagaagccaggggacaaggucuuguucauuucaacagcaaucaugugacuauaagcagugaguuugacuagacaggccucugccaucaugcagguggugaaaggacuguaauguugucugcagaacuauauguacccuccaagaugacuccuuuauucccugguaauggggacaaacccagauuaucacuguggcauugucaucugccuucacacacuguuuguagccagauggggccaguagguggugcucuaaggaccucuguguuucucuucccuggguagguaagaagaagagucaggauuagggauagaaauauuuuuacaugauuagauaaauauuuaagcuugaggaugagccaguuagcuuagucuaacccacuuggggacucacauuauaacuggugacauacaguauuauauggcaaacauuuuucuuaagaaauuauucuaccugcauuaaaauaauaguaauguuauuugguggugguggcuguuauuauuauuauuguuauuguuauuauuauuauuauuauuauuauuauuauuauuauuuggagacagggucucauguauguagcccaugcuggccuuuaaguuaccauauagccagggcugcccuuaaacuucugaugcccugcugccaccuuccaagugcugggcuuacugugugccccaucgcugccaguuucugugcugcuggagauggagccagggcuuccagcaagcuaggcaagcccuccaccgcacuuuuaugaauucacuaauguuuuccuaacccuguaacugaaguagcaguuccauaugaaacuguugucuggugggacccucagcaacagagugcccacgggaagggcugcuaagacccccuugguuuggguggacuagacauuaagaagcuuaagauagaaccugcuuacguuauuuuuuaaaucuuaguguaguuuugauuuugagaccagauuuugcucuccuaccucuacuucucaaguggcugauaauuauagauauaugcaaugcugcugugcugaugaauuuugaguucauuuuauaacuaaaagagacaagcugauacauucauagaggggcuggagcugauguguacuacugauacacacuaacaaguacaguaccaucugucagcuuccagggcuucuuuucuuuuuuuaauauaaagauuuaauuuauaugaauaugguguagcugucuccagucacaccauaagagggcauuggaucccauuacagaugagucaccaugugauugcugggauuugaacucaggaccucuggaagagcagucagugcuguuaaccucugaaccaucucuccagcccccuuccugcuccccuuuuuguuucucauuaagggcuagguugaguaaccaaguguuuuuucaaucacuccuauuuuccugccuuuaucuucccaggaaaaugacuccucaguggcuaucgaccgauccuuccuggguuugcuuccaggcccgucucucacagauaaacuuuacaacauuuggauucgccuucagagccacgucaauauuguguuugacagugagauggacaaauugauguuggaaaaguacccuggcauaagacaggugagcagugaauuggauuccgaucacauguuggugagggucagcagcuaacaacuggucugcauccccggcucgcgucugcauguguagaaauaagugcacauuauacucacuguuucagaagcaagaagacaguagacaugacugaacuauuuaauauucuggcacuuuuuugcucuguguagauccuagagaagaaggaaggccuguuccggaagcacaugaugggaaagcgaguugacuacgcagcccgcucggucaucugcccagacauguacaucaacaccaaugagaucggaauccccaugguacguguuugugggcaggccucauuuugcuacugguggcugggagauaggugugccaucaagggcuggggacagaguugaugguagaucaacauggcuccaauggggacagcuuccacugcuucacauguggaaggaacuugagguacaaaaugguuuugccauccuagaagacuuuugccccagagcaccuuaaccuagucuuuaaaccuuucuuguccaacugaguccaugacgggagaagaggagggcagggaugucaguccgacuugagugucuggcaguggagaugggagagagcccucagaaggacagcgaguguguaucaucugucucucccaguuccaggggugaguggcuugccuggucacccauuagcgcuccuuggcgagccagcuuccuuuucucacuuccccgccaguuaaagccuuggugcucauuagcagcacucucuagccgacuuccuccuuaaugggccucgaggucaauaauucgaggacgguuuaauucccucugugcagaguuucauuuccuuacacgccacccugccucucuuggggcagcugguaauaagcagagcuaaaguguucugagucuugggcacaguuuggcuuccugggccugaugugucaagaacaggcagagagcacaguuccuggguucauugccucccgggaaccagaggucuucgcauccaaaagcugaaauauauaccaaggaaagccagucauaauauccuuaaguuugaaucucugggaggaaaggccugguaggcagaagguagaagccauccaggcucugaccucagugccuggaguguccccagcuuugccuuguaccuccauagcauucugaucuuuucuuuuuaagaucuggguuuauuugcuaauagcuuguauccugaggagagacucuaaugcucuccaccuuauugacccccaccuuaacccaaaaucucagagccauguaggccugagguuaauacagggugaccaggaagaacagugcuaacccugcuccccucccccacagugcaccagagggguuaugggaacaagaaggugagagaaaaugagacuaagcuaaccuggcaggguuccacacaccggagcacugccuccuaaagcugugggccgagugaugggcaaacaguaaacaagcccauuagcucgaagugaaggaggcggggcucuacacugcucccacauacagaccuggagcuuucacauccugggcucuggagucuguguguguguugaaggagcaaguaagugaacaucugugacucggaaacuuacuucgcuggagagaacucacuugcuuuagagcaaguuucaggccuaguguugacagaagaacacuucacguucucaggggucagaauugcaaauccauuuccucuucagcgccacucucugaugccaugccugggcucaguggaggucacuaagcaguuagugacaccugcugggauggggagggguguggucgcuuucaagcaagugccccguacuaccccuuuggcaacacagacuuuauuggcggacaggaaagggugacguuuugguggguguacauuuaagagaacuaaucuguaaguugcccugucuguucccuuaagagagcaagccuagcaaaauaguucagcaaaggagacauguugcucugccuguagaaaggccuuggcuaagcaagacagcucuccacaguuugggaagaaaccaggcagcucauuuuguuagcuuuuguauuccuguaaccuuugucugcccauucugaauuuuaacaugccauccuucuuucuagguauuugccacaaaacugacuuacccucagccaguuacccccuggaacgugcaggaacugagacaggcagucaucaauggacccaaugugcacccaggagccuccauggucaucaacgaggauggcagucgcacagcccugagcucaguggaugcugcgcagcgggaagcuguggccaaacagcuccugacaccagccacaggggcuccgaagccucaggggacaaaaguuguaaguaagaacauggguuuguucauaacuuccuaguuccugucugguuccaacuugcugccucugagcagggcuaaucagaggaugguucucagaucagaagcagcuucacuggaacuaaggagagagagaaguugaucaggguccucaccccuuguauugaauuagcauagcaucucugggauuggcuaacuauaauauuguaauauuugacaaacguucccaccugcuuagagggaacuuuggagacacccuuggcuuggcuuggcuuggcuuggugaccacugguucccacugauuuuucagggcuaacaauaagccagucuuuugccuuccuuauuuuugaaggucuccucagcuagagcagaguuaaauucugcucuaugcugauuugcuuugguaacagggacaccauucagaccauucaaggcaccaguuuuguucuuuguuagguuaguacauuguugggagcuaucugagggauucaagaagcagcaagguacguuuugcuuaccaggcaaauaaacguaagauaaucuuucuguucacucaaaucaaugaguugcaaugaggaggaaaguuugaagaggaauaugcaaugagggaggggucaguacuacugagugcugcucaguaguaaugaguauugagugcuucugugugcucgggcuuugcaaggacaugaccccgacagggacugccaaugaaagaaugugaucugugagcccagaagugacucuucaagggcugcaggggaguuauggauaaguagagucagguugcagaaggggcaccagggacauguggcuguagagaagggucagaagagacgaauaugaugucauggagaggagaggggugucaagggaagacacagguuuuagcgcccaucuccuguaaaaacuacaggugugagguguagauggagggagaggucauaggauuaagaacaagcuaugagaauauuaaucaaauaaagaguacaauaagagaagaugaaguccucucagcguacacagugugggagcaguugggaauuuggggugaggggaucccuugcagguuuugugucuacacuuguuucuugucuguaguuaauggaguucuuuaguccugagaaggaggcagauuucagagccuuuacacugaggaaauaggcaguaagcagguaagaguaaauugaagaguaaaucagaaauggccugcugcucuuggaguauaaagauaagucagagguguaucgggaugcuuccucacauggccugaugacugcuguggacucagguggggacaggcaaaggguggugggacaggagcuccacugagggagcgcgcccagccgcagugugcuaggcacuucucgugaagccagugagaguucuucaggagcggugagggugagugcucggggcucaguucuucaucuuccaacuugggcccgaauccucagcaaguucagaaggccaccgaucaccucucaccgcagcuggucagcuggcuccaucuccucuugggguuugcagauguuguuucucugccuuccuugugacgcuggagcugaauccugcugcuccuucaagucucaggccagcccucuuucccuagggucagaguaacuauuucagccuuaauuggucuugagcucuuacuauauagugugaaagccaguguagacaaauggaugugcauccaaaaauauuuacaaaaccagguagccaggcugcagaccguauuuuacuacuccugaaaagcguguguuccccagcacacguaguguacccucccucauccuacccuugcuucuugcucucaccacauggugcaucccuauguaugcacccaucucucuguuugaguuccccauuccugugcaaagacagaaaacacaagggguccuuccaucagguccuaggacucagaaugucacauugucaauaauguuauguacauagaggacgcuuugacauaggcaugcaugcacuucuaagggcugggagaggugaacgggaaggaaacuaaagaugaacuuacagguuaggucggggggaaggguuggcagaaagguuauuguaguuucucugugauggggguaaccacugcccuuuccccugaggcucaacaagaaggaaguguucaggauaaccuaggcuuguuucucugccuggcugccugagcagccucuggccccacgccugccccugcaaacucuuaacccgggcacuggggcacacuaauuuucaccacaguauuuauuuagugacaagagaaaggaaaggccuuggguuuggguuggcaaggggagauuucuguuuggauuggcaagugccuggcagacuggccuacaucucuucccagcugcagugaauuugcuuacaauggauucacuagucucagauucuaggcccaaccugggcucuugggacugagccacagaucugggcaacuuuucccuugagacacugaggaaagaaaaccucaggcugugugacgcacagagcagccagugcccugggcagcugcucagaggacuccucagaguucaggucuccuuggaaacaugcaggacucgccugugggggcaggaagguuggaauuccucaggcagccaaaauacagacugcuuaucuuagggcugcuacccugcuccagccaagggaacuuugaggagaacugacaaggacuguggggggaggggggcaugucuucacagcccagcugacaggcuuacccuggucagcuucccagugugcccucacaggugggccacagaaggcuucaagaccuguuuccuccugcuucuuaacucugugacacagaugggacuagaaagagaggugauuaccucuggguccauauccucugggccccuuaccuuuaugcaguuuuuguuguuuuuggguuuuuuuggguuuuuuuguuuuuuuuaauauguccuugugguguguaacgucagcuuugaggaaaagcuguucugucaaaggagccgacaggcuggguuuaaaagggcaaagugggaucaguguuugucuuaaaagggaaaauuucuuguaaaagggaaaauuucuugugcucuuuuuauucuuuaaaauuuguaucuucugguuuucgcccaucaaugagcauacgacuuaugcaguuuuuuguuuuguuuuauuuugcuuucuuacugcauuucuuuauuugggaagaagucagggauccacaugccaaggcauguguguggaauucagagacacuugucuccuccuuccaucauguguucucuccuucugucacgugggucccagcgaucaaagucaggugucaggcuugguagaaagugccuuuacccaccgagucaucucuggcuggcagaggcaggaggaucauaaguuugagaccaacuuugacaacacaacaagacaguauuuacuaaaauguuuaugcagaaguaauauguguuuuaauaugaacaauacuaagaucuggggcgguuaagauguguuacucagugccucaacgccuuuucuuuuaaguccacaccccagaggccuagcagugaguacccacacgccuuuuccuaugugcagcugcccuagauguaguugauuuccagucguugcauccugcuuccuuacugggauuuugauuuuguugguucuuuuagcaucacacugagacuggcauugaccuaaccuaaccucuauaaucacuguagcauucuguaauguguauacacuggaauucacugccauuucugugggacaguuagaauaguucuacuuuucugccauuguaagcugggcugcauaaacauacauucuuuuugcuaaccuuggcauuuugcuuacaucuuuuuuccuucugaacagcuaagaggaaauguuuuaaaugucauggggggcgggggacguauuuucagauuguauccgccaagauuauggcagucuuuaauuuuuauacuuguuuugaauuuuugaaguacgguauguuuuccagggucacugaacugagauucaaaagccuugucuuccaguccuggcuauucugggagaagcugggcuaauucuaagcuguggaauucguaugaccuuggggggauuugagaagccugccaaguucuuucaaaucccuggaaacaugcagucuuggaauuguaucuguuucuuuguuaacucugagaggggagcccagagcucuggaaggcuggguauucugaggguagugcuuacuacacaggcaccugugguuggccaugucugcuccuuaugccucugugccuagaagugggaucagagcugugaaaggccaagagcagagggcuggcaaguauuucucaaaguuucuagagcuuuuuuucuagauuauuuaguuaacuagaacacgaggcguacagagcucacccaagugaagugugguaagcccuuggaggaucacugaccccucaaaguccccacggguacucacucaccugcccuucauucugccccaggugugccggcaugugaaaaauggggacauccuccuccugaaccgacagccuaccuugcacagacccuccauccaggcccaccgugcccgcauucugccugaagaaaaaguccuacgccuucacuaugccaacugcaaggccuacaaugcugacuuugauggagaugagaugaacgcccacuucccccagagugaguugggccgagcugaagccuauguccuggccugcacugaucagcaguaucuuguucccaagguaagucugacccuugagacugugccuuacucaucaccagcaugacuuggcguaccgagcuggaccuggcugguggguagcucuaggacaagaguguguggaauaggaggugcuagguuuuucagcucuuaaugucuaaaaucagagaaacauuuuugucuuguugugacuuuaaauguuagaagaaaaccuggggcagccauucuagagaaccagauucgguaguugaauaauagcauuuaguuccaaacuugcugcauucucuaacuugcugaucuggcaagcuuuagcaugcaugauacgaagacccacagaagacugauccuuuagcuaugaggauccuaaaucugggaguuuuuucguuugguugguuaguuuuauuuaguuauuauuauuguuacacacacucgcgugcgcacagacacacacacagauauaucaguuggggcuggguucucuuuauuuuguccaguugugguuuucuuugaugaggggugaaaggguauauggauaaguauuuagaauaccauuaagaauuagcuaauuuaaugacucaucagcagugguuuugccgugggugcaguacucccagguaguuagcuaggugucuaguaccagaugugaucucccuucucuugagugggcugugaguuacugccaggacacgagugccacuauugcaccucacagauaacuugcugugugggucacuguggucggucauaggcauuaaagcugaguagccuguugguugcuucccucccuggcaguuugcagaacuccuucugugaacacuagucaucagggaggaggcuuuugggucagaucuaggcccuaugccugaagugcaggaugccuuagcaauagggacuuuaauucaaccuuugggaggcagucaggaacagcaucugugguuuauauuugagggauggucucuuggccucccaugacaaacaacucagaagggaguuuuucaugccugcuuuuugcuaaauaagcuauggcauauggggggagcauugucagcccaagcaggguaacuucauuuaaguuauauauguaugugugcauacauauaggcuuaaauguaucguguaauuuuagauaaauaaaaaaauagugugauuccuuacggcuuuuucggguauccugucucucuuuccugcucuauugaucucacuuccccuaucuccaagccuaaauuuuaagaggcaacuuaaucccagggguccagacaagaucccccugcaguucacgaagaugucucuuugaaucccccuguuucuuuccaagguuguuccucgggcaaccucauguagucagagcuguaagugacauacgggaagaauauacgucccgcucuuccccuuggccagcugacauguuuacuuauauuucaggagucugagcuagugagugcuuaugggaggaacagagcaaagaaagccagagugaggcugagcguaaucuuccuuaccuguucaaaggacugcgcccuccucagacuggacaguuucuugccagugauuuagagcauuccuuuggaauguggugggaucugaagagacuagaaauagugauggaaaacacagguaccauuucccacgcguguuuuccaugccaggcacugcagagcgcuuuggcggcuucucauuucacccugcucacaaaccucagagcuaaguacugcuaaugucugcacuucacacucgaggaaugaaacuugccuaaggucacugaaguaggagggaggaaaagcagcuuccagguccuugugguguugacugugcucaagagagggacagcacggucccagggcauucgagaagccacccagcagugcccagcacagucugcuccuucgaucuucucucccacccacucugguguaucacuguggcuuuaccuggugccaguuuguacuuaacuucgcuuuuucugcccacauuaguaggccauugguuaccagaaagacagaaggaguucugagcccacuagaccauuugaaaauuagaaaacauaauuggcuaaugugaaaauugauucuuuaucuuuucauguaauaacaaagugaaaauaguaauaacaacaccagugguagugaucugaagccaucauauacugaccaggcaguuccaucaucccucccccagcaguuuguaaacauuuucaugcauacucuucacaguggccuuagaaauaggugccauuuacaggcaagaaacacuaagaaaguaaguugucagccagugaugagaccaagacucaaaccucagaguccuuagccacacuugaugguagggcuagaccugggccuggguggggcuuguggcagaacaugacaccaugucaaaaguuaagauucuggucaauuuuacuuaaucuuaagugccaaaaggcaaauccuuauuuuacuggugauugucaaauccagcauccuugguacaguguacuaagcugucagggaguacugaggcuaaccaggaagggacuuuuguucuuuccuuuucucucuguuggucauuuuucuccuuggacccagccuccguagacgggaguuugcucauuucuccuuugguuugugucucacuuuuaaagugccuuucccuguggucauacuauguacugaguagaguuuguguuguucucuuaauuaaaaucugagaugauuagaacuuuuaccuuuuuuuuuuuuuuuccauuuuuuauuagguauuuaacucauuuacauuuccaaugcuauaccaaaagucccccauauccacccacccccacuccccugcccacccacucccccuuuuuggcccugguguugcccuguacuggggcauauaaaguuugcaaguccaaugggccucucuuuccagugauggccgacuaggccaucuuuugaugaacuuuuaccuuuuuuauuuuuuauuuuaaggaaucaacugaauuuuucauuuauuuccuugaacaauauccuccuucuguuuuccugugcucacuaagggccaaaacuguggaaaguucuugaugaaacuuaagaugugguuuucugacuucuacauagcuagaaaauuacaaggcacaaagcacauuauucucugcgcagagauacugacuuuaaugugcuaggcuguguaagggcacuccuugaaggguggaaauucuguaguaccugcucccagagacuggaauagaccaaauguauaaucuuggcuuagguuucuccuccaagaaaaaaaaagaucauuuuuggaauaagaugugaagauuuuuuguuuuuauauuagguuaacuuuuuauuuaacuuuuuucauacaauauuuuuucaucauguucuuucucucaaacaaaacaaaaacuggaauaaagaucaaaacuaauaacacaaaauauacaaaagcaaaacaagcacacacacacacauggggucuguuuuguauugacagcuacuccuggacauggggccugccccacagugugguugauuuacucaguguuacuugggaagauaaucuuuucuuauuuauauuaguaacuugaagccuucauuaaaaaggccaaugugccaccugcuccugccuuacuuuuaaggcacuuuucagcccaucucuaacgacucugugagacuucauacaccgucauuacuguguuuggaccauuugacaagaauguuuauauucuggcucuuccaacaacugugaugugagguccuaagccccucguuaugaaccauggccguaauguggcagucagaagauaaugcucuuugagcuccauucucgauuuuaucucagauuccuguaaacaugggaacauuuuaagaaacuacuuacagaaugucaaugaguguagcuauuuuuacuuugauuugccuguguugccaugaacacagaccugacagauacgguccaggagaauagggauuacaaaggcugugaaaacgucaaaugaaauuaguguggccacugaacuugggauuuuuauaaaagcccauguuuuggccuuagguggguaauaccuucauuagaacucacccuaaagcacauggugugguuggaaaacacacuagugaagggcaucccuucccaauguagucaaacggcaccaaggccuuccccugguccugccugagcccaucaucacuaagguuucaucugcacugcugcucuccgaugcagugcaagcgccccuccugccacucucagaugcagcgugaucuccccuccacagucuccacugugccauccugcccuucucuuccgcgacauuuaaaacauguuguaguccuguguauguucaucucagcauuguuuccucgccggcuucuccugagcaggcuaaugaucugccuaaugcacacaguaggcucucaggaaauacuuguuagauggaugaaugauuuacagaaguacaaggccagaaaugugugacaaacacaaaagcauaaaaccaaacuguaaaaccaagaacacaacugacagcagcuugaccaaacguagacacaaaugccaaaaaucugccgaguaacuagaaccagaugugauuaaauaaagaaggccuguggaacuggaugaguuugaaacacauuugccguaagacagaaggcaguuggcaaauguugaggccaguaguaacuccgguccugugguuugugagguggucuguuucuaagugaggguguggagccgagaguuugggcuuuauccgaaagcucuugguagaguggccuccaagcagaugguuagaaaugaaugaauuugacuuuaaauuugucuuuauucucuucuuguccuuuugauuugcaggauggccagccauuggcaggacugauccaagaucacaugguuucaggugcaaacaugaccauucggggaugcuuuuucacccgggaacaguacauggaacugguguaccgagggcucacagacaaagugggacgcgugaagcucuuuccucccgccauccugaagcccuucccacuguggacaggaaaacagguaauugggagaaucgcagccaguguauaauuuaaaaggaaauaaaacucuuauauaacaguuucaaaacuguucuaagagauccuagaccagagacagaaaaaucucuaaucaugaaauaaugugauuuuucuuuuggguagaaaacucaaagguguaucuacuaagaacagguugcacggcuucuguuuauugacucuaacauaacuuggugucuaacuugauucaaauacagugcuaauggcaaugguguuacaccucuaauaauaaguuucagugggaaauacuaagggcuuuucugaguucuuuaaacuuguuuucuuagugcuuaaauucaaccuucucucuuuaggugauaauugcaaacuuaauguuaaauuacacauucaagguuauuagagaccgaauuggaauucaaacccaggauuuuauuagugccugaaguaaccauauaauaguauccauggaaaucaaguaauggaguacacuacaguauauucuucuacuguugccugaaccaccaaauucagcuucaaaagucuugucucuuuaucuauaaaaaguggguuugaauuagucucugcagccucuccuccaauucuguaauucucucuagucugugagccugugauuugacuaguuuuaguuguuaaguuuuaauuguuuuauaaaggucacuguaacaaaguacuuuaugugagggagagcuuacuguacaugagagguucagagcuugccauuuuggccacuugacuguugcuucuggaccuuuguguggugagucagaucauucugguagggagcaugugguagaacagagggacuccacgaggacaggagacagaaagagaaccaagaagcauggaagaaagagauagacccuucagaggcaugguccagaggcauacaccuucuacuauaauagccaguuagguaaacucgucaguggcuuagcccaccgaugguguuagcacucucaagauccaacuaccuuuuaggagccccuucagagacagagccuucaacaugagagcuuuugaaagaaugguucauauuuaaacuauuacagccguugaacugggcuugcuaauauuuuguuuagaauggauguuaccuuucucaccgcugugaugauauaccugacaugacaggaacucgaggaggcuggaggccgcauugcaugcacagucaugaagcagagagacagggaccuaacacugccgcucagcucacuuucacuuagacugggacagucccacauccagggaugacucuccucaguuaaacuguccuaggaauacccucagagacacacccagaguuguuuccacagugauucuaaaucccagcaagguuacaaugaagagucaccacaacuaaauguugacucuguguguguguguguguguguguguguguguguguguguguguguguguuucugcacaggugcuauggcacucauguaugccugguugucagguuuacacagcaaaugcuuuucccuacagccaucuugccggcuuccaaguacuuuuuuuguuuuuguuuuuguuuuuguuuuuuuguuuuguuuuguucuguuuuguuuguagaacaugauuuuaauauuuucaacuguuaauguucaacaaacaauaauuauuuuaagauauauuuuguuguuaugucucccuuuucaauacugauuuuauuaacuuggauacugucucuguguccucugguuagucuggcuaagugcuugucuaucuuguuauuuucucaaaaaaccagcuccugguuuuguuuauucuuuauauaguucuuuuuguuucuauuugauuucagcccugucuuugcuucuuuuuguucgagagcuuccaggugugcugucaagcugcuaguguaagcucuccaguuucuuuuugggggcacucagagcuaugaguuuuccucuuaacacugcuuucauugugucccauaaguuuugguacgaugugucuucauuuucauuaaauucuaaaaaaccuuucauuuuuuucauauuucuuccuugaccaaguuaucauugaguagagcguuguucagcuuucaugugaauguguguuuuccguuguuuuuguugguauuuaagaccagccuuaguccauggugaucugauagggugcaugggauuuuuucacucuuguaucuguugaggccuguuuugugaccaauuacauggucaauuuucccaaguaccuuuuaaacagauugugggaucuuggucucuuagggcguucucuccuucucaauguccuccccguuugucugucugucugccucuucuggcucgggaugugguaaaucugcuucuccucacuguccuugcccagcagcacccugaccaaaagcucucucguucacucuagauuucacucuagauuguuuuuauaaaugauuuauuaacuuuucuauuuuuuuaugauuauguaaaagugcagucuuuguauuuguccuuaauaaauuucacauuauuuuucacuguagaaauaauacaaaaauagaaguaauaauuagaaaaaaaagaaaagaaaaaaauuaguugcccaacagaaauacaaaaacauaaaagaaaaaauucccuucuucaccauguccguucucaauauacacauauaaucuuaccagaaauaaauaagaguggggucauacuauaguguccucagggcugcucagaacugaaccgugauuaaguuguacaguuuuuaaaaauccucauuuauauuuaguuuuuguauaugagcauuucaucugcauguaugucuguaaaucuugugcaugucuggugccuuuagaggccagaagauggugucagaccccaggaacugaaguuacuuagaguuaauagcccccuguaggugccaggaaccaagccuggaugcucuggaagagcagcagccugugauccuaaccacugagccaucucuuugcacccacucccauccccccuauuuuuguauccugcuauguaguccaggcuggcuuuaaacuugucaguccugccucagccuuccaagugccuggauuauaggcauacaccaccacacccaacuugacauucaguuuucaacauguauuuaaaaucaccccuucugcagacaucuggaaccugaagcaugcaccucuccacuuuuguuuaguugaggaggcugugagugagcucccacauccuucacagggagguuuguuuaucaguccuuuucuuaauccaguuuuuacuggauacuuguuuuauguuguauucaaccgcccacuccuuucaguugucacucuacuauuuauacauaauuaugguucaggggcacaguguggcauuuccauuugugaaugcaauguuuaaugaucagauauggauagcugaaaugucugcuaccuuaaguguuaacuauuucuucaugaugggagcuugcuaaguccucuguagcagcugucuugaauguacaguuauuggcauccagguauccugcagcucuguggagcgugagaguuacucaagccgcccccuuguaccuguuaaccacccucucugcagccccuucucagcuacucauagccucuuuucuacuuugugcuucucugaagucaacuuuagaacauaugcuaucugcuuccuggggugugaguauauuguaguaacaugugcuaucucccaggcucagcucuuguacaaauaagguuccauuguguuuaaugucugaguaguguuccccuguguaugccaccaccuggucuuggcuguuucguuauagaugaacggcuagcuugauucugcaccuucccuuuccgugggugugugccauguggcaugucugauuuacaugggaguucugcuucuaguguguuuggggaaauuucguguuuuccauaauuguuauauaugugagcguuucguuucucuuuucccugguucuagacaagucugcuuuuuaacauacuucacauaugacaaguuuacuuaaguguuuccguugccuaguuugcagacccaaacuuuucuuugauugcuuuguaacuuaaauucagcacccuugaugauacgggcgagcggguacugagucuguauguguagagcugccucugucucuucagccucuguauugucgagcucagugauaugaguauccccuaguugauuuaaguaucccucuauuuaauaccuaccucuuaauagguguuuaaauuuuuaauugguauucuuuuauuauuauuuuaacuagugcuauagucaguaucuguuucuuuauacucuaggauauuuucauggggauguauuuuauaucaguuucuggaaauuguuauccaaggauauuuacauuuugaaacuuguaaagaaauccauuugcuuuaaauuguuuuuaaagauuaaugcagauuagcauaaagcuacuuuacccucaugauaccuucuguggcugggcugagcuguggggaggaugagcccuguaaucaucgucugcucugaaagcaguguuaccugccuucuuuauuuuuauuucuuacucuuauguacacagguauuuugcuugcauguguaucuguauaccacauguaagcagugcuuucgggggccagaagagggcaucacauccccuagaacgggaguuaacgggcaguuagcugccuuguaggugcugcaaauugagcccagguucccuuuuaagaggggcaaguguucucaaccacugagccaccucuccagccccagaaccuguaauaccuguccauuugucccagcacugcucgcucucuggaggaauguacuuggcaacucuucccaggccggcccauuguccucgggacaccgccucccucugcagagccccugcuugagagagugugcgccucuccaggccuucuuucaacuacuguuugcugaugauagcccuucugguugacucaggaaagacacccugaccuuucaguacuaacauuaauucuaguuacaucaauuuaccuguggcacuuagcucuguaaaagcuuggugucagguuaugggcuuaucagucuuuuaucagugugacaccuguucuuuaaggcguucauuuaaggcuguguucagcauggagaccuggaauguauuuaaaguaaacgguacugucaggaguuaagucagaucaaucuuuuguguaaauacuuguuuucccaggauucauguuauaauccucacucgccgccgccccccaagauaguauugcagaaugaggcuuuugggaaauguuuaggucaugggagcaaugcccuugugagucuucuaaguacuccauccgcaaagucaagacagaguaagaagucuucauuuaugagcuagaaagcauggugcuccccagacucugagucugcccccacaacuauaagagauacauuccuauucauguccugggcuggucagggcauuuggguauagucgucagauacuuuccuuccauucagcuaagccuuuccacucacccuucagucccuugcccuaaaaugcaugaucuugucugacugcccuggcuggcugaggccuuccauggccaucuuacuaaaacagccgugcccucguacacucugcucuuacuuuuccuugaucuguuuccuccaaagcaggauccucgaggaaucgaggcuccaaggagcacuauucucuccccagugccugccucauaguaaacacaggguagauaauugccagggaguggaugcaucuugucugcaggcugugaacaagcaaugcugggucccucagugcuccucagugcgugaccaauaccaggcaccccaucccugaugucucacuccgggucucucucagaugcuuaggccucccguggggagcugagcgccuuagguaguuuuaaugucuuugccucgagaauacaagcucugugcagguaggaagucauuaaacuugguagugauuguccccuacuugaggaugacugaagagugugucucagcuuucccuccaggcagguagggaggcuuagaagccucaccaucucucucagcuucucucagcuuugugaagucuucauuuuuguuauuuuaccacauuaucugauauuugcuuuaaccccaaagcaauuucuauuuuuccucuccuuccuuugaccuauucagaaauugaaugcaagucauagagauugcucacuuuaggauaaaguguuuuccccuaguugcucugcuuggucucauacugacuuuggcaauauguucuaauuuucuggcucauucuguuuucaccugggucuagcuuggccucucuucaacaugucucaguaaagcuuccaguaaaaguaccuccuccuccuccuccucuuccuccuccuccuccucccccuugcccccuccuccuccuccccucuguccugcuucccucuuacaaugccucucuuuccucucugugugagaguuaggcaucuguucugccaaucuuucaucgcuuugcuucucaauuagacaucacuuucaaaaaugaguucuuccuucuacaaacuaacuuuaccuucauuguuaggauuaaaggugugugcugagguugugucuguauuccagccagagggaugaaaggugugugcuaaggacugagucacaccacaacuagaauguuagugaauaacacaaucuugggguucacugugugaucagauauccuucaacaaugaugcuuucauguauguuaguguauuugggggggacuugucuaucagaggaccuguuugccuuacugugccuugagagcaugagagacugcauccugaggugacaauccuuccccuuccagcauauuguccuucuuuuucccagguugugucgacccuccucauaaacauaauuccagaggacuacgccccccugaacuuaucuggaaaggcaaaaauuggcagcaaagccugggugaaggaaaagccacggccuaucccugacuuugacccggacuccaugugugagucccagguauggcugcccuuucuaaagugaaucucuguuccuggagguaggcagaugaacuugaaaaaacaaguucaaaaacugaugcugugccucagaagacaaguugucuuuccgauguggucggggcugcccucugcccucuggcucucauaugaaacgccugcugauuugggaaggcuuccuaaagcuggugcugauaccucaguguuuacagcacagaacuugcucuguccuucaagaccccugagagaugugacuuagccaaaugcugugagguucucauucccaccuccagacauucagaaccaggcuuagaggaggccaauguggucacccuccauuacuucaccccugugagagcacacucccaccaaagacuaccaaggccucugcgugcucgugguaagcgagcaucucaggucugcugcuggcuguauuuuuaacagggccugcucuccucuaccucccucuucccucuuucuauucaugggguguugguuauugaacccaggauccccugaacgcuuagcaugaacucuaccagugaaccccacccccacccugugucagaugcccuaugcagaccuggagcagccacuguuuuucccuguauagaucauccacuuacugugugcaguuaaaaacuuagccaguguguauuugucucccccaucuaaaguguguauuaguuucauauauucccuucuacuuucccugaaggauuugaggcaggucacaguaaagggacauaaacaauaaaacuaaauaguacuuggcuuauauggguagcuccuauaagagaugaccccugcagcccggcuuuggugacccuucccuacacaggugaucaucagggaaggagagcugcucugcggagugcuggacaaggcacacuaugggagcucugccuacggccugguccacugcugcuaugagaucuaugggggugagaccagcggcaggguucucaccugccuagcccgccucuucacugccuaccuccagcucuauagagguuucaccuuggguaaguacccugcuuguggcccuggcucuguucaccuuacaggauggcaccuaggcaguuuucuuggucgauguuuaggcucuugccaucagugcuauccacugacuuugcacagccagugcuccuuucccuccagcagugcaaagcaacccucccauccccguucugucccuucaacccacucguuaugauagcauaaacuccugcacccaacucacaagugaaagccagaccuaaccaacagccgugcuugaagcucuucuagcccagggcacagacaggaaugguucagugcacuggugaccuaugugccaaggguugacagagcaagcaaggccaugcuaggagggaggagaguuugggggagggcugccuaauuggcagagaucaucauuacagggauggccuggaugcgaccucaugcagggucugcuuuuaugcuuuuggcuuccacggaaaggaaucaucuccuccucuuccugcuugcauagagucuucagaagccucagauuuccagcuacuguaaugggacuuccagauguuugcucuugcucuuaaacagucaguuguugccuucccacucagaucucuuaagucuggcauucuuguguagaaacaaaacauuguuggguugaaaagaaauuacuguacuugacguggaugcgugcuugcaugcaugcauacagcuguagaucggguuccugggauacucacugucagccucucuucuacugcugaacagccaaaaucucuagccauuucaucccacauauauuuauuggauguagccagcagagcuucuggcuaaaaagcagaaguuugaaacuuaagccucggcuuucuucuguguaucucaguuuugagcccuaauuguaucacuuacgaaagagaaguuguaguguuuaggccuccaugagcauucauuaguguuaauauagcuguuccagaguuucucuuaccuguagcucucaacuuugggucaaagcaucaccaaguuuacuagccagugcaacauuaggccugggcccuguugaucuucucuguuugacuuugcagguguagaagacauuuugguuaagccaaaugcagauguggugagacagcguaucauugaagaaucuacccaguguggaccccagguaaagaggaggacugggaggcuguggucugcuguccaccuuacagaauaaaaccacgcccuccuuuggcuagagcuuccuguuccuuucuucguucuaggcugucaaggcugcauugagccugccagaaacugcaucaugugaugaaauccaagggaaauggcaggaugcccaucugagcaaagaccagagggauuuuaacaugauugauaugaaguucaaggaggaagugaaccauuacagcaaugagauuaacaagguuagccuggccauacagugcacaaauccccaucuuuuugaaugcugauuucuguugguuugcuuuuaauuacauuugauucucacccugagccuuuuagaucagcccaacuaggugaaguuugaaguuggguagguagaauccgucuuugugaagagcucacacagagucugggaaggccuugguuucaugcaaaagaggaacgcuuugagcagcauuucuaaauguguuuccuuugaaguugcugcauuaaaggggcugaagaaagaagccugccuguagaaccacuccacuguagguagauguacagaaugaaaggcagaagucucugaugcuugugcagcagcaccaagggaaugccuggccuccuguuguacuugguccuugcugugugaccuuaaggaagucgugugccugggcacugaguuguucucaccgagaagcaggcgugugaggaugcugagccccuccucuggcaguccuggaggagaugggacucugcaugggucaaggucacaugugcucucccugugcuccagagccuggacuccccgucuugugguuuggaggagccaccagccaggagucuguccugagcaaagcaagaacgaggcuacuacucagcaucagucugucuguggauccucucccugauguucaguugguggccuagagaacagcucuccucaguagaaaguuguauucaagccgggcgugguggugcacgccuuuaaucccagcacucaggaggcagaggcaggcggauuucugaguucgaggccagccuggucugcagagugaguuccaggacagccagggcuauacagagaaacccugucucgaaaccccccccccaaaaagaaaguuuuauucagaggagccuuagcacugccugggaaagcaggagccuugcccuccagagcugacagcacaucuuagaauagauucuugucccguggcucacuuccugcccaggcucugccgcuccugugcagaguugggugucuagaucuccagacaaaggcugaaacagauucagaacccaugucauugucccccaggaucucccugugggcuuccucacuucugcuggcuuuuugcugaggcaaggcucccaacccagugcuugguguugugcuggugaguguggacauugguaaaaugcuggcucuuuggggaagcaaauggugcuuuccugugcugauucauuaguaccguaccuuagauuuuauucuuuguuuacauuuuuuuauuaucuuauuuuauauucauugauguuuugccgacauguucugugugaaagugucagauccccuggaacuggaguuacaagcagcugugaacugccguauaggugcugggaacugaaccugaguccucuggaauaacagccagugcucuuaaccacugaacuaucuuuccagcccagauuuuauucuuaucagugucuuaucuagucacuguucuauugcugugaagagacaccaugacauguaaggcagcucuuauaaaggaaagcauauaauugugggcuugcuuacauuuucagugguuaguccguugucaugacagggagcaugguggcacgcaggagucaugguacuggagauguagcugagaguucuacauccugauccauaggcagaggcuuuugaaaccuccagugacacauuuccucuaacaaggauccucugauccuuuaagauagugucacuccauggugaugagucucugggcuauucuuauucaaaccauaucuagagccucccaguugcauuugccagcuccccacccccaacccuccccugcuucccagccauuuauguuuccuuauuuggugagguuugaccagugaauggaaccuggggcuccugugaguguggcagaggcaggacacaucuauaggcuuuagugaaaggauaauccagauaaggcuuuccuuugucuuaaaugcaguucacucuucucucuggcuuuauugguuuugugucauaguuuuaccuucugaaugugggauuucaaaaaagaugaagucgcugaccaauguguugauuuaauccacaggcauguaugccucuuggcuugcacagacaguuccccgaaaacaaccugcagaugauggugcagucaggagccaaagggucaaccgugaacacgaugcaaguaugaacaaaaguagcucagccaguuugccggaggggugggcugaugucaggagucagcuuucagguuuauuucugcuuuuaaaacaucuccaguccauguaaaauauaacuaacaagacuagaaagcccugaagcauauaguagucagugcaggugcuaaccacugucaggacucagacagagcugauggaaguaugcaauuagauuacauaccauaugagguguauuauaacaacaggcauuggucuguuuauauaugcauguuauaucugcacaucauccgucuauguagaguuucagugaaaaccuugauguugaaauaaggagaugccucaaucacugaagugcuugcuucacaagcccaaggaccugcgcucagggcuccagaauccacgcaaaaagcugggcauggcaguugauguaguccccuugugggugggguaggcagauccccaaaggucaugcuggucagccaugcuaaccaaaaugaugaguuucagguucagugaaagacccuguuucaaaacaugaaggugaagagagauuaaggaaauaccuagugucaaccacuggccuucacaauuacacacaugaauucaaacacacacacacacacacacacacacacacacacacacaccacacagaaucuuacaauguuguaugacuacugcuuucauuuacacuguaagcauuguucuaaggaucauuuaccucuugagucucauuauugucccagaguuccuuggugcuauggagacauuuucacagaucuuagugucuguuuugauguggggugguuguuguuguuguuuucaguccuugggggucucuuagagaguaugcaccauccuuaggugagugccaagacaguguggacgagaggcugagcagaugagugggcugacuucucucuggcucugggauuauuguccccucuggacuccauccauauccccauuggaacccuuucuuagaguuuuuauuguugggauuagcaccgagagcuugaggaggaauugauuuccucuuacaacuccaugacuaagggaacucagaacagaaacucaaggcaggaccuggagcagaagccauggaggagcauugcuuccuuuuauuacaacucagggccaccugccagggguggcacugcccccaauaagcuggcccacccacauuaaccauuaacaaagaaaaugcacuacaggccuacuuccaagcagccugauagaaacauucucucaacugaaguuccucuucccagauaauucuagcuuauguaaaguuauuuaaaacaaacaaacaaacaaacaaacaaaaacaagcccaagcaggacaaacuucaaggcacucccagguauaccauggugacucuaagucacaguuucuuuucuaggcaucgccuguccucaagugggagggggggaaagccagagccaacuuuuccuuggaauguucuucuuuggcuuguauaagcaucuagguuggccuucaggucugacaccauuuccaaaugcuuucccugagggaaagcuggaaguccugcuuggacagagugucacucagcacucaaaccuugugugucguuuguguuuuguuuucccagaucucuugccugcugggccaaauugaauuggaaggucggagacccccacugauggcgucuggcaagucacugcccugcuuugagccuuacgaguucacccccagggcugguggcuuugucacuggaagguuucuuaccgguaucaggccuccuguauguauauuuuuggcauuuucccucagcucuaugccuaguaguggugacuuguggccucauuaguaauaguacaagaacaaccaaguagaaaacguuaaaggcauaccugccagaccacauggagaugcccacugugauacuagggccagcaaagugcuuacaguaggcaugugaucauguuaguaguaaaaugaaaagauugagccuguuguguuggcucaugcuguaaucccaguacuugcucaagagagaauugucauguuugacuccauccaaagcugcguagcaaguccucaugccucaaaaaaaaaaaaaagaaagaaagaaagaaagaaagaaagaaagaaagaaagaaagaaaaacaugaaaagacaagauagaucuuggucucacccuuucuguaacguagccucucuaaaccaguucuuagcugcuucggaagcagccaaaagugggaguaucagucacuaaggugcuuaugucacugaaaggagcgugguaaagauugauuucaugagguccccauuuucuguugucuccccucacuccaucauaguggggcaucuguagcaaguauauguuauuagacgcguucucacgaccggccaggaagaacaccacagaccagaaucuucugcggcaaagcuuuauucuuacaucuucaggaaaagagagcaagaagcaagagagcgaagcaagagagagaagccagagagcgaagcaagagagagagagaacgaaaaccccgucccucuuaaggagcauucuccuucgccucggacgugucacuccuugauuggcugcagcccaucggccgaguugacgucacggggaaggcagagcacaaguagucauaagauacccuuggcacaugcgcagauuauuuguuuaccacuuagaacacaggaugucagcgccaucuuguaacggcgaaugugggggcggcucccaacaucucccccuuuuucuuuuaauaagagcaaauaggccacccauauuaaugagaguggagauagaggucaaauccccaguguguagguaaaggagccauguacaggauuagcucuuaggcuuacaggcuuuuacccagagcaacccugaccugcucccgugucguuuugccugggggaagggaacuaggacacugaaccuucaugaaagaugacaugucucccuagaauaggcucauauaugccgcagagccuuuccauugcagugcuuagccuugcaacucucucgggcugcugaagcacacucacucuaucccgugcaaugagucuagccucaugggauauaagagcugaguggccagcgaccuauugccuaagcauagauaaccauauaucagggggagcuccauguucuaguccugcaagcgccugggcaauaaccaccuugucucuccuaguuuaggccuuaagcuuacagaccaaucaaagaagcaacacuaauccacagcaaaguguaucuccaaauaauauuaaucccacccauuuuuuaaagaaagaaaaugcugaggagauccaauuggguaauccuuuggucagggacagguccaagcgcguggaguugaccugaagucucaauucccgaaggaucuguuuaaauucagccauccaauucuguaacauauacugaaaaagacuuuuugacaaauuagcugcccuaguaaauuuaacauacugaauggaaauaacacacaaucccggaaacuuuuguucacaucccugcugaguuauuugucauaauacaucuaguuguaucuggacaagaucuaugaguugauuaaccagcaugagaccucucuguaucuugacauuagcugaggccuguucaucuaugacuguagucacugaggcugacaaaguguuaauggugucagucaucuggaccuguccagacagagccaaggcugucugaauuaaggccaaacccaguuccuaguuagugguaaaaaagcaggagaauacuugagcauuauacaucaccgucauugggaguggaaaugucgacauuaucccccaacgcugcucucucuuuauuauugacgcccuggacaucaccaagacgagggacauuaguauucccuuggucagucuggauuuuucgggugagucuuucugguacccaaaauggguugucuucauucugugggaaaacacagauagcuccccuggaucuuaucaagauaggauccgggccauaccauuuauuaucaaggacauuuuuccauuuaaccaucucauugggccuaucuggcucugaacaaugacguucagccgcaguauggccaugagcaucaauauuuaaaaaauuaaguguaaagagugccaaagacaccgacacucuuggugcucgggguacagucuccucaaaaguuccccucuucuguuuuauaagauaggcuuugagggugcgaugcgcacgcucaacaauacccuguccuugaggguuguauggaaguccagucaguuggguuacguccaucugacggcagaacugcugaaauuuuugagacguauaagcugguccauuaucagucuuaaggagucuggguuucccccaagcacuccaugccucaagacaauguugaaucacaugugaggccuuuucuccgguuaacggagaggcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuauuaugaaaauuucuugcagccucuaccggggaugauagggcagcagccaccacuuuaguggccuuaucugccaaaucauuucccagagccauggggccagguaggccugaaugggcucuaacaugaguaauauaaacaggagaucuucuagauaacaaaacuaauuguaucugcugaaaaauauuggcaacucuacuggaaggcuuaaucacuccagccacuucuaaaagauuuacugcauuuaccacauaacaggaaucugacacaauauuaagggguuuuaaaaagguuuuuaaaacuucuaagaccacuaaacauucuaccacuugaggugaauuuucauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacuguaagauuggauguuuuggauaaugguuaucuauuuuuccugaaaaggagguaacuaaaacugcccaaucauuagaugcggcugccaagguuugaaccugugcagcgguauaagguacaauuaaaagauauggacuuugcccaaagugggugauugcugcuuuuaggccuuuaagggcaagcugugcaauugcaucaggauaccaaucuauuauuuuagcuggggauacguuuggauggauccacaacaauggcccauucugccacaaaacugcaguuggcaauugugcugucuuaaagacacacaaacugaaaggcugcgaauccucaauacguuguaauugugcauucuguaaggcuuuuuccacuuuuuguaaggccugguuagcagcuagaguaagaguccuaggggaggagauaugaggaucuccuucuaaaauacuaaacaaaggccuuaacucagcggaaggaaucuuuaaaaaaggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggaccuuuucuguggcuaucuguagaccccacugacuuaaaguuuuaaguagaaaaggauaugccuuuuguagcaugguaaggucuuuauggcacaggaggaugucauccauguaaaggagcaaaauuaaagaggggaacuguuuccucacuggcaaaagagcuucuugcacauaaaguuggcacauuguaggacuauuggacauucccugugguaagaccuuccauugauaccucuuaucagguucagcagaauaagcucucugacccguuaacaagucaaaaguccaaucucucugcucuggaguuaaagcagcagcguuugcucgguccugcgccugugccgccuccugccacagagcucgccauuccacacacuugcccauaccagggagagcggccuccgcaaucauuugccagucggcaggagucagugccacgccggcaagccuguccaacugcaccaaggcaaaaccagcacugauuccacauuuacggaccgacucggcaaguuccccaaucugcacauauucuaccggagcguggacacgcccacccucggcuccuucaaagacuggaaaugccugcuguauuuucccccgcuccucucggggaaugaaugagucugcgcacugccucucugcgcacugccucucugcgcauugcugacgcacuacgggcugacgcacuacgcagggcggggacuccgcauagggcgggagugcaccugguagccgauugcccugaggccaauuagcaaacuggccuucgccagccgcuuuuggcuuuuuucuugaccgauuagcuggcugguaaugggcugcuucuuccucccagucuguuuccucagaggaggauucuucaucugcuucagagcuacuaagagcuggcuuccugagcucaucuagugacgaguaucuccuagagaccuccgcuaaucgaucuuuuuucuucucccuuuuuccucuuuuucuucuaaucucucuccagguauuccuaccuaaccuuaacuuuuccucggguucaagacccuuggaaaggccuguauacuuauuuugugaaccauauuuucucuuuguuccuacucuuucuucccgcuuuacuucugauagcuuguccugaauuuccucuagaauuuucagcccuaucuuaaccacuauauaacaugugaaaaggaacaaaagggcuucuaacacuagaaaaaauucaaggccaaacauaacuuguaaagccauuuuccacuuuacuucugauagacugucuugaauuuccuuagaaaguucaagaucagacuuaccucguuccccagcugaaaaguucugaauucauacaguugaauccuucuuaacagucugcuuuacgggaaccuuuaucaccgucguuccccagcugaugaguucugaauucggcaguugaauccuucucaacagucuguguuacgggaaccuuauaaccuugauucgcaguucugguucuggaaugaaguaucccuccugcgccaguccggaguuuuuucucgucccggauuuucucgucccggaauucggcaccaauuguuauuagacgcguucucacgaccggccaggaagaacaccacagaccagaaucuucugcggcaaagcuuuauucuuacaucuucaggaaaagagagcaagaagcaagagagcgaagcaagagagagaagccagagagcgaagcaagagagagagagaacgaaaaccccgucccucuuaaggagcauucuccuucgccucggacgugucacuccuugauuggcugcagcccaucggccgaguugacgucacggggaaggcagagcacaaguagucauaagauacccuuggcacaugcgcagauuauuuguuuaccacuuagaacacaggaugucagcgccaucuuguaacggcgaaugugggggcggcucccaacaaguauauagcuuugcuucagcaaauacaguuuucccccuaauggaauccccuuuugggugucagucccuugguuucaugggguugugcacauguugcacaugguguugugagagguugccgagucuggagugaaggguuguaaggcugcugaugcucuagagaccccaccauuggccccacacagcauuuccaagaucauccacagccuauaggcaagaaauacuaguggguuuaugucgaauguuucaaacucugacacacaccuuugaguauaucaaaaaaucccugagcuggacugugaacuaccauauagcucucgacuguaaucccaauuagucaggagccugaggcaggaggaucacaaguucaaagcuagcuuagaugacauaugaagacuuuaucccaaaacuaaacagaaaaguuuagggaauauuugagcuacaggauccaggucugggauuugcaggacagcggugaacuccagcauugcuucucacugcagaguggcauacaguguccucaggaugcaugagggagugcacuuagggcuucugacuccuguugcuuuugauccacgugucccuccgccucaggcaggaagagagcgaucccagggcaucacaagucuuuaggagcuauugggguuaugaaagccaggauucuagaaucuaggaaaugaacaaucugcauggcuaggagagggugcauaaggugacccugcaugguacucacugccacaucgggcucccacuuuccucauaggaguucuucuuccacugcauggcaggacgagaaggccugguggacacugcugucaaaaccagccguucuggcuaucuccaaagguaaaaaacaaaguaccucggauagguggguuaguaucccaagacccugaaccuguuguguacauucuuuagaugauauaaucucuuuucaaugucuucaugugugcccugagacagaaaauagcacagaguguuucuguaucacugguagagcaugccuucagagguuuacacaguaagcccugcguucuacaggucuucuaggugugccuuaccugugagcugcauaugccucaaaauaucugaacacaacccaacauagaauuguaaccccucaucaaagauuaugggguucuuuuugcauauauaaaacucgguuacacagucauuaggggugaacuuuguagaugacaacauagugaauaauaaccagagguuggacaugccuggauggcaguggugaguucguucuuugucagagaggucggcaaccugggauagguacagaguaaccugcuaaggugucccugucaccuggaggucaucagccaagaccuuuucuuuccucucuguuaggaaaagaaacagucuuguaccuagccucauuggguagacggaaggaucugagcccaaagaauguacacuagugggaauaaugauaagaaaccgaggggaugcagacccaggccucuccagcugcgauauggagcgugugggcagagugacaggagcccaguuccuuccugacuuccccuugaagcucugcccaccgguuaaugcuuugacauuucuucugagcucagacuuaccauguuguguucacuuccuccuugacuccauggcaucaguguagggaggacaagaguugagggcacuccugagugaucuguugguaagaagaccaucuggagcuggcagggcacaagccccuuucuucccaggagccuggguuaccugagcuuugugugagcagagguuagaccuccauucccccuaaauuguucaagaaucuuaaguguagcaucagaaaagcugggaagcacaugaugggugagcuccgcaugguaggacccaagugugggaauccauagaaagaagacuauaggaggcuguuggggucucuggcugagcagaagaacagcagcaaagcucuguaccuugcagaauucaccugccaguggggagcugaggcaggaggaggcacagcacaggcuucagguggguaaguggagaaggcacagaacugcucacucaaguuuucaggccucagaggcagcacagcacaguugacaggaaacagaauacuguagcagcgggaggauacggcuggcugcgguuugauaggaggcgguucaaaguagaugugucagugggccauuagcgauaagaucugaagcucagagaagcagucuagagacauggacaugaggggcagcuguuaggcccucuaaggccaacauagcagcaggccaaagacugacaucaccaccaccacccuguguggggaaaggagaguugguguuugccaccagcuugccgggcucugagucaaacaucauggaagugguagauagaacugagcucuacucucccagcuuggguuggaaaacagggucuuaggaaacugcaguagccguugaguugugaccaagacagaaagcaaaggugggugaaggagccagcuaccauagaggacuggagacaaaggucuuuagguaggggcaucaugucagcauuuaguuccuggugcugcccuuuugcuuggcagucugcacugacuguuuaagaauucuuccuucucuucccuucuuugccugccugugauucuaaggaugcuggcugguuccuuagagcuccgagaugcagcagagcaaacaacggggagcagccauaucagcugagcuaaauaggaaaccuggccuugggaguguggcagccagaccacugaggugcucucuuccuggaaaacgggcaggaauuguagccucuggauguuagagccauggccuggagcacuagaagugguccaucauagaguuucuccuggagcauugguccccuuccuuccccucaucgccgcccugggagguguuuuccaugggcacugagcagggaguuuccuuacagguguaucaucaagcaccuggaggggcuggucauccaguacgaucugacgguccgugacagcgauggcagcgugguccaguuccuguauggggaggacggccuggacauccccaagacacaguuccuacagcccaagcaguuccccuuucuggccggcaauuaugagguaaugucaguagucaagggcgauagcugcggcccugccacuccaucuaugugaccauugagaaaagccagaaauuuuguaaagccccaaccaauguccaaaagcauuugauauuuucagagcuccuccuuagacucugaccacacaaggucauggcaacacaugaguaucuguggaauaauagcugccuuuggggagugggaguacugggccuuaaacugaaacacacagcaagucuggguuccuccuuggugcaguugagggcuauagcagccuucugcccaguuuuaucuaaagcaacuaaaugcugaagcuaugauagccaacuggugggaggugggcagggguuugaacacaggccugccuuacacgugucuguaacuuguguauuucuuuguuguuguuguugaguuuuuuguuuuuguuuuuucaagacaggguuucucuguauagcccuggcuguccuagaacucacucuguagaccauaauggccguggacugagcaguuaccguuuucagccugggaaagugaaaccaccaugagcugcccaggacuuaguucugauagaagaauuaagcucucacuccuggcuggggccucgccuuacgugcaccugucccaguacccuggccaucuuucccucuuucccucuuccugcucuuaaugagcugaucucucuccuaacggugaaggcuuuauucacaggguguuuguuccuuccaggcagugaucuggggacucuuaaugcaccuugggucacuugacgucuuaucaugugguccauuuuuaugccgucaucuugcuuguaugguuuguuuguuuaggugauaaugaaauccaagcaucuucaugaaguuuuauccagagcagauccccagaaagugcucggccacaucaaagccauuaaaaaauggcaucacaagcauuccggugcccugcugaggaaaggcgccuuccucaguuuuucccagaagauccaggcagcugugaaagcuuugaaccuaaagggcaguauccagaauggccgcagccccgagacccagcagguaacguggggagacuguguccacagugccuagcguguccgggccuccgacagaggaaggauaagagcugcucccuaauugagugauagcagcccagacgccagugguggccaugugagacuaugacuaggagacucauuaaacguaggaguaggccuugaaggaguacucgggcucugauggucagaaaagcucagagagaccaguccuagaaguggagagggcaucugugagcagagcucuggauagagaccugggagagacaaggccagcguggguuugggagagaagugcuaacuagcauuuaguagucaccucacucugagugucaugauugccugggacaggucuuugccucuuauaccauagucaugaacacuguccauuugauuccagaggaaccuuaauuggacaguaaauaaugaugccaugccccugcuaugcuuuggacaggccaaggugaauugcccaaagcauccuggucagcaccaugccaugggacagacucugucccuguuuuaaguguugagcugguucuuaggucaucacggccaaccagguuccugcucgcgcuuccccugcucuccuccagagccggugccuggaguuggagaugccugucccggugccuucccaccuagcuaagacacggcuugcugucuguucagauguuacagaugugguaugacuuggaugaagagagccgauggaaauaccagaagagggcugccccuugucccgacccuagccuuucuguguggcgcccagacaucuacuuugcaucugugucugaaacauuugaaaagaagauugaugacuucagucaggaaugggcagcucaagcagagaggaguuacaagaaaucagagcuuucccucgacaggugagauuauugaccugugacagggugugugagccuccaggccaggccaggagaggaaggcaggcagccuucaccugcgacccagaaggucugcuuugccuucagaagcauagagaagagcuuacauaggcacacagcucuauggcuuccuccacgugugcugccucacacucaguuguucauacacaucccggguugcugagugagccccuuccauggaagauaauggugguugcuaaugggccagccaccugggaaagaugguuaguacauuacagaguugugcagugcagacccugcauaauacgggugugauuuacacaagcagaugcacuccccuaccucugagugcuugguaaaccucaaccuauuuccaguggguacaguggaaguggaaaccaaacuucucuugcuggucggggagggaaugugaauggucacaaaguaacuacugcucagagggccuuugucacuggccuggcaagggcauaugauguucuugugacaaacaaggaaccagcuagggcucuguguucccgguuucuaguguaguggauagccuaacacuugcuccugauuccugcuguuguccccuaugucuccaggcugagaaccuuacugcagcugaaguggcagcgcucacugugugacccaggcgaggcuguuggccuccuggcugcccagagcaucggagagcccuccacacagaugacacugaacaccuuccacuuugcaggcagaggcgagaugaacgucacccugggcauuccaagguauaagggcacaaggaggcauacugcagcugugccaucugcucuaauauuccugggcaaggacucaucuuaugagagggacaaggaacagggcuagugagcaagagaucucuaaguauggauucuugagcauauuuggagccagagugguuucuguggcuagaucuuguaggguuucuguguauccuucugccacaucaucagguuaccagaaauaccugugagaccucacacacaagaguaugguucauuccaacacagugccaccuguuugcccagcuucaggagugucauucuuguggccaugacccuuuagguacauagccauacacugcaguguggugacugcuggggaaguggaaaacauggacccacccugcuggcauuccuccaugcacauuccacucucuggcagaucgaugcuggauagcuuccccaacuccucaaccugagaguucgcuccagugacugcagaagagaggcugagcccacuaggcugcuguugggauggcagggcucaguaagagugcugaaggcuucuaguuuacucuuuccuccgucucucauuugcuaagcucucuguaagugccugcugacugcagggaguggugaaaggaagcgagcuguagcuguaacugcacaugaggagcugguccugcaggaaccuggcaggaccagaguugugacugguagggcauauuccucugucauaccccgaucaagaaaaucagguuaccucugaucagauguguccuuauucuuugucagauugagggagauucucaugguggccagugccaacaucaaaacgcccaugaugagugugccuguguucgacaccaagaaagcauugaagaaagugaagagucuaaagaagaggcucaccagagugugccugggggagguaacugucucucauacuugauuacacgcuggguggagaccugauccugccuccuccuaccccaacagagcagucuacuggcaucuuaguuccagacuccuaccaggagacagacagucucugccaagugcuagacaggguuagaucaagaagcuuuuaagauaauuguuaguucccuagcauuugccuggagaaugcgguaagaaugcuuccuggguuaacuuagcaaacaccagggcuguucacuugagcauaccgcaaggcauucaugcaggcagagcuuacuagggugucugcaguuuggggcuguggcccccucagacuuuugauaccgugugauccacuugcuaugcacaaucaucuggggggcugagcaagucagauucucuguguucauucaucugguucuagguauugcagaaaguugacauccaggaguccuucuguaugggagaaaaacggaauaaguuccagguguaugagcuccgguuucaguuccugccacaugcauauuaccagcaggagaagugccugagacccgaggacaucuugcacuucauggaaaccaggucaggacucagcuguguuugucuuugacuuugagccauggagcacuccuggcaggagccacaaaggauguguuucagaggacaguaggccccaccaccuaauauggaucccucaccccaaucuggccuguaagugggacccuucuuagccauuuaucguugccucggccuguccuggacggacgaguucucuccugguuaugggauuaggguuugaaaggaccuguacaggaagcaagggagccucgucacaguggugccucuguggcuccauccaacacgcagcagaaagugggacucugugguuucagccuauaaugugguuccucguucacaucuugucagcugauagggagcccguggcaugucgucuccacaccacuguauaaacggauucucacuguaggaauucuggcuucucucugcuagcacuguguaaacggauucucacuguaggaauucuggcuucucugcuaacacuguguaaacggauucucacuguaggaauucuggucucucugcuagcacuguguaagcggauucucacuguaggaauucuggucucucugcuagcacuguguaagcggauucucacuguaggaauucuggucucucugcuaacacuguguaagcggauucucacuguaggaauucugguuucucugcuagcacuguguaaacggauucucacuguaggaauucuggucucucugcuagcacuguguaagcggauucucacuguaggaauucuggucucucugcuaacacuguguaagcggauucucacuguaggaauucugguuucucugcuagcacuguguaagcggauucucacuguaggaauucugguuucucucugcuagggagagugaacuuccuuuuucucucaaguugggguuacuggguuugguuaagcauaggccagaaugaugagggugcaagauccgaaguguggcaagauuggccaaagcacuugauuugcccagugauggugaggcagagugggaggacacuggcagaguguggaaccguuuuggcggguuggcucucacaugcaagaauguggaccaggacgccugaaucuaauaauuucagaaaagaaaggcuugccuccugcugcugucuugagacaugcuuuugcuuugggugagcagaaggggagagaaggucaguguccaagcagcagcagcugguaaauauacauuuaauacauuuaagcaaaaggagauuccaucauugacaggauuuggcuguuugccccugaccacugccuuuuauguagacaggaccccaggucuccccagagcugcuaacuuguagagaccaggacaauaagauggcucagugggugaaggcaaugccaccaagccuaacacccgaucucuaggaccucauaguggaaggagggcacugccccucggaaguugucuguccucugagcucugugugcacauuggcaggcucacacacagauccagagaaagaaguccugcuccagccauugcuuuugugccgugcuuacaucacagccuccguguaucugugcccauugcuuguguuguuccuuccuaugcucugggacacugggcagagugacagcacagaacaggcuccagcccgccagcuuguuaacuaacagagacgaucagggcccccacauacaguggguguuugugcuggccgcaaaguucucuucugagaagugggacucagagcccacagggccugauugagaggaggcggaguugacagcuugccccauuucucuucacccuggaagcuuuagcugcuaagcaggaagggcaugagggacaugccagcugagcguggaguucugucuaccuuauggaagaaaaaaaagauauuucuauuauuuuaaugauggguguaugugugcuguaugcagguggccauagaggccagagaugucaggucucccuggugcuggaguuguaggcaguugugaaccacccaacauagguugugggaacucaggucuuuaaagagcaguaaggccucuugaccacugagccaucucuccaaccucugaaccacuuuuguuguuguuguugcuucuuacaagugacaacccuggcuuguucccagcaguguaguaccuuuucagcuccuggguguauuuugcuuguccacuugaaaagcugugauaaacagagcaugugcagucacuuuggucagugguagacuuaaugaguccacagcaggccuccaaggucucaggcaaagacaaaaguaggagcagccuguaacacagcugcaguuuagaaucucuugucagccuaggcagugagagacucaaggcauuaaggcccuggagcucacuggaaauggaagagggcgugggagccacccucccugcagcuguuccuccuuucuucccuucccugucucugccaucccuuucuuuucuucuccccuccucaucugcgagaucaugaggguuuuuuccuuuuguuuucuuucuuuucuuuucuuucuuucuuuucuuucuuucuuuuuuuuuuuuuuucauuuuaaacaaauaauggaaggaaaaggaaacaagcauguguuccuuagagacacacaagcacagauguucucagaugucugcuggcauccaucacuguggauaucuguguggcuaaccuggaagaguaggccagcguugugguacagugggaagaacacugggcugagucaaggacuguagcuucugaccuccggcccagccaggggcccacugaccccuucuacagccagagcaacugagcagaaucgacucucacagcagcuggugcuguggacgggacaggcaccuuugggaacacugacagguccuguucccaggucacaguuguuuaugugggaugagcagcuccucuccgcaugccuguccgguuccuuucauuugcccacugccagguagcacgaccgucacagaacauuugcugagggccaucacucuccuugcugucugccauucuccagcauccugcuguuccaccuucacccuuguucuccuuaguucuggucuccagaagaugcaggccggguagaggagcccuagagggaggguguuuuugagguguucuguggccccucagccuagccuugggggaauggagaaaggcuggggauauugcugagagugcagaugcccagaggaccccugagaguaggaacagagggacuguugggaaugcugggcgaggaaccucagagcuggaguguccguauugaggcagggcagagguacugaugacagagcgcuaacccuagccucuggaggggagcgcccuguucugccuuauuccagcuccucuguggugcccuugggaagugauccuuauaacauaugcaaucaagguucucacccuucuccagugucuacucuuuccaccugaacugugucuuuccaaaguccugcccugccucgacucuucugacuuuucugccccuguuccucagcaccuggugagcaagcuugucucuguauuagugggucucagauaaacugugcacucuuugaaaaauugaaaaaacaauggcuggagaguuggcgcagagcuuaagagcccccuugcagccauccagguuugauucccagcacauacgugguggcuuacaaccaucuguagcuucaaguacagggaaauuggcacccucuucuggacuccauggguaucaggcacacaugcgguacucauacaugcaugcaggcagacacucaacacauaagauagguacaucuuucaaaaacacaggggaaggaugacauucuuuagggauuaaugacaaaaacaguaaaauauuugaccugcugcuuuuguaaugaagacuccaugcuucuucgagggcugggagccugucuuuuuaucauucucuugccuacaggacuagaguggguuagguauaggguagaacucagaauauaggguggaugaauucagggcugggaugagaccuuagacuuguauaauuaacacaguccacuuugggaugcuccaagugccuaacaaaggagugagagguuauuuuuuuaaaaaugugggaaugggguacacuaaaauccaagggacccuuaaauguguaugugagggggaggugacucagggagaagaagaaagggacccaugaguucuucagauagauuugggucuaaccuauugguguggccauugcuucaaaguucacuguguuacccuuugagucccagcguacuuuaacaucuucucuugcccuuuaacaucaucuuggagugggcugucacaggcuguguucccaucucuuagaauugguucuccuguucugauuggaugacaagcacaguggcaccaauauccaucuuuuaccaaauacaagcucuaccaagccuuaaagaaaguauaugguggcuaaaacguacuugcaccuugcauacuaaaacccacauucuccagacaaguuaaaaagugcaagaagcugucugucacaggcggaagcacauuaguuuaggagugacaguguaucuaaaugaggcaggcuggaguauggggcugguguucuuucugauucaccaaggugagguggguaggagagacuggccucugucccuugugcuggcucccauguaaauccuuuagcaucuagagggccagacacacuuauccugauggggcuggauggcuuucuucuccuacagauucuuuaagcuacuaauggaagcuaucaaaaagaagaaaaacaaagcaucagccuucagaaaugugaauucgaggagagcuacacagaaggaccucaaugacacugaggacucggggaggagucagguaagcaaaugccagggaccccugaccccugugaggugcacaggacugaucuuaaggcugagagacuuggagggcucccauggggguucucugggugagguuuugugacaguucucagcauucuacaagacucucuguggugcuagcuccucuccccacauaccucugcgcugaucugcugcucucgcccauuaagcuccacuuguuacucccaggcguggugggccaggccagugaggcugccagcaagaugguuugcucagcucgggaucaguccuacagacacccauuugcauccuaaagauggugcacugagccuuugaaacuucuuauucucuuuucaguuuucucugcauuuaacuucccccaaagcaccaaggcacucacuaaagaagugaguugaaguagagaaguugagccucagugacaaaagggaagaaaaacuauugguagcaaagcaagaguggaagacguaggccagauaaggagcagggugggaauuccuaaggccagggaccagagcacuccuagggcugcaagcagaggccaguacugaugcagugagccugcucagguggcuugucacauggaccgggaaugcccugccuagcucugugccaccugucucagggccuagaucagagaaaguccuagguuccucuuguccugugccuuucccauuucaguaacucaagcauagaucgacaugauugcauucaacugcuuucuucacuucaccagaaagaggcaaagaaacuaggaaccaaggacaggaagggaaaagaccgcuuucuccuucccacccacaguguuggagcaauauuuaugucauguaaugacugugggcggcccucuaccaauaaacuguaucauuaaccccuuuaaccaaaauauuaugguguacaagagaggguaaugacguguaugugacaugaacacaaaaggaggggcugugguaagccauuaggaacuaaggaacaagcaaggagggaagacagagggcaucuaggugaaguguccugagagugaugcagacaccacagcaaacccauugcucuguaugguaccuagagggaaagagguuugcaaaccccaggcuaggugagcagaccggguagaagggcuaggguagaggacggcugauggaaaggcaaguagauggucauuggaauguggcuacgucguuagguaacgaggccauugggugggcuacggauuugcugacugcuggguauuaguagaacugaucauuuuucuccuugcccucaaaccacagagagaggaggaaagggaugaggaagaggaggggaacauuguggaugcugaagcugaggagggcgaugcagacgcuucugacaccaaacgcaaggagaagcaagaagaagaggugaggggugcugguggggggcagggcugugcucacacauaaggaauucccccugaccaugccacucugucacacugggaacccaccagaaaucugaaggaaggccugucuguccagcguaccucuugaugaagcagacaggacuucacuuagacucuggcuaacccugaauaugcaucagacucagagacccagagaagacugacaggaaguuagugucugcaguuuguccagugagaauaugaucucucacuguccucagaccuaucccuaggguccuaagagaagauuagagaggcuggggggauucucaggugagugggcgagccagagaaacugugugguaagugaacuagcugccucugaggggacaucaggacugaguggcagcaacucagaggaaaggcgaaggaagguggccagggcagagcagagaggcuaguaauucgggccagcggggucugggauuguucauaggugacauccaagugacugggacugcacugacugccagcaucucuuguccugucagguugacuaugagagugaggaagaaggagaggaggaagaggaggaggagguacaagaagaagggaacaucaaaggcgacgguguccaccagggccaugagccagaugaggaagaacauuuaggccucgaggaggaggagucaucccagaagccuccccgccgccacuccaggccucagggagcugaggccauaaaacgccggauccaggcuguacgggaguccuacucguucaucgaggacuaccaguaugacacagaggagagccuguggugucaggucagugucuauacagcugggccagggccuucgucuugccugacacucaaguaggcgcuuacugcauaacucacgagaugcuuuuccuacgugacuaucuccuaagaaccucucucuccuucuuuuaauauuuuaucuguauggguguuuugccugugaguauggcuguacaccauauguacaauucccuuggaggccagacaagagcauuccuuggaaauggaguuacagauaguuguaagccaucauguagguacugggagucaaacccagguccucugaaagagcggccaguguuauuaaccauguuucucuagcaccccugaagagucuccuacugacuggugacccugugcucuaaagcacagccuuacccauuccccuuuccaaccuguagugcucagaaguagugcauaugugagucucaacugcaggccuagcagauaagaccuuccaaaugagucacuucauuuaauguaagcacaaaccugucaccauacaucacaggcauggcagcuuccuucuuccugccaggagacaguaacccaucauuucagcucccuccaaagugucccuguaccccauccugagaguuucaugguucuugugaggccugggugguucguuguuuugauagcggcauggaauacucuucucuguaaucaaacuccauggcuuccaagcuuagagaacacaacuggcuggggggaccugaagccgaaagcagcaggcacugugcgguggccgcugagaggacaucuaucaacugucuccaccuugaauaugggucauuuaaaccacccaguauucagcccacuugcccacuagugcagcaggacccaucuccccugccaggagaauauuaggugggcuuugaaggcugcuugaaguagaccuguaggccccagcccuguucauggagcuggggggaggggaggggagggagggagggaaggagggagggcuguuuuccuuggcccagcgcucuuucucccguaggugacugugaagcucccacugaugaagauuaauuuugacaugagcuccuugguuguguccuuggcccacaaagccauugucuauacgaccaagggcaucacucggugccuccugaacgaaacgaccaacaguaagaaugagaaggagcuuguacugaacacggagggaaucaaccuucccgagcuguucaaguacuccgagguaugugagcccggcaggcugguggcugugcugggacaaauccucgcccugaccucauguuccuuggagaaccaggcacugggaguugaacuccaggucaucuggcucuugacccuaccgagucauucgugcaacacuguggaucccaaauugaauguauuccaaauugagugugcccucaucugugacccaaggacucccauugccuguuaggcuuucaguguagaaaccugcucaacauuagccagggcuuucuucguguugcuuuguuuacucuuggaggcguucucagaguagaguauaagaaacagugcacugcaucccuggccagaguguugcucccucugucugguaaugguagcugcagcucagccuucccugcccugcgugaagcugacggagacccccggcucccaucccaccguucuucaguccuuuucucugagaugcuuucaccccagggcgugagaguuucuccuacacuaaggagcuuggcugcucuggccccgugugcccucacgcacacuccacugaccaagagcuugcccaggggagggacagaagugaccuguaccuccugaguauguggguguggcuugacuuacucacuuggggguuguuucaagugcucagucagacagccuaucucucugucuccuaugaauugugacuuagaauuauagagccaccaagagccccuaugacucauuuggagccucagaccucuagaaaagccaaguaaauugugggauccugugcacccuggagagguguucgagggucucugcugaggaaccucucuucaccucccaagcguccaucccagugaacagauugcuguuacaagaauaauaaugaacaaaaaacuguuucuugauuaauuucaaguguguccuacguugucucguuauacuggucacaaaagcaagacaguguaggacccuggcuggugugcagcaacuguccucgcucauccuugcugucuccacacacuuggcaccagcuggccccagccacugggcacaaggcgaggagagaauacuggggacaugcacacaggacaaagcuggcaaugggacacuuacuuaaguccgucccuucuucccuuguccagauacuggaccugcgccgccucuacuccaaugacauccacgccauggccaauacuuauggcaucgaggcugcguugcgggugauagagaaggagauuaaagauguguuugcuguguaugguaagcggagcaugacagcauaccuggccuagucggaguaccugcaggcuagggcaagugaacugaggugguuagcccuucauuuuggugggaacagaggcaugguugcugagucuacagucauuugagagucaccaugagggaguguggaagaugguggcuuugacucuugaaguagcgucccuguuacugaugucuuuguaaaguucaugauggauggcuuuggcccuucaagggucuagaucccagguagaaacaggacacuuaggcagagucucauuauccuguguugcuugcuacauggacaugaugagcaagaugaagggaucagggcagucccugggccagguguagggcuuucacggcuggaugaggaggugggggagcugagagagauccagggucucacuguagccugccugugucagaggaugcucccucaaguuugccuugucucuguuuaaccuuccuaauguucugccccugugacaggcauugcaguugauccucgccaucucucccugguggcugauuacauguguuuugaggggguuuauaagccacucaaucgcuuugggauccagucaagcuccuccccuuugcagcagaugacauuugaaaccagcuuccaguuucugaaacaggccaccaugaugggugagugugggcagugacuugggccuucccugggcagaugggcuugucucaccccuugcaugcagugagaucuuggaaucagaaguggagaggcagccgacaguaaaugucugcauucugauggaauaaagagagagcuccucuuccaaacuuaaauacagugccauagcaugaguccacggggguggggggaugggaggguguuaucuccggcuaacagguaccaccacacagccucagcacugagcccucagucccccacaccucccccagaccccuaacacaagcucuuucugucuuacauaggaucccaugaugaacucaagucaccuuccgccugccucguggugggaaagguugucaaaggcgggacaggccuguuugagcucaagcagccccuaagauagcagcauugucugcccagccuggaggaccugggggugggcacagcugacaguacagagugacauagcaaagcaguagccuugggguccggaaagcagauggccugagcugggccggcuucccucagaaaaggcuccuccuaccuagccuuucucaucucgggaucaggagcaaggcuucccaagcccucagagauggcuguugcucgacuuuugcucccagaggccccagccaggauccuaacaagacccaggacuacacagugggaagaucaccgugagccacauuugcuguugggaaucccaggugccaccguugcugugcguaugcuaguggcuaaggaaacauucccagggguuccugaagauccagaaagggcaugaaaccugcuccaugugccugucccucccugcugcagcuaccaaaggagaguccucaaagaggcuccacucagggcugcuuuccugggccugagucaauggcacaaggcccccgccacacugccauugcuguauggcugcauacaccagaccagaacacucccacagccaagacaucucucugggaccgcagcagcucccuaccccacagccuaaaguuuccuacuggggcuauucagcaaggccacguagcuugaccuuccugccucuacacucagcuggaugucagagccccuagucacccccaggcccuguacuguuggggucuuugagccaugcagucagguucccuggcuggacagaaaagacagaggcuuuaugaagccagaccguuucuauuuuuguccacuguuauuccagcgugggcugaguaauaaacauggcuggaacuggcuguuagaagauaaucaagacuuaaguuuuuaaucuuucccuucauuuaugguuucugcaucugguaauuaguauuuucuuggcacagauuucaggcuccucuuccuacuuuuaucuggcauuguaagggcagacugugcccccugcccccaacucccagucuucaccucugaauccuacccauggccagaagcacagaacuguggaaggcuguggggagaauuuguguuaccuuagucggguaagaagacugcggugacuucagaaaugggcuggccuaaagguuaccaugccagaagagauucugcagucuccuucaggcucaugauggaaccuauccuguguauacccaagaaagccagcaccucaaaacagacugcaggacauggcauagaagacugucacagccucuaagggaagcagacagaaggggucccagaaaacccugcccugaggacgcagccugcaggauagauagggcauucauucuuugggugaaaaggcagggugacuacuuacucacuuucuucuuacacuagaguggagaggggauucuuguaggaaauaucaagguagucuggaagcuguggcguccagagccuaggugggugugugacuuccugcagucaaucuuaccuggaacugaagagcauagagcuaaaggagcaaacccugaauguaaacauuaaugugaccacacuuaugccagaccucugaccuguacuggagccuggagugguggcauccuuccuccacccacccacccagcuguuucacauuuagcuugggucuacugugccuguuuugaaauagcuucaaagaaagaacauuugcaguccugagaauauuccccagccuacugccguaacaugacagggagaccaaccucaaaggauucugaacagagaaacaccaaagcaagugaguaauccuguaaaaauagcccagcaaaaaggaagugagcaggcucgagaucagaaacaauaaguaugcucucuccuacuuaccucccugggguggagucguaaaccaccaccaccccuucagcacuaaagauugagcccggggcugcaugugcgagaugaguguucugcucuacccuccccagcaccugcggaacauuuuagaaagcugauuauagaaccgcacuccaggauugagauaagaguggccuuggguacaccccggauaugaaaugagcuucagaaaagaguauacagcaagagucaaaccacaagcuuaguucacccgcaguacugugacuuaaagcuaacuucacuugagugugaggugaugugggaaguaagucacuggcccucaguccuccagugagcucuaaauagcuaaugucugcagggacucuagagauugcucaaaggaagcugcagugaucuaacacacaugaggccuggcagaagauaggugccaggaagcuccugagucagcacauuauggaagcugccugugcaccuuucagaguuccucccaggaggauagcaacaggaccaaagggaggggaugcuuggccagccaguagaaguuuccaucaaaacagugaugcuuugacuuggagacaugcgccuguaguuccagcacuugggaggcugaggcaggaggaccucaaguuuaacaaccuccuggucuccauaaugaaaucaagaccaucuugacaaagaaagaacccagggcuggggguccagcucugggagagucucuuuccaagggccugggcccagccccaguacagcaaauuaaaaagacccagauguccagagacacucauccuucugguucuccaggugccucuguccugugagugccagggaggcugagugcaggucugaggugucacugaaggcucugcgguguucuguaugaaucagugguauuugcugccacuucccuguacccaaaucucacacaaagugcccacucccaguuuccucccauccugcauccaucccacuccaaucuccacuugugcgaaccauacagacccuauucucauggagcuagcaaugcagcauuccaaacaucucaccaggcaauucugccuuauuucuagccaaagguuaugguacccagagggcaugugaacacacaccauauacuuauccagguaggaccaaacugcugguuucauggggaggaaagagaauagcugagugcaugcucagaggccagaagaggaagcugggaaaaaaucaugacucagucacugcuuccccaccgcaguuugcgcuccuccacaccucccacuuccuggcuucaucgugaacauacagaugccucauccuggcccagccacaugugccucuauauuucuagcaaguuugaguaucuauaugaggaagaccugcuggcccugccuggugcugcuuucuagaucagcuguccacugugcuguugucacaggagccucagccaguuuggggcugagguauauaugugagggucucagacaccacuggucucacuggguuacacugaacggcccuuacucaggacucuguuuguuucacaagguggauggguaugauguaccuauuuguguguugguacaugcacacuuguguguggaggccagacgucaaugcugagggucaaugcucaguuacuuuccaucuagauucugagacagugucucccugagcccagcguucaacauugguuacuuuuacaugaaugcuugauaacuuggguccauauguuugcugugacuuuaauggcugagccaucuccccagccccugacauuacagugaguagagccagccaauccucaaggacagcaggcaagacagcuggcgcugaggacagaaucaaguucucucaucucacaaauguaacacugagggaguugcuuggcccuucuguauuuuauguauaaaaugguaauuaguaaguguuccuaaagucuacuuuagccauaucagcacaacuauaggugcucaccuauauuaccuguacacugagugguccuccacuaggggcauauuguacuccuucccaugcacacuuggaacuuuugucaaugucuaaagauauuuuugucacaacuguaaagagaugcuacuggcaucuggaggguacaaguccaaugcugcuguaauuaaaguauagucuuaacaacaaaggaucaucuggaugcaaauguacaagacugaaaaccuuaccacacaaucacccaugggguggauauuguaggcuuugauuucucaaaaccuacuuuuaauaaggguuuguaaacacuuuaaccucccuucuaggccaccacccaccagagguaguggaaaggaaagguuaauagggcaaaggaggauauggaccugcuuagaaauaguucuuuggagcaaauccaaucugcagugucaggauaucagccucucaguucauacgaaucagcauugauccacucgaaaacaccauucacaaaucagaagaaacccgggaggcucugccaaacuguccgaauucacagaagcaucaagaagccaccagaacaccacuggaaguuuacugguguguuucugacaugacaaacaacuagcaaagaaugguaaggcauacuaauaccauccagcaucguccacugucuauugggucauacuuauauccuucccaaacaucgcauguucucucaagcauccacucuagcaaaacaucacaugccccuuuuucuggcugcuuccagaaaaacaccacaugucuguucuuaguaaaacauccuccccugugucugcuucaggaaaaaacauccucucauaagacuguuuccagggaaaaaaaaucacaugacacaacugagucucgaaagaaaccagaaauuucacuucaggcugugcgugcuuuugugagaugaaucccuucccccauugaccucuccauauaucaaauggguucccuaaaaauagaaugcuucuaaagaguggcucauuccuuuucuggcuggccagugagcaccagggcuuugccugugucagccuccccagugcuggauuuacaggaacacaccaccacacugaggcuuuuuaucugauuccugagaguccuccagaguacauggcaaacacuuuaccaacagagccguccccccaaccccugcuucacugccuuuuguuuuuauugguguguuucuguuugucuauuuuaaugaauuauuugugggcuggagaaauggcccagcagucaagagcauugucagcucuuccagagaucuugaauucaauacccagcaaucauaugguggcucacaaccaucuauucuggaaucugaugccaccuucugacaugcagguguacauuuagaucauaaauggucuuaguaaugagauacagggucugaaaaaaaucauuaagaaaaauacagggaaauucuaggaguugguagauuacaaauuacaguugaaucauuagggccuguacuggcuaguuuugugucaacuugacacagaguuaccacagagaaaggagcuucaguugaggaaaugccuccaugagauccagcuguaagacaucuucucaauuagugaucaagagggaaaggccccuugugggugggaccaucucugggcugguagucuugaguuuuauaagagagcaagcugagcaagacaggagaggcaagccaguaacaucccuccaugaccucugcaucagcuccugcucccugaccugcuugaguuccaguucugacuuccuuuggugaugaacagcagcauggaaguguaagccgaauaaacccuuuccuccccaacuugcuucuuggucaugauguuugugcaggaauagaaacccugacuaagacagggccccaugcuacucucugugcauguucagccuuacacacaggaaaugagggacacccacccacacacacacacacacuguuaugggcaggagaaggauuuugauuaauugaugaugcgcuuuggugccuucuugaaggcaggacagaugguucugguaggcagaauucugauguucucuuaccuuuuacaggaguuuacaguugugauaaagagggaucauguugaaacaaggauucaugacagacauggagaacaccuuggcucagcgucuggcuuccugcuauuacagaaagauaaaaagaugcacugcccuugccuaaauguuggcaugcuacugaaaaggcugcaugguauuugaaaaagucaaaggaaaggauauuggcuuuaugauuaggucgaagagccugucuaauaggaaaggaaaauaaaggaggaaagggaaaacuugaacaaaggacugagagguuggacuucucauagagaaacuaggugucuaucaugacagauugauaaaauaauacaggaaaagcuugaaauaacacguaccaggaaauagcuucuugacaacuaacucuggaccaaacucauaaacagcugugcugucuaguacuucuauaacugcaaagcuucaugacaccaaucuugaguuaaaagaaaacugauuuuaucauacuauuaacuuucuguucucuugaaacuugauguuugcuugcuuuguuuaauaugcuuauguaauuaaggaagacuuuuagaaaaaaauguauauuaaaaaguuuugua

SEQ ID NO: 3067 - RNA, 2633 nt, Mus musculus
ugacauaugaagacuuuaucccaaaacuaaacagaaaaguuuagggaauauuugagcuacaggauccaggucugggauuugcaggacagcggugaacuccagcauugcuucucacugcagaguggcauacaguguccucaggaugcaugagggagugcacuuagggcuucugacuccuguugcuuuugauccacgugucccuccgccucaggcaggaagagagcgaucccagggcaucacaagucuuuaggagcuauugggguuaugaaagccaggauucuagaaucuaggaaaugaacaaucugcauggcuaggagagggugcauaaggugacccugcaugguacucacugccacaucgggcucccacuuuccucauaggaguucuucuuccacugcauggcaggacgagaaggccugguggacacugcugucaaaaccagccguucuggcuaucuccaaagguaaaaaacaaaguaccucggauagguggguuaguaucccaagacccugaaccuguuguguacauucuuuagaugauauaaucucuuuucaaugucuucaugugugcccugagacagaaaauagcacagaguguuucuguaucacugguagagcaugccuucagagguuuacacaguaagcccugcguucuacaggucuucuaggugugccuuaccugugagcugcauaugccucaaaauaucugaacacaacccaacauagaauuguaaccccucaucaaagauuaugggguucuuuuugcauauauaaaacucgguuacacagucauuaggggugaacuuuguagaugacaacauagugaauaauaaccagagguuggacaugccuggauggcaguggugaguucguucuuugucagagaggucggcaaccugggauagguacagaguaaccugcuaaggugucccugucaccuggaggucaucagccaagaccuuuucuuuccucucuguuaggaaaagaaacagucuuguaccuagccucauuggguagacggaaggaucugagcccaaagaauguacacuagugggaauaaugauaagaaaccgaggggaugcagacccaggccucuccagcugcgauauggagcgugugggcagagugacaggagcccaguuccuuccugacuuccccuugaagcucugcccaccgguuaaugcuuugacauuucuucugagcucagacuuaccauguuguguucacuuccuccuugacuccauggcaucaguguagggaggacaagaguugagggcacuccugagugaucuguugguaagaagaccaucuggagcuggcagggcacaagccccuuucuucccaggagccuggguuaccugagcuuugugugagcagagguuagaccuccauucccccuaaauuguucaagaaucuuaaguguagcaucagaaaagcugggaagcacaugaugggugagcuccgcaugguaggacccaagugugggaauccauagaaagaagacuauaggaggcuguuggggucucuggcugagcagaagaacagcagcaaagcucuguaccuugcagaauucaccugccaguggggagcugaggcaggaggaggcacagcacaggcuucagguggguaaguggagaaggcacagaacugcucacucaaguuuucaggccucagaggcagcacagcacaguugacaggaaacagaauacuguagcagcgggaggauacggcuggcugcgguuugauaggaggcgguucaaaguagaugugucagugggccauuagcgauaagaucugaagcucagagaagcagucuagagacauggacaugaggggcagcuguuaggcccucuaaggccaacauagcagcaggccaaagacugacaucaccaccaccacccuguguggggaaaggagaguugguguuugccaccagcuugccgggcucugagucaaacaucauggaagugguagauagaacugagcucuacucucccagcuuggguuggaaaacagggucuuaggaaacugcaguagccguugaguugugaccaagacagaaagcaaaggugggugaaggagccagcuaccauagaggacuggagacaaaggucuuuagguaggggcaucaugucagcauuuaguuccuggugcugcccuuuugcuuggcagucugcacugacuguuuaagaauucuuccuucucuucccuucuuugccugccugugauucuaaggaugcuggcugguuccuuagagcuccgagaugcagcagagcaaacaacggggagcagccauaucagcugagcuaaauaggaaaccuggccuugggaguguggcagccagaccacugaggugcucucuuccuggaaaacgggcaggaauuguagccucuggauguuagagccauggccuggagcacuagaagugguccaucauagaguuucuccuggagcauugguccccuuccuuccccucaucgccgcccugggagguguuuuccaugggcacugagcagggaguuuccuuacagguguaucaucaagcaccuggaggggcuggucauccaguacgaucugacgguccgugacagcgauggcagcgugguccaguuccuguauggggaggacggccug

SEQ ID NO: 3068 - RNA, 56982 nt, Mus musculus
cauccgcgcgggggagcggacuguccggggcugaauuggcgcgagcgcggcgccgggggcuggcuggggcgcggggccccgggcuggcggcuugccagcgcucccucccuagcaugcacacagaggcggugggcggcgcggcgcggaggccccagaagcugcgaagccaagcagcggcaccugccugccgagguacguggcgcagcccccagucggcagagcggacaccggggagcccagauagcggcgauccgccuuugcgauaccccaggcccagcggcuccuccccagcccugcgacgccggacgcgccugcuaggggacacgggcggagggucgcggccccuggcugccuacaugggcgcccccggcgcagccugcgcagguguggacgcggcgcugcggguaaggaugaccugccccgcguggcagguccagccagaguggcccucuucacgucgcuugguucugggauuuuaauucauugcuggaaccuucugagccggcagagucgaauagacucagugucucccuugacugcuuuggggaaccuuguacaggguaacuaguggcgccugaacccuccuggugcauccauguggguagacgugcagugugaaaguggguagcuuucugcuggcagaaauucacuggugaccuucccugcccccucucugcggccaguccugcggaggagacacauugggagaccguuuugguuucuuggaaauuuuaagcuguguccugacgaggggacgcguucuuugugcgcuguuuuauuuguuuguuuugcggagaggguguuagagaacaauugguaggaccccaguaaaugaaagcucuugucccuacugcacaucagcuggaugaccuuggcagacacugauauccuccuguggggagcuugcucuccaggucuguacuggaagacuuaacuugcuguuggcuugggucucuuccacaaugaguuugugguuuuaaccauuuagaauaaauaugucaauuggcgagaacucuguagaaucacuagcugacuuggaaaugaaauuuuuauaccuuuccccccaguaauucagucuuaauucacauauaugaauuuugccuuugcaaaauuagguguaaauguaaguagauguacuuaaaaggaggaagaggcauuuuuauguguugugcuuuuucugggaccgauggguuucagguuccuucagccaagagcugugcuggguuuuagacuuacaaaggaaggagacucacacucaucucugcccucuggugucuagccaagccuucccuugguuuaugacuguaaauccucuucuaccugcagcccuacgcaaaugcugggccugagaagagggauuugucugcugaaagaaaggaccagaaaaguagguuuugguuucuuuuguguaauuccauauccugacagcucagaaugguuucucacauugcugguugcagggcuaggaauugucugauuuccaaguuuuuggucaagagaauauuaauaugagcuuccagagcacuguagucagagugcugcaucuccugacacucaugucugcuauguggucggugcuguggcuaucaggcugauaguguuuucuuugagacuugaaaagaaauugagaugauuggagguuuggguggcuguuuuguugguuggucgguccguugguugguugguugguuuggguuuuugagucggggauagcaugcuguucaggcuggcuuugaauucacuggugcauccgaagcuggccuugaaccacugauccaagugcugggaucacagacuugugccaacaugccuggcuuaaacagaguaagaggaggugugacaaggcuucuggaaaauggcaugcugggggcuggcaggaaauucuaaaagcacacauuuaugaugauucugcaaaugcauucagcuugacauacacuggucacugccccaugucaucaaaacaagucaaaugggugacuggacagggagguaaucaagaaacacaccugucguuggcuugccuccuccaccucuugcucccuuacugggcuugcaaaguaguagagaauuagcagcugucucuuggcagauuaauggugugcuggguaguuuuuaaugucaacuugauguaacuuggaauuauuugagaaaagaaagcaucauuugaaaaaaaaugcccuuaccagauuguccuggaggcaagccugggagacaguuucuuaaguggggagggcccagcucauugugggcuagugguccugaguuguaugagaaagaagguuuagcaaucucuggggaccaagucaguaagcaguguucuuccauacucucagcaucagcuccugccucuagauuccugcaguguaucaguuucuguccuaacuucccucagugauggacugcaacguggaauuguaagcugaaauuaaacccuuuuuuuucucccaguugcuuugggucaugguguuacagcaguagaaacccuaaccaagacauguggggaggagaaagagucacccuccacgucuaucuagcuuuagaggaggacuuuauucugcucugcuuauggaaccaagagaacagccgucacccuccaagagcaugcucuucauuccagucuggcugggaaggcuuggcauagaaacaacugggaauauauaauauauauauauauauauauauauauauauauauauauauauauauauauauauacaauaacagcggaggauggagaagcaaggacuggaucagcguggguggcagguguuagcagagggggugugggaggaagccauaaauauggaugguggcauuagagcucucccgggagagaaacccaggagcacucccauagagggaauuaguggggugugugaaggagcagggggaaaaaugaagugagaggcuccaucaaucgguauuaacuuaccugaacaccagaugagguuuguuccucuuuaaauguuguguagguacuuggagcacguuuguucauuucagcacuugggagauagaggcagggggauaggaggauugggaguccaagaucagcugcugcuauagagcaaguuaaaagucagcugggguauaggagaugcugucaugauagauacacacacacacacacacacacacacacacacacacacacacgaagccagugagauggcucagugggcuaaggugcaugcugccuagugaccugaauucagucuccagagcccacacaguagaaggaaagaacuaacucaguucucuccugaccuccacguuuagaaacguguguagggaaaagcagagccaccuaaaguaacaugugccacccucagaucaagggacagaaaacaccaggaccuguguccuacccagucagucaccgccucuccuagcaguuacccuggucugaccugcuucucucacaccgugcugacuuggaaaccuguggcgugugucuuccuuuauaagcacuaagugacagggaaggagcagggaaccccgugcugccugugguucagugcuguggcucgcgguggucacaggguaaguuuggugccucuugucugucaucaguuguugaaugucaagcaacuuccaguguuuguccgccccagguagugccgcugucacugcucugcaggugccuggcuuugguaaggcaugccuugaguguguuaugggaaccugcagggcaguaggacacacacccccaccccaccccccaggcaaagcucuuuuagucuagucucagaaugaaccauggcgggagcuccuucauccucaaggaugaaggcagcaguuccagaugauggugcuggcggugcuuuuucaguaggaagucucugccaggcccuguucuaugcggccccaggaagaucaguccuacagaguccuggcucuccuugggucuuagcacagggcaggcugagcuccaagagccucuugaaguggagaaugugucuaguugaccacuuaguuugcucuuagucuccacccagcugaaugcaaacaaaccuccacccagucuguuucacuuaccuacaggaaaagccuuuucuugcuugaguuuuuaagcaauagaaagcauuuugacaauacgcaggggugaauuuuuggaucaugaaugaaccccuguacucuggcauucucuuuucccccucagguuuaaaaccauccgggguuauaauagguugguaucaugugacuggguuugauaagcucaacaaacagcgugugaaaggucuacuuuaugaauaauaaauacuuaagucuuuuugaacauugaagccacuuuuaaagguguuuguuuucaggcaaggguucguaaaauccagucuggcuuugaguuuugacucccaccccccuuccgccccccagugcuguggauuacaggccuguaguaccauaagacuaucauugucauaauggugggcuuauguauaucaagaaccaaguguuucucuuagagguugucaccauccuuccuggcuguccuguccccucaucugucuuuucaacgucuucuagcuugcuguuauucaccccugcguguuuauuucucucuuuaucuggacuggcaggcagcgagaaguucaaggggaugaaguggcuucugaucuucccuucucuuugcuugccauuuucugcaguugagaucuuagucagcgaggguuaucugcuggcacaggcugccccuaucuuuaucuguauguuccuucuguuugggugcucuccgguagaaacaaccugagccauaccuaugauuuaaauuuuucuaguagccucccuuauggaaagguaaaaagaagcuggcagggacuagagagcuggcuuuguggugagaaagcuugcugcuuucacagagaacuggaauuccaugucuagcaucuaagucgggcagcucgcaacugccuguaacuccagcuguggaucaugcugugccuucugccagccucugcgggcacgugcacucacaugcacauacauacccacgcgugugcuacacacggaauuacaaaauaaaaguaauggcuggcaaguuggcucagugggcaaaggccucugcugccaagugugacaaccugaguuugauacccaggaccaccaugcuggaaggagugaacucagaaaaagaggucuccacaugcaugaucuccacguguauaccauggcaugugugcauccacacacacagacacacacacacacagacacacacacacacagacacacacacacacacacacacacaaaguaauaaaaugaaaaauaagaauaaaaacauaaaucuuuaaaaaauuaaaaagaaacagguagauucaaguuuccacuucucuggaagauauugacuucuaaacucacacgcaccuagagcccacagcuucuaaccauauguaauucguuaaugaauauuuuauaaucgguucgucauacucagucuucaaagccugcuccccgcucccucucuuguaaaccaugagaaguaguuuucucagucuguccucacuggguguagaaacguuacauagacuagcucauuagauuucaccauagcgcugugagcuugguaccauuauccuaucccucccguuuuauaaagaaggguguuaaggucaaaaaagagguaagaaguuccagagggcagagcuaggauucagaccuaggcuuggagauaguagaugaggcuacgguucccaugucuuugcagcaaauaauguauuccgaucccucagaagauaucccaucagaacuugggucuccguggucagccuucugucucauacuaccucaugaggggaugucuccaucuguagucaagccucaaaagagguuucuucaacauccaguuccacuuagaaaaaucccucuuauuccuccaguaucauuucagcaccucugguagggacugcucauuucucugucagccucaggauauugucccucuugggcugggcccuucaaacauuauccucagacuucuccaaccaggcaggaccugcugucccuacacuagugacaucugcccuccaguccccuccaguuccuauucagacuaaguaagucacuagucaguaacuaaggcgcuggagcagacauguuccuucuucggaggagcgcccccaaagcucuaaaaccucuuggaacacuucgcccuagugcccaguauagaguccaggaagagcgaccacccuggggguagcaacaccuccuccagcaaggaggaaugcugacuccuaaugcugacuccuuuucauucaaaccaccacaagcucggugaccucugaccacccagugccugcccaggcggcucucgccauuguccugcuuagaaccauggaguggaugucccggggucugcuuaguugagucuucugaccgcuguccuguaggacccugguauggagucuccgcacaccucuggauuaaccaacaucaucuggaacccauucugaaguccuccuuacccuggagcacccauggcucaucauguccucuggauggccucccugguuuccucugauggacuguggcuccuuaccuaucagacccaugaucucauugguggugcuuuggguaucuggggguccuuggucauauucauagaggaaagggauuaugccuuauuuauuuuucuauccucaguuccugguauguaauauuuguuuauuaaauguuuauuuauaggauuauaaaucugggcaugaauguuuaugcuuguaacccagggagccagagguaggaagauuauuacauuggauuuaaggcuacuuaguuaaaaaaaaacaaagaacaaaaaaacaaaacaaaacugagggauagggagaauuguuacgcgaacaacaaagcaaauuccauaccaguguagagcagcccuucccaaccaaggcuauaugagaaauuuaagcccuauuauccaaaggcagccuguaauacauuaacuucucucuuaugcuucuggaaggauucuaguuguuugaccauccuugagacgauugacaaaauuccagcccuuuguaauagggcuucauccccaguggaauucaggucaaagaaggcucaacccuguuuaugugauauuaaaggcugacagaauauagauaagaagagugauagcaacgggcaccccugcguuguaggacgucuuucuaaucuucuuuccacuguuaaauguucucugacguuucugacuuuguaaacagcaagaguucaaggcuggggagauggcuggaggaggaaaagaguguguacaaaugugagggccugaguucggauauggagcgccuacauaaaaacuguguggcugcagucugguuaccucaguguugcugauagggcagggcaggaggcuggccagccagcuuaacagaaacacaaagcggaaagaguaagacagacaguaauagagagagucaguuuaccuuauguccuucucaggccucuugaaauauuuccuagguaaagcaaauuagugucccuaaccaccauuauaccagaggaggaggcggaaucacagaguagagcccccucgguguucucauuaaaagacucaaacaaguaaacacaaaacaaaaacaggcauuggugugacugggugucagcucccuggguucagcaucugugcuugcuucuggauucucagaaagucuuuaauagacacucuauaacuaauauagucuuggguccuaucuagaggacauauaguugucuuucuuuuuuauuuuuuuauuuuuuugguuuuucgagacaggguuucuuuguauagcccuagcuguccuggaacucgcucuguagaucaggcugggcuugaacucagaaauccaccugccucugccucccgagugcugggauuaaaggcaugagccaccacgccuggcuuauaguuuucuuucuuuuauagauuuuuaaauuccauuuuauguguaugaguauuugccugcauguguguaugugugccauaggcaugccugcuccucaaagaggccagaagaaggcaucagaucuccuggaacuggaguuauagauggucgugagcugccgugugggugcuggaaacugaacuagaguccucuacaagagcaacaagugcucuuaaccacugagcuaccucuccagcuccuaccuuguuuuccucccagcuaaaagugagcauggguugagguuucaagaagcaaauaugggaagaggcccaggugcuaauucauugucaccaacucuguacugacaagccuuauuccugagguucgaaugugaccuuaccuaauuuacaguuuauccuuuucucuaccaguggcuacugaaucagaguugaugaaaaacuaggaacuuuacuuaguuccuagguguggugguuugaaugagacacacacauacacacacacacauuugaaugcuugcuuugucccuaguggguggaauuguuuaggauggauugggagaugagaaggcgagucacuagggauaggcuuggagauuuccaaagcccaugccaggcccaguuucuuucacucugcuuucaacuugaggaucaggauguaagcucugagcuacugccccagcaccuugccugccugcugccaugcuuucuucccacauggucacagucucaccuucugaaacuauaagcaauuaaagguuuuuguuuuuuguuuuuuuaaaacugaguugccuugguccauugccucuucacagcaauaggaaaguaacuaaggcacuagguaugucacaucgagucccuuauuaguucacaaagagaaaauagcaacuggcuuauaccaccuuaaccagcuguucacccgaggugccaccagugccaggccgggugaacaccgugcaccuccugaggaaacacugagagaaaagcacuucacucucugcugcucuggccccagugcauaacucgaaucuaaucgugaagaaacgucagacgaaccccaacuggggaacauucugcaaacuacuuggccuguacuuuucaaaaaaugucaaggucacgagagauaaaggaagccaacccaacaugacauuaggccucauaugugauccuggaugguauccuggaaaacggagaaaaaguuguuucuguuuuuguuugaaagucaucacuugaaaugacuagagaacucuucuugagaccuuuauauuagacucuaguuucgagucaguguccaggcccucgcauugaucguuauacugugcucauauaaggaaugauuucauuucuaggaaaauaaaauauuuaggggugacagugccuacaauuuucuuucaggcauuuaaauaaauuaugcauauuauauccuaauagaacgacagcacacacguuaaccauggugggggcaguuauugugugaaggguagaugagaauauaaguaucguucuugcagucuuucucuaaguauagaauuguuucagaaagcaaaguggacaucucugcagccuccagcucauggguguucugacacuguggacacagaagcuguggcauggcuggcugcgucuuguguggccacugcugcucauuuccuguauuguugagcguuccucagcaucugucccuccugaccucugcaggaaacagaaugaagaccuggucuccauuggccucagaguucuuucuguuauccccgcuauugcugcuauucuaagaggcuuccugguuuguagcuggccucaggggcaucuggucaaccagcucugguuuaaacuagaccuaccauaguccugugagagacguuucccacgcagacuuugaaguguauuuaaacccaaacacacaucugugcccuguaagaucuaguccucgacaguagauaagauacaagccacacauuugccuacuaaagaugggucugcccuuguuggcauugcagcauacacuugugaucccagcacucgggagacugaacgggaggauccugaauuggaaauuauuguggaguaauggggaagauacugucccaaaacaagaccuacaaagcaaaaaaguauuccccagugccuugagagaaccccaaguuguacauuucaguagaaaucuuacacuucuaaaagcagaauauuuuaauuaauuuuugagaauuucauacauacauacaauguacuuugaugauucuuccaauuccugcccccaaaacuucuaucguccacccccuccagacugauuccaguuugugcugcccccacccccaacauuuuaaaauccaguuugaggaaucuuuuguacuuccagcuggguuccucuguggaaagguagugauggggaccaguucuuggauucaaaggaggaucuccaaguuggggccuguaaugguuuaugguguguaggcucacaggucuugcucugucugcagcuucccucugcagagacugcagcgcuccggucagcagaggaagagaaacugauacaaauuuuuauuccucuuuucuaccuuuccuuccuagccagaccauucccuucuccaccguucauggcugucugcccucaagcccagcccaaaauaaacauuguuguagucugucucucucucucucucucccucucucucucucucuuguguguguguuggaacuuaaaaaaaaauccuguccacucuuuccuuuugggggggucuuuagacuacugccauuuacucuugccuccuuucucucccucccuggccccaacauuuuagugcccauucaacuagccaagcuauuuacuguucuuucuuuggaaagucagacaagugaagauucuaacaucccaagaaggaagacaagcaacagaaagguuuuacccaacccgaauuuuugcaacuaguaaacuuacuccaaccaugacuuggcccacaucaaauugacaaagaguugagcauuucaacucuucccuguucugaggaagguggcagcaccagacagauccaguugcuuuugcucccaggccugucccugcugguaugugggacagccauugaucgguuugccugagccuuccucaucucacauucaagggucuuauguacaaccuggacacuuaagaaacauccugugagccaggaguaauggcgcaggccuucaaccccagcacuugggaggcagaggcaggcgggucucugaguuggaggucagccuggacuacagagcaaguuucagggcuacacagagaaacccugacuccaaaaaaacaaagacagacagacagacagacagacagacagauaaauagauagaaagaauagaaacgaaacaaaacauacagugaugguuguguuuggauuuggugauuagggauacaggugaauuugagugaccagugcaagcuggcagucaucccuucaugcuucaaucagucccuuugggcaagcagugccugucgaucuccuacauuaguguggaacacagguaaaucggcugaugucuggcuaucuccagcacagggcagucaaguagcaaagcaaaugagcagguugagaggugauaagcuguuuaucaagggucuuaaucgaggaaggcaagaaaggcaagccccagggauuauuggguaagauauuggagaggcaccaucugugcccaugagucacauuucucacuuuagagaaugagugguuuuagaaaguauuccaagcguucagaauuuaucgccuuaauauuuuaaccuuguaaagagcagagggcuaagugaugguaaugucucccccuucacaccagagggaucucacugguguggacuaaagugaaucaugaaggguuaauuggccacaacaggaggcugcagauucuaacaacagugguuuuguucuucauagcagaccgacccuuauuucuuggcucuguuuguagagucuggacagcugucaggccggaaccuguuuaucccaugugucugucugugcuguggaaaacuugcuuaaaaggaggauuuauuuuuaaagugcuaugcccacguuacacgagggagcuugcuugaaaauggacaccuucaucuaauccagucaggugucacauucugagcacgaaauauagggauuugcaugcuuuauagccucaaguggcucuuguucaaggugugguuacaaagcccuggcugaagugacggagggagguguuggagggaacucagugacagcacuuucugcgguuugugggggugacugcuugugaaagucggauuaggcccugcccacccuguggaugugggaaagggagauagugacaugggacugagaugggugaagcacgcaacaaccaucaguuggaucugugagugggugcucuccucccacugcugugcaccagcucuuagccugcuuuguucagcccaccugugugugggcucagaccaguucacguuaguugucuuguauaccauugacagguaaggaccugauaaaccaagaucucuugaaauugugcauuuucaaccccgacacagaaucuuagauauugaaaugcaguugucauuaguuuuucuuguagcuuggcguguaagucugauuaccuuucuugacucuucuaugaggaauauguuggaauauuaauauguauaauuaacuguaccaacagugccagggugcuuuuguuccccagggacauguggcaacaucuagggacauuuaaaucuuacuacauuuuauugagacgguguguguguguguaggcaugagugccauggcaggaguuuggaggccagaggacaacuuccagagccucuucuuccaccaugcgggccuugggucgaacacaggacuuuaagcuuugaggcaaaugucuuuccauagugagcuauccuauuggcccaggaaauaaaauuuuauuaaaaggauuauuuauuauuuauuuuuauguguauuugugcuugccuaugugacuuuaugugcaccaaguuuguucagaugcccauggaggccugaguaccucagauuccuuggaacuggaguuauagaugguugugaguugccuccucuuugugugugugugcgaguguguguguguguguguguguguguguguguguuuguguugggaaccaaacucaggucauccgaaagagugguaagcacucguaauaauggagccauuucuccacucccacaagagacauuuuugauugacacacaggaggagcaggaggaggaguggucuagagauguggcugaaugucugaugauaaauggaaccaccccucccaccaacuguggagcugaacauguaggcaccaagguggaacaaugaugcagaagaccuuaucucuguauuguuacaggcuaggauucuaagcguguguguguguguguguguguguguguguguguguugcaaugcuaaagcaagccugugguuagcuaccuagauuguguggggauggaaaucacuugggcaaggaagaguggguugauugcuagaguggagaaagaaguuagaaaucaagaguguccaaagccaugccugcugccuaaagcacagagccauuucauaguggcucugugagguuuacaacagguucugcaguacguagacaggaaaguggucucugcaauaaagccaauucguggaccugucaucucgcagcucccaucucugugauuggagugccuguaauaaacaucucuaacaagagccccucauacauuuugaccuacuuuaaauaauuguuuugauuuguguguguuuuuuuuuuuuugagacagguucaggcuggccuugaacucgguguauaccccaggcucugcaucacacuugcagcaauccuccuguuucagcuuccccggugccaggguuauaggcacgugccaccacacccaacugguauuauuagcuucagcccucacaugguacauuagauaacuauacuuguucauuuuauuuccaucugcuuucuguuccuuccgcuaacccaacuuacuaacagggaauagucuaagcagcaauagggcaguuguucuucuggauaacaaaauauauuuaauuagauaaauaacauaaccagaaauggcccuaaaaggggaugccucuaucucaggccucagaugaaguucuaaccuuagaaucuguuacuuuugagcagcaauauuaccaguugguuuuuaucagcucugggugauugccauagauuuucagcaauuaauuuuuguugcaaugccugcugagucuggugcggcacagagagaaggcugauguuugcagccuaauuuaauuugucagccugagccuugaaagcuaaguauuccccaaauuaacauagccaggguggcaggggaaaccgagcugaaaagcagagcucugggaucaggugagcugugcucucugcagccguucccucuacaaacucaaaugguccuaaguuccgccugugcucugucgcccauaagcugugccucugaguaccugcucccucaugcaccagugaacugcccacaacacaagcuucgaagggcacugggucagguuuucaguuguauuauuaucucauuuaauucuuauaaaaaucauuaacuauuuagacaacuuuuuuuuucaucucacauauaaagaguuaauuuuguauaaaaggucaaggaguagaaaauauuggucucugguccagcuuggcauagcaacugauucuaccuuugaaagaguucagaaaggaugaauaaagagaaaagaaaaguaagaauaauuuggugcuaacaaaucgcaaguacauacuuuggaaagagacaauagaaccagagaaagaucagguuuuucuguggcaagcuucagaaauaaaaguauaaaaacaaauaagauuuuuggauuuuuagacuugaagggacaguguccaaccuuccgccaagccuguugucaguuuccuucaggauggcgccucuucugcuuugcuuugcuucccuaccguccuucucagucccccaaugccuauccugcuccugccugugguaacugcuguugaauucucucugucuguauucuugaggguuuuuuauuuuuuaagaaucacacaugugggauuugucuuucuguauucaauuuauuucacccagcauggugucuuccauggggcuccauuuugaagcaagcaagaagcaucuuugcccaucauugcuucaggcugccucucccuuuggggugaggcuaagagagacugauuuagaacuuacuggcacccauugcagcgcagcccccgcucgccaaccccagugcugcugcuugccuugccugcccacugacagcugcagacugcccugcucagugcagacaccccgcugcagcccugcacagcucccucucucugagaucauguuaccuucuuggacgguugauauccaaagcagggacucagccguuguugucuccaugucuuuacugugaacauuggcaggaccagugaaacuuaacugacaaauuacccuuuccuggggaugcaucggggcuucuaagguggccccugcuccugaguuaagcaauuuaaaaauuuguccagaacuauucaacuuagaugaugagaguuccagaaauaucuaaacccuacaaagcuaccaauuuuauccauuucuuccccucccccccccuuuuuugacagauuuuucagauuguaccccaagcagguaauucuccugccuuuucccccugguugcugacauugcagguguaagcuaccaccacauccuucauagcuuuuuuuuaccuuaauauuucuuuuuuucaucuguucaacuuccucaagguaguuuuccccaagagaagucugagcacuggucuuccccauugggauuuuaucacuguagggaccuuaucucuucucuuccuuauccuuaucuagauccuugucuguucuagaccuaccuauuuucucccuuacugcagaaacugaauuuuccccgggcaagcagcauacaucauuuacggaaaaccccagacagcucugcuguuagagucaccauagaagugaugaaacaucagaaccaaaaguaacuuggggaaaaaaagguuuauuucaguuacauuuucacaucucuguucauuauauuagucaugguucucuagaguaacaaaauuuacagaaugaauccccccuauaaauaaauaaucaaucaaucaauaauauauacauauauauguuauauauauaaaugaucuauuagaauagcuuauaggcuguggucuaccuaaccuaacaauagcugccuauaacuagaagguccuagaguccaguauuuguucaguccaugaggcugaaugucucagcuggacuucaguauauacuugaaucucaaagaaauugacucuaagggcaauggagacuuuguagcaaggcaaaaggaaacaggcaaagagcaaacccuuccuucuuccauguccuugcauaggcuuccugcagauggcauggccuagauucuuucuaggcuucugcuucaaaagaucuagauuaaaggugugucuucagauuagaagugguucuucccacuucaaaauaagcaaaauuccucacuggaauuuugugucccauuuagggguuuuaguuaauuccagauacggucaaguugacaaccaagaauaaccaucacagccaucaaagggagucggaugggaacucaggcaggguaggaaccuggaggcaggagcugaugcagaccuugaggaagugcugcuuacagacugguucaucguggcuuucucagccugcuuuuuaaauagaaucuaggaccaccagcccagggucggcaacaccugcaaugagcugggcccuuccucaccaaucacuaaguaagaaaauguccuacagcccgguguuauggaagcacuuucccaauggaggcucccuccucucaggugacuagcuuaugccaucacagaccccaauccugccuuccucuugucugcacugcaccccggcaccauuccuucuugaccaugcucaggcauuugcucuugcccccacaguagcuaggucucugggcugagcuuguuagcuucaugugcccagccccauccccgucuacuucugccagaacuagauggauuuugcaguuauuacuaggaaguuuaaggugcacacuccaucuuuccuuuacuccccugcgugaagccuauccgccaugcugucuuuucuccacuacaaguuuacaaaaucacaaaaguuuucuagcagcugucucuuauuuucccauguguggauaguaaaugguagugcagacacacugggaaaaaacgccuugcaacuuaauucccuuggcuccguggaggaaggcuggcugucaggacagacacugucaaagcacaguccacaucccaucguccuccuaggcccuggcauccgaucaccucucacgucagguucaucgccaccccaagcuacacaaagccugacacucaugccugcuucucccugugagugggacacggaucuuuggugugcucucuuucaucaccacauuccuuucaucacaucuuagucaaucugucgcugccuccucuuccucuugguccucucagggcggggggcccccccagguuccucauucaccuuugagaccgcagcagugugugcccaggucuuaccucacagucaaugcgaauguaggguucagccaacuaggcuaauuccuaucuguggugaaauccauuucucacagaccucccaccccacagauuuuauccccauguccuuggcuggacacguucacuccagucauguuugcucacucagaggcuguuugaaacagucugcaguauuuaagcccucauggacgccgcuccugccugcuguccuucccucgcagcggagguggagaggggugagauggauuucucgacaccucuacucacacagguauguccuugggaaaguuaaauucagacagcaaaccggggaaguagaugcuuuaggaucugguaagaucagauguagucuuaugcucacuccgugggugcccuaucuacucuuuggacagcaaguauccguagggucaguuugccacugcauuuuuuacagcuuugagauaucuauuuuacuuuugucuguagaggcugauucuuaaucucaugaaguuacauuugggggaccuguagccagugacacauucugcacaggcccgucacuucucuaggcccccucagccagucuuuaagauccucagguuuccucccgucgcucuuguacauccacauucacuuauuuccugccuccauccuggucagugccuaccuccuugcgaccacuagcuucucuccguuccuaaaauucacucauuucagaaauagaucauugggaccuggugagauggcucagcaggugaaggcauugguugccaugcuuggugacccugcacuugagugacaugacccacauggaaggagaggagagagcugaguucuuccuucaagcugucuccucauguaauacccccauguauguauguauguacguauguauguauguauuauguauguauguacauauguauguauauauaggcauggugucacacucuauaacccuagcacuuaggaggcugagauaggaagaucucugugaguauaggacaggccuggucuacagagugaguuucaggacaaccagagcuauguagagagauccugucuuaaaaaacagaacaaacaaaauauaugcacauauuuggaauuacacagcauguaaucuuuaagacgcuguaacuuaaaugauagagcaagauauaaauaauaacaauagauuauagcaacaugauauaaauaauaauucacuuguacaucacugacucagaaaauuucacuuuuggacaucuuuuuaaccucuagaaguagagacaaugauauuaugccuguuuccuccuguuuccagcugccuugugugguaccuauaacauaguuggccuucgcucaauuucuuuaaggugaaauagucuacauaugaauuagaagcucacccccccccccuuaagguuuacuuuuagcccagguagugguuagaauaugcuugccucacaggaaguggcacuauuaggagguauggccuuauuggaauagcuguggccuuguuggagcaagugugucauuguuggggugggcuuugagagucuccuucuggcuguuuucagaucaagauguagaacucucagcuccuucuccagcaccaugucugucuucaggcugccaugccuccugcuaugaugauaaucuacugaaccucugaaccuauaagccagccccaguuaaauguuuuccuuuguaagaguugccguucggucgucauggugucucuucacagcaauggaacccuaacugagacacugaggcacccucccuccaccucccuuccuucacuucccccucccucccuucccccucugucuuucccucuuccccuucuguauuccuguguguguguguguguguguguguguguguguguguguguguguaucuauguaugauaaaaugcaguuacuugaggcggucagaagaaagugucagucccuuggagcuucaguuacaggcaguugugagccauuuggcaugguucaugggaaccaaacaagccuuuugccagagcagcaagugcucuuaguuacauuucuuccucgggacuuuaauaagaaauguuuucuuaucaaacacauagccucuuaaaaacccaucacacuuuuggguaugaguagaaaaacaccuucaaagauaagccuguucuaugagaagugguuagugaagcuacaaaguagaggcugugguccaguagccugaguaaggauaggguuaaauugguaugcccuagggagccaagcaauuaggagggagcccuggagagacacuauagccuagaccugaagaaacuauauucaugugagggagacaagagacaaaucguauuuuaaaaaguaaggaagccuggaugccaugccccgaagugcacaagugucuguauaggaagggcauauaaaccuaagcagcugcuccugggaggguguaguuccagcaugccauggcacuuagagcaguggucagagcggagagaaacaaacccaggugggugcucagccagcagucuccacugaaaggcauuucagcaucccuugccuagugaaccauagguggauccccaccuccguuacuauaauuaagauaaucccccauagacaccuucaaagauaagccuguucuaugagaagugguuagugaagcuucaaaggccagcgccaucuaacgaucccuuaucuuaucagcuugacaagacaauacagcauuuuaaagccauaaccuuucaccccagguccacaaaguuucuuguuaaucucauaaacuuguccaaccugaacaacucuuacaucuuuaaaaaucccaacacguuaagaaaugucucuucacaauggcgucuauaaaauaaaauuaaaaaaaaaaaaaacaagcuauauauugggacaaaauaaacauucccauuucaaaauaggaggauggcauaaaacagccccagcaaaacaaauccaacaucuagcaggguaaauaccaaaccccguggcuccagguccaacuucuagagcuccugaugaaaucuaaccggcgccaauggacuggggugcgcccaccccuccagcucuacuaccgcagcaccugcagauucguccugaggacgaauugggauuuuuuuuuucaggcuuuugccuauggaguggugccaucaacaccgauaccaccugggggauggcuugacauugucacguuuugaugccagcuuaauguguagccaggcccccaugggaccucagguguaucagaugcgauaacccagaggaagcccuucgauauccucccagccucugcucaucuaucagcugcagcugcucugucugcaucagccagcauagcaucauucugccuugaaaguucugccacgagucuaccauuaucuucuuaaguuuagcuucucucaguucucagaacaguggggugaggaaagccagauucuuggccauaauagcacaggaucagcugcugucuggcccugaugacucuuguuucuuccuucugcaagcuccgcugucuguguauccauuggugcuccuugcgucuuacagacuccacuagaacagccuauaagcacugcucccccaggcugaccguacaguggugcuugaaaacgucucaggguccuggcuguuguaacuuuucauuugucuucagcaaaguuuuccuaauaaggucuuugguacugguuguuugguuuuuugguuuuuuuguuuuguuuuguuuuguuuuuaguggauuucaaguagaaugauacacuaugauaugaaauauucucagucuagaauugguagaauaucugccugguuagaguugaggcugggcaguguuggcgcacgccuuuaaucccagcacucgggaggcagaggcagguggauuucugaguucgaggccagccuggucuacaaagugaguuccaggauagccagggcuauacagagaaacccugucucggaaaaagaaaaaaaaaagaaggaggaggagggaggaggaggaggagggaggagggggaggaggaggaagagggaggaggaggaggagaaaagaagaagaagaagacgacgacgacgaccaccaccaccaccaccaccaccaccaccuggaguuaagggacagguuguuuaaagcagggaaaagaaaaaaagaaugaaauaacuugcgugucaguuuacuuauguuugaaacagagccuuauuguguaggagaggcugcccuugaucugacaguccaccugccucagauucuugagugcuaggaugagcaagaaugucagcuuaagauaaaaaaggguuuuacccuuuucgaaucaaagaauccauuauccacaaggaaaaugaccaaagucgagccagguguggugguacacccuccagccccagcauuagggaggcucaggcaggaagauugccaguucaaugugggccugagcuacguagugaauuccugccugcaaaggggaagagagaaaguaaaccaaguaaugggaugcagcuugaggucuaggauggguagcucaguagauaaagcacacaguaugagaagcccuggguucaauccccaagaagauggguggggggaaggugaguauauuuagccuuucagauagaaaagcuaaauaugguaaauauauuacuaaauauguuaauuuaucauaauagccauugauguccauauaagcuaggauauaauuuugcuuaauugauaccuaacacucuuagguauuacucuguugcuguaauaaacaccaugaccaauaucaacuuaggaaggacaggauuuauuuaaucucacugcccaucaugaagggaagccaggucaggagaugaaggcaggaacugaagcagaaaccauggacggaugcugcuuacugacuuaguuaacccuguggcuuucucaguuuguguauacagcccaggcccaccuaccuaggaauggcacaauucacagugccugcucccuccagcaucagcugacaguugagaccauggccacaggccagucuguuggagacaaugcuucaguugagguuccucuuccccaaugacucuuaaguuugugucauguugacagcugaaaguaacugugacacaccuccaagagaaugugggacagccaacaguggcccaggaagcaaugggaacauggaaacaauuaugugaauuuuuuaauagacacaaaacaaaagaagcucauggauuauuaaaguaauuuacccaucacaugguagguaggguacagcagaguggggacaucucugccgcagguuuuagauacugugugaugacgguguuagcccuuagguugguugugaguuaauaguucagguguagaacauggguguucaguggcuaguggggguuauuaagauagcccaagauaaucuggauucuggaucaacagcuuuccagcucucccaaguuguaaaguucaaaccccauagcugguuuagaaucuucaacacaguuguguggccuuuuuuuccugggaacugcagguuauagcacuuaaggauuagcagcugcuuaaauaggugucuucuuacuuuaucauccugaaguccacccugugaccuuguauuaauaaucccacuggcuuauuaauaagaccacuaccacaauaucuugagccaaacuugaagcaagcuuuaauuaaauacuggccaaggugguggacucuggucucgaguauucugagauucccagaaaauggugcugagucaaucccccuuggguuguauccugagucaaauccucgacucuguggcagguaccuguuuacacugggaucuaauaaccaucagcuuaaugguacccagaugagaauuaucaucaaguuaaggcauuaaugaugccaggggcaacaguaauuaguagaaacagaaaggucaaaggcccugcauuggcugacaucaguuacuauccaggaggagccugaaaaugagaauggggacaggucauuuaugucaucacaggccccuccuucaaccccccuccauuuuugcaauauuuauuuccuuaauuauuuuaggacagccagauuaucucuaacaguuauagaaacaauuuucucuuaaagccacacaggaccuccuuguucugucuaaagcaggucagguacccuauuguauuguagaccaauuucagcuagucaaccuaccuguugauagaucugagucuauuugguuucaacaaguaccuuuccugguaugccagugggcaagauaggcagccguuuuguccccugugccagguccuuuugaccuaacaucacagccuguugaggacacaggguagcauacucuacucucuuuaacuacuucaugcugaaauuaagauguuguccucagauucaggaaauggagcauucauuagaagcaucuggugagcugacccagcuggagagacagggagcaauccgaaucagcuggcuugguccaugucagcuuucggcaaguccagggcuccaagccaucuggaucagucuguagucugcagcugauuccuggguggugccugucaucugaaaucugucucaguggaaaucugcugagacagauacaagcuagggacagaaguuaaaguuuaaggaaaaucuuacacguggaacuuuuaggccuauaguccugguaauugggaaggagagagucucaagacagagauaggggaagcagggagagagggagagaaggagagagagagaccucguccucagggauagguguggggacuuaggugguucuuaucuggaguccuuuugaccugugggagguggauucaagucuuaggacucagacucccugagcuuacaggauuuuuuagucuacuuaaagagagaaaaguuuuagauauauaagcauugucacuguguguaaucuguagugaucuacauugugggaaaagcagcaagcaggugucuguaagacagcuggaguagaaucccaccuuugaaucagcaaaagcuauggcuucagguuaaaaaagaugaacauuuauuucuccucuguccagugggauggacauauagauuugacagagacaauuuuagccagugagaagcaccguuaagucuauacuuagaagacaaccaaauaaaauuuaaacucuuuuccuugugacuauaauaacaaucagugcucuaccaucugucagaauuccacugaucaguguuaaaacucugaacuuuugaaaucuuaguauaacaagaacagagagguaaagaaauaugaaacucccauuuuucauauaccuuaaaucauucucuuaaaccuuuacaacgaacgccauaagucacuuucuuagauccucugaacuuaagccuucacguucucagaccucucugcaccuuagaacacuaucuuagacccucagaacuuacauagacuuuaaaccguuuauccaucuagucauuuacuagaggcacaaaugguuuuugcugagagcagccauugcaaagcaagugcuuugaguaaaagaacaguaaauagcuacaucagaaaccuguuuguccuuuaauaugaagccuguuggcaaggaaaccccaucuaccuuucucaacuggagacuuaguagcuuuagaaacagcaaggccuaguuuuuacauaugaugugaacuaucuaggcagcugcagccuugcagggaggagcccguugccugcugccguuaaacugacagagcuacaguuagccuagccaucaaugccagcagagauccgagaaggauacauuguagcagaaaguauccaaauggcuuauguucugauuaaaaugacagagacuuacucauuaucgagaugaucacccuaggcucuguggcuacgauggcuuggggggagguggaggucucaggccagcauuggucuucagucaccaggcccagaagaucugagagaauuuuauguggaggacaggugaggaacuuuguggggacugaccuuacccugugguucuuucaauggacuugaguucuguucccaacugaccuuacuuugaccaggcaagaguacagcaaucaacucaacaguggccggguuugauggcagacgaggcaugaggcaguuaugcccagugguuaagguuaccagaauccagaugaaggugucauguuuagaagccuucaucuggcuucuacuacuaggagcuggggucucugucaugguaagcucuuuuacauuaaacauucuaaauuccaaauucagcagaccuuuagaaagucuuaaggaccaauaucuauuaaguauauacaaaguaauaaacuuugcuugcuuuuaguuacuugcuuuaggcuuaaccuugaaaaguaaauagccagggggugccgccuuuaaucccggcacucgggagacagaggcaggcagauuucugaguuccaggacagccagggcuauacagagaaaccugucucaaaaaaccaaaaaaccaaaaaacaaaaaaaaaaguaaauaaagcuuauuucuauaauuaaugauauuagcacucagcaugacuacaagugagguucugaacacauuauggaauuugaucauuuacucugugacuguuaacuugcaugucuuaacuauggcuuagcagcuuuuauaagacuaggauuuuacagcuuuauuuuugugaaguuugaauuaaaaaaaaacaaucauuucugaaggaacugaagcucuuugguaucaaaauaaaacuguaacucauaaacacaguccacauagauacugggaacuuugcugagccuuuuacaguguaccacuauagaauauuaguuucuuauauuacucagauuaucacaauagcuaaagccuaacgaaguuagccaagacgaggaagggagacauacauucccaagccagccucuuccagccugagccggccuuagguaaggagagacauccauccaguucuuagucagauucuucaggucguugucuuguugcuccaaaagagaggaauacuuaagguuuugguguuuagcguuuggugcucauagcuguggcccuaauuuuuuagccucuuaucuauuuuuuaaggccagauauuaauaauauaaaacauucuauaaauuuaaaguaucccauagccuuauacauuuaaauauuuuaaaagcuguucuuuuaaaaauauccacuuuucuaauuuuaaaauaucuguaaaacuccaaaauuuucucuuaaagaagcuuuaaaaucucucaauugugugcuccuauaacaguaaauaauaauaauaauaauaacaaaguaccuuuuuuuauuugaagagggggaaaaacccagagcaaaaccauaaucugaacaagacaaagccgagcuccaacaguaccgacaacucagugcucaguaccugggauucacucaccguccucugggauucccaguggggccugggucaccucuguggcccuguccucagcauuauacccagccugccuuccaggugccagcuggcuccauuucauagcagcugcuguuucugggggcugucauacggcaccagcccugccacacagugccaagccucagcuauucuccauggcuacuucaugccuuuaaaaccaguaccacccaggugacucuuauaucacaaagauuggcuguuccacaagguauguucuuguauauaaaugcauggagauaaagcguuaagaccauauuaaacaaacauuguuuuuaaauccugucuuucauaaaccuuguuuuuaugacuuuguuuucaggacagaaaucauuauauaaaaauccaccguaguccaaaaucugagacccuguugccuccuugauuuuauaccaugcgcucaccuuuaaucaacauuggugguggugaagucacaugacauucacccgcugcaucccuaacaaagauggcugccagccaagaggcugccuccuucccgaugcggaacagcagcuaagaugguggcaaaccacauguugcuauaucacgaaaugacaucaugccacauggucccuuuagguuaccuaugcguagaguuuuaacuaucaauccugugauacaaguuuuaaaugaauuguuuuucagaaauuucacgccauacccaauaaaguuauaaaucauaagguacagaaacuucacauaaaccaauagucuaguucuuuuggcuguucugacuugcuuucuucuccccaucacaacauccgguggcuucccugaacccugacaucuaaacuuuaaaagcaugccuaggucuggaaaaaggagagccaugacccaauuccagagccagcuuuucaauaaauaaggacaacauaaaacaacuuuuauauccacacucaaaagauauuuaaauccucgcuaaacugaacccaguggccagaaagcucauagauaaauuuugagcccuggccauaaaagaagccaugguaguagugguggcugacugcagcagagacagcaaaaaauauaacccagaaaacagaacaaggaagguuacauacucgaagaaugucagaaacaaaaugugguagccaccauauagucacacauucaacugagcaugacccauuucugucucagcucaggguuuacaauagaacuuacagacacaccagaaaacacagacccguccgcacaugcagagcagacagacacaacaaacaaacagacgaagcuuuccaaccauccagagacagacagacaggcaaugucucacuaucugcccuagacagaagaauaauuggggucucgcugaagcucccacacaacccagauacagaucacaccuaacagaauuagacugugacucaaaaccagaaggccuccauagaugcucccggguuuccucaacauggcaguuacacuccauagcucauaaaaccgaaggcaacuccaaacccuuggagcaucucaaggccugugcuucccgcagcagccccucggcucugcaguccagagugaaggucuggcuuuagaguuugggugggcggucugaaucucacugaggccuccagaaaauguuaaucugguggagaauaaggcuguuaccucaacuuucugagccaaauuuaaaguaagcuuuaauuacuggccaagaugaugggcucuggccaggacccuucugagguucccagaaaauggcagcaagucauguuuuuucagugacuuauaaaggcagaacccauaaggcuauguauuuuccaccagguacaaucaggagcaagcauauaucuugacguacuuccugccugcauaccuccugccuauguccaaucaggggcaagcauauauccuuauguacguccugccuccauauuuccuaucucugugaacaagcacgucagguacaauugauucaaucaaacucguuuagggaagugaaaaguggcuucuaucacacaugaguaacggccucaaacauuucagaaaauaucuugcccuuggacaagugggcuuacaggcuagaggcauuuuuguuuuuauggaucuuugaggcauaguaguuaaagcuucaaacauaacucuagcucucacaauuggcucucgguuggcguugucugagauauacuagauauccuccugugugguccccaaguggcucauguuuuuacacuucagucagcuggaaagagcagaaaggagaagagggacggugcuaaaggggagggggugggggggugggcaacacccugggagcugcaaguaagaauucugcuccuauuucauuggcuagaacuuaagcacggggcauaaccaacuccaagagcaucugggaaauguagucucugucuuagcaggccauguuuccaacuaaaacuccaaguccugcuggggaggagugggugcugggaggagggguaggagaggaacaacuucuuucauaguuuuucuugugauaauacacacagugaugaacggugugcuggcaauguggcuagggcuaaagcacuugcauguaugagacauugguucagacuccagcacugcagaaaaagaaaagagaaaagguaaguauguucacagauauauacauauauguauauauauauauauauauauauauauauauauauauauauuuaaaggaaauguuuuuuaaauugccauaaucuccuuuucuuuguuucuccuaacguggcacuuguguuuaauuuaacuuuaaaaaaucucuucaugauuuuuguuuuguuuuguuuuuuucuagacaggguuucucuguguagcccuggcuguccuggaacucagaaauccuccugccucugccucccaagugcugggauuaaaggcgugcgccaccaccgccuggccacucuucauaauuuuuaaaaucauuaaacaucacauguguaguaagacgagucuuggagucagcacugcauaccuguuccagcucaguuagcauuguccuaggcguuuuccccguggccuucauuguaaaguagcucucucaucuauaaacguuucugguuuuugaaucucauuuauuuauugccugugaguguguguguguguguguguguguguguguguauuccucagauccauggcugauauuagagaaaaacacucucucucucucucucucucucucucucucucucucuuucucucguuguacacucacacucuggucacugcacaugcagaggucagaggauggcuuucagauguugauccccuucuucuaccaugugggauucagggauucaaaucagcucaucagacuuccuggcgaucgccuuuaccuacuuagccaucuugccauucccccagcccaaaugaaaugauuuguuugugacaaccuagagauuuucuguacuucccugccaccacggcaucuuguaaaacuguggagcuuggauccaucaugaccagaacauuuccauugcuucagggucccucacagcgacacacuccacaguccuuuuuauuccugagauggugucuguagcuuuugcccucaccauccuccugccucagccucuuaggugcuggggugauaggcauguaccagcaccccuccucuuacccauaauuccuggcacccauugcuaugcucuuuaguucugugguuuuguccucauacagugcaugacccuucaucaugggcacaguguagcucccuucuguuucacccaacuuguauugggaauccaucccuuuucucacagaggaguacuccagguacagcuguaucacuuuagucucguaaaccauaguccaccuaacaauucuucccucauuuccucucuccucccagcaaugccaagugaguucaccucugcaaagcugagaagugauugcucaaggaccucccugcaaugguacacccgaacccagcacaagaugagaagacccagcuuguuaauaaaagacaucugcaaguaagcgcgagccccaggcccugaggccgaccccucuagaucaacagcagcuaggucgacgguguggugagguucccaccuggcgugagaggaaagcacgggguccaagggacagguuucaccacagcugaguugacgacucgggguguggaugaguggccucauccacugcuuguguuugguagauggugagcuccauucccagcagaugaccagccucugagcuuggaugccuacgagcaccacagucaucuguucuucaugccacugcuaaccaaaagaggcauucgcagcuaucgugagcucaugugaacuggugagcuaaaggcuccuuaaacacuggagaagagagagguguuuaagccaggggccucuuauauuccagcaccuaggaagauuaacagaggaagaacuuggcagguuucuuugguaccagucaaacccguuuucuuuccuuuuuuucuuuuucuuuuccuuucuuucuuacuuccuuucucuuucucucucucucuuccuuucucucucucuuucucuuucuuucucuuuuugucuuugucucuuuuauuuuuuaaacuaaaaugcguugugugugugugcauguguauguguauguguguguaaguguguguguguguguguguguguuuucacaugcagcuguauguuuuuaaggucagaggacaaauugguagucaguucucucugucuaccuucaugugggcuauggggaucaaacucaggcuuccaugcuugguggcaagugccuuuacccacugagccaucucaucagcucuauuuuuuaaaaaucuauuugcauucauuuaccaugcagguguucacacacguauguguacauucaccgugaacauacgccacaggaugcacccggggaucagaggacaaccaagggagucagggaucgaacucaauucacuaagacaugguggauggugguucuaacccucugagccauuuccacaggccccggguugaaaauuugcaaaagucuucagauagaaaagauguaaacccaagcucggcauugugacacaugccugugguguggucacucaagacugggaaggaccucaaggccaggccaggcugcauaagaaucuguuucaaaaagcagagagagaaagggagugggcaaggagagauagaaguuggucucccacuucacuucauggacguuuaugugaauaaagauuugaaucccauuuggucccagucaucugguggcugcugagguuuacagcauaccuagcacuguaucugacgccugcuauauagggccuucauccagacagacccaggccugugcugaguggugugugacagaccacgcuaggaaguacagcgaagaggcacgugcugcagauguggggaugucuuaauacccucugauuuuaaaaaaauaaaaucaaauuggggauucaccuagcaugcaagaagcccugauuugaucuuuaucauuucauaaacuaggugugguacggugugccugcuaccuuagcacuuaggagguggacucaggagaaucaagggcuccagaucuuuaagugacaaugauuuugaggccauccugcgauacauuagacucugucucacaaaaaaagggguggggguggggugcugugagaugaagcuagaugagguggcaugugcuuguaacuccagagcuggggaagucuuagagaugguuggaucccugaggcucacuagccaaccagccuaggcugcuuggaaaguucuaggccaauaagagauccuguuucagaaauaggcacaggaggcagggaaguggcucagaggguaaaguuaccacgaaaagccugccgaccugaggucaauccccugggacccacauggugggaggagagaaccagcucuaacagauagucccccgccucccacacaagcugugacacacgugauaugccuaugcacauaucacaggaguaugcauacauacacacacacacacacacucacgugugcauacauacacauaggcacgcacauaggguuagagaaaggacugcaucauacuuaguucauggauuaguaaaaauguaucaaggggccuagugaaaugccuucucccuccccccacccauauuucccucugcucuggagaacugucauuaacuguaucuccuauguauaagauacauucuuuguuuggagauuugcucccucuugacuuggccaagccauuuucauagacaauacuauauccucucuaccugaccguguacucaaucucaaagagagauuuuggugcacagcaugaagugagaacucccagcaaccccuccuugcauccucucuuuccucagcauuugcaucuguuagagccagcacaaucugcuaggggcuuuaagaaacugacuccaguuccuggagagcugacuccuucaucugcccuccuuggggaccaagcacacaugugguaaauguacauacaugcaggcaaauacucauauacauaaaauagaaggaaauacaucuuaagacuauagauguacuuuaaauaaagcagcaguggcucuuaaauuguggcuuagacauuuaacuucucguucaucaguauuacuggggauuuaucaaaacugagaucuuggcugggcaugguggcacacaccucuaauuccagcacuuagaaggcagaggcaggaggaucuuugugaguuagaggucaaccuggucgacauaacaagcugcaagacagccaggacuacagagagacccuucugucucaaaacaaacaaacacauggauaucucuagagcuaaaacuagacagugucuuuccuucaaagacugugugucuauccaucugucugucugugugcauguguguguguauguaugugaugcuaagcuagugugaauuuaugagauguagagacagcucuuugaugugcuuaaggguaacugaugguaguuuacagguguuuguuuguuuguuuaguguuugaccugcaaguauguuugugcaccaugugcuugucuggugccagagaccaggcaggagaggauccccuccgcccugaguuacagguggcuguuagccaccauguaagauuguuucuuuuuaaaaaccuuugggaacuugauacaugagaacuacaucuguggcuuuucuacuucucccugcaccuagauaauuucuuuguuaaauauuugacaaucucuuaagaagcagaaaaagaauuugaagcaaagauucugcaguucagaucuacuacuuauucuauuuaguuccauugucaaaacugugauuugguuuuuaucauuuggauugucugcccuugcaacaaguggcaguaggugggacgaguuuauauuugcuuauagcauagaggaucgucuaaucaggaaauggcaccuuccuuucacaguguggcgaccuuaggucagcaguucucaaccuuccuaauguugugacccuuugucguuacuuuauaaauauacuuuuguuacuguuaggaaucguagaguacccugauaugcaggguaucuggugcgugacccgcacagguugagaacugcugucuuugauccugccuugaucucauuugaaucaggguuguacuugguguauauuuuccucuguguaucacauaaugcauuacuguacccgacucccccccacccaggugcacguugguugcauuuggagucuggcuccuguacauccucauuuugaauuacaccgcugaagaaugugacaugaaaagaaugcacuauguggacccugaccggauaaaggugagcuagugcgugcgguuucaguucagacauuuccaagcacauacuuuagcugcaggcccaucucugccgugugacauagaacuccucgugaaaaccugaagaaguguucagguuacacaccuguuucugugauaaaauucucugaccaaaagugacuugggugggggaagcuuuauuuuaauguacagggugcagcccaucauugagggaaguuaaggcaggaacucuaagauagaccugacugcuauuccaugaagaauuaccaucuaaccagagaacucacucacagccaaggaguguaucagaaaccaugcaggagcacugccugcuggccugcacaggcucaugcucaaucaacuuccuuauauagccuaggaccaggacccuuugccuaaggaauaguacugcccacagugggcuggacccucuaacaucaccaaucaauauagucccccauagauaaccucuaacaucaccaaucaauauagucccccauagauaagcucauaggcuagucugggcaguucauuaguugagauucccuuucucaggugacuauaagcuguguccaguugauaguuaaagcuagcuaggacaaaggaaaaaaccaaucuuagcacuccaaaaacagaggccucuuucuggcccuuccguuuugcagaauuauuuuccacuuacuagugggcuuuccccgauacauguugagacaccuaccguggaguuuaccauguugcuguccaucauucuucuaaaacagccaaugaaaaaguucugugguaugaugugucacuccugggcuucgguucuacgggaucucuauuaacauuguggccagcagaguaaagagccacgugaggcaagagggaaaucuaauucaacaugacucaguagucacuguugguucaaacuuuuagucuugacacuaggcaguuuauuuuaggcauauuuaaguacaggacaauuuggggaaaagguuuccuagaguaacacagucccgugugcacaaggaggccuaauuacaucgaaacucuucucaaaguguaugccacuucuuccaugaagauggguucuaaagaucagcuggauguauuaucuuaagggccauggguaagggccaugggagguuauguuguggucuugaagagguccucugggcuauuagccacuuccaguccugguuaaaagagcuugagggaggcccuggcauacagauagcucaaggaucguguaggcuaugagcuaccuccauucccagccuucuaggugggaacagguuuuugcuuuccugcugccccacuguccucagaugcuugcagccuuccccuguuuuaucaauauccacaucugcuugggagccacguguguccaguguccugugcuuggagcucccuccucuaccccccugaagcccguucaauuccauggccuuucacagugcacuuggaucgggguuguugacaauccuguuuucugacuccagggaaaggccuaaaauaauggcauuuagugcggcuuacugaauugcuguggauucuucugucucuuucuuugcugagcuccuucacuuucucaugcaucuuacuuucccauccuuuuaauuauaugcaccagaacugccugccaguugaugacacuggagucuguauuguggaggagagacugagucucucacaugaggccgaacauggugcuucguguaggguggauauguuuucauaaugucguaccaugcagaguccaccuggcagaaguagagaccugaccgccugcauuccuuaguuccccccaaaacuacauuaauaaccgggauuggucuacuuguccuuuuagaggccagacaacugcauaugugugugugugugugugugugugagugagagagagagagagagagagagagaauuugugugugcaacccaccaugccugguuuuucccaugggcccucaggcuagugcagaaguacuuugacacucaaccaccccuccccccauaacuauugcuuuguuuuugagauuuguuuaaacuuuauauauauagguuuuugguuuuguuguuuuguuuuggauuuugguuuuuaggacaagauuucucuguguagcccugaacuguccuggaacuugcuugguagaccaguuggccucaaacucagagaucugccugccucugccuccugaguacugggauuaaaggcuugugccaccaccaaacccagcuuguguauagauguuuugccugcuuguaugucuguauaucauaagugugcagugcccacagaggccagaaaagggcauugaauccccaagaauuggaauuauagaugguugugagccuccagguagaugcugggacucaaacccagguauucuggaagaacagccagugcucuuuaacuacugagccauugcuccagcuccaugauugcuguagcaauugcucuuuaaaguucuucagggcccuagugacuugauuaagaccuagaggagacucaagacugcauuucugagguugcauagaaagggugggaacgcuuacauagccugaaagaucugcuuuggggaaaugaugggaccugccuaggugaccuuaguaacagaaagauguauucgacuagcaaccagacugcaggaggaaaggcugagaucuuccguuugccacacacucucucauauuaauugaugugaguauauuaccagucugucugaacuguaaauuauuugugaguggaauugaguucauacaauuccugagagucuaaguaaaggcucuuaggagaucuuuucucucgccuguugucuguuucuguuuuaucuuugccucaggcaugcccugugauugcacagcagaauuucuaaaaacagaaccugcugagucacaccucagacucuuggucucucauuaucuuuggaagcauguggagacccguuccuccaccuguggggggcuucauggcccguggucccacuucccuccgccccacaucaucuagcacugcccguguugggugcacuggguggaacugcuuucauucccucucagccucauucuuucugaccacuuuauugacauauaauucacacaucauaaaauucacuguuuaaagcguguggugcacagucuuccaugcauuuacaaagcuguguugcaugacaguguguguacagagccuuuucaucaucccccaaagaaacuccaggacucuuagcagucacucccuaccccaggcaaccaugaaucccuuucugccuccaaggcuguugccuguuuccuguaaauacagcccaccgucuucuguugcuggcuugugcaccuagcauaaugcguuccuuuuuccggcugaaagcuaacacuggcacugggcauaaaggacccacaguggugucccagcaccagaggaugaggcagugacugggguuaguguacacuguggagcaagacccuguuuuaaaacuaagcaacaacaaaacccucaggggcgaauccuggagaagguuugcuauagcucucccuuguggaagggaagcuaagggacuguuaugugcgcaucaucccuggaagccugcaagaguccugguacagaacuggaggcaaggugcccuguguucuauguggcucaggcucaccuuaaacacgcaguagcucucuuaacaucuuuuuucaaacauuuccuuuauguaugugugucugugggugaguacugccacagcaugcacauagaggucauaggacaacuuacaggaauugcugcuucucaccguguggguucugagggaugggggagcauguuuacccgcucaggcaucucacugcaccccaccuucugaaaaacaaaacaaaaaacagcagcaacaucagaaacaguuuucacccuuauacauugccccacauuucagaaagguauugguaagaugucacccucugcugugugcagcguaucauggagggccuggggugaggcucagcaggaauugaaauggaaaagggcacagaggggagguccuuaaaaccacagcagacagcacacuaguuuguuaucucugguacaccguggacugggauugcagaugugcgcuacacaucuggcuuuacauguggguggauuugaaugauuguacauguguagucucagaagugaaccccgcuagcuucauuggucauguccagcaucuggaagcaugaacggcacccuguccuauccuauaagauacuaguguuccuaguugcacccaguccagcugucauucauuccacaggggagggagaacagcugccaaguuguggaguuuaugauuuuuuuuuuaauuuaaaaauguccauuaacaugccaguucuuaacaagaccaaugguagucucugaagagagguuuaaacacauugaaagugugucugagauccaaaauugugcuuaaaagauacuugagaagagacuggcauauugugucaauuuaggcuuggucugagugguggcagcagcaauuugaacuuggcccacucuucuuucugagagcugaagaccacaggucacccugaggacagcauuccgugcagcauaguuaauugggacccaacacucagcucuuccggccucgcgguccucccuuuaccaugcugcucacagugagcgggcucgcccugcauagcuggucuuugauccgaggcggcagcacuugcacacaucucugcugugcuugcuaccaccccacuuucuacagacuaccccacaacgugucagagguuaaaaaaaagccacgacuccauccuccacccagcauccacugcuuuaacggagauguuacuaguuaaguagaucugcagcugccagccuuucugucuccacaguugauagacaugaaaucacacaguaggacuuaauccuuuagagcacucuacaccguucucagcguaauucaguuuggggcuuucugucacacugcucaauuccugcagagcccuuucucaacugauuccacacagagcccacauccacuacggcagugaggguucacuguggcgucugccccaugaguauuauccuuaaauucugacugcuuuuaaucaccagaaggcugagaacuuugcucucacuuguggcagccacuaggcaaagggaggaagagaccagugugcaguuacagaugugaaaacuauguguguuucuauaauaacugguccccagauaccaggagcuaugacuguguuaagcucuuuccuguauuuaguuaacucaaaguucauugaccuaaauucucuccucuccugaaacuauaaagucgguauguaauggggauagagcuucauguggacuugaaagucugccacuuguuuguaugucuaagaaacaugaccccgaagccagggaguggaaauggcagugcugcugaggaggucagcuugcccuuaaugcccuucaguggauauuccuguugugauggcccaugguaaauuaucacaucagugacagcuggaccuucaagaugucuuuauucuucauugcugguggccugcagcucaaccuggaucacguuugucuuagucaggguuucuauuccugcacaaaccucaggaccaagaaacaaguuggggaggaaaggguuuauucggcuuacacuuccauacugcuguucaucaccaaggaagccaggacuggaacucaagcaggucaggaagcaggagcugaugcagaggccauggagggauguucuuuacuggcuugccucaccuggcuugcucagccugcuuucuuauagaacccaagacuaccagcccagagauggucccacccacaaggggccuuucccccuugaucacuaauugagaaaaugccuuacaguuguaucucauggaggcauuuccucaacugaagcuccuuucucuaugauaacuccagcugugucaaguugacacaaaacuagccaguacaauugaccccuugucaacuugacacacaaaaacaucacuaguaagccucaacccuuacaaucuuauucauccccaagaucuaaauaacuuuaaaagucccacagucuuuacauauucuuaaaauuucaaucucuuuaaaauauccaucucucuuaaaauccaaagacuuuuuacaauuaaaagucucuuaacugugggcuccacuaaaacaguuucuuccuucaagagggaaaauaucagggcacagucacaaucaaaagcaaaagucaaucuccaaccguccaaugucugggauccaacucacgaucuucugggcuccuccaagggcuugggucacuucuccagccaugcccuuuguagcacacgcgucauccucuaggcuccagaugccuguaauccacugcugcugcugcucuugguggucaucucaugguacuggcaucuccaaaacacugcaugaccccuucaguccugggccaucaauugcaacugaggcugcacuuucaccaauggccuuccauggccucucacagugccaagccucagcugcucugcucaacuccuucaugccuucaaaaccaguaccaccugggugacccuuacacauuaccaaguccagccacagcacaauguacaacuuuggcuauaucuggaacacagccacugugcucucagaaaacacuucccagaaaaugucaccucaaugaugcuggucucuucuuaaucaccgcuaauuucuuagcuccagcuaaccagcaucaauagucccaguaaugcaaaguuuuugcuuuaguaguucugguaucuuguuaaucacagcugauucuucagccccagcuaaccagaacuacagaaucuucacaaucaaaacaggaauggcccugaaaagagucuuuaauuuucccucugaaauuucacaagccaggccuccaucuucugcacuguucucaacauuaucuuccaagcuccuacaaaacaucugacagagcucuuaacaacgaauggaucuucaagcccaaaauuccaaaguccuuccacagaccuccccaaaacauggucagguugucacaggaauaccccacucugcugguaccaauuugucuuagucaggguuucuauuccugcacaaaccucaggaccaagaaacaaguuggggaggaaaggguuuauucggcuuacacuuccauacugcuguucaucaccaaggaagccaggacuggaacucaagcaggucaggaagcaggagcugaugcagaggccauggagggauguucuuuacuggcuugccucaccuggcuugcucagccugcuuucuuauagaacccaagacuaccagcccagagauggucccacccacaaggggccuuucccccuugaucacuaauugagaaaaugccuuacaguuguaucucauggaggcauuuccucaacugaagcuccuuucucuaugauaacuccagcugugucaaguugacacaaaacuagccaguacaacguugaagagcuaaagccuuuauuuccaccccuagauuugacacagcaucuuguuucuuaaaagaggaacaucagcucucuggaucucagagccgccaggauggcgccucccagucagcccuccuccacuuggcugccaugguccggaaccccugcuuccucugagcaccccaguuccuuaaagugaacugucccaccuuuuuuuaaagcugugaaccccauguagggaaaagagaagaggccccaaagugcacuguaguuagcaaaaguugcccugugauggcaggcaccuucagagcucagcacaucuuuaaacauguggaaccaggcucacaguguucucacucucuccagugcuguuagcugcgcucgcucccucagguccccagccccagcccugagacaggcaggguuacuacagagggugacagcugggccuugggcucugcucacaauacaguagauuaaaugagaugaaugcuuucccaggacagggaauggaaugaaauuucacuccucuccaaaggaaacuucuaaagaaaagauuuggcagcacaggagagcugcgcgcacacuuccagcauccuucccugggccuccuuuggcacgcugcaggugucccuuuggauccuaggugacuugggaaaacauguacugggcaugaauccuaggggugaacuggguuucaggagcuccaaaaauggcugucuaugaccacgagaccuggagacuagagcgaugaguaaagucaguggcaggacccuucuguuugccacccuccccccaggcugggauaaggccccaugaagggccgagccucgccugcuuaguguuugugaggacuccgggccaugauagguuccuugcuugguguuccgacugaccccucaggaagaugucagugcuugugugagcugcugguguguggaguaacuuccuuuuccauaggcguagaagcugcuguuucgggccuuggcacgugagcagcccugauucauucuccugggugugacaccuugaaaccacaaagggaacucacuggugaccuuaucuucgggugccacagggggugcaaggcugugaaaccauuagucaguuccccuuuaccaaaaggagguaaauuccccaaaugcacacacacaggccucucuguguagcccuggcuggccuggagcucacucuggagaccuuugcaaggcuacacuuuaaaaauauuuuuaaagguuuuucuacugagaugagggaaauguuuccgucgaaaguauauuuuguaaaaaucagauaauggcuggugaaguggcuccaaguguaaaaagcaccugcugccaagaccaacaaccaguuccucccuuagccccacucggaggaaggggaaaacuggcucccauagguuggccucagauaccccacacacacaugaacacuaacacaugcacacaccaggcacacacacccacucacauacacauacacagaaugaaguguaacaaaaaauuagaguaaaaauaacaagaccgaggaaaaccagcugaggucauguuuaugacuacaacagcuagaaucuccaugauacacugacagguuugaagacaagauacagucuuaaaaguagguauccugugaccuacaggagccugugccacacaucugcacggacucgugugcacacaagagaaaacugccccgggggagggggggagcggggggagcugucggacacaaagaugggaagcacacagcaggagcagcacgugggaagucuucugacugggccucagcagcuggccucgguaggaggaccaucccugggcacgugcacaggaaccagcaaguucugugaggucaggacacuuguucucugauaacacugaaggucauugucucccagacggcacaaagccauagaacaaaauuuaccaucuuagccaguccugagggccaaaucagagcauugcaacaugccaagcaaacauaccacugggugcaugcguguguguguguguguguguguguguguguguguaugugugugugugcacuauaacacaguacggaggucagaggaccacuuuggggaguaagcuuacuccuucuauucugugaguucccagagauuaauuaaacucaggucagcagcaagcaucuuuaccuacugagccaucuuucuggcccuccagaaucuuucaaaaauacuguuuuuguuacugucagacacauuccuuaucucugcaucuccucagucccuggucccacuauucuuccuuguguuuucuauagaucugaccacuaugcauacugcagguaaguacagucagccaacuuagggcccaucuucuggugacaguuugccucaguggcauaaugaaaguaauggccuuguagaguuucuguucuugucauaagauauggccuucugguuccugcccauuccugagaaaacacuaacccuaaaagguaaaugauguauaucaucagaugguaaucacaggacuaaaugucuagacagugucauuucuaauguuggagagguuuuaaagccuauguuggucauccccuuccagagagcucagagcuaugcucaggaagucuugcagaaggaaugucggcccagguacgcgaagacggcuauggcucuguuauuugaggacagguacagcaucaacuuggagccuuuugugcagaagguccccacggccagugaagcugagcucaaguaugacccgccuuuuggauuccggaaguucuccaguaaaguccagagccucuuggauaugcugcccgaacaugacuuuccugaacacuugagagccaaggccugcaagcgcugugugguuguugggaacgggggcauccugcacggacuagagcugggucacgcccucaaccaguucgaugugguaauaagguaucugcgcuccaaaccagccuugcuucucuagaaucuuccagggacagagaggaacagugggagcucuucagcaccccugcuucaacucuuggggguguugaaacaaaaucacaaauggccaaguguccaaacugcauugcuuacccuagauccaaggccuaugugugggcugccgucacuggccaggccucgcagaggaaggagguuuggaaagguggaggugggggcuugguaaccaguacuguaagacagagccuguaggcugaugcaaggcaggagggcaacaccuggcuuuggggacaaaguuuagggacagugagcccugggaggacagccagccuccagggcaguuagaacucagcacaggcaggaaacagccauccuagaguucagugauguuccugacucuucaagggggggcgagugcuugcuugcauacuuguuugguuugggggcuucuuguuguugggggcguuguuuuguuuguuugguugguuucuguuuuuuaggacaggaucucucugccuaggguuaaaggcaugugccaccacacagugccuaaaaguuauuuuuccuauuuaauuauuuagauuagggauauagccaaaugguagaaugcuugcuuauaauacacaggggccuggauuuagugauagugcaggaaagaaaaagguuauccaauuauaaauguaaaacauacccauuauuaggaagaaaaugagggcuacucggaacaggaaucagcagccacugccgacugcugugcagccccccucacuccugcucuggaugugagguugcgucuguguuucugucucucucuaaagauugacuuuguuuuugguuuguguaaccuguguaugugugcacaugcgagggagugcccguggaggccagaagaggccgucagaaucucccaagugaaguuacaggcugcuguuagccacccaacauggcugcuagaaaccaaacucuggaagagcagcaggcgcccuucaccacggggcaccucuccagcccuccacuguguuuuuacaagauaguuuaaacuuacacuuaugauuaguuucugaggucuuaguaucuuagcgcuccuuuagaagaagauaauuuuuugguggcucuuuugccagacauuagaauauuuaugucucuuuacuuuuuauugugaaacuacuuugcauauuuuuaugcacaugucguuuuauccagcuaugauugguuccuuagacaaguuauuuaaaauagaauuggucucuucaagaccuggggccuauuuuuccgacccuggguuacacugcaguaaauuagccacaagaucuggguccucauucagucuguccugcagagacccaugggcaggcgggagagaggggaaugaagacagagccuacagacgaaggugugacaugcauggcugggggugacacacaaagaguggaaauagugacaagacugaauuugggggacauacugaaaaguaauugacagccccuuuuaauagcuugaaaacuaaucucaagugauagauuucuacuccagggaucucugaccuuagcagaaccacuaaccagaaccacuaacagaaccccggaaguggggaaaaacugguuagcaagggacaugacaaaacccaucccagccauuuugacucccaaaaugaggauguucacauggaccuuugugauuugggccagccacuccacagugccucaguuuccucaucuguaguccagaagcaguaagguuuguccacuguggagaccagacgcacggacgguaaagcacuaagagcagugagugacaggauggugcucuguaaaugccacagcuacuuugggggagagcauaggaugcagggcgcuggggcgaggugcaguggguaggaggccuuuguaggaauaguuggguauucaaaggggcaaggaaaagaaaccaggaagaagcagaaaggagccucagaugacugggagcagagcagagugggccgggucucacggggaggucaguggcgacaugaaacagcugccaccuguuccggcuuuuuguugccuggcaguguuaagugcuuucuucucagaaauaaucccaguuguugaugucaugagugucugguaccauggaagacacaaagaucucaguccguaacugauuaaauacaagggcugagggcuuccagaaccuuguaccggggccugauugaggagcaaauuaaugccuguaugcaaguagcccugugccagacaggaccaggagccccacccauccagugguucauggcuuaggcugugggaaagaaguggguuagacccaugcagacagugcagaccuucaguuccaggacagauggcauaugaagcuggcuuagaaggauagcaguguguaucuucccagagaggagucagacagggguggcugaauggagaacccuaccugguggggggauagggcuaagacagcugagagggaccagaaaugaggcuugauguccugggguggcaggacugggcaugaacgcuucaagggcaggaagacuccugugcaccagggacagugaugggugcaucaagccugauuagaaagagaaagauuaagaaauguuuuuauuuucauaaauccguggagauaguacagcuccuuccugucuaccuucucgcccuggucgagcacgcccgguugagcuuauuuucccugcaucgacucuacagauguuccuuagcguaccaggaggcuuccaccugcacacccagcauacaccuccaucaaaagaugccugaggggcagcgagggagguggcucaguuccuauauucaugucucagaacuggagcucagcccuccagugcccaaguaaaugucaaguagacaugacagcccggcuguacauuccauguucuauaaugccaggcucagagagcagaggcaagggauccccugggcaggcuggcuggcuacaguagucacgcuggugagcucuggcuucauuugcgagaccuguugcagugauuaagguggagagccauggagaguggcuccccaugucuccacauagccuacugagcaucuuaguuugcucaucacucguaguguagagugccugucacuuccccucaugauccacauggcugccaccccgucacagcauaaauacacaucaccagcccaggaaaagucaaaauccaaaguucacaauuugguuucugucaaaugcacauggcuuugaaccaucauaaaguugaaagaguuuuaagucaguccacugacaguccaucucuacuguuacucucugccgacccauuuuugaaaguugauuagcaaguccugagaacuugagcgugccuuccugagaacgaggccaugaugcucaagaucagagugugugugugugugagugugugugugugugagagagagagagagagugugagagugugugaguguguguguguguguguguguguguguguguguguguguguguguguaagccaugcccuucaguuucgaucaggagaaaacagucuggcccagugugugugugugaguguguguguguguguguguguguguguaaaccaugcccuucaguuuugaucaggagaaaacagucuggcucagugugugugagugugugugugugugugugugugugugugugugugugugagagagagagagagagugugagagugugugugugugagagugugagugugaguguguguguguguguguguguguguguguguguguaaaccaugcccuucaguuuugaucaggagaaaacagucuggcucagugugugugagugugugugugugugugugugugugugugugugugugugugugugugagagagagagagagagagugugagagugugugugugugugugugugugagagugugugugagugugugugugagagugugagugaguguguguguguguguguguguguguguguaaaccaugcccuucaguuuugaucaggagaaaacagucuggcccagcggcacgcucuggcauuuaguugacuuauaaccaagggauuagcuugguuuaguaaccaagggauucgguguuuaaggucuggaagaggaaguagccaugagaaagaaaguuuagacacaacugugcugcggacacuuucaugggauuucagaaauccugggcacaguggcacaucucuguaaccccaaguacucgagaaacuuuggaauucugucaagaacuccuaauuaucaaaacaaacaagagauuuucaaagaaaguaacauccaggaaagccccaaauguucuauguuuggauuagcuuaaaacaccaggacaugccagaccacuuagguugacagucauaaggccguaugcugguguuccuccauggacugcaggcugcauucagugaggaccacgggggacagucaguguugugaagugcgcggaggccauugggagggaagccuguuccaacaauguccugauucaugggggacauggcauaggaugugggagugucacgugauaugaccggaugguuaauggccuccuuugucaauuguucccuuucguuugaucagguugaacagugcgccaguugaggguuacucugaacacguugggaauaaaacuacuauaaggaugacuuacccagagggugcgccacugucggacguugaauacuacgccaaugauuuguucguuacuguuuuauuuaagaguguugauuucaaguggcuucaagcaaugguaaaaaaugaaagccugguaagaacucaaaguccucgggcaaucagacauagguaaaagcuuagagcaucuuggauugcaauuauggacauuuauuuuuuaaauagacacaguagaauucauacuuuuauguugucuuucaaauuacacucucccuguuuguagaaaccccucagaacucuugcugcaaauugcuucuagaaccugguuaagagcugggucgugggacugaaaaugcagcucaguuguagaauccuucccuggccuggguucgguccccagcaccacauaaagccgggcauaggagugcacaccuacaagcucagcacuugggaggugaggacaggaggauaagcucugggucauccucagcuacauagaguuugaggccagccugggcuacgugugauccuccugucuuagaaacaaacaaguaaauuaaaacuaggagagaguuuuaugugaaaaugguggucauuacuaaaagggaguaugaacuuuaggaccacauuuuccauccugagauuaguuaccuuguucuccagaauagacucgaauagcuuuuaguuaguucaagaagugaggcugcuaggaugaagaauauauauguauguauagauauauaucaucccaaagacguucuccaaaaugccauggucaggauccugucacugggguaaauccaaagucuucuagaaaggcagagcagagcuuuccaccuggauuccuguuguugggcuguccaguagucaaaucauguuacuuuguaguuccacccauuaaagugaaauaauuuucacaguucaguuaucaagcugaucacaaauauccaucucuaaaacuaagaggauugccgggcggugguggcacacgccuuugaucccagcacuugggaggcagaggcagacagauuucugaguucaaggccagccuggucuacaaagugagugccaggacagccagggcuacacagagaaacccugucucaaaaagaaaaagaaacaaaaaacaaaaacuaagaggauagggucaucggagauggcucagagggugagccauuauggugccugccaccaugccucaugacccaaauuuaaucccagggagcugcaagguaaaaaagagagaaaugacucucagagaucuuucuccgccuaauacacacacaaacacacacacacaccuagaaagcuaaaauauacauuguuuuaaauuagcuccauacuguguaauggagccauuucuauccccagagccugauuuucuacagauuauuaugaucuuggauuuucuauugcauagaauuucuaaugggaaaaugaagugaccuacagccuguugcuaagcaacuuuaugagacuaggaguuaaagucaguggaaaguggguacuggugagaacccauccagcaagacacucacagcacucaguacccuuaaauccagccagcauaccguccuucccugggaacacaguggcuguagauuguaaaagagaggcccucaggucaucccugggcaguuuuuuccuuaagcaaauaaacugguucuaucugcucuguucaggucugugccaccuuuguaaacugcacguuucgggguuccauuauuggguugcaguccuggauucacaugcauugaggugaugauacucuaggguuuggguuacaaagccaacuggagccaggcccauggccuuggcauaacuagcagugaaucucuuaucaccgcuguugacaggaugacauuacuaagcauucuaaugacugcacucuuuccacagcccuuuuggguucgccucuucuuuuggaagcaaguggcagaaaaagucccacuccagccaaagcacuucaggauuuugaacccaguuaucaucaaagaaacugccuucgacauccuucaguacucagagccucagucaagauucuggggccaugauaagguagucuuguugcuacccuguuaacuguucucuguggacaagaggaaacuuguucaaguucuguguggacacaucuguaucccuagaacagcggcucucaaccuguggguugcaacccuuuugggaagcgaaugucccuuucacaggguugcauaucagacauccuccagaucagaugcuuuuaaauuaugauucauagcauuagcaaaauuauaguuaugaaguaccaauaagaauaauuuuauaauuggggucaccacaacaugaggaacuguauuaaagggucucagcacuaggaagguugagaaccgcuguucuagaagcaucuguaguagggaaaccucacugaccagacaagcccugugugguuaucauuacacuccuuggugccagggcucaugguggcuuaauuagccuucuuccugguguacucuuuagcagagagacacaccacggagagguuacuuaagauaucuuugccgccccacgaccacacuaaugggcacauuguucaucuaaaaaguuucuguauguuuuaucucuacaagauaguaagaauugguacuuacuaacacuucacaggugauaguaaauaaagucagcccucuaagacagugcuuuucagucuagccccaucccagauauucagacuuuauuggucaguguuguggucugugcauggggauuuucaaaauuacccagaugauuuucuuugcagccuaauuugaaaaccuuuuuuguucuagguuguccacugaguaggguguuaaccugcaauuagcauaugccgccagaaggggguaguguggagcauccuuuucuuaaucguagcaaguagauccaccuaccucugccucuggagugcugggacuaaaggcacaugucaccacacccagcuaggaaaucuuucuuaaacaagauuuagcacgugcaugaccaaguaaugcucaaaauacaaagaauucuuccuagagcuaaaucagacaaacaaaagagcauagauagauagauagauagauagauagauagauagauagauaaauuggaauggaaugaaauggagcuagagacauggcucagugcuuacuuauagcuaagagcacuagcuguacuuccagaggaccugaguucuguucccagcacccacauagcaguucguaauguuuguaacuccaguuucaggggauccagugcccucuucuggauucugaggguacgcauaugauacacuugcauacaugaaggcaaaacacucauccagauaauaaaaaaaauuaauagagacaaaaauuaagaacauuugacaaaauaaaauaaaauaaauaaauaacauaugauaaaauauuuaguccucagaaauugaauaaaaagcaguuagagccacaguggauuuuuuuaaccccacuuucuuuguuguauuuuguuuuguuuuuaugaucucacuaagugacacuggcuagccgagaacucacuauguagacuaggcuggccuuaaaacucacuucauucuccugccucugccuccagguacugaggucaccagcaggcaccaccacaccugacugguuuuuugcucaccuuauagcaaaauuuaaagaucuuugucuggcaguaauguaguagaauaaagugacccuuuuccuguauuaguaguaugcauuaacuuaaaauaaggauggucacagauagaaagauggcucagcaauuacaggcccauguucuuucagaggaucuuaguccaguucccagcccucacaucagauggcucccaacugucuguaauuccaauuccagggcaucugauacccuccuuggguggacacacacgagagagagagagggaaagggagagggagagaaagagacagagaggcagagaggggcagagaggggcagagagaggcagagcauauauucacgugcacacacacaaauaauaaagauaaaauccuuuaaaauuauaaaauaagaauuaucuuggcuggcauuuuggcauccccauuagcccaguacucaggaaguuaaggcaggcucagaauagcuacaugguaagaccuugccucaaaaagaauggauuucuuuuacccagcaauguuacucugaaggcuugauuauaaaacaaaugagaggauuguccacugcagguaguuagggauauucaccauaacauaguagcagaaugcugaaugaagcagagccuagauaguuaccacuaaacgaugguuuucuuuuuacagugcuagggauguagcucaguugucggaguguuugcccacauucaccaaugccuggguuccauccccagaaccacacaaccaggcauuuuugcacaccuugcacccaggagguagaaguaggaggaucaaaaguuuaagguuauccucugcuucauagcaaguucaaagccagccucgaucugcucaugaaaaaucucacaucagcccuuccaucaagugagaagauuugugggcugugagauguggucuuuuugguacaaaugacacaauuuggaaagguucuaguccucuuuuaaaaauuacauuuauuaauuuguauguuuguuuguaugugugugugcguagguguguguguguguguguguguguguguguguguguaagucaaaggacaacuucuuaguucucuccuuccaccuuguugguccuggggcuugaacucagaucaucaggcuuggcaucaggccccuuuaccggcuaagccauauuggcagccccagcaguccuaucugaucucuucaugcauugcuucuaugaacaguugauuucacacacaguugugcaggcacugguuguggauccccugcgugcugagugcccugccuaucacuugagcuccaggcugcuuauuggaggauacaagacaggaggcugcacagccacagcacggaggcaucuuuggugucuucccucuguccgugaacaggcaugcagacuggcugcgacaaccccuuuuaaccagugaggcuggcuuugagacguggaugcccaugggucaggaugcaguuuagaaugaacggagcuccugggagccucccugaucccaucagcaucucugagcucuuggggaacucuugcucuaguuuacagaaaagaaauacuuauggaagccaccaucuccacugaaaugagagcaacaucagcagaguaaaggcuguccaaagccaaauucacauugaacauccugaucugaaagucaaaaccuguuugacagccaacaugauauccuaagugggaaauuucauaccuguccucaugugauaggucauaaccaagacguagauacauuaaaaauaccuuauaaaauguauauguaucaggcauacaugaaacacaaguaucagugugggagggguucuuuucccaagauguccuccauguaugcacaagcacaccagaaaugcagaaagcacuucuggguccaugcacuuuagauacagaauauagccuacaucuggaccgguggcaaccgucagggagggcugucaaccgcaggcucucugcacuugucuuauggugcuguuuuuacccaaaacuugacugaagauccaggaagcuuugugcuaggguugcagauccugggaggcgugccaugaugccgugcagacacagggcgugccagaagggggaagccacagugggaugagccugggaccugcuaggcgacaguuaguugaaucuauuuugaaaggaguaaauguaagcaggcagagcggccuaugccuguaauccagcacuccagagguugacgcaggagaucauggggcagaagccagcuuggggcacguggcaagaccuuuaucuuuaaaaaaaaaaaaaaaaccaaaaaaguucaaucucagacccacauggugaaaggagagaaagcucuuggaaguugaccucugacccccagacaugcacagugacaugcguguccaagugcauaugugugcacgcacacacacauacacucauauuaaaaauauaaaaagagacaccaaacaaugcuacacaccuuaaaccagcacccaggaugcagaggcagaugaaccucugugagucugaggccagacuaggcuacagagugaguucuaggacagccaggaagggcuacacagagacaaccugucuugaaaaaccaaaaauaauuuuuuaaaaaaagaauauauauauauauuucucaaaaaugaaaugaguuaaaaauaauugaaauacuaauuuuuuaaugcauaaacuggucuguguucuucccagaacauccccacgaucggcgucauugccguugucuuggcuacacaucugugugaugaagucagccuggcaggcuuuggcuacgaccucagucaacccaggaccccucugcacuacuuugacagucagugcaugggcgccaugcacuggcaggucaugcacaaugugaccacagagaccaaguuccuccugaagcuccucaaggagggcgugguggaggaccucagcggcggcauccacugagaacucggaacacggcaaaccucacccagcaccgcagcugagagcguggugagcagccuccacagggacuucacccugcagcugcuucgaugugcagcuaguguuuucaaacuccacauuuuuuuuaaaaaaggaaaagaaagaacaacagcaacaacaaaagcucugcucugugcaccucuucguccuauuuauuugaagucaguguuggauuuugcacaguuuuguaaguuaaucuuaagaaugggauuggaaggacuuuucaaagagaauuguauaguuuauuguuuuuuaaggaaguaauuuaauuugcagaaacuguacacacguacucugcucagguguugaggugggaggagaggggcuucuggccccuggaugauggcugugaugcccgauacuggggucugcugcucuguuugguagaacugauggcagagaaacuuccugccuccaggauaaagggcuuacucaucaccucuggcagcugcuagacaaguucauaaccccuuucugcuaguccaucugccagcuggcucgcaggacucaggcagggcagcugucccggaggcugcugguuggugagccacugucagcugagcgccgugauguugccccaggguggaagaagccacacuuccuacacugucagggcacuuuuaaacuucuggagggguguguguguguguguguguguguguguguguguguguguguguguguguguguucauucugcccuuccaaaucaucuaaguguuauuuaaggcacucugcuguuuguaugagaugguucauagaaauuaugacaaagccuuuguuauccaggccaugggaagaggaaaaagaaaagaaagaaagaaaagaauaaaagcuuuugaggagccccugugauuuccugac

SEQ ID NO: 3069 - RNA, 2987 nt, Mus musculus
uaguaguagaagccagaugaaggcuucuaaacaugacaccuucaucuggauucugguaaccuuaaccacugggcauaacugccucaugccucgucugccaucaaacccggccacuguugaguugauugcuguacucuugccuggucaaaguaaggucaguugggaacagaacucaaguccauugaaagaaccacaggguaaggucaguccccacaaaguuccucaccuguccuccacauaaaauucucucagaucuucugggccuggugacugaagaccaaugcuggccugagaccuccaccuccccccaagccaucguagccacagagccuagggugaucaucucgauaaugaguaagucucugucauuuuaaucagaacauaagccauuuggauacuuucugcuacaauguauccuucucggaucucugcuggcauugauggcuaggcuaacuguagcucugucaguuuaacggcagcaggcaacgggcuccucccugcaaggcugcagcugccuagauaguucacaucauauguaaaaacuaggccuugcuguuucuaaagcuacuaagucuccaguugagaaagguagaugggguuuccuugccaacaggcuucauauuaaaggacaaacagguuucugauguagcuauuuacuguucuuuuacucaaagcacuugcuuugcaauggcugcucucagcaaaaaccauuugugccucuaguaaaugacuagauggauaaacgguuuaaagucuauguaaguucugagggucuaagauaguguucuaaggugcagagaggucugagaacgugaaggcuuaaguucagaggaucuaagaaagugacuuauggcguucguuguaaagguuuaagagaaugauuuaagguauaugaaaaaugggaguuucauauuucuuuaccucucuguucuuguuauacuaagauuucaaaaguucagaguuuuaacacugaucaguggaauucugacagaugguagagcacugauuguuauuauagucacaaggaaaagaguuuaaauuuuauuugguugucuucuaaguauagacuuaacggugcuucucacuggcuaaaauugucucugucaaaucuauauguccaucccacuggacagaggagaaauaaauguucaucuuuuuuaaccugaagccauagcuuuugcugauucaaaggugggauucuacuccagcugucuuacagacaccugcuugcugcuuuucccacaauguagaucacuacagauuacacacagugacaaugcuuauauaucuaaaacuuuucucucuuuaaguagacuaaaaaauccuguaagcucagggagucugaguccuaagacuugaauccaccucccacaggucaaaaggacuccagauaagaaccaccuaaguccccacaccuaucccugaggacgaggucucucucucuccuucucucccucucucccugcuuccccuaucucugucuugagacucucuccuucccaauuaccaggacuauaggccuaaaaguuccacguguaagauuuuccuuaaacuuuaacuucugucccuagcuuguaucugucucagcagauuuccacugagacagauuucagaugacaggcaccacccaggaaucagcugcagacuacagacugauccagauggcuuggagcccuggacuugccgaaagcugacauggaccaagccagcugauucggauugcucccugucucuccagcugggucagcucaccagaugcuucuaaugaaugcuccauuuccugaaucugaggacaacaucuuaauuucagcaugaaguaguuaaagagaguagaguaugcuacccuguguccucaacaggcugugauguuaggucaaaaggaccuggcacaggggacaaaacggcugccuaucuugcccacuggcauaccaggaaagguacuuguugaaaccaaauagacucagaucuaucaacagguagguugacuagcugaaauuggucuacaauacaauaggguaccugaccugcuuuagacagaacaaggagguccuguguggcuuuaagagaaaauuguuucuauaacuguuagagauaaucuggcuguccuaaaauaauuaaggaaauaaauauugcaaaaauggagggggguugaaggaggggccugugaugacauaaaugaccuguccccauucucauuuucaggcuccuccuggauaguaacugaugucagccaaugcagggccuuugaccuuucuguuucuacuaauuacuguugccccuggcaucauuaaugccuuaacuugaugauaauucucaucuggguaccauuaagcugaugguuauuagaucccaguguaaacagguaccugccacagagucgaggauuugacucaggauacaacccaagggggauugacucagcaccauuuucugggaaucucagaauacucgagaccagaguccaccaccuuggccaguauuuaauuaaagcuugcuucaaguuuggcucaagauauugugguaguggucuuauuaauaagccagugggauuauuaauacaaggucacaggguggacuucaggaugauaaaguaagaagacaccuauuuaagcagcugcuaauccuuaagugcuauaaccugcaguucccaggaaaaaaaggccacacaacuguguugaagauucuaaaccagcuaugggguuugaacuuuacaacuugggagagcuggaaagcuguugauccagaauccagauuaucuugggcuaucuuaauaacccccacuagccacugaacacccauguucuacaccugaacuauuaacucacaaccaaccuaagggcuaacaccgucaucacacaguaucuaaaaccugcggcagagauguccccacucugcuguacccuaccuaccaugugauggguaaauuacuuuaauaauccaugagcuucuuuuguuuugugucuauuaaaaaauucacauaauuguuu

SEQ ID NO: 3070 - RNA, 1099 nt, Mus musculus
uggcaggcuagauguggccuguuuauucaugugcuccuaggaaaacauugggugaauuuuacuuguuuuguuuuuaccugcagagccuaugcuccauccuuauauuaaguguaauuaguucuggcuguagggaugcuuuagggauggcaauacguauggggugacucaugguuuuggacaaagcucagccagaaccuuauaaaaucaugccacuaaugcuaggccucuugcaauucgguguuccucuuguuucuacauaaaaaagcaacgucuguuuccauagaucaugggggagaaugugucuucauuauugguuggacccagauuagacuacucuuacugaaugaugacaucuuggucaccagugguuugaguagcagcuaugacccuaguuacuacaacaaaaagcaauuguuaaagucaagaaucccuuugcuuuagcaacauuccaguccuuugguuccuuacuagauaucaaaggaauuauagaauuugcccuuguauuaucucaagagaacauuuuagaccagcauuguagcauaauuaaggaaugugucuuauauccucuccuuugagaaguucccuucauccaaauguaugaucugugugagcgggcgagugugcaaguacacaugaguguacaugaacauagauagauacauucaggagguauaaacacacuccuuauaugaagaagauaugaauuuguauucacgaagcaauggacucauacaaccaacacucaguggaagacucagagaaaccagaaaggagggcuacuuauuaaacaugcauggcuacucauuaaauaugcauggccacucauuaaacaugcauacacagaugcuuuugaccaugcucucuacagggaaagugcaggcuuaacaguucacuugaauugucugaauaagauuuuuacuaauucccgauauuaagaaauuucugagccagacaugauagugcacaucuuuaaucccagcacucaggaggcagaggcagacagaucucugugauuucuuuaggucaacauggucuacuaaacaaguuccuggacagccagagcuguuacacagagaaacucugucuagaaaaacaaaca

SEQ ID NO: 3071 - RNA, 1432 nt, Mus musculus
cagaaaaacagcaccaagaaagccuccaagcuuccaacagacccuggguguguauguguguguguguguguuauguauguagcugucaaucaggauuuuaacuucuucccuccacuccagcacaaucuguuaaaaaguaaguauaagcugcauaugucuccugcaaauaucacuggaagcugcugaaaggauggacagagcucugccucaguucaaauccaggcucugccauuuacuaggucugugauguuggacaccuuauucaccucucuggcuagggaaacagacauaagaguccucagcuuaacagcguccuacggacucaauaauguacucaagaucuaaccccucuguaaagaacagcccacaaacuuagugucauauguuagucaacaugaguucauggucacagaaagcccaagaaaaggccauuuacuggguuuguuucauuuuauguacugaucuuucuuuucuuuucuuuuuuuuuaaaucccugccacacuuucucuuccagguggcagaaauauuaaaacccagccugauagaucacacugguggacagcguuuccuggccgggucccagcuaccuuauauaacagugcaguuuaacuggggucacuggcccagggggcgcugcuauugaugcaguggcugcuguaagggccaggugggcaggagcccugacgcagagagaggggcuugcccgggggcgggaccgcgggcgggcgggcgacaggcggcggcucaccucgguggcgcggcagguacacuuguaggucuggcuugcggggccgcgugggcgcgggcguguggcgccuccucgccuucuccuuggccgccugcuucaccuucuugucguagucgucccugcggggagccgagcgggagucaggcgcugucacccggccgaaucgggccgggccgggccuggggcggggcgguaccgaucgagcugguuccgacggaugugguguacgaagccguggcucauguccagacgcccgccgggcuugcagcacaaccccggcccgugauccugggccgccuccauucguaugcuggguacagaaccgccguaaccgccacaacugccgcggaauuagggccuucggcugcggaccaugacuuccggccgccgaccucggcuuccggcuccgaugcccuuuuuccgguugcguagggccaggcgcagcggagcagagaugcuuucgaaauuugagaaccuucaucugugagcgcccguagagcuggagguccucuuacuuugugguaucaccugaacgaaagaaggaguauauauagcuaauaccaggaaauuauuuuuaaaaauucgagucauccacgaauacugaaaaugcauucuauuagucuagagauguugacuuucuuuuccuagcccuuuaguauaauaaacuucacuaugagaucauau

SEQ ID NO: 3072 - RNA, 6134 nt, Mus musculus
augaucucauagugaaguuuauuauacuaaagggcuaggaaaagaaagucaacaucucuagacuaauagaaugcauuuucaguauucguggaugacucgaauuuuuaaaaauaauuuccugguauuagcuauauauacuccuucuuucguucaggugauaccacaaaguaagaggaccuccagcucuacgggcgcucacagaugaagguucucaaauuucgaaagcaucucugcuccgcugcgccuggcccuacgcaaccggaaaaagggcaucggagccggaagccgaggucggcggccggaagucaugguccgcagccgaaggcccuaauuccgcggcaguuguggcgguuacggcgguucuguacccagcauacgaauggaggcggcccaggaucacgggccgggguugugcugcaagcccggcgggcgucuggacaugagccacggcuucguacaccacauccgucggaaccagcucgaucgguaccgccccgccccaggcccggcccggcccgauucggccgggugacagcgccugacucccgcucggcuccccgcagggacgacuacgacaagaaggugaagcaggcggccaaggagaaggcgaggaggcgccacacgcccgcgcccacgcggccccgcaagccagaccuacaaguguaccugccgcgccaccgaggugagccgccgccugucgcccgcccgcccgcggucccgcccccgggcaagccccucucucugcgucagggcuccugcccaccuggcccuuacagcagccacugcaucaauagcagcgcccccugggccagugaccccaguuaaacugcacuguuauauaagguagcugggacccggccaggaaacgcuguccaccagugugaucuaucaggcuggguuuuaauauuucugccaccuggaagagaaaguguggcagggauuuaaaaaaaaagaaaagaaaagaaagaucaguacauaaaaugaaacaaacccaguaaauggccuuuucuugggcuuucugugaccaugaacucauguugacuaacauaugacacuaaguuugugggcuguucuuuacagagggguuagaucuugaguacauuauugaguccguaggacgcuguuaagcugaggacucuuaugucuguuucccuagccagagaggugaauaagguguccaacaucacagaccuaguaaauggcagagccuggauuugaacugaggcagagcucuguccauccuuucagcagcuuccagugauauuugcaggagacauaugcagcuuauacuuacuuuuuaacagauugugcuggaguggagggaagaaguuaaaauccugauugacagcuacauacauaacacacacacacacacauacacacccagggucuguuggaagcuuggaggcuuucuuggugcuguuuuucugaucauuucugugggcagggguuuuagcagcauacccccucuucccucucacucugguuugcccuuacagauggcuccacccaccccgugaacccagacugugaggaagccagugaaagcagcaguaguggaagcuccgagcuagagccuccuggccgccagcucuucuguuuagacuaugaggcggacaguggcgaggucacuucaguuauugucuaucagguacgccuuuuggaaacagcugcagcgugaccguccugggccaugacggaaacuaccaccaguuccugaaccgcuguuaaucucagggccagugggaaaauaugucuucccagcagauagucucagcacauagagauuccuaguugggggaacagggaaaacuugugacccucaguugagaaucacuguuacaggggacuccugagaaacagaagccuuaagccaaacaguucugugagcgugcugucuaggaacagagcagcacuuguuugagggagaaccaggcucugagcuuccugacucuuccuccacguaggacgaugauccuggaagggugagugaggcaguaucagcacacacaccucuggauccagccaugcgggaggcccucagaucgcgaauccaggaggaacuugcaaaacgccagagccggcacugacggggcggaggcaggauucacugcacuuggcagaauuuugcccaaggagcucaccccuaguuuggggggugucaggaugaguccaugugaucuucagggagccuguccuccuucucuaagcugcuguauccacaaaggucuugcaggaccacaucugaccugucucucagcagccauuuuucuugucucauucaucuaaccuaacauucuggaauuuuaugacagcuuuggcuaacuugguguuuugggagcagagacuuuagggagagccaggcuuucugaagcuuuugccuguguggugcugucuugaugaggucguuugucaggccccuucauguuucugcuuucuuccacucaucuuugccuaggccuguuuucagcugucacuuuuccuuucuccuaucuuuuugccuuagguagaaucuaugucccccacccccagcaugacuguuucucugccacucaggaauuuagcaugggacuucugggagccugccuuccuaacaaggucuccaaguacuucugaugccaauaaacaggagagcuuugguuuugaggccucuuuggaagcacauguccuuccccuuuuguggcuugcccaagcuccucauaggccucacugcuuaaaacugucuacguaggagacccaggaagaagaugcugagcuaagcugcaguccuuaguugaaaaaccuguccugcuacucgugguggcacaugccuuuagucccaguacucaggacucaggagguagagauggguagaucucugugaguucaaagccagccuggucauaucaacacaucuaguuccaggacagacagugguugagagagccuaucucaaaacaaaacaaaaaaagaagaagaagaagaagaugaacccgccuuggcuaggcuuaccaaauucaccaucuagcuguaaagcaacuaccuucugcucagacuaaaggggaauuaucaaagcagucuuaaaaguaacucuucaauuguaguuuagcaaucuugaaugaaugaaguugagagaguugacaauagcuauaauuguucuggggcaggagggcucuaguugcaaaaaagagagaguugugaagaacaucacagaggaagugaaauggcccuuucucugccccaugcuuucuuuccuaccucccaagaauaugucugagccugaugagacacacuuuaaccccagcaugaaagaggccaaaguaugaggacugcugcaaguuaaagaccaaccuaagcugucucaagaaaaaacuaaauaaauguaacuuagguccuuuggguaaagauccccagacauagcauuuuuccaacgggggacauguuuuucaacacaagcuuaggcuaaggucugaaguccacaagacauccuguucacagaauucaggugcaccuacgauuuccugacauaggaaccuaacuucagcaucuugaaacaugaaucauaaaacagccuacaagcccugagacugcccacaaccaaaccuccuaccccagggcuuugucuucuaggauuucaagaucauucugacuguaugaguucaguagcuuucucuucagggacacuugcgaucccuccuguguuuuaucccacucugcugaaaacauguaauauaguuggccaucugcuuuacgccauuaaaacagugagucacagcuugccaugccagaacucugggacuugaguuaggugguaaguuagaagggccugguucuagagguggccggagaccugaaugcucuaaaccaggagagcuggucucaggguucagugccuuaagcauugucaguccuaaucccaggaugcugucaaagggaaaagccuucauccuguacuugugcacuagugcuguaagugccuguggacuuacaugguuagauaccaucagagccucccgggugaaggagggucugccaaacuccaugcucuucauccugcaagucacuauagucuccaguuaaucaguccauauucugacuugaaacacaggauucacuggaacgcuggucgggacaaagaacauuggaacuuuuugggggucuguguucuuagagcugugcuuccuauauccugauucuguuauugaaccaaaaaacaccugaagaaucugaggacccgacaccuacaaauuugccguuauucccacuucuugaugaaggaauagcuagaugaacaaaguguucugcagaggccuuuuauguguuuaugugguccucaaagaccucagauaggagacugguggaaacuucucuaaguucuuuuuccagaagcacuuugcuuaucaguguguaugaaagauuuucuagcuaagaaagcucucuugauucuugcuaguuuauccuguaugacuaccuaaagccccaagccugugccuaaaugaagaguggucauucugagccagccuguuagagcugauguuucuaggccuccucccuaaaaugccucuuggggcugcccucagccuuauggcuuagcuugauugcucugcuggccuauucuggggucuguaauaauacuggccaguuuauuuggcagaccugcuuccagauagaugucucuuaaccuauuucaaaacucacgggccauagugaguucucagaacugcccaguguuuuugcacaguaggcaggacuuaacuacaaacugccucagaaucaacauucauuugaauagauaaguucuuaucugucuuuugugugugugugggggggggggagaugggggcaagggagacugggcuacagguaugacgguacaugccaguaaucccagcauuugaaaggcugagauaaaagguuugccccaugucccagaggcaggaaggucuuuuaguuugaggccagccuuaucuacaaagcaaguuccagacaaccaggacuauguagagagacccugucucaaaccccuacccccauuucuuucuuucuuucuuucuuucuuucuuucuuucuuucuuucuuucuuucuuucuuucucucucucucucucucucucucucucucucucucucucucucucucucuccucuccucuccucuccucuccucuccucuccucucucuccucucucucucuucucuuccuucuccucuucucucucuccccucucucucuucucucucuggaaugguuuuuuccccucaguucuuaacuagaauuaagccuguauuuuacaguuuugugauuccugaacugaguauauauuauuuauaagagagaauugguuuugcaaggggguuugggcugugcaagaauaaugauaaaaacugggguuguaccccacugacaagcaugaaugacuuugaagaguguggagcaagaagggaaaagauauauaaguguauaugaugagaauaaaguauauacuggcugcagucuagccagcagggguggaucuaaaauaaaugugaaagaacauuccaucucucugaucaucuggggugcauugcuaacuagagagcagcccagacaggugggaagcucuuuggguggugaguaucuagccugcuguguguuugacaagaccugugucaggguggugcuucccagauaacucgaauuuaaaugagaccuuuguauaaugagcauucgacuuuccuaccucugagccuuuugaagaaauugcauauggaauguugacaguuauuugaaaccuuaacucuuuugaauuccugaggagcuguuggcauccagcccaaauuuccuugguguuagaguacugcuagaagugaaagccuuccuaguuagggguuccuccuuucccagagcaaacagaacaagagguugggaaugguggugaacagcucaagagacagagauaggaggaucacuguauguuugagaguagccuaagcuacacagcaagcaucagcguguccuggcuaugucauggugcuaaaugcagaaaaagccauacauucuuuuucucauuuccaguguuucuguauaaaaaaaugaauuaugcaaacuguuugaaaaucauggacgguacuuuuuaaaccaauaaacuauuuuuacagcauuuuuuugccaaaag

SEQ ID NO: 3073 - RNA, 6134 nt, Mus musculus
cuuuuggcaaaaaaaugcuguaaaaauaguuuauugguuuaaaaaguaccguccaugauuuucaaacaguuugcauaauucauuuuuuuauacagaaacacuggaaaugagaaaaagaauguauggcuuuuucugcauuuagcaccaugacauagccaggacacgcugaugcuugcuguguagcuuaggcuacucucaaacauacagugauccuccuaucucugucucuugagcuguucaccaccauucccaaccucuuguucuguuugcucugggaaaggaggaaccccuaacuaggaaggcuuucacuucuagcaguacucuaacaccaaggaaauuugggcuggaugccaacagcuccucaggaauucaaaagaguuaagguuucaaauaacugucaacauuccauaugcaauuucuucaaaaggcucagagguaggaaagucgaaugcucauuauacaaaggucucauuuaaauucgaguuaucugggaagcaccacccugacacaggucuugucaaacacacagcaggcuagauacucaccacccaaagagcuucccaccugucugggcugcucucuaguuagcaaugcaccccagaugaucagagagauggaauguucuuucacauuuauuuuagauccaccccugcuggcuagacugcagccaguauauacuuuauucucaucauauacacuuauauaucuuuucccuucuugcuccacacucuucaaagucauucaugcuugucagugggguacaaccccaguuuuuaucauuauucuugcacagcccaaacccccuugcaaaaccaauucucucuuauaaauaauauauacucaguucaggaaucacaaaacuguaaaauacaggcuuaauucuaguuaagaacugaggggaaaaaaccauuccagagagagaagagagagaggggagagagagaagaggagaaggaagagaagagagagagaggagagagaggagaggagaggagaggagaggagaggagaggagagagagagagagagagagagagagagagagagagagagagagagagagaaagaaagaaagaaagaaagaaagaaagaaagaaagaaagaaagaaagaaagaaagaaauggggguagggguuugagacagggucucucuacauaguccugguugucuggaacuugcuuuguagauaaggcuggccucaaacuaaaagaccuuccugccucugggacauggggcaaaccuuuuaucucagccuuucaaaugcugggauuacuggcauguaccgucauaccuguagcccagucucccuugcccccaucucccccccccccacacacacacaaaagacagauaagaacuuaucuauucaaaugaauguugauucugaggcaguuuguaguuaaguccugccuacugugcaaaaacacugggcaguucugagaacucacuauggcccgugaguuuugaaauagguuaagagacaucuaucuggaagcaggucugccaaauaaacuggccaguauuauuacagaccccagaauaggccagcagagcaaucaagcuaagccauaaggcugagggcagccccaagaggcauuuuagggaggaggccuagaaacaucagcucuaacaggcuggcucagaaugaccacucuucauuuaggcacaggcuuggggcuuuagguagucauacaggauaaacuagcaagaaucaagagagcuuucuuagcuagaaaaucuuucauacacacugauaagcaaagugcuucuggaaaaagaacuuagagaaguuuccaccagucuccuaucugaggucuuugaggaccacauaaacacauaaaaggccucugcagaacacuuuguucaucuagcuauuccuucaucaagaagugggaauaacggcaaauuuguaggugucggguccucagauucuucagguguuuuuugguucaauaacagaaucaggauauaggaagcacagcucuaagaacacagacccccaaaaaguuccaauguucuuugucccgaccagcguuccagugaauccuguguuucaagucagaauauggacugauuaacuggagacuauagugacuugcaggaugaagagcauggaguuuggcagacccuccuucacccgggaggcucugaugguaucuaaccauguaaguccacaggcacuuacagcacuagugcacaaguacaggaugaaggcuuuucccuuugacagcauccugggauuaggacugacaaugcuuaaggcacugaacccugagaccagcucuccugguuuagagcauucaggucuccggccaccucuagaaccaggcccuucuaacuuaccaccuaacucaagucccagaguucuggcauggcaagcugugacucacuguuuuaauggcguaaagcagauggccaacuauauuacauguuuucagcagagugggauaaaacacaggagggaucgcaagugucccugaagagaaagcuacugaacucauacagucagaaugaucuugaaauccuagaagacaaagcccugggguaggagguuugguugugggcagucucagggcuuguaggcuguuuuaugauucauguuucaagaugcugaaguuagguuccuaugucaggaaaucguaggugcaccugaauucugugaacaggaugucuuguggacuucagaccuuagccuaagcuuguguugaaaaacaugucccccguuggaaaaaugcuaugucuggggaucuuuacccaaaggaccuaaguuacauuuauuuaguuuuuucuugagacagcuuagguuggucuuuaacuugcagcaguccucauacuuuggccucuuucaugcugggguuaaagugugucucaucaggcucagacauauucuugggagguaggaaagaaagcauggggcagagaaagggccauuucacuuccucugugauguucuucacaacucucucuuuuuugcaacuagagcccuccugccccagaacaauuauagcuauugucaacucucucaacuucauucauucaagauugcuaaacuacaauugaagaguuacuuuuaagacugcuuugauaauuccccuuuagucugagcagaagguaguugcuuuacagcuagauggugaauuugguaagccuagccaaggcggguucaucuucuucuucuucuucuuuuuuuguuuuguuuugagauaggcucucucaaccacugucuguccuggaacuagauguguugauaugaccaggcuggcuuugaacucacagagaucuacccaucucuaccuccugaguccugaguacugggacuaaaggcaugugccaccacgaguagcaggacagguuuuucaacuaaggacugcagcuuagcucagcaucuucuuccugggucuccuacguagacaguuuuaagcagugaggccuaugaggagcuugggcaagccacaaaaggggaaggacaugugcuuccaaagaggccucaaaaccaaagcucuccuguuuauuggcaucagaaguacuuggagaccuuguuaggaaggcaggcucccagaagucccaugcuaaauuccugaguggcagagaaacagucaugcugggggugggggacauagauucuaccuaaggcaaaaagauaggagaaaggaaaagugacagcugaaaacaggccuaggcaaagaugaguggaagaaagcagaaacaugaaggggccugacaaacgaccucaucaagacagcaccacacaggcaaaagcuucagaaagccuggcucucccuaaagucucugcucccaaaacaccaaguuagccaaagcugucauaaaauuccagaauguuagguuagaugaaugagacaagaaaaauggcugcugagagacaggucagaugugguccugcaagaccuuuguggauacagcagcuuagagaaggaggacaggcucccugaagaucacauggacucauccugacaccccccaaacuaggggugagcuccuugggcaaaauucugccaagugcagugaauccugccuccgccccgucagugccggcucuggcguuuugcaaguuccuccuggauucgcgaucugagggccucccgcauggcuggauccagaggugugugugcugauacugccucacucacccuuccaggaucaucguccuacguggaggaagagucaggaagcucagagccugguucucccucaaacaagugcugcucuguuccuagacagcacgcucacagaacuguuuggcuuaaggcuucuguuucucaggaguccccuguaacagugauucucaacugagggucacaaguuuucccuguucccccaacuaggaaucucuaugugcugagacuaucugcugggaagacauauuuucccacuggcccugagauuaacagcgguucaggaacuggugguaguuuccgucauggcccaggacggucacgcugcagcuguuuccaaaaggcguaccugauagacaauaacugaagugaccucgccacuguccgccucauagucuaaacagaagagcuggcggccaggaggcucuagcucggagcuuccacuacugcugcuuucacuggcuuccucacagucuggguucacgggguggguggagccaucuguaagggcaaaccagagugagagggaagaggggguaugcugcuaaaaccccugcccacagaaaugaucagaaaaacagcaccaagaaagccuccaagcuuccaacagacccuggguguguauguguguguguguguguuauguauguagcugucaaucaggauuuuaacuucuucccuccacuccagcacaaucuguuaaaaaguaaguauaagcugcauaugucuccugcaaauaucacuggaagcugcugaaaggauggacagagcucugccucaguucaaauccaggcucugccauuuacuaggucugugauguuggacaccuuauucaccucucuggcuagggaaacagacauaagaguccucagcuuaacagcguccuacggacucaauaauguacucaagaucuaaccccucuguaaagaacagcccacaaacuuagugucauauguuagucaacaugaguucauggucacagaaagcccaagaaaaggccauuuacuggguuuguuucauuuuauguacugaucuuucuuuucuuuucuuuuuuuuuaaaucccugccacacuuucucuuccagguggcagaaauauuaaaacccagccugauagaucacacugguggacagcguuuccuggccgggucccagcuaccuuauauaacagugcaguuuaacuggggucacuggcccagggggcgcugcuauugaugcaguggcugcuguaagggccaggugggcaggagcccugacgcagagagaggggcuugcccgggggcgggaccgcgggcgggcgggcgacaggcggcggcucaccucgguggcgcggcagguacacuuguaggucuggcuugcggggccgcgugggcgcgggcguguggcgccuccucgccuucuccuuggccgccugcuucaccuucuugucguagucgucccugcggggagccgagcgggagucaggcgcugucacccggccgaaucgggccgggccgggccuggggcggggcgguaccgaucgagcugguuccgacggaugugguguacgaagccguggcucauguccagacgcccgccgggcuugcagcacaaccccggcccgugauccugggccgccuccauucguaugcuggguacagaaccgccguaaccgccacaacugccgcggaauuagggccuucggcugcggaccaugacuuccggccgccgaccucggcuuccggcuccgaugcccuuuuuccgguugcguagggccaggcgcagcggagcagagaugcuuucgaaauuugagaaccuucaucugugagcgcccguagagcuggagguccucuuacuuugugguaucaccugaacgaaagaaggaguauauauagcuaauaccaggaaauuauuuuuaaaaauucgagucauccacgaauacugaaaaugcauucuauuagucuagagauguugacuuucuuuuccuagcccuuuaguauaauaaacuucacuaugagaucau

SEQ ID NO: 3074 - RNA, 5492 nt, Mus musculus
ugcuuaagcuuuuguuugggaggagacuaggaggacggcagcagagggcagccgccuaccuggagaaaccugcaguuacguguguggcaggagccggaguggcuggagucgcgggauggucaggaggcgggcugaaaguuggaguaagcaggaagugaagcuguggcugccuuggguggaaacagacuaggcgaaguucugcuuugagaggcccaagugcuccgagacauggugagugacguggggaccaagaaaagagcgaguuagagcagcugccagagggggaucgggccuggggguugccugugucgagaaagguaaguuggcggcagucagagggcuggcgggguugggccagcgcugccucugucuccuuacuuuugacaacuccuccacaaauagcuccgcacuccgggccagggguuccugacacuucuccaccuccuuccucccgugaccucggugcuggauccgaucaggauuucgguggggguugggggacccaaauuccaagccgagcugcugcgccgcgcccucccccuccuccgccuccuccagcugggccugagcccgguguugugacauuaccgggccacaagcguuccugcucuuuggggcucagauuccagccccgcggacuggaguucucccccuuacccucgcacuguaucuaugcagacacccagaggaucuaucugccuggccaccaaaagcaccacccuuuucuagaaacauuagcaacagugccaaggguuuguaaagcagccagauggcgguucuucccgauaaucuagcuucagcccacacccguggccgguaccugaggcccccugggucccuaagggaggagucaggccucuucccuccuuguucaaaagccuuaucuagaggccuccuggauagagcgaccgcagcaggaaggacuuuuauuaauaucugcauaagcaggcgguggugugcggccuaccaggcguuaaauuguggggaaagcagaaguauaugguccaacggcacaugaugccuucugggggccacauccacugaaccggggcuacacugcccaguaggcuggaaccagaacucaccaacagcugucuggagaagggcauuuauuuggguugggccgggcaagagugugcugcuggucaacucucacaguuuuagagagaacccacuaggauugagccgagggaggcuacaggaaccaguuaauaguucuuggcugugcucugcugaggaaacgucagcuggguuuucuccuugacccucuuuguggagucaagacaggggcagucgugugcuguuuuuuuguuuguuuguuuuuuguuuuuuguuuuuuuuuguuuuuccuugucacgcugaaaauccuccaaagaagguggaugagaauccagggucaaaccucaucuucugggacuuaaaaaaugcacuuacauggcuggcagccgagauggcugggcagguacaaguguuugcagagcaagccugccugccugaauucaguauccugcucucuccugcccauccaacuggaggagacaauccacucaugaaaguuguccucucaccuccacaugcgugccguggcaugugcauacacguauauuccccagcacacacacacacacacaaugcacuuaugacagacuaaggaugugguucagcugauagaguguuugccuggcaagcgucaagcucuggguuucauccccagcaccucauaaaacaaggauaaugguacacaccuggaaucccagcccaggguaaguagagacagggggucagauguuuaaggccauccuacuuaggaagccuauggccugccuagguuauaugagaaccugccucagauaaauaaaucuggggagguggcucagugggcuugcuacgcaagcaugaagauuugcauuggaucccuagacccauuuagaaggaaaaaaauuccaggugugguggugcaagcaagcacuuagguggcuccuagugcuagggugguggagaaggcugagcccuggggcuuuuuguccacucuaaucucagagccucaggccaacaggagacccagccugugggggaaaaaacaagggaggagugacaccugaccacccgaggcugaucugggauauaaacgugcuugcaucgaagugaacauuuacguagaacauucuccugguaaacaguugaagcaucagaaacggcuaaaaucuacuuuaguucuuccaaccuccucuggccucuuggauccucugcugcccggccuaauuaaccccuuauugacauccaggaggaggccagugggagugccggaaaugaccgaguuaggaaccugcagagugagguggagggagucaagaauauuaugacccagaauguggagcggaucuuggccagaggggagaaccuggaccaccuccgaaacaagacagaggacuuggaagccacggugagauugggagaaaacugggaguuggugggggcagaucucggggagggggagaaguuuggguggggaggcaaagugaacagaagggacugcagacugucaugucuacugcccuuuugccuaugcaggagauggcugagguuccaccucugcuuccuugcuacucugcuggcugguagagagcccagugagugguuggauuugagcuugggugaggggcccacccacagagccauuucugagacaguucagucaacugcuccauuccuaagcuucauugggguaugaaacugauuuuugucucaaagcuugcccuuggcaaccauuuggaguugaugucccaaaggcaaaguuaugaguuccgggcaacccuuggccuuucagcauucucccuccagguguaauuaggcuggaaguugguggggggcgucuugcugaguccgcuuuaaagcacagcugggaagaccaaugaaauccuuuaaccccaggaucccugugugcaaaggccaaaauaauaucucccacacaucuugcuuagaccuccucuuugcugccauggacugaggccaagcugcucagggcagaagaaagucuaacacaaaccaaggcuggggccucaguuuucacuugcuguggaguacacuggcuuccuggguccauuggguuaucuuggaaucuagugccuccugcagcauaagcugggcacauggagacuuagugucuguauuaacuuggagaagcaggaggcuuuuuucuuucuuccuuucuuccuuucuuccuuucuuccuuucuuccuuucuuccuuuccuuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuuucuuucuuuucuuucuuucuuucuuucuuucuuucuuucuuucuuucuuucuuucuuucuuucucaagacaggguuucucuguguagcccuggcuguccuggaacucacuuuguagaccaggcuggccucgaacucagaaauccaccugccucugccucccaaaugcugggauuaaaggcgugcgcaaccacgcccagcucuuucuuuuaaguuucugcagugcuuugguucuuccuucagcuucuacagaacucagaagacaaagcaaaguaucauugagccaggacaugugcccaucuggagcacauuccuguaccccuuagcuugugggucugugcuccaaaggccagauuucucuaccagucaaacaaacuccaauugugagcauauaucuguaaaagaccccuuaguaugcagguuagugcaggggcaagaaaaagaagggagacuggacauaagacucaggugguagaguacuucacuagacuucacgaagcccuggguucagucccuggcacuauauaaauaugguauuguggcacacgccuguaaucugaacucuuugaagguagaggcaaguggaucagaaguucaaagccaggccauugagauggcucaaaagguaaagacacuugguaccaagccuaaggauuugaguuccauuugugggauucauaugguugguagucuugauuccuauaaaaugaccucugaccuccacuguggcuugugcacaccacacacauaaacaaacaaacaaauaaauauuguuuuuaaaaguucaaggucgccgggcaugguggauuaaucccagcacucgggaggcagaggcagguggauuucugaguucgaggccagccuggucuacagagugaguuccaggacagccaggacuacacagagaaacccugucucgaaaaaccaaacaacaaacaaacaaacaaacaaacaaaaguucaaggucauccuuugcuacaaggaguggaggccaggcuuugcuguaugagaucccgacuagaaagauagaaacagaaaaggaagggacccugcuaugcucagagggaaguuuuaugaguucaagaauucuaaacuagaacuuggcuuacagauuguuguagaaagacauuugugaagcagccagagauagacagaucucugaagcuccuggccauccaggcauacuuagugaggcccugucucaaaaguaaaacaaaacaaaacaaaacaaacaaacaaaaaaaaaaaaaaccagagagagaucaguggguaaagacuuuugucagcgagccuggcugcguggguucaauccccaggacauacagaggagaagagagaaccauuuccugcaagucgaccccucuccaccacgugggcaguguggcacauaaggcagaggcacaaauacauguuauaaaguauuuuuaagaaccuuuccauuccuauuguaagaggaaagaauuguucacuuauuuguguuuuuauuucgaaguggcuauccuccagcuccagcgucuuuuuuuccguuuccuacuucgauuuauaauguaauguaaacaucuauacuauggcaugugguguccgucuguacucucagucugagggcaggagcucacgacuuuaucuuauccccaacagucugaacacuucaagacaacgucccagaagguggcccggaaguucugguggaagaaugugaagaugauugucaucaucugugugauuguccuuaucaucgucauccucauuauacuuuuugccacugguaccauccccacuuaagagucccuuccaucccacccuacuccucaggggugaccucccuaauaugugccaagaggagcccucuccuguccuccuccacccaagugcugcucagucccugugagggccuucugcugcaucagaugccccagacgcaccuugauccccugggaggagacagcuggacuguagcugcaucucaugguccugagaguggguuacagagacccagaggacccugucuguggcugggaaacuguugguggcuggugggcaauaaagaccucuugguaucccuaaguguacgaggcgcuu

SEQ ID NO: 3075 - RNA, 16407 nt, Mus musculus
cuuacgugucgaggaggcggggccuaagacagcaagucuaagucuggagguuccacuggguccgaccuggcugcagagaggcucaccugucccugcagucauggcugugcaccgcggcuccgcacugguugcucccgccucagguaggcugaggguuggcgagaggcacgguggucuuaguggggaaguggcuuauugagagagauggcggucuguguuggaagaucguaggagaaucuuggaugaccugagacucagaagguugcaggagcuggaucaguggaagaacccaguggguggagguccuagacuguagggacugcgguuuucccacgcacuuuuugaccccaggucuugguuuguagauaaaguacagaaaaacaagucugcacagacaucaggacugaaacagggcagccgaauggagaaaauuuuaggguuugaauggacagauuuaucuagcuggcagagugucgugacccugcuuaacaaaccaacggacccugcaaaccuggcugucuuucguuuucucuuugguaaguccauuuucuggauggggacauuuugguugaggugguggugguaguggugggaaaaugucaucuuauuucuuuuuaagauuuaucauuauuuuguuuauguguauguauguauguguuaguuugcuuucuauuacucugauaaaaacaccaugaugaaaagcaaccuggaaaagcaugaguucauuucagcuuacaguuguaguccaucucggagagaagucagggcaggaaucuggagaccagaacugaagaagaggccauggaggaaccuuguagaugcuggcuggcuccucgugguuuguucaaccugcuuucuucuaccaguagggaucaccugcccaggguggcaccauccacaguaggcugugcccucucacauaaaugcuuacgggccaauuucuucgagguauuuccuuaguugagguccucuagcuuguuuuuaggugacgaagauuaaccagggcagugucugugugauuguaggccaggcgugugcuugcuuguagaagccagaagagggaguuggaccccuuggagcuggaguuaaagguaguugcugccugauaugggugauggggacugaacucuguuccuuuggaagaucaguugcaggcuggagagauggcucagagguuaagagagcauugacugcucuuccagaagucuugaguucaauucccagcaaccacaugguggcucacaaccaucuguaaugggauccgaugcccucuuggugugucugaagguaacuacgguguacucauauauauaagauaaauaaaucuuuuuuaaaaagaaaaauaaaaagaagauuauuugcauucucauaacugcugagccauucucuccagccuaguugcccaucucuucuccuuagagcugaagguauuggaauaauggaagaauucuuuggaaguuuggaauuaucuggccuugucaucugcaguuaggguuuaguguuuagaaaugcuuuggacacauggaguagaggaacagcugcaugccugugugcaugcaagagcaugcuugcauguggugaguuuaggccagaggucggugucagcugucuuccucagccacuguccaucguaguuuuugaggugggguuucucucuccugaaccuagagcucaccaguugagguagacuggcuggccagcaagccccaggggucagccuguuucucagccacugagaucgguagcuaccaugccaggcaggcuuuggacaugagugcuagugaccugaacucagccucucacgcuugcaacaaggacuuugauuuuuuuuaccaauggaguaaucuccccggcucuuuuuggcuuuugaaauagucucauuacauagaccagguuugucuggccucuuaagugcuccucuuguuucucaagugcugggauuacaaacaccaugacaccugacaggagagacauuuuguucaugucgugaagcuacucagaaguuacacuaagcaauucagagaaauagccagggugacaacucacaggguuacagaugugccaagaugugccuuuaaguccagcaguuucuagcugggggccauuuugcaaccuggagaccuuuuuaguugucagaacuuucagagaagagagauaggugguugcugggauuugugcugguaccaggauacacuugaugucuuguaacaaacggguaaauaucccuauagauaauuaaccagacuggcuacugcagcuucucccgggauugagaaacccugccugaaccuaaguggcuuuccagaccugagugucccuuauuugucuugguguguugagcaaauaccacuaccuuccuggguaugucaggagguuaaaaaaaaaaauguuagaaaggcccccuggggcacuuuucacagcucgguaggguguaucuuuauagauguaacuacucaaacccuaccuuucuauaguguuuuguauuuaggucuuauuuaauccuaccagcaacccugugagauuuuguuauuuuugucuuguuuuguuguuuguuuugauuuuuugagacaggguaucacuguccuggauauauaguccuggguggcccugcaacucacuauguagaccagguugaccuagaacucacagagagagaucugcuuguuucugucuccccagugccagauugaagguguauuaggaacccuggcuuuugaaguuuuuuaaaaaagauuuauucauuaguguuauagauauauaaauauacaggugugugugugauuauaugcacacaugugugauuauaugcacacaugggggauuauaugcacacaugugugauuauaugugcacgugugugugauuauaugcauacacaggugaauggguggaagucuaagcaugagcacagaugccagcagaugaucucugccccaccccacuaguuucuuugagacagaaucucucucugagccccuggggcuugcaguuucucagcaagcaggaagccaguaagcagcaagccucuuguuucuacccauucauugcuggcaucaaagaugugcauagaauucccagcaugcuacaugaaugcugggcccugaacuacaguccuuaugguugcucaguugggccaucucuccagccgccccaccucugcacaggugugggggccagccccagcgugggggauuucuucuuguugguucuugaggcagcagagggggaagagcauagggcagaggguaagacuuugucuugcgagaaauuuaagguugcuguauaauaaaaaguuuacuuaucuaagucuaaguuacuaugcuauuguagcugaccugccuucugugagccucuggcacuuagcaccucauccuaaaacagcaggagaugaaguaaaggauuaauugcuagagccuuucccuauuuccagaugacuguguagcccaggcuagucuuaaacuucaagcguggagcugggcaugcuuagagcugugucuugcuuccucgguggcugccugacaggugucuucuccugccugccuuuacagcuuucuugaugcugcuggacauuccccaggaacgcggccuuagcucccuggaccgaaaauacuuggaugggcuggaugugugccguuuccccuugcuggaugccuugcgcccacugccacuggacuggauguaucuugucuacaccaucauguuucugggugaggggaacugggugcuggggucugaaccagggccugugagacacucaccagcagcauucuggugagccaagucauuggaugcuugugccacgucugcugcgauucaguuucuugccccgcucaucuguguaucauaugagucgucaugaccccacaacucuucucccauguagcucucugccugauuauaaaaugccugcugacuuuucuuaauuucagucccagggaagcugggccugugguggugacacuuugaccugaacccucuccucaccaauccccaggggcacugggcaugaugcuggggcuaugcuaccggcuaagcuguguguuauuccugcuaccguacugguacguguuucuccuggacaagacuucguggaacaaucacuccuaucuguaugguuuguuggccuuucaguugacauucauggaugcaaaccacuacugguaugugccuugggagauaaauagaggggaggugugucugggucaggaugcuuacagagagauaggggcccagugaaguccuagaaacuguccaaugggaacaguuuuuauugguguuuugguuuugaagggggaggggaagugggguuuguauuucuguaucucaggcuggucuagaacucacuguauagucuaggcuggccuugaacuugcuauuuuccuauuuuagccuccugagugcugaauuacaggugugagccaucaugcuggcucaguagacauauuuuuaaucaaguuuugcaaaguagaguuaugagguccuacuuugacuuggauggauuugggggagccuguucucuccuucuuccauguggguuuuggggguccagcucaggucaguaggcuugauggugagcgcccuugccugcucagcucuauugcuugccugcuuuggauggauuuaggaaggggaagggccagcaaguugggugauugcagggccauaggaaaguguccaucccaccccuucacuguuuuccuaucucuccagguaccuugguauauccucuccuguaagcaucuuagaagaagagaagacuaaagccagacauagcuguuuucagauacugcaggggugcagacuuugcuuucugugugugagcccagagaggcagaauuauagccaaacauagaaguugcugugagguggaagugauagcagaaaccaaaggacaggggccaccaggguggcucagcagugcugucccaggugaaaggaacccacugcgucucuggccuaggugaccauuucucaggggagguggggacaagccuuggagccaggguggugggccccgagaccuugagauuuucccaucgugaguugcagcuguggaagcacagugagccagauggaggugguucacacugacacacaagcgcuuacgucucucccguaaagcugugugugugugugugugugugugugugugugcacacccgacuuccuucgagcugagcauggccacuaccaccaggcugugaccccauuucccaugcccuaccaucgucaaacuugaaaccaauucaggaugucuaacuuugaccauagaggauuaaaagguugcuuugacggcuaucucccaccuccaaguuccacuuuugugacuuuuagacauuuuuuaaaauuaccuaucauacacucagggcuuuguguguagcgggcauauuuacauuuuuuuuuucccucuuuaaauccugaugaagagucagguuuaggugcucauucccagcgcuuugggaugcugaggcaagaugguugcuucgaauuagagcccagcuugggagauguguguguguguguguguguguguguguguguguguguguguguguguguaugaaugaaugagagaccuugucucaaaacaagcaaacacacaugagcucccuugagcugaggaaguaagucuuggggaaaugaagaaucagccuagguuuacacagcagggaggagacaaauggggcuuuguuguccuugaccuuaucacagccugcuugguuucugccucagaggaaaucuggguuaguagccugucuucucuguucucucuuaggauaaaauuuaaaaccaggaguccucuagcacuggauccuggcguguauuuuauacauguuaguuuaugcucugcauuauuuugcugggggauauuuuaaguuuauuuuuccuuuuuuaccccuauggagguggggaucaaacucagggucuuauacaugcuaggaagugcucagagccucugggcugcuuucccagccccgcccucccuuucuuuuuucuuuuuucauuuuuuuuuacugucauacuguauagcugaaucagauggugcauaacuguauucccagcauugaggaggcagacaugaggauuauagcuugggcuauauguguaugaauuuucauguguguguuuuaauuuuauuucauguggauguauauuuagcugaccuggauguaugugccccaugugugugugccuggugccuguggggcucagaauacaguacuagauuuccuggaacuggagucacaggcaguugugagcugcugugugagugcugggaguugaacccagguccuguagaagagcagccagugcuuuuaaccaucucuccagucgccuguuuggugguuuuauuaucuauuuacuuuuuuuuuuccugagacauagucuacuauguaaugcuagaacuugcucaguagagcaggcuggccucaaacacauggggaucugcuugucucugccuaccugagugcuaggacuaaaccuaugugcaccaugcccagccuacuuuuaguuuuuaguugaauuuuuuauuguguaggauugggagcacgcgguuuaggggaacaagggcaugcaugccguggucccugugucgaggucagaagacagcccaccuuuuugugggcuucaggaauugaacggauugccugcuugaggcauuucuccugcccaccccguaggguuuccaaacauucccucaaguguuccuucuugucauuucuaguugaacuuugaacuugaucugauucauuggaacaaacuguggagugagccaauaggaaacgcuguguguguacauuuguuuugagucgggcucucauugcguguagaucauacuggcuccaaacuuuuggcaguucuccggucacugucucccgaguccugggauuguaggcaugugccacuaugccccgcuacacugaaguuuuauuuauuuagguuuuuugagacacgguuucucuguguagcccuggcuguccuggaacucacuuuguagaccaggcuggccuagaacucagaaguccuccugccucugccuccggagugcugggauuaaaggcgugcgccaccacgcccggcugaaguuuuaaucuuaugacucacaauagauagucucugacuuaaugguucaacuugaauguuuuucacaccguggugagaaaaugccuguugucuuaguuaggguuuuacugcugugaacagacaccaugaccaagucaacucuucuaaggacagcauuuaauuggggcugacuuucagguucagaaguucaguccauuaucaucaaggugggaacauggcagcauccaggcaggcauggcacaggggaugcugagaguucuacaucuucaucugaagcaaacaggauaagacuggcuucuaggcagcuaggaugagggucuuaaaguccacacccacagugacacaccuacuccaacagggcuacaccuuuuaaaugugcuacuuccuggguggagcacauagaaaccaucacacauguacucuuacuuagucgauauaguauucacuaaaauauucaaccuuuauuauaaaauaagucuuguccuggaugguuuugcccaacuguaggcuauugcaguuuucucugagcacauuuaagauaguguauaagccaugcugugacauucaguaguuuauguaucucaaauacauuuuuuaaauuaaggcuauuuucaguuuauaaugggauaagacuuuauaagccacagaacaucuauggugguaguguucgucuaugaucuuaguagucauugcuguuauagugcacucauauuccagguauggcagcacacuccugugguuccagcacuugggauacugaggcagggaugucaggaguucaagacuaguuucagcuaccuggugaguuugaggccagucugugugugauaugagagacucccuucgcaacauaacaucccaggaaaauguacgcauguguuucaagagggccucagaguagcccagagaaucagggcaggcaugagagcuguuucugagauagacaugacuggccuaauaguaggacgggaaugcggcuggacuuuggaggccuuucuugauguuuuuaccuccuuccuauaggucuguggauggcuugcugaaugcccgaaagaagaaugcucacgugccccuuuggaacuacacaguucugcguggccagguauggaauuguguguguguguguaccuuccaccuugacuuuuuuuguuuguuuguuuuguuuuguuuuguuuuguuugaggcugccccaugagcuuccagaaacugcccugucucugucucucucccaucucacuucaggagcuguaagaacagaugcaaacuccugugccuuacuuuacauggguccuggggauuaaccuugggcccucaugcauuuguggagaaugcuuuaugcacugugcaccacccagcaagguucaggauuucaagauggggaggggcucccggugagcuguuacggucagcaguggucagaggccuucuccucugccucccuauauucuuucuugcuuuaugauuuuuauuuguuuguuuuguuuugauacaggguuucucuguguagccauggcuguccugaaacucuguagaccaggcuggccugaaacucaaagauucaguguucuaccuccugagugcugggaucaaaggcuugugcaaccaacacccagcuauucuuucuuguuuuuaagaauacacuauacauacuuuuaaucucagcacucaagaaauaggccagccaggacuauacagugagaccuaaucuuaaaaaacacccaacacuucauuauuauuauuauuauuauuauuauuauuauuaucauuaugugggggauaucggggugugggugcaugugcuauggcauccacauggaaauacaaggauaacuuagggaguugguucucuuucacuuguugaggcgguaucucucuucauguuucugcccuacugcauacuccaggcuagcugacccauaaagcuugcaggugauucucccaucucccuggaggagugagcacagauacauaaugaaugcugcauccuuuuuaccagggauugacucaagcugucagcccugugcagcaagcaugcuuacccaccgagccaucuuguuagcccugguuauuucuuuauucuuuuuguuaaaaaacuagauuggcccuuccguuuuuuucuaauuucucaaucucugaguucccacuccaucauggaaugaauaagaccuuggguguauuggauucgaauuuuagagcuuguuggaugaaugacagugaggggaagcuuagaggaguuaaucuguucucucuggggcauugggcgagaugagaacuguuauucuuuaaaguugcauuuguucuuacuugugucugugugccuguuuguguguauguggacugcgggcauacagugcccacagagaccagaagaaggugcccuggaacuggagugauaggcaguucugagcugccuaacgugggugcugggaaucaagccuaggcccucugcaagagcaacgagugcuuugaaucacggcgcuuccugcagaacacaggcgcucuuuguuugcuuagacguucacgcuuccuucuuguuugcagaucuucaucguguacuucaucgcgggugugaagaagcucgaugcugacuggguugggggcuacuccauggagcaccugucccggcacuggcucuucagucccuucaagugaguggucagcacagaggccuuucgggggccucauucgccaggucuguguaacacauaucugacuuuugccuuaucuccccguucagccggauacagaguaaugaugcugaaagauggaggccuaacugcaucuuggagacucugugcuauagauggucaaaaagagaaaggaaucagaauuaggugacuuaauguccaacuuugcuuucaauuguugcgauaagaccacaaucaaaaccagcguguggaggaaaggguuuaauugggcacccauccagcccaucccaguccucugccaucaucgagggaagccagggcaggaacucggcagagcaggaaccggaagcaggagcugacgaugcagagaccaugcagugcuagugcugcauacugccuucuuucucauggcuugcucacuuuuucuguuuuaugcauauaagacaagcaccccagcccugauccaacucuuuuuauuguauuuauuaauuuuuuguagacagggacucacuauguaacucuggcuggucugauccuuacuauguggacuaugcuggccuugaacucagagcuccucugccucuucuagcauuaaaugcaguaugacuguagucuucuuuauuauuauuuauuuauuguauguauaugaguacacuguagcugacuucacacacaccagaagagggcaucggaucccauuucagaugguugugagccaccaugugcuugcugggauuugaacuuaggaucccuggaagagcagugaccugcugagccaucucuccagcgacuguagucuccacaggagcucucagacaguuuggcaaaggcagaugaugccgcuccugcuugacaggcagccucaucugcgguuucuccuuccuuccaagucgcccucauuugcucuuucccacuuccuguuuuccacauucugaacuuugaccuguuacucagccagucacucguuuuuuacauuuucauuuuuccauguaucuacuuguauguguuuauagguacacuuggcacacaugugccguggccuauguguggaggucagaggacaucauacaggaguugcuucuuugcuuccaccuugugggugccagggaucaaacucagaucucuaggcuuaguaccuaaccauguuaccagcccagugcggucaacuuuuaaaagugagccuguucuuuuucuuuugagaaaaggucucaucuaucccaggcgagcccccagcuccaugaggaugaccuugaccuuucugaucccccugcuucugccucccaggcguuaggauuacaggugugcaccgccacauccgguuuugugagaugcuggggagcagaccuggggcuuuuuucuugcaugcgcggcaagcgccgugggccccgugcccccccuucugugagcugcacgcccagcccaggcucgccuuuccacacuucugcucuaggauguccauggggcgccagcuuccuccagcaugcuuccagucgaguuuuaucccaggagauugggccuuacuccucguacagggggucuugggggagaaaauggacaccugaaaaugucaagggauuggaaacuccaguguagaacauucugucugcgucuggggcuuaguuguuguaccccacugcugggcagauccuucgucagggacagguuacugaagcaccugaugcuugugcucuggcugcugggugagccagcugaccagcccuggccuucuguccccaugucugcaggcugguguugucggaggagcugacaagccugcugguaguacacuggugugggcuucuccuugaccucucggcuggcuuccugcucuucuuugaugccuccagacccgucggccuguucuucguguccuacuuucacugcaugaacucgcagcucuucagcaucggucagugccugcagcgguagggagagugacugcagggccgugggaagcaacuggggauggugauccacaggcaggagaugguacugggugaacccaguauggucacugcaaagugggaagagguaaagaugagcggcuugggagcuccgggggcagccagcgugcugcacagugagggucugugggaagaacagugaagcacuucuagguucgggaagcaguucagcugcugcagugcuucucuagagugcacaaagcccugaguuccaucccgagcaccacaggaaaccagcugggaugguauucgccucuagucccagcacuugagaaguagacuguagaaguacuucauaaggggugaugguagaaggagugugagcacacggacaugucuucuuccugcuuuccuagggauguuucccuaugucaugcuggccagcagcccucucuucugcucagcugaauggccucggaaguugguagcccgaugcccgaaaaggcugcaagagcugcugcccaccaaagccgcuccucggccuagugcuuccuguguguauaagaggucccggggcaaagcuggcccgaagcccgggcugcgccaccagcugggagccaucuucacccugcucuaccuccuagagcagcucuuccugcccuauucccacuuccugacccagguucguggcaucuggacacccacaccaaggcugggcucgggcugugccugguguggcaggaucagggaaggagggaaggaaggaaggaaggagggaaggaagggaggagggaaggaaggaaggaaggaagggaggaagaaggaaggaaggaagaaggaaggaggaaggaaggaagaaggaaggaaggaaggaaggaagaaggaaggaggaaggaaggaaggaggaaggaaggaaggaggaagaaggaaggaagaaggaaggaaggaggaaggaaggaagaaggaaggaaggaggaaggaaggaaggaaggaaggaaggaaggaaggaaggaaggaaggaaggaaggaagggcuuaguucuguagucuucuugguagagaagcacuaaaccaaugcugugugcucugucuucccaggguuacaauaacuggacaaaugggcuguauggcuauuccugggacaugauggugcacucccgcucccaccagcacguaaagaucaccuaccgcgacggccucacgggcgagcugggcuaccuuaacccuggggugagacuucugaugcugccaguucuucagagaucguauuugguccgacaccauaaaguaaaacaaacugggucucugcauuuccucaaaaaaccagauggaaccuuuucuuuuuucauuuucuuucuuucuuuuuuuuuuuuuuggugcuggacccagggccuaacacauauuaagcacauacuuuuaacagugagcuacauccucaucccugagcuuuuugaaguuuuuuuaaaaaauuauuuuguguguuuguguguguauguguguguguacacaugagagacagacaggcacauguggagacaacuuugaggaguuaguucuuucuacagcauugugaguucugguaauuuaacucaaguuuucaggguuucauggcaaguguuuuaaccuguuaaaccaucucaacagaccauauuuuaaaucaauaagucaggguauuucuauauaucccaggcugguccuguuucagcuggugcugaauauuuuuaacauauauacuguggauagagaugagauaguuugucauuguuuugaauuaagauuauguuuuuggaaagguaaguaaauauuuagcaaugaaaauucaccacccaagacaacuuucuuuuuuucccuccugguaaaguuagguagcaggcagagauguuuaugucauuggcagugcaugucuuggagguugacagugacaacgugggacuaauguggggguuuggggcagguauucacacagagccggcgauggaaggaucaugcagacaugcugaagcaauaugccacuugccugagccuccugcuucccaaguacaaugucacugagccccagaucuacuuugauauuugggucuccaucaaugaccgcuuccagcagaggugggcaaggggagcagcgacagggaaagaugaagcacuguucuuuuugccaagaugaaaagcugaagucucccaguugucugcuuuuuacaaggcucucucucaguguagugcaugucgggguugaucugguugugguccagcagggggcaccaucauccaggagaaaagugaacugacuguucucucagacacuguuaacacaaugccgucucagguggccacuaacucacauucuuuccccuccucucugccauggacuggcaauaacaugcugaccgcgggcauuucuuuuuuugggaaaucuuacuccuucgagaacguggguucaguggugaaaggagcagaaccagaaaucugguggguggguggcuguugccuccugagaacaugguuuccuuuuugaaggcuuuuugacccucguguggacaucgugcaggcugucuggucccccuuccagcgcacaccuugggugcagccacucuugauggauuuaucucccuggaggaccaaguuacaggauauuaagagcagucuggacaaccacaccgagguggucuucauugcagauuucccugguauggaggaaggccaggggagauuuugcugucuuucuuuggcuuccuugaccauagagacauugcauaugaugggguagggaggggacucuggaugcgauggcugugaaggugugcuaucugugcuggugagguggggugggauggugaacucucuugcuccuggcagggcuucacuuggagaauuuugugagugaagaccugggcaacacuagcauccagcugcugcagggagaagucaccguggaauugguggcagaacagaaaaaucagacucuucaagaaggagagaaaaugcagguauuuucugggguuagcagugauaacuaacuggggauuuaguaucguaaaauaagaacguuagaaauuuaggagaagcugugauuccagaggccguugucagacucccaacgcacagaaagaaagcaccaguaggauuagaguggggcggcaauagccuagcuagggacguuagagugaaacguguccuuuguucccgcaccaguugccugcuggagaguaccauaaagucuauacuguaucaucuaguccuuccugcuacauguacgucuaugucaacacuacagaggucgcacuggagcaagaccuggcauaucugcaagaauuaaaggagaagguggagaacggaaguggugagugcaugaaggcuugggcagggagaguaccugguuuuagaagucaguguuacagaaucgaacaucaaagagagugcgugaagcuucuaguugauggaaaugggcuuucuaaaugagaaugggccuucucaucggauccuuuuuggugucuucuggacagaaacagggccccugccuccagaacuucagccucuuuuggaaggggaaguaaaagggggcccugagccaacaccucugguccaaacuuuucucagacgacagaggaagcuccaagaaauugaacgcaggcgaaauagcccuuuccaugagcgauuucuccgcuucgugcugcgaaagcucuacgucuuucgacgcagguaaguuucagucacagaagcaugucauugccaucaggugcucaacaagccugguuacucuccccuagcauaacaaauccuagggaucucuccccucuucacccccuuccgccugcuuaucuuuagccuuuccaugguuauuccuguuuuacccuagaaucuugucaagcuucagaguagggucugcuugcauuugagauguggaagggucauuucagguaauuuguguccacaggugaaggggucuagaccaaauguuuccugagggcuuugguugaaguuacauagaaacauacauuuggacugaguguuuaccuuucuuuucagcuuccugaugacucgaauuucacuccgaaaccugcuauuaggccgcccuucccuagagcaacuagcccaagaggugacauaugcaaacuugcgaccauuugaaccaguugaugagucaagugcuucaaacacagauucuucaaaucacccgucagagccagauucugagcauguucacucugaguucugagggauguacagaugcucugugcagaugugggggcagccuguuauaggcuuauugucuacgcaaagaacauauuuuuggagaaaaaugauaugggacaggcuuucacaguacagcccaggcuggccucaaacucaugguuggucccucugcuucagccuguuuuguaauuacauagaucaccaaaccuaguugcuuuucccuuuacauuuuuuccccuuauaaguucuuuaaaauuauagcuuacauuuuuucuuuuuucuuuuuuuuuuuuuuguauuuuuucuuuuucaagacagggucucucucuguguagcacuggcuguccuggaacucacucuguaguccaggcuggccuccaacucagaaauucuccugccucugccucccaagugcugggauuaaaggugugugccaccacgccccacugggcuuuuaguuuuuauagacaagauuucuccauguagaccagaccagcucuccugagugcugaaauuaaaggcacgggacaucacuaccuggcuuucuuauuaaacuuguuuuaguggucucaaaauuca

SEQ ID NO: 3076 - RNA, 12797 nt, Mus musculus
ccgcccuucccuagagcaacuagcccaagaggugacauaugcaaacuugcgaccauuugaaccaguugaugagucaagugcuucaaacacagauucuucaaaucacccgucagagccagauucugagcauguucacucugaguucugagggauguacagaugcucugugcagaugugggggcagccuguuauaggcuuauugucuacgcaaagaacauauuuuuggagaaaaaugauaugggacaggcuuucacaguacagcccaggcuggccucaaacucaugguuggucccucugcuucagccuguuuuguaauuacauagaucaccaaaccuaguugcuuuucccuuuacauuuuuuccccuuauaaguucuuuaaaauuauagcuuacauuuuuucuuuuuucuuuuuuuuuuuuuuguauuuuuucuuuuucaagacagggucucucucuguguagcacuggcuguccuggaacucacucuguaguccaggcuggccuccaacucagaaauucuccugccucugccucccaagugcugggauuaaaggugugugccaccacgccccacugggcuuuuaguuuuuauagacaagauuucuccauguagaccagaccagcucuccugagugcugaaauuaaaggcacgggacaucacuaccuggcuuucuuauuaaacuuguuuuaguggucucaaaauucacuaccuggcuuauuaauagucauuuuuuuuuuuuuuaaguugacuuguucuuuaggaaaaggaauuacaccacagugaauguagcugaauucauugugcuugcuaugugcuugguaccauuugaagcaguguaccugaauuaacauacuuaguacuuuaagaagcauuggccuuuaccuuugaagaaaggaagacaaaauuuacccaaaggcaucugggaguugacaauuugaaaucuguuagauuuaagguccuguauccugcugcuuguaauuuucagacccaccaacacuaaagcugaagaauuauagcuuacaacuuauguuaaugccaagugacuagggugaccagguacuaacaaaugcacaagguagauuuuaauuuacaauuuacuuauuccuauuuguagccagcaaguugcucagcaucuuuggcaucagaauagcacuacuaaauagggaagccagauggcuuacuuuugcauaaaucagcuuagugaaugguaacucucuaagccauugcugagucauaagccuugagguuuucugcuuucuuguauuuguccaacuccaucacaucuuccuucuauucauccuauuuuuaucucuacuaucacucuaucccuucacccuuuauuuugaaaucuaguuagggauaagaccaggguagggucaauugcacagguuaggucugagaauggagaaccaaaaaucuagcuuaaugcauacaaugggccagagggguuggcucggggagcucugaugaaauacaaccuggcauuauguccuuaaacggucagcccugaguaguaaggagggggggggguguccuuuucaaacuuuugcagugcuuaugaacccaagguucacgcgaugcuccuuccauguugauuuaagagugaauuaaguggagaugagcucaguaguaguuaagcugcuugggacuagaaauggggguucaguugguaacauagucucccaugcaguaagucuuaccaaauaaacugggcacugguaugcaucuauaguuucagcagaggcucaguuuagggacagugcaggggaagcaagacccuauuuaguacuccaccuaucucgaguacacuuccugcuugcccauauuuccuucucuucucacuggccuaguuaaguguuuauguaccuaguauuucucaggaccuccuuaagauugagggcucaagcuagcuuuuaagaucucacaagcacaucuaugugguagagcacuuuugagauggucucaccccaggacacccccaaauauaaauuauguagcugaggaucucaaguuccuaauuguccuguucuugccagugggcaauuugucauuuuugucuugagcaagcaagccucuaaaaacuugagauaaggacuugcuauucuugaauaauuggauggauacaugagccauucuggagacuaccagcaauuuaacuaugucuaucuuugccucccaagugggaggauuaaaggaacaagcugccaucaccaccaggcaaagaaaaucaauacauuuuguguaacauuaacaccauagcaggguuucugauugcuaugaauuaaagcuacaugucuaugaaauuagucucaucuuaaagucucuuaaauggccaggcagugguggcgcaugccuuuaaucccagcacuuggggaggcaaaggcaggcggaucugaggccagccuggucuacaggguuccaggacuugaaaaaccaacucuuaaauguuuuuagugccaagaaagaguaaaauaccuaucuagcauauagacuaaauuccugccaucacagaagccucuugaccccuguucugcuugcuucugccauccaaaaggcagcacuuaauugccaaagccuucagacaguguugauuucccaggacggaucuccaagugugaauaaaaauccugaccuccauaaaccguggugcaugcacaguauaagccaggcuuucuaaaucacuaagcuuuuaucguaguccugguugaaaacuuuauugcuggcaauggguagcagaugcuauaaauuuuagcucagaaagcaacaauggacaaguaauagacacaguuuggguagaaccuagcauuuuauuuagaucuucauuaaacuguuggaauugagaaccagacauacguaauaaaccuccaaaaaauagauccugaaaggcacuuucuugcuuagggcaagcagucauggaauaagcauguaaacaagcuggcuucucuguaccacaccagccaagucagcuuucuccauggccagcugcaccagcucugcccucccuucuguuaacaccagccagacccccuguaggucuaacccaagguuuuucuguaggacaccuuggccuaccugggaaugcuggaaacauguuaaaggaauucaugguguugaagaaaaaaaaaaaucuuuuaaaagcugccaucugaggugauggcuucucuguacuuacgccauaccccagaauacaauaaauaagcaauuagaaaauguucaaguaugaagggauuuccuccuccccgccaaaagcacugcucucugaaggaagcugguuucucuguagcuacaccagcuguucagaaagcucauuggaccugguuuugaaaauaaaacaaaguuaaaacccugggaggagcuauugugcaguguggaguacucuuucuuauaaagaaaaaaaaguuaccugguaccaaagugugcaaccuacagacccucagguacugcccugugacuucucuguauaucacaagggugccaaaugccuguuuuucuagacuaaaaguuggugagguuuggcuagugcugaaaccaugcauaggguugguuuacuaaauaaaaccuuauuacguacguccuccaaagacagcugaaaaguggagagauuuugauuuggugcuguuugagguggcaauuaauagcauaagcaccagggagaugguuuaaucguaacugccuuuuuuuuuuuuuuuuucaaagucaggcuagagcuccaacugaaacuuucguuucaugcaagauugauuggauaggaacacucccugauaaagaacuacauaauuagaaaugaguuacagggaggauaaggacaggggcuucacauucaauaaauagagcucaagacguuacagauucaugcugacagggcuguggcauugccagagucuacagucaaacuacaaguacuuuacgugcacacuacaaggauguuuucagcaucuggugggaaaguaauugcaauuaggacuuuggaggauuaggugauagggcacaaagguucgauuucaaagcauuauucacuacaguguuuguuucuaggcaguuacauggcucaccuaugcucacuauauccauuauaauggugaacaaaacaccuagggacagaauagcaagcccaacuuacagucccccacaaaagcuaaaauucaugucauugauuagagugacugcaacugaucaggagcugaaagaggacagaaaaauuuaggaagaaggcccuuucccucagagcuugaaggcuucucuguaaccuacgccaacaagucuggggaaaaaaggcuaacacuuucaauauuuaagcuuuuugggcacuucccaugggaagcugucccuaccaaaguggccauaggcugcaguccucugauaaauuggcuucuucagauccagaucccuggaauauacaaguccauaacuuaauauguagcauuaaauuaaaacagagcaaaacaaucagcaagacucauuucaagaguucuggcaaaugaguucaguucucccugggguuugcuaggaaaaaaguucauggcgaaaguauuuguuacuucccuuguguuacuugcaguuuuuauuaauaguaacuacaguucuuguuuuccagcucuggcuugacaaaugaaaacuuaucauucucaggaauuccaauugaauacuuaccaagguccaaucacugaccacuaugguuauuuucuuuguaacuuugagcaucccacuuuagcuuauucuuaauguagcacccuuaguuaagauaagcacaaagcucagaaucaaagauggagaacuuucuagaauguuauuuuaagucacagaacacuaacuuaaucagcuagaucccugucugaagacaauuuaaaauauuggcauguucuaggaauuaaaauuuguuuccccucacgagaagucuaccucuaucuccucagauuuuaguauauaugucccaaaccccuaucucacuagcaauagguuuuaccaucuuuaccugacaaugaccccagggcgaagaucaaaauucuucuuuacaauuucuaauagcucucucucacucuucugagaagugccauaauggaaaauggagaucgacaauggaugagaaacuccaauagcauaagagaccuaaaagucagaaauacauuguuauaaaauagggaaguauuugaaauauuuuacuaaguacccuucucccauauaaauguucacuacauaccugaacaagaacccuccugcacagaccuccuuuaacaagggauuuugccacccaacgagcagcauaagcagcugaacgguccacuuugguauaauccuuuccugaaaaggccccuccuccaugagcuccccaaccgccauaaguauccacaaugauuuuucggccagucaggccagcaucacccuggaauuauaggauuuaagucauguaauuuuuuucccuugagacagagucggucuguguaauauauaauagcccuggcuguccaggaacucagagauccaccuguguuuuuuccugccuccuaaguacugggauuuaagguguacuuccacucuuggccauguaauuuuucuaauaagaggugguuaguacccauucuagauucaucuauagccagaaguagaucauacccauaaucccacuugggaggcacuuguuggcagaacaagcugcacaaugccauaacauuagauacguagugaauucuaugguagccuaggcuacaaaagauacaggguguaugugaaaugaaggaagcagacuagaaaaaaaaaugguggcauccagaaaccaacgauaaaccaaaacauuucauauauuaccugaggcccaccaauaacaaaucugccacuuggcuguaggugguaaauuguauccucaucaagguauuuugcagguacaacagccuugaucacuuucuccuucagagcaucccucaucucaucaagacaaacuucuucaucgugcugaacagauauaacaaucguguggacucugaugggaagcacagcaccccgaucuugcauauauugcacagucaccuugaaugcaaaacagaugggaacacuugucaaacagcuuuauaguggguucucuaucauaaguucaaauauagcagaaaagacaaggauucucccuagucagcuauaauuaacuugggaauuuuaauguaauuugagagaaauguagguuuaagaucacuacuuacuugaguuuuagaaucugggcguaaccaaggcaauguaccauugcggcguaguucagccaauuuggcauuuagcuugugugcuaagacaaugguuaaaggcauacacucuucaguuucaucaguggcauaaccaaacaucaaacccuaaaaauauggagaaguggucaauaaaagugucagaauuuaacauuuaaaaggauccuaauaaacaucguaauaccuggucuccugcaccaauaucuuccucauuccggucaagaugaacaccuugggcaauaucuggugacuguuguuccaaggcaaccaacacauuacaagucuuguagucaaacccuauaaaacaagguguuccaguaaccuuccuuuuaucuccaaaauguuaacaguagugcugugcugcuagaaagcuggacaugccaaagccaaguggucaagcacuucuuuaaaagaccauauucacauaauucacuuacugcccccucuaugguuuggaauaaggucucuaacuuggcugacuucaaacuacaacuaagcaagcagccaacuccugcuuugacacccagaaguugaguuuacaucaucaugucuggucacacuauugaugagaaucugucacuuuauuuguaggauaggagacugcuuuuacacuaugugucacauuuuagaggauaugguguaacuauguagagucaaggauuacuaggaacauuccagaagucucucccacuagcaucauuuuugcagauucuguaucugcaaaaaugaguucacagggggaaaaaaaucuuuaaaacauaccuuuggaagagucaucauauccaaugugcuuuauggcuucacgaaccacuuucugguaaucaauggcagcucuggauguaauuuccccagcaagaagaaucauuccaguuuuagcaacaguuucuaauaaaacaaaguuuuauacuuaaaauauuaagggggggguuuuugcugaggaacucaaucauguuauauaagcuguaucacugggcuuggcuucauguucuguuuuucagauaaggucuuaguaaauuacucacauaggcauuuaacuugcuaccagccucaaccucccaaguagcugguauuaccuauaccacaaaacuuugcuucaaacgccuuuuuugccauucauaaacaagugcucuguaccuaccacaagccacuuuagcaucagggucuuguugaaggugugcaucaaggacagcaucacugauuuggucacaaaucuuaucuggaaaauaaaaguuccugguucaacuuaacuauuacuacuaacccuaucucaucauguaacuagcaguuuaugugcaacccaagaagcaaauauagcuaugaauuuguaggugacagaagcuugauguaaaguuauaguaguauuugcaaggugagagggagaaucuccagucuuuuguuuuugaagacauguuucucugugcagcucuggcgguccuagaacuugcucuguaaaccaggcuggccuugaacucaagagauccaccugccucugcccuucagauuaaucaaagucaaaaugauuuauuuugauaucucaaagccuaccauaggaaauaaccucacaguguauuuuagagacaacuguucuuuuuaucccccacauuuaaaauguuacaaaccuacuaaagagccaacugucaggucauuaacuucuuaaaacaguccauuuccccuauuauuagacaauagggaaaugagauuuuuuuuuuaaccaugaaaauaaauuuaacagaagaaacaccagcaaacaaaaaaugcaguaauuuuuuuuuuuuugagacaggguuauagcccuggcuguccuggaacucagaaaaauccaccugccucugccuucggcuccaggaaacuuucaagugugcucuaagccauauccaauuucuccuugauucaucaauuuagaaaauggcaguauccuggucuggaauguuugugguauugagacagggucuuacacguggcccaggcugacaaacuaaacugcuuccauacuuuaaacgcugggauuguaguaguuaguguaccacugugcuuggcucuauguuccuugauuuuuguuacuaccccaaaauguguauugcagccacagaaccuuaagauggaaucuaauggcuguacuaaggagugauucaauagauauggagauacuccuuuccuugaggggagugugggaggagccacagcaacacuugucuuucaaccaucacucaucaagaugcuccucacaagccauguaauaauauugcuguggacccccugcgaacggaaacagcucaaacugaauauuaguauuuacuaaaugguuauguuccaucugaaacccaaaguccauauaauagauucauuauaaccgaucucaucauggcgguucaguggacaaagccuuaaggaaacaugaaauaaauccuccuuuaguuguaggaaaaagaccaaagggaagacuuuaaaacgaaaccuaacgcgaugggaguauacacuuaauucaugcacuucauccuuuucaagcacacucuaaauaagggaugccuucucuaauucgcgcuauauuuagucaguggcagucugucaccuugaaggcuaaagggcaugucuacccaugcucuuaagcguuuuccaggggccggaagucagggauauuagagaugggaccuucggagacaccagcccccacuuccaaacuaggggucggguggguagaggccgccagcuccgcuucgccccaauuccacaugcggcgaacacgugguagccgcugcaaugcggggcgcgcgcucccggcggccggacgcgagcacgcggggcggggucgcccacuugagguuuuuccaggcgacgggacuaaagaggaggaagcagugcccuccccgcgccgaucucaaaacugccucgagcccccgcccuucucgauuucuggaaccuuccgcaugccggggcgcgccgccggaugaggagcggagaaagggggaggggagcggggccgcacauugcaaacucgcggcgccacgagggaagcgcgcggccgcugccaugcccaccgccgccggagacggccucgaccacccccagcgccacugcccuccgcccuucccuccuccgaguccccgucggcucaccugggugaccuuccccuacagacucggaagugaagaggaacguccccuccucaaugaacgccucguggaagccguugagcugcccguucauggcggcggcggugagagagggcgacucugaggagacugagaggcggcgaggcggagggcugcggaagacacagagggaggaucgcuucagcucucggcaggcuggagacucggagcgaacggagcggcgggcgaagcggcccaguauuuauagagcagggggucgcgcgcgcccggcucgggcuccgccccucggcgucgcgcgccaaugcgccgcgggcgggcggauggggguuggcagggagguccgccgagccgagcuccggcugaaccauucuaccgauggggggggcgagcagagcuaaccgggccuccugccaguaguuagucaucuugauggcguggguuaaauggagauguaagugaguagacuugggguuuacgcccauccccacguugauugcuggagaagagaggauuuggauuugaaggacggccuccccuguacgaggguaugguacaucccuccgaccguugcccacggaggucugccggcgcgcgcgccucccagcggcggccguggcgguggcggccguuuugugcuguggcucucgccgagggucuuuccugccaccaccacccuccauucgccaccucgugcaccagcgccggguggcccucugccaugugaagguggccauguugacuggccagcggaggcuaauaggcacugcccuuauccauccuacacgguucccuccggggaacgagagauugugagggguucuagcccuaccguuagucaugccucgaguaacugcucuggggaaaauggcuguaaagccaacuagcaggaaugcuguauuguuuuuccgaacaauugccacuugccggcggccuccccuccccccucgccgagccucguggacccccguagucugagacgguacuagauucuuuucuauccuaaaucugacuuugcauggcuugguuuuccaugcuuccuaggaagaaauggacguuccaaucuguucgagagaauaugaaugcuucuuucguguguguaggggagggcgcuauucaagccuucaaaugugcuucagaugagcuugucaaggucaaauggccucgauuuuaugacacuuucucuuuuaaacuuuugcaguugucucaguuuugcucaugaaaugaauuaacagacggggaaaaaaagggaaauaaaacuccauacagacaaagaguggagucuggagcuaauugcaugcagagacccucuaugaggccagugucacacaacuguuggguccagucuuagggcaggccaggagccugguggcuuuugagaaccaguguuugucaagaacaucggguuuuaugaugcuagggaacagccugcuccuagcauaagaugcacuugacugugaggcugaaugacaaccuccggcugccagcugccuugccucagaaaauuagguacacuaugaaaagcaaggggcauuucccucuagggugugugccagugcaaaggugggaguuugagaaaggcacugugggaaacaaaggaagcucuuagacugugcuaugcuaggaacaaagaagauaagggacacacacaggcucaucuccaugucggaaaccacaucguugcaggcagccugacaguauuuuguucuuguucguuggguuuauuuuuaaaacuagcccuucaugagaaaauaguaaagacuuucauaauuuuuacuuguuuuaggggcuagagagauggcucagccauuaagaguaccucacaaugaguaauaaaauugccagacagaccaaaaugccuguguagaccggucagugcauuaccuuccagcagaaaaaucuauauagaagccagaauauaauuaaaagguuauuuuauuaauagagagggaggagguuaaauucaaugauuaguucauuaaauucugacaccccuuugcucucagcuccacagcugguuucauccugccaagagaauuaaacucaguuauacaucauuaccucucuugcucauagggacugcaauucguggcuuugggucacgcuucugcuguuaccuaacagaauaagcaaccuccauaccucugucuucagccuguaaaguugggauaauaguaggaaaaauuuccaagaaaucuuuugcacggugucuaacauauaacaggaaccacuaaaguagugaauugucauuuuacagguguccauuugcuggugggacaaaggcuaaaauucucuacuuauccugcugugguugcuucuugagaccaggucucacucuguagccuguguugaucuggaacucacuguguagcccaaacuggccuugaauucaugaaaagccuucccuguuucagccucuagagagcuaaagauuucaggaguauuccaccagaccuggcuagucucgcaugcucucauuaaaggguagaguaugcuguuacuauuauuucacaccguaucucagaacaguccccuccaccuucuacucuggaucucuuugacuaaugguucaagucauucauugauccgcaucaaaacaaguacauauuuucacugauuuauauuacucacauuguccuuagccgggcgugguggcacacgccuuuaaucccagcacucaggaggcagaggcaggcggauuucugaguucgaggccagccuggucuacagagugaguuccaggacagccagggcuauacagagaaacccugucucaaaaaaccaaaaccaaaacaacaacaaaaaacaaacauugcccuuucuuucuguaaauauuuaggauaccaacuguaaggcuggcaggaaucgauauggugacaggccugguucucuuccuacuccaagacucuuaagauugauggcaccuggcacacacuauccuuuccucugcagcucagcuaccacuuccuagaugaaaccuuuaccgccagagguuuucucaggguucaguucuuuucucuccugcuccuaagugcuguuugcaaugacagguuugaagauuaguugaugaauaucuccaauucccggguugguccauaaggaccaugaauaagguggugugcuuuccugcagcuuugcucucaaugcacggaagaugcugaagaguguucaagagggagaaaagaaggaaagaaccaggcagugguggcgcauaccuuuaaucccagcauuugggaggcagaggcagguggauuucugaguucgagcccagccuggucuacaaagugaguuccaggacagccagagcuauacagagaaacaaaacaaaacaaaacaaaaacaaagaaaaagaagaagaagaaggaaagaaacaggagggaaaguaaguggacauuaugaaggacucaagaaacaaguagggagccgggugugguagcacccgccuuuaaucccagcacucgggagg

SEQ ID NO: 3077 - RNA, 1567 nt, Mus musculus
agguuuuuccaggcgacgggacuaaagaggaggaagcagugcccuccccgcgccgaucucaaaacugccucgagcccccgcccuucucgauuucuggaaccuuccgcaugccggggcgcgccgccggaugaggagcggagaaagggggaggggagcggggccgcacauugcaaacucgcggcgccacgagggaagcgcgcggccgcugccaugcccaccgccgccggagacggccucgaccacccccagcgccacugcccuccgcccuucccuccuccgaguccccgucggcucaccugggugaccuuccccuacagacucggaagugaagaggaacguccccuccucaaugaacgccucguggaagccguugagcugcccguucauggcggcggcggugagagagggcgacucugaggagacugagaggcggcgaggcggagggcugcggaagacacagagggaggaucgcuucagcucucggcaggcuggagacucggagcgaacggagcggcgggcgaagcggcccaguauuuauagagcagggggucgcgcgcgcccggcucgggcuccgccccucggcgucgcgcgccaaugcgccgcgggcgggcggauggggguuggcagggagguccgccgagccgagcuccggcugaaccauucuaccgauggggggggcgagcagagcuaaccgggccuccugccaguaguuagucaucuugauggcguggguuaaauggagauguaagugaguagacuugggguuuacgcccauccccacguugauugcuggagaagagaggauuuggauuugaaggacggccuccccuguacgaggguaugguacaucccuccgaccguugcccacggaggucugccggcgcgcgcgccucccagcggcggccguggcgguggcggccguuuugugcuguggcucucgccgagggucuuuccugccaccaccacccuccauucgccaccucgugcaccagcgccggguggcccucugccaugugaagguggccauguugacuggccagcggaggcuaauaggcacugcccuuauccauccuacacgguucccuccggggaacgagagauugugagggguucuagcccuaccguuagucaugccucgaguaacugcucuggggaaaauggcuguaaagccaacuagcaggaaugcuguauuguuuuuccgaacaauugccacuugccggcggccuccccuccccccucgccgagccucguggacccccguagucugagacgguacuagauucuuuucuauccuaaaucugacuuugcauggcuugguuuuccaugcuuccuaggaagaaauggacguuccaaucuguucgagagaauaugaaugcuucuuucguguguguaggggagggcgcuauucaagccuucaaaugugcuucagaugagcuugucaaggucaaauggccucgauuuuaugacacuuucucuuuuaaacuuuugcaguugucucaguuuugcucaugaaaugaauuaacagacggggaaaaaaagggaaauaaaacuccauacagacaaagag

SEQ ID NO: 3078 - RNA, 9953 nt, Mus musculus
auugaaacauuacauguauuaauacuauauuuaaacagacuaaaauuagcacuuguuuaacauaagugaaagguuuuuaauuuuuauccaccuucucauuuacucauauagguaaagcaucccuauucugaaaucaaagcaagcuuuuuaaauuauagcauggacucaugugacaggucagaaugcucaguuuuucaaaguauuacauaagauguugugccuggucuauacauaugaaacaaaugaauuugugguuuaguucugggacccauuccccagguuaucucauguguaugcaaauacuacaaaaucugaaagaauucugacuccaagcauuuuagaaaacaauacucagguuuuguuuuguuuuguuuuguuuuucaagacaggguuucucuguauaacagagcucuggcugcccuggacuugcuucauaaacuaguucuggcuucagauucacagagcucugucugccccugccuucugagugcugggguuaaaggccggugccagcacugcccagccucguaacucaguuugacuaugugccagcaacuacaaaugccgugucuaggcuugguucaucggcagugguaucuuuugguguguuccuuuaacccacuucuaucaggauaaaacuuagaccugaggguuuucuuaggucuggcacuuugagagaguugcuacuccaagcccacacuuuuccauguauagagcaucacaacacgagagugaggaggaacaaaaagcuucaggguaggacugaaccaaccuauuccaguagccaacaccccagggguucugggugccugaccauagcuuggaguuggguguaggaaaggcaugggagcauucuucaugaggcaucaaggcuauguaguucacacuaggccuuaaguagaaugcaagguaaagaacucuugacuuaacaacacuaaucagaaacaaaaugguuuuuguuuauaugugcaaggaauugcuguaggagggaggacaccacgagaaguuggggaggugccuuuccucuggcucuucucugaacggacuacaucuucuucuuuugugccuugaccuuugagccaagagccugcagaucugaguacaaguuccguuucaggauggcacugcugcacagcaaggcccccugcagggcccccaucagcccacaggugaagauaucuuggccuagaaagcaaaagcagugacccaugaagauggggguaacaaggguucuuguguucaucccuccauaucaaggccacccaaagagagacagccucagauagaacccaggacaauagccaaggcagcccagcuccugguguaggcuugaggacgagaacagaagacuaugccagggaaguccagauucuggcaaagugaggcaguguaccugucagguagagguuggggauggggguuugggcucuuauggaagccauugcaugaggaugcagccgagccaagucauggucagcuccauagguagcuccucggggugcagccagauaguacugguuggucaguggugacccuccagucacacucuccaccugaggaaacaaaagggcaaggcaagggugaacaagggacugugggacucuuguuaccgcaggcuuugucccuguauggaagaagacaguuaagggaugcauugucaccuccagcacuguaugucagccccuaccuugcccuccagcugugggaacaguuucaugaucaccgacauagaggcuuccacgaaggcauuuuugagggucucauagucaacaccacgcuugcccuuuggcuccuccugccacuccucgaaccauucaaaggccauggguaccagcgcagucauuguggaucggucuguggguauaaggccauguuauugcuauuuggcccugccuugcccuacacccaacuucccuggacuucaagcccuaccugggaaucgcuccucccagguuggauccuugcuugaugggaaggcaaugaagagaaggggaauguguucuggagccuuuuccuugggcauagagacauagcgcuccauccuguggaugagggagggggcgugacugccaaucuuuaggccucuuccucaaagccaccagcacuacccaaacaaaggcucaucuccagggacuucccacaagggagaaaacagcacggcuuugguguagaaagccuuucuagaaguccauuagagacugcaccuccucccucaaaacacauccuucucauuccuagaaccguguggaggguggaagcaggaccuugugggaugaggcccaacacuaucagucuuccccaccccucacaucuuacgcuuuguccaugucugugucaaaauaaacauaguaguugguggacugaagcuucagguccuccuuggugccuuucagacagaugaagauugagagcaugcucagaccaggccuuaccaucgccagcugcuucuucacaucugcagagagccagugaggauugcugugcaggaguuacagccagacagccaccccugucaggauagccucaggauguucccuuuucugaucuguagcucgauccucagcugccagcugggacagagaccuggccgguuuuauaacuauuucuauaggauccuggcagagaccugcucuuaagucucguccuggcuaugugagauguagccucagauuccuuccaacucuaccaccucugccccauguccccuuagucauaggugcuggcuuccugcugauucagagcagagcuaacucacagcaccucuggacaaucaggcuguuccaacccuccucuuuauacauuuagauguuucguuaauuauagauguauauggauaaaggucugucuagaugugcaagaagccagaagacaacuaucuucuuccacucuggggauuuagcagcaaagacuuuacacucugaaccaucucaguggccuuuguuuguugaggcagggucuuguguagccaacggugaccuugaauuucuuaucuucccgccaacaccucuugagugcuaggauuacagccaaauccacucuaguugucuuaccuggcucuagguaaacccagggcugaugcaaacacucuaaccaacugaacuucaucccuagcucuugucugccauuuaacugagucuuuucuauuaaagcccugguuucucuggcaaaggaaagcaaauauacaggguuguguuuuucagcccggaaguacaagauagacauuugcaucugacaaaacagaguccucagagcucugccacugccucugugaagggcuccucuuccccuguaguccuagauuccccaaauauaaaugcuauguuccugguagcacagacuagagagagacagcuagcggacugcccaaggagaggggagcccacccagcugggcauguaagcuucacagaugaaauauuaguucaaaagaucagucuuuuaccuggcagauggcggacagucucuggcaacaagugcugauagguauugaacauucccgcauuggagaugacaacugggcaguagauguucaccagcucuugucccuucuucacacugacaccugcaggcacaagaauuuggcugagcuucuaugagcucuguggaaacaaaaaagaccuauaccauucucuagaucccucuuaagggcuaggaauacagcucagguggaaagcgcuugucuaacauguaugaagcccuagguuccgugcaccccauacccaccauaaaacaaacacaacccaggaaagugugaaauacauuucucucaaagcauuagcuguagucgcagcaugaugacauguuccugcaauccuagcauguaggagguagacgccauauaaucaggaauucgaaggucagccucagcuagcuagugaguuugaggauagccugaaacacaugaaauccugccucaaaauauuaguucugucuauagccacacuauccagaugucuccuaggguaggcccuguuuucucagaccuagaaguuccuccagccaaagcaggucccaggcacacugcaaagucacuuagcccuugccucaaaugcuucugugcuugcccucucuagcucuucuuacccacccauauggacuuaccuuagccacgcccugccgucccaagaacacuggcucuauggagucccagccccuccuucccugcugccaaguuccacaucuacaguacuccccagaugacucaaccuucaugaaacaccaaggcuucugugauguacugaagccuguguguccaaccucaucucuggccacucacaaaaccauuaugucagaccugaccuuuuguaagaauuguaguuugauuccuucauugugugugugugugggggggguggggguaggagugcuacagcccauguguggaggucagaggacaacuugccagaguucucuccuuccaccauguaggcuguggggaucaucagguuuagugagugacuagaccauuuauccacugagcuaucucaccggcucagacgccagccucuuaccgugcauaaacaggcuggcuuccaccccagcccacugaccccacagcccaguacagaucucuuaccacacgcucucccagcugaguccagcagcacacucuguacaguggcccuggugaggacagcgcccccggcccgcugaaucaaagggaugguauggaaggcgaucucacuggaacccccucgaggguaauaugccccuuguauguaguggucaaccagcagagcaugcaaggaaaaggcgguguggcugggaguuacuccuacaggaugaaggaaagaagaugagcauaguggucauuuggcaccauucaggaagaaauagggcuuccugugagggaccacaagaguccauccuaggaugagaaugcucccaaaggcccaggguagguaaugagcuuaguggaauauaaaaccauuaugcuuccaagaccaaagaagucacugacacuguuggcuaaagagaaaaaucaaccuugagcaguguacaugccuauaaucucacacucaaaagcuacaccagaaggaucauugauucaaagccauacuaagcuacggagagaucuagaccagccugagcaaagucaaaacuuuuccuggagguguaggggacagggagaaaaugcacuugggugggcucagcuggaugucuuccuaacaugcaugaaagccuggauuugaucuccagcaccacauaccccagacaugguggcacauaccuagcacuaggaagguagaggcagaaggauaaggaauuuaaggacauccucaacuacaagaguucaaagcuugccuggaagaccuugucuucaaaaaggaagagaaaacaaaacagaagaagaagaaaagauacaagagagaagaacaaaagauaacguuccauaaaguaaauaauaaaucauuuuuaccagaguccaacaugggucagacuucucagcccugauccacaaacuccugcaggccuggggcuauucuagccugucucaguuaggcagaugggaaagaaagaccaaagcugggagagcaguagccuagaaaagccugggcuauagccacccaccguaaguggggaagauguagcugagaacagccuggagcucacgggaagccccaagcugcugcaggacuucagcuaggcucugcguagacgcucggcagaauggagagaaacgagucaguagcccaaacuugcugaggagcugagucaagggcaaugggaggaacuugaguagaacugcaugagagacuccacgggccaccaccugggauaaaaaagguaaagugagucucagcucuggggugcuggagccuaguuacugcugcagcagucagcgcugacugccagcccagcaacacuuacucagaauuuuuggacuugaaaauuuuuuuuaggcauggugugugugaucagacucaggccugugaucccaacaguugagaugcuacagcaggaggauugccaugaguuuaagggcaaccagagcuauacacugacauagaagccaggacuauguaguagagcugucuuccucaccacaaaacaacaacaaaauggguccugaguuuuucucauucuucgcacucaaaugagacuauuugcucuuccauuucaugcuccaaaaaguauuguuuuucuuuuauauagagaguuccaaauauuccagugaccuugaacuccugaacuuccugcuucugccuccccaaugcugggauuacaggcuacaccaucauauccagaugcuaaggugcuugggauauaauucagaguuguaugugcuaagccugagccacauccccagcauucagauuccuuccaaacauccugguccagaaagcagguuaugauuucauaugcucggcagaggcagguggaucucugcugaguuccagaccagccagggcagcauugugagacucuaccucaaauacacaaaagucuggcauaucucagaggacaucuaacuuccucaaagccugacuuagcaaggguaccaucuagaggccagugugaggacugcagcuggggagccaagcagggcacaggcaaacacaagcuuacacuggaaccaggacagacaugaccauuccuuccugccuccccaacucagcccucuccuccuaccccaccaguuucuucacuaaugaaaaggccagucuuguuggaaauaaacuagggaugcuaaucauggugcauacuaccuuaaccaacuccauguacuugucaaugacagcuucuuccuuggggaacuucuucuuaaggcccuggauguauucuuuccucccacuguacauggggaacuccuuucggccauugggcccuucuaguaucaucaagucaaaaggggaggccaugggggcccaguccaguugcccuucagugaucugguccaagauaaaacggccaauguugcccucccgcauucguccaauauaaugaauuccuguugggaggugcaaaggaaaggagauauagagauaaaagggauugggcccuggaaauaugccaaguaaggaagagguuguccugcuuggcuauguucauguccagaggggggcugcccacccuuucuauaagaaacaaaucagaacauauaccacccaaugcuugcccaguaacuaggccaucggacagaaauggaggugcccagagagaaguugagaccuccaaacauuaaaaugcccccaugucacucaauaguguguguuauuagccaucuaaagacaaggccaugcuccuaacccuuucccacacaagccuuaccagugucaaauucaaggccauuuuccccaaagguaugacaacagccgcccgccuugguauguuguuccagcacaaggacucucuugccagcuuuagcuagaaccgcagcugaggccagucccccaaugccgcugccgaucaccacugcauccagcuucucugguacucggcugacugagaaagcuguagaagggaggagaagggugagcuucucagacgagggcaggaaagucaagucaaagaagccgggguccuucucuaacguguacucgguaagaagucucuacggcugcugggcauggugguguacuccugugaugggagcacuugaaaggugcauuaggaggccaagaucaucccacaggaggccagccugggcucguuagacccagucucaaaacaagagggaaggcagaccuuucuuuuaagguaguuuauuuacucuugacuaagaugucucaaaacauucuaccagggaauaccucggaccagacaggcagguuaagcagugaugagucuuaaccccuacaguguacuugagggauuugauaccuuucaaaggaaguaggacugacucagcuagcuacuguagaacaaaaccagaaagauggcaacugcacagggcuguaacgucaguucugugaaugcaagcgaggaaagaaaaggcaauaaggcucagggugggggcuggggacgcuggugguucagggaacuggguuucuuuggaagaagcaaggucucugagugccaacggagguggagcaggcagagcugcucagaggcugcuacucugagaggucacagcaccagccucagaaaaggaggaagguuggugugccgggaaccucacagaaccaaacuggaaugcacggucaacacaagaccugggauuuguuguuuucucccagucuuuuacuuccuuuccuccuuuauuuacuuacuuucuuugauuuuauugauucguguuuuuuaagacacacgguuucacuacacauguagcccuaacugggcuggaacucccuauguagagauccaccugucuuuuccuccccagcgcugggaucacaggaaugugccacuauguccaguaaaucugcucauuaaacaucauugcccaaggccaaguguucacagcuuuagucucagcacucaggaggcugaggugggaggaucucagugaguucaaggccagccuggucuauauagcaauagcaaguuccaggacaucuagaacuauagagagaaacacugucucaaacaacuaaaaacuaaaaaaaauaaaauaaaaaaaaaaucuccauccaagccaugguggcucacaucuguaaucccaccauuuguaaucucuugcugauggugguuggagaaucacugugaauuugagacacacuuguccuguauagcaaguuauaagcuagccugggcuacaaguaugagaccugccucucccccaauccacaaacaauaacaauaauaaaauaacuggguguggugccucuuaggaaguagaggcacaaggaucaggaguucaaagucaguccccaaaaaauagugcaguuaaggcuagccuaggcuuggcuaaaauuuacaagucagaggcuccuggaggucaaagaggugauccuuguuuguuuuuugaaaguuuugcauuuggggguuuugguuguuuugggguuugaugugugcauuuagacagggucucauuguguaguccaaacuggaauuaaauuguugcaccacuaugcccagcuccaacacuuccguaaaacguugaaaggcagacaugcuggugcaugcuuguaaucuaucucaucaugcuggggacagaagaagagggcugcuccggguuugagccugggcugcgaagagaguucaaagccaacuccaguacaaaagugagaccagucucaaaaacacaaaccuugggagcacucuacacgugcuuuagagaugguucacuggagaguggaguucuuaucccuagccaguacugaaauuccgaaguuauuaucaagcuucaguucuaugaacuggacuacauuuugccugcaacccgcuuguuaggaaaacuuucagugcugcuucccugugcccccgagcaugcacagaaguauagggaaaaguuggcuccagacccaaguaggggaaaggucucuuauucuguguaagccgugagcugaaaagauuccaacuggcggggcuggaauuuggcgugccaaggguaaugccugcacccuuucagaagcaaagaacacuaaauuauggaaccucugugugcaagagaaguuuucccagcacuuuacuaauggggagacaugagcagaaggcccgagagcaggccugaaacccaucaguugaccuuguuugagaacuuucuuccuagccuccuugucggucaccagggguucaggcggucgcuugacauccucggcgaagggguucggggaacuugcagcguaaaggcccacguagacccuguggaggaucaccagcagcagcacggccagcagcagagcagugauccacauguugcugccagggcucggaagaccgcguccuuuccccgcugagcucggcuuuuauagcugaggccccgccccucuaguucguccuuggaguaauaccagacuuggaggagccgaagcauuuugacucacgccugcucaaaacugaugaagauug

SEQ ID NO: 3079 - RNA, 2946 nt, Mus musculus
gugcaggaguuacagccagacagccaccccugucaggauagccucaggauguucccuuuucugaucuguagcucgauccucagcugccagcugggacagagaccuggccgguuuuauaacuauuucuauaggauccuggcagagaccugcucuuaagucucguccuggcuaugugagauguagccucagauuccuuccaacucuaccaccucugccccauguccccuuagucauaggugcuggcuuccugcugauucagagcagagcuaacucacagcaccucuggacaaucaggcuguuccaacccuccucuuuauacauuuagauguuucguuaauuauagauguauauggauaaaggucugucuagaugugcaagaagccagaagacaacuaucuucuuccacucuggggauuuagcagcaaagacuuuacacucugaaccaucucaguggccuuuguuuguugaggcagggucuuguguagccaacggugaccuugaauuucuuaucuucccgccaacaccucuugagugcuaggauuacagccaaauccacucuaguugucuuaccuggcucuagguaaacccagggcugaugcaaacacucuaaccaacugaacuucaucccuagcucuugucugccauuuaacugagucuuuucuauuaaagcccugguuucucuggcaaaggaaagcaaauauacaggguuguguuuuucagcccggaaguacaagauagacauuugcaucugacaaaacagaguccucagagcucugccacugccucugugaagggcuccucuuccccuguaguccuagauuccccaaauauaaaugcuauguuccugguagcacagacuagagagagacagcuagcggacugcccaaggagaggggagcccacccagcugggcauguaagcuucacagaugaaauauuaguucaaaagaucagucuuuuaccuggcagauggcggacagucucuggcaacaagugcugauagguauugaacauucccgcauuggagaugacaacugggcaguagauguucaccagcucuugucccuucuucacacugacaccugcaggcacaagaauuuggcugagcuucuaugagcucuguggaaacaaaaaagaccuauaccauucucuagaucccucuuaagggcuaggaauacagcucagguggaaagcgcuugucuaacauguaugaagcccuagguuccgugcaccccauacccaccauaaaacaaacacaacccaggaaagugugaaauacauuucucucaaagcauuagcuguagucgcagcaugaugacauguuccugcaauccuagcauguaggagguagacgccauauaaucaggaauucgaaggucagccucagcuagcuagugaguuugaggauagccugaaacacaugaaauccugccucaaaauauuaguucugucuauagccacacuauccagaugucuccuaggguaggcccuguuuucucagaccuagaaguuccuccagccaaagcaggucccaggcacacugcaaagucacuuagcccuugccucaaaugcuucugugcuugcccucucuagcucuucuuacccacccauauggacuuaccuuagccacgcccugccgucccaagaacacuggcucuauggagucccagccccuccuucccugcugccaaguuccacaucuacaguacuccccagaugacucaaccuucaugaaacaccaaggcuucugugauguacugaagccuguguguccaaccucaucucuggccacucacaaaaccauuaugucagaccugaccuuuuguaagaauuguaguuugauuccuucauugugugugugugugggggggguggggguaggagugcuacagcccauguguggaggucagaggacaacuugccagaguucucuccuuccaccauguaggcuguggggaucaucagguuuagugagugacuagaccauuuauccacugagcuaucucaccggcucagacgccagccucuuaccgugcauaaacaggcuggcuuccaccccagcccacugaccccacagcccaguacagaucucuuaccacacgcucucccagcugaguccagcagcacacucuguacaguggcccuggugaggacagcgcccccggcccgcugaaucaaagggaugguauggaaggcgaucucacuggaacccccucgaggguaauaugccccuuguauguaguggucaaccagcagagcaugcaaggaaaaggcgguguggcugggaguuacuccuacaggaugaaggaaagaagaugagcauaguggucauuuggcaccauucaggaagaaauagggcuuccugugagggaccacaagaguccauccuaggaugagaaugcucccaaaggcccaggguagguaaugagcuuaguggaauauaaaaccauuaugcuuccaagaccaaagaagucacugacacuguuggcuaaagagaaaaaucaaccuugagcaguguacaugccuauaaucucacacucaaaagcuacaccagaaggaucauugauucaaagccauacuaagcuacggagagaucuagaccagccugagcaaagucaaaacuuuuccuggagguguaggggacagggagaaaaugcacuugggugggcucagcuggaugucuuccuaacaugcaugaaagccuggauuugaucuccagcaccacauaccccagacaugguggcacauaccuagcacuaggaagguagaggcagaaggauaaggaauuuaaggacauccucaacuacaagaguucaaagcuugccuggaagaccuugucuucaaaaaggaagagaaaacaaaacagaagaagaagaaaagauacaagagagaagaacaaaagauaacguuccauaaaguaaauaauaaaucauuuuuaccagagucc

SEQ ID NO: 3080 - RNA, 9763 nt, Mus musculus
uaggccaagauaucuucaccugugggcugaugggggcccugcagggggccuugcugugcagcagugccauccugaaacggaacuuguacucagaucugcaggcucuuggcucaaaggucaaggcacaaaagaagaagauguaguccguucagagaagagccagaggaaaggcaccuccccaacuucucgugguguccucccuccuacagcaauuccuugcacauauaaacaaaaaccauuuuguuucugauuaguguuguuaagucaagaguucuuuaccuugcauucuacuuaaggccuagugugaacuacauagccuugaugccucaugaagaaugcucccaugccuuuccuacacccaacuccaagcuauggucaggcacccagaaccccugggguguuggcuacuggaauagguugguucaguccuacccugaagcuuuuuguuccuccucacucucguguugugaugcucuauacauggaaaagugugggcuuggaguagcaacucucucaaagugccagaccuaagaaaacccucaggucuaaguuuuauccugauagaaguggguuaaaggaacacaccaaaagauaccacugccgaugaaccaagccuagacacggcauuuguaguugcuggcacauagucaaacugaguuacgaggcugggcagugcuggcaccggccuuuaaccccagcacucagaaggcaggggcagacagagcucugugaaucugaagccagaacuaguuuaugaagcaaguccagggcagccagagcucuguuauacagagaaacccugucuugaaaaacaaaacaaaacaaaacaaaaccugaguauuguuuucuaaaaugcuuggagucagaauucuuucagauuuuguaguauuugcauacacaugagauaaccuggggaaugggucccagaacuaaaccacaaauucauuuguuucauauguauagaccaggcacaacaucuuauguaauacuuugaaaaacugagcauucugaccugucacaugaguccaugcuauaauuuaaaaagcuugcuuugauuucagaauagggaugcuuuaccuauaugaguaaaugagaagguggauaaaaauuaaaaaccuuucacuuauguuaaacaagugcuaauuuuagucuguuuaaauauaguauuaauacauguaauguuucaaugcuuugauaucugaaauuuauugauuucuguucaauaaugacaugaaacuaugcuaugauuccauuuacagaagcucaguaaaauauacugaaaaauacuuacuauaccacaguaagcuuuaaaaaaaauaaaauuaagccauuacaguuaaguuacaaaaaaggugacaauaccaaacauggcuaacaguagcaaucuaacugggaacacaagacaaggaaaaaaauuucaacauucacucacuuaacaugguagucugaauuaaauuccuaacagugugaggaggccagcuucauggguaguuugcuaugcuaugcaagcugagauccaaacucacaguuucuaagcuaaaauacuuaguaucacaucugagcagggaacaaaacaaacugagccaucuugauguauuuaaauuucaacaucucuuuacagcuuucugcuuuuuuuuuuuuuuuuuuuuuugagacaagcuaucauuguguaacuuuggcugccuaaacuugguauucuagacuaggcuggccucauacucagagauccuucugccucugacucuugagugcuaggauuaaaggcaugcaucaccacgccugacucuuuacagcuuucuuaaggcaaugccaaacagaacccuccuaguaagcaguuuugagaaacuaugguacagggccuggcacacccuucucugcuuucgaacggcucaugauaugugcaaagcauaccaugccccgaagaaaagagaaagugcaucccuaccagaggaacucugaagggcacagagcucuguuucuaggggaaacauguuagcacauuuuguuaguuguuguccagagcuggcuucuuuaguccacagcaggaaaacaaacuauuaacaguuauaccucaagcagcuuccccuuaagaaauugcccuuuagccaaacacugaggagagcaagcucagaaaaguccacaagagugcuacuugagacuucauaugcuucuuacaugccaacccaaucccugguauagacaccucagcuggaccauugccacacacucuagcaaauaugcuucaaguauucuaccuucaaaaaacaaaacaaaacaaaacuccuaaaaagaacuuuucuuuggugggaaccauuuccuucagugcaacuucucaagugaacacaaauucuacuguacucugucagcacaaggaacaugucagcagccaaaagagggugaggagacucuggcaauccuucacaugucuguccacucacugucaaucuuuguugcuaaaaaucaauuuuccuuccgguccuucaagagcaaaagccaacaaguauaaggucauagcaaacaguauccaggaagagcuaugugagccccaguuucagcuacaccuccaacaagaaauuugaccccuaaggucucuggcugauagaacaaugacaauggcugucucucagagcuuaguuuucuuggggggagaucacagaacaucagaacuaugucacacugaaguuccaagaugagagugacaguaagcuaucaguguggaauggaaggaccacuaugcauauuccaagcacaagggccugagaaggcuggaagaaggggacagccuaaccauagagcaaccccgaaaagcugugauacaaagacacgaggagggcagaggcagagacggagugagugucgcagugcagccaaggaggaaucuguagucuagauuauaaccucagacagaagcuucagaccggggcacauucuggaaugaucaauguuuccaaaacugguaaggucaauucagcugguuccuaaaaauuagcggagaguauaccuagauaauuucuuuaaaaaaaaaaaaguggacuucugugaugauaaaaauguuuuuaguuuauaguguggaguuuucagaugauuagagaaagugaaggauagauagagaaacguaauagauacaagagagaaacucugguugugugacaagcagacaacguggcugaguuauuuagcagaacuggguucuugggaaggaggccaaaaaaaacaugagcgucacagagaggauaaagaauggauggauuuauugagacagucaaagcaacagagaccuggguacccuccuccauccccaugagauaaggcaaaggauaauuugcaagagacaaccagaaugucaacaugcauaggccccggcauccaacauuauuaccaaggguuacaagcugugaaaaugagcugcugaauuuggugaucuguuaacugaguaaaccuugagaaacaggaggaaaucagaccaaggcaacccugcaaaugucaggaagaggauggaaggcaauagaagcaacaccaacuagaacaggauagguaugggcgugcauacaggcuauaaggaagguguucauucagagauguacaaacaggucuauagagaggaagaaaaaauggaaguggggaacuaaagagguguuaggaaaagcuaaaggagacugaaaaaggcuuggaaaaaaguaacagacuuguggacagcugagacaauaguagccauggccuuauuucuagaaugccaccugccaagaauacauacuucaauuucaagcccaugcugcagucagcacuggaaaagaccuccaagaccauugcuuccuuagacugauuuccccaacagcacaggacucauacuuuucuucuucucguucucucugcaucccugagauuagcugagacuuuucucucuuuaggcguaaccauacagacuggaauaaaacgcuagacacagcauaauccaagacaucuucaguuaucucagggaaccuauuuaguuuccuacaguuucaugaccagauaugacaggauaggaaagauuuuccuuauucccugcacaucuuaaacagcaaggaggagugugaagaaugcaguuaguuucuaaauaucuaucuacugcgggcaauaaaagcaaaacucaauuuguagaaaaccucuuuccugcauacuaaaucccuccuauguguuuucuuccacaaagcaugaaccugucccuuuccaggaaguuccuauuggggugaauguaugcaagaacacacuuguucaaugaucauuuuuuuaaaaaaucccaucaaacagugauuuuacuuucagaagccucgagucccuuuuaugcuaguacaacuagcaugcaaacuuucagagaaauauacagacuaucagauggaccagacuuuaacacucuuuaaccugcuaguuugguuugcagcugagccuucuguagagaauaaguauucaaccccaucucugcccaucaguaucccacauaaccaucuacaucuugucuagaaagcaccucucuacaguuugcgccuagaguugcaaagauaaagaggcuguggaaaggugguccauuguguggccugccuaagguggggucuuccuuuggucacauccauuuuuccaugugcuucuuccguuugcacuccaaggaagaaaggaugauggaacacgucagcauacaaggaacacaaaaguaaauaaaacaucaccagaggagagugucaucaaagugccggugcaaaaccugaagcuaucccaucucugccagcccagacuugccaccaaaccccagaggaggucacagucuuuucauuucucuucauugggaacaaaucagcagggaggacacgguucuugcagacaaaguaaagaucaaagcugaaacgagaacaacacacucgguugauaacacucaucuuuuucagggagauaugucaguaagacaaagucauccaccgccauuaauaaaagugcaggagucacaauagugaguuuuaaagucaauuagaaauaagauauggugagauggcucaguggguaagagcacccgacugcucuuccgaagguccggaguucaagucccagcaaccacaugguggcucacaaccaucuguaacaagaucugacgcccucuucuggagugucugaggacagcuacaguguacuuacauaaaaugaauaaauaaaucuuuuaaaaaaaaaaaaaaaaaaaaaaaaaagaaaagaaauaagauauggaccugaaaguuguacauuuagcuaauaugguggcucaugaucuguaaucccagcacucaggcugaggcagaaagaucaugaauuuuaggccagcaaagauuacaucaugagucuuaggcuauagugagagauuaucucaaaauuaauuaacuaauuaaaugcugacaggagaguaagagguauucucuucagcaggguagccacugcuaagguguccaugcuccugggaacaaucccacugaaacucacugggugacuuuuaagaaaaguaggcuggggcuggugagauggcuuaguggguaagagcgcccgacugcucuuccgaagguccggaguucaaaucccagcaaccacaugguggcucacaaccauccguaaugagaucugacagccucuucuggugugucugaagacagcuacaguguacuuacauauaauaauaaauaaauaaaucuuuaaaaaaaaaaaaaaaaaaaagaaaaguaggcuggagauagcuaagcaccuaagaacacuugcugcucuugcaaaggaguggaguuuguuucccagcaccuacauaguggcucacaacuguccuuaaccuuaguucuagggaucuaacuaccucuucuggccucuacuggcacgaggcacauauaugguacaccacauuugauggugagcagacagaauuacuggcuucuacuuuauacucucuuauauuauucugaauaauuuucaugcguauugcuuucuuccuacuaaaacaaaauuaaggaggaaaaaauguuaaagucaauuaugaaggaaaguagcagagcuagagcuaacugugaggcugaccuauuuuugacacguguucugagcugaguggguuacucuauacugcugugaacucuuccauguaggaaccauucccaucucagucaucaacuguucuuugucacuguccuucuuguugcuuaacagaacagagcaggugccuguuguagccaccuacuaugacuauacaguugucuguggggagaaccuucuucagcuccugcuacuguuggaggggaaaaggcuccucuccuggcagaggcagacuggccacaaucaggaggaccagcccacagugaguuugcuugaggccuaugugcuucugugcucauaugcuuugagggaguugugagcuagggcuuugcugcccaaaguguggccgagcagccuuuggugaucccgccaaaaugaggauggauagguucuaugccauacucagugaaucagacuuggcuuuuaucacaauauucaguguuuaucacaguauuugugugaccagagcucaaauagugaacaaaguguuuaaaaguguacagaguuacuaucaggugcuaguguugucucugaaugaaaacuuaggaagaaaacagauagaaaucacauuuccacgcagaucuguuuaccugucaaaugugaaaauacugaaagaccucuuuaucucuaccuuuguagauacauauguaggguauggaugguccuauuugccaucaagggcuagggacaauggcugcagcaugcccagaauuggcccaacugaggcugcauaucccuccuagaccuggcuucuccuuccuuaccuuuagguucaaacguugguagucacuggccuuuggccuccgagugacuuuggaucuuuucccuuccagagcaaaagcaauaaucugagggaaggacaaagaaaacagaauaacauuugacucuguaaugcuguacuucauucaguuccugaaaucagaagcacuuaccuagauccacagagaggccuauuuaaaucacacacacacacacacacacacacacaccccacacacacuuucuuuccagugcuggagugcaaucguggcauuguggauacuaggcgaaugcugugccaagcaugugauaugugauauagcacuauaguagaacaacugucuagcaugcaggucaccuguguucaaccuccaacaccacaaaaguaauaaauuguaaagauuuuaaaaggguuugguuauaacaaaauccuuuauacuacuuaauagggaccaagagagcagggugguggugaugccuuuaauccuagcacucgggaggcagagggaggcggauuucugaguucgaggccagccuggucuacagagugaguuccagggcagccagggcuauacagaaaaacccugucuugaaaaaaaaaaaaaaaaaggaccacgagauggaggcugaggcccguggaaaucuuuauggcuuaacuguggggcuagaguuaaaggucuaccaguucuuuugccagaguucuagguuuaagcaggguggggauaauuacugauuguuuccuauccacaaacacuugcuuugugcccacacauuguuucaacaacuuuucucuaauuuacugcucucaacauggacauuuagauguaaaugaagaauguacacucuccauucuuuaugcccaaaggcuaucacaaauugaacucuucaauaagucaaguuacugaaauugucuucuaaaucucauggcucaguaggaaauacaauaauuuugucauauagaguuguuucuaaaguuguuucauggguaacacuuuaaccccaaagauguguacauuugugcaauuucaacucuuguugguuggcuuucuacuuuugguguuaguaacuauguaacugaaaacauucuuccugccuccagauggaagaugguugguauagaagcuagaaaugguaaacuaucuuaagccuggaaaagggggaagaggucuacauaucaagaggcugggaaugaucugaguuccaaguuaggggaggggaauuacaguuaggucaggucaugacucacguccaacuuggcacuuuacagcagaacugagaggaaacaagucacaugaugaaaacaccugauuuacaaaacuuaguuuuauaagccccagcagggucuauggaaaaaacaagaugaucuuaaaauucucaaagcucacaggcagaugagugacagauagcuguccaugaacaaagaacuuaggguccuggaaaucccaguccccucuuaccuuucguuuguugugguaagcaauauagaggacagcaacaagaacagcagcggucacuagauaugcaaagaaguggcugcucucugcacugguguuuccagaacuguccuuauaaagaucauccuucucauucuucauagagucuguaaguguccccucuugguucucacuggaggaagggcccggcaccuuuucauucucuucuucaaguggugagccuucuuccggcucugugucacccucuucaaucuccuugguuuccacgucuucaguaggcucugaagacuuaucuccuuucucuggcuuuaaagagaagucagaguccccugccaguguuuccccagauucaguuuuggaaguaaguguugguuuuuguccuuuuucaguuggcuggacuuugucagucuucgaagucuccguaucuggggagauuuuggaggugggcuuguccaaaucaacuuucguggacuugccagaaucaucuucuguggccuuauucgaaccagcuucugugggcuugccagaaucaccuccugugggcuugccagaauuaccuccugugggcuugccugaaucuucuguggagcucugaucagacuuuuccaguuugggguugacuggugagaggggccgcgcaguuucguucaacucggcauccguuuucucgggcugccuucuggaaucacccaaacugugaucggucgcggcgguccgcggcccagauuccgccuuacuggaaacugcugccaaagucgucuuguccuggucuuuuuuaucugacuucugccccugaccgucggucggccuuguagucuuuaccugguuagaagaaggcaggggaguggaggacuguuuggaaggcugauucggaggauucugagagucaccugagucggcgucucucuuauaaacggacggcagagcuccugaaacaaacagaaaaaacaaaaaacaaaaaacaguaaguccucggaagaagagaagcgggcuugacuucugagagccuagcggggauggccgaaugggaaagcggagauggcuagagcagggucgggccagacaagaaagacgccggcucccguagcgacccaccaaggugaggaauggggaaccuaaaggggagagugagcugggcugggguggggguccuuacucgccaccgcgacacucagcaggagcaacgcaaccuggaaccgcauccugcagucugcgcuuccgcccucugaugacgugagagcggcgcacgagauuuucccgagcguggccccucccuuuccggcggacuguuucucuuccggcgcagccccgccuuagggguggggcuaccgggcgacagcagccguugucuguguguuccgguagagugccggaagucaaguccagcucuuuauucccccccaagucccuucuguuucucagcagucugcggggcucggcgaucucguucuuguucacuuggccucguuuuucggaagcug

SEQ ID NO: 3081 - RNA, 6357 nt, Mus musculus
ugauagaacaaugacaauggcugucucucagagcuuaguuuucuuggggggagaucacagaacaucagaacuaugucacacugaaguuccaagaugagagugacaguaagcuaucaguguggaauggaaggaccacuaugcauauuccaagcacaagggccugagaaggcuggaagaaggggacagccuaaccauagagcaaccccgaaaagcugugauacaaagacacgaggagggcagaggcagagacggagugagugucgcagugcagccaaggaggaaucuguagucuagauuauaaccucagacagaagcuucagaccggggcacauucuggaaugaucaauguuuccaaaacugguaaggucaauucagcugguuccuaaaaauuagcggagaguauaccuagauaauuucuuuaaaaaaaaaaaaguggacuucugugaugauaaaaauguuuuuaguuuauaguguggaguuuucagaugauuagagaaagugaaggauagauagagaaacguaauagauacaagagagaaacucugguugugugacaagcagacaacguggcugaguuauuuagcagaacuggguucuugggaaggaggccaaaaaaaacaugagcgucacagagaggauaaagaauggauggauuuauugagacagucaaagcaacagagaccuggguacccuccuccauccccaugagauaaggcaaaggauaauuugcaagagacaaccagaaugucaacaugcauaggccccggcauccaacauuauuaccaaggguuacaagcugugaaaaugagcugcugaauuuggugaucuguuaacugaguaaaccuugagaaacaggaggaaaucagaccaaggcaacccugcaaaugucaggaagaggauggaaggcaauagaagcaacaccaacuagaacaggauagguaugggcgugcauacaggcuauaaggaagguguucauucagagauguacaaacaggucuauagagaggaagaaaaaauggaaguggggaacuaaagagguguuaggaaaagcuaaaggagacugaaaaaggcuuggaaaaaaguaacagacuuguggacagcugagacaauaguagccauggccuuauuucuagaaugccaccugccaagaauacauacuucaauuucaagcccaugcugcagucagcacuggaaaagaccuccaagaccauugcuuccuuagacugauuuccccaacagcacaggacucauacuuuucuucuucucguucucucugcaucccugagauuagcugagacuuuucucucuuuaggcguaaccauacagacuggaauaaaacgcuagacacagcauaauccaagacaucuucaguuaucucagggaaccuauuuaguuuccuacaguuucaugaccagauaugacaggauaggaaagauuuuccuuauucccugcacaucuuaaacagcaaggaggagugugaagaaugcaguuaguuucuaaauaucuaucuacugcgggcaauaaaagcaaaacucaauuuguagaaaaccucuuuccugcauacuaaaucccuccuauguguuuucuuccacaaagcaugaaccugucccuuuccaggaaguuccuauuggggugaauguaugcaagaacacacuuguucaaugaucauuuuuuuaaaaaaucccaucaaacagugauuuuacuuucagaagccucgagucccuuuuaugcuaguacaacuagcaugcaaacuuucagagaaauauacagacuaucagauggaccagacuuuaacacucuuuaaccugcuaguuugguuugcagcugagccuucuguagagaauaaguauucaaccccaucucugcccaucaguaucccacauaaccaucuacaucuugucuagaaagcaccucucuacaguuugcgccuagaguugcaaagauaaagaggcuguggaaaggugguccauuguguggccugccuaagguggggucuuccuuuggucacauccauuuuuccaugugcuucuuccguuugcacuccaaggaagaaaggaugauggaacacgucagcauacaaggaacacaaaaguaaauaaaacaucaccagaggagagugucaucaaagugccggugcaaaaccugaagcuaucccaucucugccagcccagacuugccaccaaaccccagaggaggucacagucuuuucauuucucuucauugggaacaaaucagcagggaggacacgguucuugcagacaaaguaaagaucaaagcugaaacgagaacaacacacucgguugauaacacucaucuuuuucagggagauaugucaguaagacaaagucauccaccgccauuaauaaaagugcaggagucacaauagugaguuuuaaagucaauuagaaauaagauauggugagauggcucaguggguaagagcacccgacugcucuuccgaagguccggaguucaagucccagcaaccacaugguggcucacaaccaucuguaacaagaucugacgcccucuucuggagugucugaggacagcuacaguguacuuacauaaaaugaauaaauaaaucuuuuaaaaaaaaaaaaaaaaaaaaaaaaaagaaaagaaauaagauauggaccugaaaguuguacauuuagcuaauaugguggcucaugaucuguaaucccagcacucaggcugaggcagaaagaucaugaauuuuaggccagcaaagauuacaucaugagucuuaggcuauagugagagauuaucucaaaauuaauuaacuaauuaaaugcugacaggagaguaagagguauucucuucagcaggguagccacugcuaagguguccaugcuccugggaacaaucccacugaaacucacugggugacuuuuaagaaaaguaggcuggggcuggugagauggcuuaguggguaagagcgcccgacugcucuuccgaagguccggaguucaaaucccagcaaccacaugguggcucacaaccauccguaaugagaucugacagccucuucuggugugucugaagacagcuacaguguacuuacauauaauaauaaauaaauaaaucuuuaaaaaaaaaaaaaaaaaaaagaaaaguaggcuggagauagcuaagcaccuaagaacacuugcugcucuugcaaaggaguggaguuuguuucccagcaccuacauaguggcucacaacuguccuuaaccuuaguucuagggaucuaacuaccucuucuggccucuacuggcacgaggcacauauaugguacaccacauuugauggugagcagacagaauuacuggcuucuacuuuauacucucuuauauuauucugaauaauuuucaugcguauugcuuucuuccuacuaaaacaaaauuaaggaggaaaaaauguuaaagucaauuaugaaggaaaguagcagagcuagagcuaacugugaggcugaccuauuuuugacacguguucugagcugaguggguuacucuauacugcugugaacucuuccauguaggaaccauucccaucucagucaucaacuguucuuugucacuguccuucuuguugcuuaacagaacagagcaggugccuguuguagccaccuacuaugacuauacaguugucuguggggagaaccuucuucagcuccugcuacuguuggaggggaaaaggcuccucuccuggcagaggcagacuggccacaaucaggaggaccagcccacagugaguuugcuugaggccuaugugcuucugugcucauaugcuuugagggaguugugagcuagggcuuugcugcccaaaguguggccgagcagccuuuggugaucccgccaaaaugaggauggauagguucuaugccauacucagugaaucagacuuggcuuuuaucacaauauucaguguuuaucacaguauuugugugaccagagcucaaauagugaacaaaguguuuaaaaguguacagaguuacuaucaggugcuaguguugucucugaaugaaaacuuaggaagaaaacagauagaaaucacauuuccacgcagaucuguuuaccugucaaaugugaaaauacugaaagaccucuuuaucucuaccuuuguagauacauauguaggguauggaugguccuauuugccaucaagggcuagggacaauggcugcagcaugcccagaauuggcccaacugaggcugcauaucccuccuagaccuggcuucuccuuccuuaccuuuagguucaaacguugguagucacuggccuuuggccuccgagugacuuuggaucuuuucccuuccagagcaaaagcaauaaucugagggaaggacaaagaaaacagaauaacauuugacucuguaaugcuguacuucauucaguuccugaaaucagaagcacuuaccuagauccacagagaggccuauuuaaaucacacacacacacacacacacacacacaccccacacacacuuucuuuccagugcuggagugcaaucguggcauuguggauacuaggcgaaugcugugccaagcaugugauaugugauauagcacuauaguagaacaacugucuagcaugcaggucaccuguguucaaccuccaacaccacaaaaguaauaaauuguaaagauuuuaaaaggguuugguuauaacaaaauccuuuauacuacuuaauagggaccaagagagcagggugguggugaugccuuuaauccuagcacucgggaggcagagggaggcggauuucugaguucgaggccagccuggucuacagagugaguuccagggcagccagggcuauacagaaaaacccugucuugaaaaaaaaaaaaaaaaaggaccacgagauggaggcugaggcccguggaaaucuuuauggcuuaacuguggggcuagaguuaaaggucuaccaguucuuuugccagaguucuagguuuaagcaggguggggauaauuacugauuguuuccuauccacaaacacuugcuuugugcccacacauuguuucaacaacuuuucucuaauuuacugcucucaacauggacauuuagauguaaaugaagaauguacacucuccauucuuuaugcccaaaggcuaucacaaauugaacucuucaauaagucaaguuacugaaauugucuucuaaaucucauggcucaguaggaaauacaauaauuuugucauauagaguuguuucuaaaguuguuucauggguaacacuuuaaccccaaagauguguacauuugugcaauuucaacucuuguugguuggcuuucuacuuuugguguuaguaacuauguaacugaaaacauucuuccugccuccagauggaagaugguugguauagaagcuagaaaugguaaacuaucuuaagccuggaaaagggggaagaggucuacauaucaagaggcugggaaugaucugaguuccaaguuaggggaggggaauuacaguuaggucaggucaugacucacguccaacuuggcacuuuacagcagaacugagaggaaacaagucacaugaugaaaacaccugauuuacaaaacuuaguuuuauaagccccagcagggucuauggaaaaaacaagaugaucuuaaaauucucaaagcucacaggcagaugagugacagauagcuguccaugaacaaagaacuuaggguccuggaaaucccaguccccucuuaccuuucguuuguugugguaagcaauauagaggacagcaacaagaacagcagcggucacuagauaugcaaagaaguggcugcucucugcacugguguuuccagaacuguccuuauaaagaucauccuucucauucuucauagagucuguaaguguccccucuugguucucacuggaggaagggcccggcaccuuuucauucucuucuucaaguggugagccuucuuccggcucugugucacccucuucaaucuccuugguuuccacgucuucaguaggcucugaagacuuaucuccuuucucuggcuuuaaagagaagucagaguccccugccaguguuuccccagauucaguuuuggaaguaaguguugguuuuuguccuuuuucaguuggcuggacuuugucagucuucgaagucuccguaucuggggagauuuuggaggugggcuuguccaaaucaacuuucguggacuugccagaaucaucuucuguggccuuauucgaaccagcuucugugggcuugccagaaucaccuccugugggcuugccagaauuaccuccugugggcuugccugaaucuucuguggagcucugaucagacuuuuccaguuugggguugacuggugagaggggccgcgcaguuucguucaacucggcauccguuuucucgg

SEQ ID NO: 3082 - RNA, 8432 nt, Mus musculus
uguggcaaagcugauacuuucuucuauuuaccugggucgggugacagaagaauggagggaccccuggcuuagcugcuccggggcagguggcagagucggaggguggcagggugcugcuguggagucucaguccuccgggauccccuaccagccccacaguugaccagcucuggcagacaccacccacagugugucugaaggaacgaccucuacuggaccugcucccuccccauggacuuugggauguuucaaagaaacugaugucacugcaaacauuuucaguguccauucuccccgggagcccugcccuucucuaucagcuaaggggucauggaugauugacaaaacucauauucugaauagcguuguuaguugucuacugaaauguugggugauuuccugggcagccauugucaaguccaggacuccaucgugauugacagcagaagggaagggucuacucuccugagcgaucaaucccaugcagcugguuucugaucagguuaagggagagauggcucugcaguuaagaggcuggcugcucuucugaguugaauucacagcagccacaagguggcucacaaccaugcauaauggaaucugauucccucuucuggugugcaugaacaccugagcaauccuauacaugaaauaagcaaauaaauaaaucuauaaaagaagaaggacaacaagagggagggggacuccucugguggacaguuuuccauggcgagcccuuagggguugguuuuacuuugggcuuaaaauaugcccuggggaccccuuugcuuucuuaagagcugugaguuugaagagcuucaaaagggaaaagacugaagcaggcugugguggucaucgagcagacuaaguuacacagccugccucagcaaggugaagcugcgggccaaaggagauggcucagcagauaaaguguggggaccagaaggaacugggaugcucagaacacauaaaacccaggcagcuguggcagccucgcauggauuuagcagauuauaaagacagggcaaggaguugagccaagaucaacaagcucuggguucagcaagagaccucaguaagucaaaaggagaucaaggagacccuccucaggucuccaucuguguacacacauacacacaaaacuuuaaaauggaucagggagaggaguugucaagauaccugggcugagaaggugcucgaccuauguagcuugcuggaaggauuuggcuguuucggauggggcauugcuggaaggacuuggcucuguuucggauggcauuccuugcugagcaagcccguguggcuccuacgucuuguacugagguuguccacuugaggcucugcauuccugacgguagccucagccuuugccgugcucaucaagcuccuggggacagcuggagagagaagugggugaggacagagugggagguagccuccuaagaggacaggccagccucuaggacaacucuugcucagcaacacuuccuguccagccccucgcggaccauuuucuggacaaugaugcccccuagugguacaaaauuauaacccgcaggucauuuagauuuauaccuagauuugcaaauugaacucccuuuauguguucuuugacugaaggguaagcaggcaacugaaacuuuuuaguuuauuuauggaaggggguugguccaggcuggcuuuuaacuuacuauguaacaaagagugaccuuugaccucugaucuuuuuacuuccugagugcaagugucugcguuaccgguuuaugcuaccacacccaguuuacacagagcuggagaucaaacguggggcuucaaggaugcuaaacaacugugcuacauauuccagccuaagaguucucacuauaaaaugacaaaaaugauacaaauaaauauaaauuaaaaacugaagcgugaaggcuggaguggaugaucauggguucgaaacuagccuggacuauauaaugcgauguugucaaagauaaauaaaugacauggggcguuguuggcaggggcuggcuuagcugugugauuauguagcaaucaguuuuagaaucauuguuuaugaauuguaucaugguuugugcaauucucucuauuuuuauucauuauauuucuuuguguguaugugggugggcauccuuuagccaugguguucuuguggaggucagaggaucuacccugagggaucuagaaagagauggcagguuaucaggcauccaccuugacccacugaacauucucuguaauucaauagcccuauuacguuuauagugccgaaaauuacccuuugacaggcuggccccuauaaacccagguucaucauuuggauacacucacuugguuccuagaaaucugaugucagagcuaguuauugcacauguucuuucuugugcuguauauucaucauugugauggccaggaaauacagugaaagcagccagguguaggugacacacgccuucagucccagcacuugggagacagaggcaggcgaaucuccgaguuugagaaccuacagagugaguuccaggacagcaaggacuacacagagaaacccugucucuagaaaacuaaaaaaaaaaaaaaaaaauucuccaaaaaagugaaugggcugguggguaagaucacugacugcucuuccaaagguccugaguucaaaucccagcaaccacaugguggcucacaaccacccguaaugagaucugacgcccucuucuguugcgucugaagucagcuacaguguacuuugggcccaagcaagcagggacugagcgagcagggccaacccgagcgaacgggguugaccagagugagcagagguccugaaaauucaauucccagcaaccaaaugaaggcucacaaccaucuguacagcuacaguguacucacauacauaaaauaaauaaaucuuugaaaaugugaaggcaguauuuaaguuucaccuuaugcugcuacagcuaacaaguacagaggacuaacuaggaagcuacucgguuugaggccuuuuugcaccaccaaggccagcagcacaccucaugaucaggaugggcuuuccugcucucaucccugcucugcccacuuuaccugcuauaagacuuggaaacccaggaagccccaggaacugagcagaccagaguuugugguaugcauaucggaugaaaagaggggcagcaggaagugacagagaggucaaagggcuucucgucaguaaagucagaacgugguuacauaaacccgagagcuccugucagaacggcacagcccacaagcgccccgcuguacccauaaaggggggcugugugggaguuagagaccggggugggaguucgaggcccucucucauccucuucucguuuccuucccucuaggccaguugugagggcuggaaaggguguuacacugaaaggagccaccggugaguggcagcuggcuggacacaccgucuuccugccacugugccuaguccaucuccucucucucuugcaguccaacaaaguuccuguuguucagcacccucaucacaugcacccgcugacaccucucaucaccuacagcaacgaccacuucuccccugcguccccucccacgcaucuguccccagagaucgacccaaagacaggugaguggccccugugacaagcugggcucccaaagagcggugguggggcucuauggggucggggguuaaguauagagccuggaaccauuguaaaugcaaggguuguuuagucaucugagguugggccucuauaaccagaacgugugcccacuacaccacauauuuccaauagagccuucuggacagacgucaaaauggcuuuuaaaacaaugggggcggagcuggcuuuaauguguggaaggugauaauuaacugcccaccacaccuguccguaccuggaagccuaggucuucauaacguuccuacugagucacuguaacacuaagaauuuucagagcccauguuuaaagaaauaaugauuauuuggggguagggcgagaugaccgucgaauaaaaacccagaguuuagaggcagggugguuuguuggcagagaaagguuauuguacugagaaugaggcugguugucuagaaagcucaauaagugaggacuuggaguaauauuugcucucuguuggguauuuccugggccuuguaugaaucccugugcagucaacaaaagaaaguuacauccgcagagauggcuucuggguaacuagagagacuguaucuggguccucucucccuuggaugcccuugaguugacugcccagggcuacuagaaggugaaaggggcagagaugcugagagacaagggcuuuccacggcagcuccuaugggauguuacgcagguuacgaaggcugggugagggaagcauuugacguaucucucuuuggaagcaggaaucccccggcccccucauccaucugagcugucaccguauuacccacugucuccaggagcugucggacaaaucccccauccccucggcuggcucgucccacaguaaggaaaccccaaagccuuucuuacccuccuuccucccuccacugagcucugcccuucuggacucgggauuuagacauccucacucccgccuuggacagcuugcucccaacuccucugucuucccgcccguuucuuagcauccucuccagcccccuccgacuuggcugaccagaucaucuuccucccuccuccccccucacaggcaagggcagcccauguacucucucccuccgggugguuuccggcauccuuacccugcccucgccaugaacgcuucaauguccaggugaguccucaggccggggcugccaacaugaugucacaguccagggauauuagugacugccacuucuggccauaagcuaaccagucaccuauagguuaggcaggauggugggguuccuugauccuuuuuuguuuguuuugggggggguuguuguuguuguuuguuuguuuguuuugguuuuucgagacaggguuucucuguauagcccuggcuguccuggaacucacucuguagaccaggcuggccucgaacucagaaauccaucugccucugcuuccugugcugggauuaaaggcgugcgucaccacugcacgguuuccuugauccuuacuucucuuugaugaggggcuagcucuuacucauacuccuuacaccacaaccccauggaaugggcaccccaggaccuacuaugcacacacacacacacacacacgcucgcgcgcagcuaaacccuccuuccacaucccuacuuaccagacucuauggaacagagucauuuuaaacaugacacacugaagccagagacuaggaggaaauguguaucuuccaugguaaugccaggaaaggaaacaguguauagggauuucucacagggguggcucuaccugacagugggagcaccaguggcaggcggccuauaguccugcaguccuucuaaguuuuucauucugccugcauccagcaccaaggcuguguguguuuaggggaagggacagugucauugggcggcccccaaaacugaccgccuaauucugcaggugaccacccucucggugggcggcacacagcccuugccucuccguucucacuugugucuccuuguuacacagccuggucucaagccgguucccacacaugguggcuccugcccauccuggucugcccaccucaggaaucccccacccugccaucgucucccccauugugaagcaggagccagcagcccccagccugagcccugcagugagugcguaagugagaucccucuggggggaggggugugauccacucucugcucagccugugcccuguggucuucucuccugcuggcagcuggcaguccaagcccuggcuucucccgugcacgcuguucucuuugauuugccauggcccuuccuuuaagaccuaaugcuucuguccucagacagguucuuguggcugugaggagcuaagaaagcuuuuggcuucccucccuacccugucguccccaauaaaauguaaggccaggaugggagaaaggaauucucucaaggacuggugacagcuggugccagagagacccuggcauuaucccugugcuggaaagauagcagaaacacccacaccaccagaccuauggcugagggaggccacgcucugccucccuucuccucucuuguccucccuuccccuuccucccuccauccccucccaccgcccccccccccaccucugcccagaucaugaaagcagucacacauggccaccaaacaagccucuccucccagugaaggcaggcaggagggaagucugaagauggugauaccuaaccuucagcccugugccuccccaggaaauccccaguuacggugaagaaggaagaggagaagaaaccucacgugaaaaagccccugaaugccuucauguuguauaugaaggagaugagggccaaggugguggccgaguguacccugaaggaaagugcagccauuaaccaaauccugggaagaaagguaaugccugcugcuguuaacucguccuggcagaggggccucagggucuccgccuacccugauggcucugugugucuucacccucucucccucaguggcacaaccugucaagagaagaacaggccaaauacuaugagcuugcccggaaagaacggcagcuucacgcgcagcucuacccaaccuggucagcccgggacaacuauguaaguguucaugcugugcgugcgugcgugcgugcaggaacucagaccuugggagcagcaucuucaggaugcagaggcgagagagcaagcuacuucggcuugauucuagaggagaagccauguuuccuggaaauaaggaagccaaguuggaaguuuuaggggcugugucuagaauuucugugagacuuguuggauuguucuauguaugcuuuuauucucucuuccuuuucuuuccuuuuuucuuuuucucuccuuuuuuuaaucuggugagggggcucauaguagcugcaucaaauuuucagagaggccugggacugcucagaaaaggucaguaagcaggccagggugauagcucaguaggugaacugccugccugccaacaggucaaguguuaaucuuuaacaccuacaugcaaaacugggccauggugcuguguaccuagacucagcccugaacagaacaaaucuugggguucacuagccagccagccagccuagccuguuuggcaaguuccaggccagugaagagaccuugucuccaaaaaagguggacagugccugaggaaugacauccagggcaauccucugguccccgugugcauugcauguacucgaaugcuuguacacacacacacacacacacacacacacacacacacacauucaugagcacacacacacaugugugaggaggagggacagaagcuuuuaaaaccacucuuguagggaguaaagggugcaagagacagacuagcucgaagguccucgggaccaagaggcuugguugcccccaccagagggacuuuaugagaaaugagggcagggucgcuuuuccucgucucccaggccaguucuccagcaccuuacccaggaacgaucaggagaagggcugccaucucuguucuaggguagucuggggucuucuugccgggcuaguauuauucuguccuuacucaucaguccuguggccauguuuuucaggggaagaagaagaagaggaagagagaaaagcagcugucacagacacagucucagcagcaaauccaagaggcagagggugaguccuggguugguuggugccccucgcuuccccucccacugucccggacacucuugcuuauguuaccugagucucugaagacucuguguuccugagcaacuucagcaggacggcagcacuuccuuucagagaagaccaaguaagagaccgagaacacagccgcucaauccuggguuuggccccagcacccucccucacauaaagcuuuggaagguuugcaggguuuccuagucccucucuuuaagauagcaaguguuuuaaaggggguucgggaacaaucuucaaagcucagacuugucucagugcagcugaauugucccuuuagagucacgccuaaagucgauaccuaagguaaaaacaggagcuagcuggaauuaucucugaaguucccuuccaaaggcggcaugcuagagauagacauaucacccggauuaguuacuuucucguugccuugacaaaacaccugacaaaaggugacuuaagggagcauuuguuuugucucgaagcuuggaggacaccguccauuauggugggaaggcaugacagcugaucgcgguguguucuuggccagcagacagagagaugaauguugguccuuaccugcuuucuccuuuccauuuagccuagggccuccgucuauauucaggcuggauccuccuugcucug

SEQ ID NO: 3083 - RNA, 1283 nt, Mus musculus
gggaucugaugcccuccccugcccuuaacaggcacugcacaaacacaucuaauaagaugccugccuugggcuuccaguaacagagagagaccuuucugccucagugccgcacacaggggucacaggcaugcaccagcgugcucaggucccauacuaauuauaacugagaucgggaagcuaacagucuuuaagccccgcccaccacugaagucuggcuuuuuucugauacaucugagagcaaguggauguggauaguuguccugucacucuggucccaucuggcucuauccacuccuggaggccugaggaauccguuuggaagguagaacuauguuagcgacuuuugucccuugugugugguguacauuugucuguaggcauguucaugugugugggugcacauguguauggauaugcaugcauucaugccuagcacuuucugccuuguucucucucucucucucucucucucucuuucucucucuguuuuuucaagacaggguuucucugcguagcccuggcuguccuggaacucacucuguagaccaggcuacagauuuuugaacucagaaauccuccugccucugcuucccaagugcugugauuaaaggcaugcgccaccaugcccggccccugccuugcucucuuaauacugggugucuaugauugcuuuuuaccuucucuauugagguagggucccacagcugaaucccacccagagcuuacugaaucccaccucugccuccuaaacacugggauuagaacugggccaccagaugggcaugguguuuauguggacgccagggaucugaacucugguacucacacuccugugacaaguguuuuaaccacugagccauguccccagccuccuuuuuaaaaaagauuuuugaagagacuuguggaguggaugucagaacuuuaagacucccugaaucacuuacaaagcucuggauuacagcauaagcaguggggaauucuaagugcuuugcgggaccacgaacuagggcagucggagguaucagugccaggagcaugcaggcaucugcaguucugaaugccuaggucacgccaguggaaagaaacugcuuuuccaaaaagauuuauuuauuuauuuucaguauuaauucggucucuguguguuguguacauguguguggguauccacacaggucagugaguuggaucucuuugggcuacaauugccuacgguuguguaagccaugaacuauggguguugaaacuaaacucgaguccucugcaagaacaguacccacucuuua

SEQ ID NO: 3084 - RNA, 4014 nt, Mus musculus
cacacucaaaccuccucaggguaccgguuaucucuugcuuucccugugaaggugucuugcuccaugauuugccuugcucagugugauuggauggaaguuaagucugagaagagaggggaacaccauugagugacucuauguaauuguugccauuggcuguaaccucccagauagggccugcuuguucagccugcuucucagaaccaaaagggugugcagaugagaaaccacugaguagcaauggauaguaauaugaacaaagguaugucuuuuugucguuguaagucauugagguuuugggggcugaaagaaaaaguaaggcucgggacccccaaggccaaguucucagcacaaaggagacuuauuugcccccagaaggacagagggcaggcauaaggggcaaagccagaagauagaggaagagggagaagggaaagggaucaagggagaggagagaaaagggagagaggugagagguguuugucugggagagaguggaggaggacaaaggauugcaucuggauagagaggagacagaugugacacacagaaaaaaauggcaguuuauuuaguuaggaugagguguuuaauuuuaacugggcauguuaauuaggugugcuuuccauagcuuugauagcuagaucuugguagugagccucaggaggagggaguagccaaauaaaggaauagacauuggggucuagcuucaggaaaguaaucuuaauuuuuuuuuuuuuuuuuuuuuuuuagcaugucgagaggagcuggggagaaggugaaggcuugccauggucaagcuggcccaagccauuccagggacuaucuuucguuucuauugcugugauaaaacaccaugaccaaaggcaagguggagaaggaaggguuuauuucaacuuacaacucuugguugacuccaucacugagaggauuugaggcauaaacucaaggaacaaaccuggagguagcaacugaagacaugggcuggagaagacugcucuuacugguuuguuccucaugguuuguccaggcugcuuucucauacaacucaggaccaccccgcagugggccagaggugcaccacccgucuguaacuccagcuucaggggauaaucugauaccucuuuuuggcuccaagaacagcaggcauauacacauaaaugcaggcaaaacauucauacguguaaaauaauuaaaucauauauaugugugcauauauauauauauauauauauauauguauauuuuuuaaagugcucagugggugaagugcuuguugcacaagcaugaacacuugaguuugauuucucaagcuggguguggcagcacgugucuguaacuccagugcuuggggguugggggcaggcagagcccgcgggccagcauguugggggcaggcagagcccgcgggccagcauguuuagccaggcuggggagaugaaucagugggcaaaagagcuuucacacaauccugaugacuugaguuaggagcucuagaauccauacagaaaggcuggauguaauaguacaagcauccaugcuaucuaugugcaggcacaguaguggugcuggugaugacgguuuggugaugggguagguaccgcuguugguguugguugcuauuuguguguuccacaucuccccggcucucucacauacaucucagaucacuuuguuuugaccccacaucuauaguggccuccaaaugacuacaggauacagcacgcccaccuuccuuccuggacuccuuuugagguugcuucuguuuucauucagugacugcucccuuacuucgcugaauacauucuggugucaacaggaggaggagccuuccguugaacaagccccacucaguggucucacuucuugucuucaaucaaaugcuuccucuuucaccaaggcagccacccucacagcuaacuucuuugucugcuuucccacaggaggacggcuuugugucucuagcguuuuuuuuuucauggagcguuuugcaguuaguggcacaaaacuguacacucaguacaguguuagggacuuuugggcacucagaagggcuguguuaagcucaccaaauacauggccucuaaauuuugcagaaauaagcaucccacugugugugugugugcgugugcgcacgcacacacacuugugugugcaugcauauguuuugagacagggucucaaguagcccaggagaucuugaauccacuggauagcugaagaugaccucaaacucuaaauccucuaaacaucaucucccaagugcugagauuacaggcaugcaccuccacaccuggcuuccuaauuuaugcaugguucuuccuauaauuuggaucuugagaugauccucaagggccuaugugaugaaggcugguuccucaggaggcacuguugagagguggugggaccuuuaagagcuggggccaaguggaagguguacugugggaccccuaccccuuccucuuccucuuuugcuuccuggccacgucuuccggugcuuugcuuugcuuugcaucuccacucuguacugccugaccccagauccaaagcagggucaguagacuacacacuggaacugcuaagacaaaagaaaucgugucuauuuccaucucacagguguuucuucuagagacaaugcugccuaacguagccgccacuuaguuacugggcagccuucccucauuaccuucauugucaaucaacaguauuuccuuccuacccugaacugggcccagggagggaaaugauguuuggcuucuucaaaccaugaugagguucaucaugcucaggcccugucaauuaaagcgucaagcccgugggggaagggaagcccgugggggaagggaagcaugggagcugcuuggcuuuagcaugaccugagaggaggccagugaagauucaguaggcuuuucucucuucuuucuuguaaacuaaugagcuuaugaggcccacuuacaggagcauuagcuagagacuucuuacucaagcauugggacuuaauucagccccauccuacccugggucacuacaaaagcuacaucugugggaaucacuaacagcagagaaaaagagcccuucccuauucagaggugauggaggccuccagguaccagcuggaguugaucuguuauguaaaccaggcauuggcuccccaaccugucuguccgcugaucugcccugacugccggucucacuacuagguuuuaaauuucuugugaccaggaggauacagcucauuugaacuaacugcccucaucuauuuauccagucccuuggggguaaggcaaaaauguggggcaaacccuauccaauuguuucccucccuccccuccuacaggaaaaggcuaccccuguaaucauaagccugcuucagugcccaauacccuugggcuccuccuccauuagccccacugugcuggucccaccccuucccugugggucaugaaagggugugaccuccuucaguucugccgccacaacgcacgcacccgcugcucucuuccacccucagaggaucugucugggaggcagcucagccuaugcucccucuauaauggcuaacgcauucgcauaagguucagagacaaaaaacuaggcugaucuccguggcugcaguucugaagauguuccgcaaguugugauauaaugcgguuuuaucuggccuuuguuuuuauuucaccucauucuguuaacacccaauagaaaaccucguguguuugugucugagggauggaccccgaccucgcccaauuucccacauuccugaaugauucuuugcauccuuuccucucagacuuuaacaaaucacugcuucuggugugcgugaaagguuaagagggcagaagaaaagguaggauuugaagagccgaucaaaagcaaagcuuaaucuuuuggacagcauuuuucaaaaugggguuaaaauugacauggaucgcauuaagggcgaagcaacugagaacccaggaaaccgcaugucgagaagcacguaaaacaaaaauaaaaacgauacauccuccu

SEQ ID NO: 3085 - RNA, 4794 nt, Mus musculus
uaauuuuuuuuuuuuuuuuuuuuuuuuagcaugucgagaggagcuggggagaaggugaaggcuugccauggucaagcuggcccaagccauuccagggacuaucuuucguuucuauugcugugauaaaacaccaugaccaaaggcaagguggagaaggaaggguuuauuucaacuuacaacucuugguugacuccaucacugagaggauuugaggcauaaacucaaggaacaaaccuggagguagcaacugaagacaugggcuggagaagacugcucuuacugguuuguuccucaugguuuguccaggcugcuuucucauacaacucaggaccaccccgcagugggccagaggugcaccacccgucuguaacuccagcuucaggggauaaucugauaccucuuuuuggcuccaagaacagcaggcauauacacauaaaugcaggcaaaacauucauacguguaaaauaauuaaaucauauauaugugugcauauauauauauauauauauauauauguauauuuuuuaaagugcucagugggugaagugcuuguugcacaagcaugaacacuugaguuugauuucucaagcuggguguggcagcacgugucuguaacuccagugcuuggggguugggggcaggcagagcccgcgggccagcauguugggggcaggcagagcccgcgggccagcauguuuagccaggcuggggagaugaaucagugggcaaaagagcuuucacacaauccugaugacuugaguuaggagcucuagaauccauacagaaaggcuggauguaauaguacaagcauccaugcuaucuaugugcaggcacaguaguggugcuggugaugacgguuuggugaugggguagguaccgcuguugguguugguugcuauuuguguguuccacaucuccccggcucucucacauacaucucagaucacuuuguuuugaccccacaucuauaguggccuccaaaugacuacaggauacagcacgcccaccuuccuuccuggacuccuuuugagguugcuucuguuuucauucagugacugcucccuuacuucgcugaauacauucuggugucaacaggaggaggagccuuccguugaacaagccccacucaguggucucacuucuugucuucaaucaaaugcuuccucuuucaccaaggcagccacccucacagcuaacuucuuugucugcuuucccacaggaggacggcuuugugucucuagcguuuuuuuuuucauggagcguuuugcaguuaguggcacaaaacuguacacucaguacaguguuagggacuuuugggcacucagaagggcuguguuaagcucaccaaauacauggccucuaaauuuugcagaaauaagcaucccacugugugugugugugcgugugcgcacgcacacacacuugugugugcaugcauauguuuugagacagggucucaaguagcccaggagaucuugaauccacuggauagcugaagaugaccucaaacucuaaauccucuaaacaucaucucccaagugcugagauuacaggcaugcaccuccacaccuggcuuccuaauuuaugcaugguucuuccuauaauuuggaucuugagaugauccucaagggccuaugugaugaaggcugguuccucaggaggcacuguugagagguggugggaccuuuaagagcuggggccaaguggaagguguacugugggaccccuaccccuuccucuuccucuuuugcuuccuggccacgucuuccggugcuuugcuuugcuuugcaucuccacucuguacugccugaccccagauccaaagcagggucaguagacuacacacuggaacugcuaagacaaaagaaaucgugucuauuuccaucucacagguguuucuucuagagacaaugcugccuaacguagccgccacuuaguuacugggcagccuucccucauuaccuucauugucaaucaacaguauuuccuuccuacccugaacugggcccagggagggaaaugauguuuggcuucuucaaaccaugaugagguucaucaugcucaggcccugucaauuaaagcgucaagcccgugggggaagggaagcccgugggggaagggaagcaugggagcugcuuggcuuuagcaugaccugagaggaggccagugaagauucaguaggcuuuucucucuucuuucuuguaaacuaaugagcuuaugaggcccacuuacaggagcauuagcuagagacuucuuacucaagcauugggacuuaauucagccccauccuacccugggucacuacaaaagcuacaucugugggaaucacuaacagcagagaaaaagagcccuucccuauucagaggugauggaggccuccagguaccagcuggaguugaucuguuauguaaaccaggcauuggcuccccaaccugucuguccgcugaucugcccugacugccggucucacuacuagguuuuaaauuucuugugaccaggaggauacagcucauuugaacuaacugcccucaucuauuuauccagucccuuggggguaaggcaaaaauguggggcaaacccuauccaauuguuucccucccuccccuccuacaggaaaaggcuaccccuguaaucauaagccugcuucagugcccaauacccuugggcuccuccuccauuagccccacugugcuggucccaccccuucccugugggucaugaaagggugugaccuccuucaguucugccgccacaacgcacgcacccgcugcucucuuccacccucagaggaucugucugggaggcagcucagccuaugcucccucuauaauggcuaacgcauucgcauaagguucagagacaaaaaacuaggcugaucuccguggcugcaguucugaagauguuccgcaaguugugauauaaugcgguuuuaucuggccuuuguuuuuauuucaccucauucuguuaacacccaauagaaaaccucguguguuugugucugagggauggaccccgaccucgcccaauuucccacauuccugaaugauucuuugcauccuuuccucucagacuuuaacaaaucacugcuucuggugugcgugaaagguuaagagggcagaagaaaagguaggauuugaagagccgaucaaaagcaaagcuuaaucuuuuggacagcauuuuucaaaaugggguuaaaauugacauggaucgcauuaagggcgaagcaacugagaacccaggaaaccgcaugucgagaagcacguaaaacaaaaauaaaaacgauacauccuccucacccauucuaccacguccccuccucucucccugcggcacaacucacucccagaccgcucugcccacgcauacucaacuaaaaaauucagaccacgccaaccaugccacgagguguuuuuauuuucaucaaucauacaaauaauuuucuauaauaucccagggcaaaccggugaaauuuggcaguccgauuaguggagggguccccuucagagacccgcgggccgguggcaucggcucggagugcccggguuucacagugcagcuuguggcucgcguccaucuugcagguggcucuuccuccacaucacgagggggucuuggagaugauggggcgggguggggugggguggggaaaucuuccuaggcuuuuaggagauuucacuccucuuuuccuguucaauggcugcgaagggagggauguggucauuggagcuaccuuacagccccccauacccaacccacaaaccuggugugggugaggcacccacgaggccugcggacagagaagggguuuggaagagacaaagugcuuugugugacuggaaggguggcuguggccuuagauucggggugggaagauaguggccggaugggggugggggugccgggcuggcacagcagggaagggaggagcgcuggggugggaacccggggcacacuuacucucuuuggucggcaggguguucuucuccugcgucucgguuuucuucagcuuggccuuaucgaagcuggcgauuucccccauguccggcuugucugccauuuucuuacaacucugaugggcgaaacaaggugauaauggguggccaggggcuugggggugaccagcgcguccuggaucccgcgccuuccgcgaacgccucucaacguggcauucccaguccugggcguucccgcagcccggaggccgaggauccuagacucguccaccacacccucccuccgaagccccagggcguggccugcuagccccagaagauuccaaaccgccgggucgccuguugcaaccgaaggggaacgcgcccgccagccauaaacuggcccgaccccacccaggguaggccccaaggccggcgcugugccuuaccguggauucuccuuccgagcucgcgcuccaggugcucccacucucguugcugcagcaagagacaaaagagcggcgcccgccccucgucuuauauacaccgcgccccgccccgccucucgcccgccgcaacgagggcguggccagcccgcgcggagggcguggccagcgcgcgcgggggcuggggggcgcucagcaucuccaggcugccuggggcuccgcccuucucggcccgcguuccuaacccguugcgaucccgcguggaggguggcaggcaccagcucccgguggucucuuuucuugauauaucuccuuuuccuaguacccaggagccugcugcucaccccgcgggaagggcgugggggggggggcagcggggaaggacuugggguuuuguugaauguauguguggugua

SEQ ID NO: 3086 - RNA, 8320 nt, Mus musculus
uccagaagccuuggcacuggaagccgugugaguguguguguaugugugucuccaugugucucuguguguguaucuguguggaguaugugucuguguguaugugucucugugugagugugugucugugugugucucugugugagugugugugucucugugugugugugucuccaugugucucugugugugugugugugucugugugugaguguguguguaucuguguggaguaugugucuguguguaugugucucugugugagugugugucugugucugugugagugugucucugugugagugugugugucucugugugugugucugugugugucucucuguguguguuuuccaucgcugccaccccacugcuccugucuagagauuuagggcuuccaggccaggaggagcagaagucccaggacugaugccacucgaaguucaucggauccacaccauucaguuaagagugucuggagaggaggugaggcagaggaggugggcagagcaugucugcaucuggguuucccugggaauagugagucaaacagacacaggaauguccuucgcacugggagagaugggaggccucucaucggguaaccuucccuaugugccugucgccccauuuaagguaguugcuuugauucuagccuuguguguauaccuguuagaacaaauauggauguguggaugggcccauuaaagccugaauguagugagaauaaaggucacaaagaacucaauuuucacccccuuuuuggaaguucugugaccauucuguaacuguucagagcuggcagcuuuguagagacaagcaugcuugcuagaacugguccucagagaaaguacauucuuagcguggcuagguugugggucagcaguggauagaagagucuaaauccaaggggcaggaagccuccggcagaauuauaccagagaggcuggaauccagggucccuuaaacgaaagcgaaggcugagcuccucugguguguuugcagcuaugugcguacuugggcaaacuggaaagcuguugauccuggcuucgugacguacacagucuggugacgaaaccagauucugagucaguaagccagggaagcacaagcauugugguguguggucauauguuuguguguauguguguuggaggguacuaguuacaguuuggguuuagagggagccucuucaaggaaguuuucuucuggcugauaucaaaugggaaccagauggaguggagucugaaaagcagauauguggagucuggaucgguagaugcugagauccuguguugaguaagugcuucacaaacaucaggguggaugagggggaagaucuggggcauaggggacuguaaggcugguuuugugugucaacuugacacaggcugggguuaucacagagaaaggagcuucaguugagaaaaugccuccaugagauccagcuguaaggcauuuucucaauuagugaucaaggggaagggccccuugugggugaugccauuccugggcugguagucuuggguucuauaagaaagcaagcugagcaagccaguggaaguaagccaguaaguaacaccccuccauagccucugcaucagcuccugcuuccugaccugcuugaguuccaguccugacauccuuuggugaucaacagcaauguggaaaguguaagcugaauaaacccuuuccuccccaacugcuucuuggucaugauuuugugcaggaauagaaacucugacuuaagacagggacugagugaaaguugguucuggagggagugauccuaugagugauagcaagaugaagcaacucuggcuggaaccauagaagaaaaaaauaauuagcugcaggacauggucuagagacaaaaacaaagagggaagaagggagggaggaagggaggaagggagggagggacggcauuccuugcccacaacaacagggaauuacugagaggucugaccucugguguccugugugucuugcaguuuaaaagauuuacuuguuuuuauauguaugcaccuggcucuguguacacauaucaugugaguucaggugcucauggaggccaggagacggcauuggcucccccagaccuggauuucauaaaagauugugagcacugggcauugaaccuagguccucuauaguagcagcaagugcuuuugcaccaagcucagucccaaauuucauuuuuaaaugcauaagagcugccagccuggagacagugagguaggaggcuuagcaacugcccgcagccaugguggcucuuuaaucuuccucacugauggaauauuaaucugcccuguguaguauuugcaaguugggccacuuccucucaagguguccauggguuuagguauuuuaugccucagcugagcugaaaggaucaggugaacuugaggucaugggagccuccccuugucgugucuuggcgugccugcaugguguucacacaggcccagacuaggguagaugagaggggccgagacccagggaggaauccucauggccuggcugugcucagcgguggucagagagcuagauccaugcccaagauuaccagaggcuaaugaugggcgaacucugaauugagcuuuccuuuaucaaggcccuuagcacucacugaaccgugggacaguuggcuggucuccuaauguucugccauuugguuucugguggaaauggccccaaacaccuaauuaauguacuaauacacauuccugucuuuaaagaggggaagauaaaaagccacuggguggacacagaggcggggugggggugggguggcuugggaacgacagcgguuucuaaugugccugagucugucuuucucaggucccugucacggacaggucccucccucugcccccaacugcagcuucuuggcaugcaaauucuuaccacagccauaugguggucaucagggcuggucugucccucuggacuccugcgguuugggugcuaaugcuggcuuucaaaacagagacauuccucauucaguaacucugggauccgggccaagacguugucugaucucuuggaauuuaaaaauggucaucuuuauaauucauagucugggggcuggagagauggcucagugguuaagagcacugacugcucuuccagagguccugaguucaaaucccagcaaccacauggugguucauaaccaucuguaacaagaucugacacccucuucuagagugucugaagacagcuacaguguacucacauauaauaaauaaauaaauaaauaaauaaauaaaucuuuaaaaaaauuucauagucuggucugaucuugauagacccaauugagaagaauucuuguuuucuuugagacagaauuccacuauguagcccaggcugcucuugaacuuggaauucuccugccucagccuccugaguguuagaauuaugauuucuggcaggaugagacacugauaaaggaaaauacacauuggaaaugcuucucuuuucaaggacugaugggcagcuacgcagcaguguuggggggcuacagucauaugacacaauaguguauguccuaggguuuuacugcugugaagagacaccaugaccaaggcaacucuuauaaggacaacauuuaauuggggcuggcuuacaggcuuagagguccaguccauuaucaucaaggugggagcguggcaguguccagacaggcaugguguaggaggaguugagaguucagcaucuucaucugaaggcugcuagaaaguauucuuccaggcagcuagaaugagggucuuaaagcccacacccacagugacacaccuacuucaacaaggccacaccuucuaauugugccacucccugggcuaagcauauacaaaccaucacaggguguaaggagauaauuguuagagucuccugaaaauagacaucuuuugagcagauguucguuuaugacauguauaugugagucaauagcuguguggcucccacccucuggaaucuacuacagcacaccuccugggccccacacugcugcguguaucugguuugcaugcagggccaucagugggcuauguaggucuccuacuuagggucugguguauagggugcucucuccaugauccauagacacuuucauuacauuuagcauguuaagcaucucacuagaugcuggggauggguugguuuugucagaggggcuguacggaauaguuuuuacacuacccacuccugcgcuauuuuguauuuacacauuuacugggucucguagggagaauccgagugacaugguaaguguagagcuugcuuugguugugccuggaacagaaauguugaucucuguccagcugucauccccuggccaacucugcaucucucaccugaugguccccuuucuguccccuugggccuuggaauagcucacaaaacucagaauaauuauccaggauuggaugggaccgagaaggaguaguacguaugugucaucugguuuaaugguagcuggaucgccuggauuuuaagcucuggcuucccuuccuuuccugguguauaugguauguguuugugaguugucuguguaugucacaugugcagcugcccucugaaguccaaagacagugucuuuggaucuccuacaauugaaguuauaggcuguuguaagucacuuccuaugagugcuggggacccgacuugggucuucugccagagaagcaagugcuccuagcugcugagccuucucgcuagcuccucuaucaaggagcccccuagagugggaacucgugccacgggcagucugucuggcauguucaaucaguggcgugugugcugcaugugacugagagcugugcauguuucccaacacaaaaucauaagcuuacuuaaaaaaauugugaugggcagagggaugguuccauggguuggccacagaagccucaugguucugaauccuccagaaccaauauuaaaagucagacaucguggcaugucugaaaccccaaugcacucuuucuaggacaugaaaggcagagacagaagaauugccagaagcucaguggacagcuauguuggcauacguagcagcaagcaagagagagacccuucucaaaguggagggugaagauugcccucugauuuuuacguguguaccaugguggcaugcaugggcccacauucacacacacauacauggacacacaaacgccauacacacuuguacacuagcaagacuuucuuuucaugguuucaugguaacucaguugcacagcucucucaagggugagcuuugugugugacaaugucauguuacaauaucuaaagguuguugcuguugguggugcuggguuuuugagauccuuaauuaggucuagaaacaggaguaucagggccaugugccuaauguggacugugggccucuccuacaagugugaccaggaagggauccugugugaaugaggggccaacgcuggcucuccccaggccuucaacgacacacuggagagaagcagucuagcccggcuuucacauagaguuggggguucgagguaauaggggugugugaaucaggagccuccacaucacagccgggguuuccaacagaaauaacucaaaacgacuuuauuuuaggucaugggagaaauaacagccacagcugccauccuuaagucgacucagaggucacuuccuccucaucagggaagacuucuggaucggcgaggcucccacuuacucacucagcuggcagagcaacgcugaccccuuggagauccaguaaucacugauccucuuggaggguaagaggacagucaccacaaaguugguugaauggccugagaaaugauaugggggugguggugggguggugggagggugggggugguggugggggugggguggugggggugggcagggugggaaagaagagauguuauuuaaacaguaaccucuggauucacggagauaagauuacugagagucaagaggcucuagcuccagaccuggcugaaccugaagaugcugggcacagcccucugaagguucuaguuuugggcgauaagaaaggagauuuuggaauacauggugcuuugaggccucucuggcuuagagcuuauaucuuccugaguauguuucagguuuucuguagguugaaccuaggagcauugggcugagauucaggccugacuuagggguuucuaaugguagguagggcaucuauacauguggucgucuauuuaucugcccuuccuucacuccauccuacacuggaaaacucuugggcuccugggaugaacagguacggggacaggcauuuugucuucaguguguaaccguucugugcagcaagucacucuucaggaguucuuucccuucuguggcugucuacggggccacugagaagaagauggugcccucggauggcgauggcuccuucugcaccacucucucagauuccaucgguguggaauggacaucagggaaggcagccucggacccagcagagggugccucuaccuuuucaccuuucuggcccauuggauuccuggcuuuccagugccacagcauggcaagccgcucuagacaccuucccuguguauuuacugguuuuaugcaguccagaaauuugucuccaugcuucuaugggugccggcccaaugcaggcaaucagugccuggaguaugugaggccuucccugggucuggaggaagacucaggauacaacuaaaccccugcauccacugacuggguuuaagcagaaucaauucccuguuggccagaaaugaguguagcugccuuccaaaauccccucccacucaaccucccggcgcccuacuaagggauuuacuguccaaucugcuuggcucacaguuagacaagaagcaccuccaagggguagaugauugggacagacaugugugugugucucaugucacgugcccuacgccgacauccuggagggcugaugucagaggucuugugcuucugacaaacaggauggccaugacacacaugcuguguaguggacugccguucaagaaagcaaaggcuggcugcuuacuacagagggauggagcgugacuggaagguuaaggacagugcugggcaggcauagacauguggaucucuaugagcuggaggcccagcuuggacuacguggcagguuccaaacugccagggcuacguagugauagugagaccggcucaaaacagauggauggaugaaugagaaagaaaaggaugcagaaauaaaggcuguguucccacagaagggauuuaaugggcuuuagaacuacagaaccugcucaccaaagcugcugucugcaggcaggaccagggccugcaccgcaggggcuuagcugaacuuacucuggggguggauggggaccccuuagugaggaaacauguuuuacaucugagaauaauucagguguucaucacaaugggaaccugcuuucguccuucuucaugcugcuacaguuaacaagagacuuggaccgccuuuaauucagcuugccuugaaaacaguacuauuguguuguucuaaaccagacugagaaauuguuagagcgcucucagagguuagcuggguucacuguucauguuugaucaugcuuagcuuuucuuuuuuuguggaaaaaaaaauuaaagcauaaaugguccuuccuuauccaucucaugauacacacuucacaugccuuguagauuauuuugaagaaauauuacguaaaaacuuuugcugcaucuauuuugguaugugucucuaaauccugacuauuaaaggcacaaauaucauagcuaaaauauuacuuucuaagagcuguucaaauuuuucuagugugcauacauacauguauaaacucauuauacacacacacuguauguauauauaugcauauauauacacacacacacauauauauauacacacauauauauauacacacauauauauauacacauauauauauauauauacacacauauauauauguauauguuauauugguacuugacaguuacuuagauucagaguuuaaauaagggccacacuccacagcaaugauguguguccuaaaucacuuuuaacaauaaauuaaaauuguaacuauaaaucugccucuuugccacucacuacaauauauuuguugacacaaacagguugguuccacuaggagucccagaaucuccuaucuuugugaaggaagaagguuuaggcacagggaugagcucacgcucagguuuaaacgcccucuucuggccaaaagacgcuacuacauuuacucacauguauacuauuacauaaaauaaaauguacacuauuacauaaaaauaaaauuuuauauuaaau

SEQ ID NO: 3087 - RNA, 28532 nt, Mus musculus
acauuucccacaacaccacgcgccggccgggccucucaugggcugucccacacauugccguuauguuuaugguuacccaagcccacaucuacuaaagaacagagcuauuguuugcuuuucaaacgucauccuucuuguucuuuuccacuuguaacguucacuguuugagaagagacuccgaggagcguaagauauucaggcuacuccucuagacaccuuucugcgcgagccugagcccaugccaaggucccgggguccugagagugucauugggggaugaccgcaacaguaguugcugcggcugccacugcaaccauggucuccagcagcagcggccucgccgccgcccgccuguugucgcgcaccuuccuccgugagucgugccggcccggcucuguccuccaugcuugcguagaccucggguuccugauucuggccccggcgguguccgggcucuuccgggcgggcccucggaaggggcgagggagccaccgguccaaacgccaguggcagaccucggggguggagggggcuuuguccgauggggucguggaucggccgaugcacuucgcagggcgcccugcagacacggcaacaauauccuaguucccucggugacgggguguguguguguggaggcgggggggggggggugagguggagguggccucugggcuggcccuuacuuggagccaaggcuaaagagguccaggaugaacucugcugggagugugagcccccggguugaagagguuguaauuugucccgaaagauucugcacuuggaguugaccguucuguugaagugguagggccaacggaaaggugguuucugcacccagagucaacguggccccguaggagcuuggaagcugaccaaugaugugucgcucuuuacgagacuccaaugaacaccucaguuucugagaaccaaucucccaggguugcuauccugcaaugcugacucuugaaaaguagugcugcguucaaagucucuguguuagguacgauaggaaacagcuugggaaccggucaugucguuuuugaagucuggccaaucauucguauguguauaauagucuuuuuuuaaaaagugauuucucgauggaugugguggcccacacauuuaauuccugcauuugggaggcagaggcagguaugcgggucuuugugaguucgaggccagccuggucuacaaaaugagucccaagagagccacagcuguuacacagagaaacccugucuugaaaacaaaacgaaaugaaacaaacaaaagccuacuaaacaaacaaacaaacaaacaucucucaaguaauagcuugguuugugaagcagagcauuguccugccuaucacuaacaggagaaaugauugccgauuaaaacugugaugagugauugguugucagguuuauccagaucuaggagauguuaagaaguaaugagugguuugguuucauuguguagaauaagugagucaguuuacugcucagaaauagacacucauguaacacucuuuucuuugugacaucuuguuuccucucgcaucagauaguaggugagacuuaguuucuuucuuggguauccuaaaaguguucaaggauaagugugcacccaguagcuguaccucauugccaggucauuugaggacagagguccgacuugguaacuuugccaaaugugaaagaguugaguguauuugggaacguuuucuggagcaccuucuugacugauuaaaaggauaccucaaugugcuccaaauagaagggaaggaaggcauuaguugugccaguaagugcuguggcugguagaguuugaacacuuguguguuggguauggccuaagccagcuuauuuggaaucguuuguggguuaagauguggaacaccagaugugcacauuagcuaguuuucuggaacacucaccuaugcaccaaugucucucucugcugaggucuuucugguccaagacccagccuccauccagaaggucugcuguguuaauagagguguuuccagaagaggaaugucuaggugauuugguuccuuaaauucauccuuagcaacccucaccccacagaacugaacgucuuucauccuagacugcaagacugaaggccuagaagagauuuagcuuucuguugcuggaggcaugcuguuaaaacucugagggaucuaagaucuaaacuaggauauuuuuguauuaguaguauuaguauuaagguuacaagugacuaauguuuaaaaaccucuuaguuggcagaccuuggaauucucucacaccugcaauauuuccaagccacugcaguggccauguugucucacaaguuagugcugcuacuguuuucuccuccuucucuuccuccucuucuuucuccucuuccuccuccucuuccuccucuuccuccuccuucucuucuuccucuucaucuuccuccucuuucuuuuccucuuauucuuccuccuccucuuccucuucuccuuuuucuuguuacaaauuauuuaggcuuuuagguuaaaauaagaugauaggaaucccaccuccacccuguucuuaaauuuuagcugauggcacauaauguguugaggucccaaguuuugcaguguugauuugaguuaaaagagauaaaaagacaaacagcccuaggugcuacagggcucuauugaagggcaacuaagagacugcuaagcugcccucgaccccucacacacauuuaauggcuuaggagagcaagggacaaucuuguugauguggggaggauauggaaaugaggaugauuuugacgagaauauguaagaacuuuacaagcaucacugagauuaaaaugaaguuugaaaagaaaccuaaaguuugcuagagucuuuaaaacuaucaaccaggagguacuauaaaucacaucuuucugaauaauuaauaagagcagguauuauuuugaucuuagaauuaggauauuuugaugucagaaaguugaucuuacaauccaguuaguucugcuguuugguuuggcaaaugaggaaacaaagccagaaaauuucccaggugguguccacggagucccggaaaccaggucugcuggugcgugcagugucuuuucacgugcgcgccuugggaagcuuggacuuccauaugaggagcaggaccuuuggacucucagggauccguggaggaagcgucuccccugcucggagcugcugcuugccucucucccgcccuugccaaguuccacaggcuuauuugcagacucagggaagcucuuggaaguguguggaaaaggacacuccacagugaucguucccuuucuagucucuguugcuguuugcaucuaggaacucaaccuuuaucucagaaauggaagccugaauccaaaugcguugcuggagcccugagaaagugacuugauuuuucuggccucaaaguugcuucauagaaacacugaaguuuaaaaugauuaguguaggaauaauuuagaguuugccacaggacagguauuuuguuguguuugaccaauuuauuaaguuuuuacuuaauaauauuucuaaaaucugaauaucuucuccuuggugauacauuauaaaacauuguacacauaauuuuuacacuuagugcuuaaaaaacaagagugcuuuacauuuuacaaaacauggugcuugugaucaauugagccaauaguauugaaugcaucauuaguauaagugaauauauaguuuuauguuugaauagcugauugguauuuaggguaaggagcugcugagauacucccauguauuguaggucuacuauguaacaguuccuuuuacaauuaaaauauuccaccuuguaggacgaagcuccuuaagcaggaaaguaaacaucucugaguaguuucaggaagucccuaaaacugaucagauuuacucuuagaguaggccauaaaagcugagccuuccccucagacggaagggagccaagcugcaaagaagacucucauaccuggcagaagcagaaacaagccaagcugcuuggaaguaauuuagaccaacugaggcaccagcagaggccauucuccagccuguuaagcugcugcagguugugcaaaguguuccagguucccagcuuugugagaugucauccaugcuggguggccugugguucugcagcugucuccagucaguaaccccucacccauauuccuguaaguaaccccaguaaaacucagugguucaccaaguuggacuuuguuaguguuuguacuuuggucuguccuggacucccuauguguguugcaucuccccaggaaaaguuuugucacacaacaaggucucuucauuuggggaccacaauagccuuuguuuugcauauguauaauucaugguuaaugcuauauuagagcagguuugaguguuccccaagaguucccaugcuaggagggaacucugaguucccagugagguggugaacugugagaucccugugccuagaagagguuacugguagccugcccaacuuaccccuccugaggugaguuaccaagcauggcugccccaugaacuugaccagcgccuuggcauccuguucgcuuguugguuuucugccauguuauagacaggcagagggguccucaccacaggcuggacagauaaggcugcccuaaagugugaguugaacaaacugguuuucuuuuaaauuaguuacuuuguuaaaagucaguuacuuugugaaguuggcugcaggugggccaguaggguggugaguuuacauuugugaauucaugaacacaugcacaccaguaaaagaggaacaggaacacaguucucaggguugagugagaaguguuuucaugacuugagucaggcuaacagucucaccugggaggugcucuuuggcucuguauuuccgcauuaacagcacagccaucuuagaagugguauaguuguuaccuagaggagauaggacugccugacaaaccugugugcucuguggaaaacaucuuucucaguaccuaggcccuuuccuugagcaucuuauguccguuuguccuucuaugguucugugauuccuugguaacaugguuguguuacagaccaggaggcuucuguggguacucuugucagguacucacucaugagccugucauagaggccacugauuucccacaguuguuugcucugcucagucugcagcagugauaacgauaguaagguaguaauuggugauaucccacauaccguauccucucacaucagccagcgaggugcauaauauuaucuguauucucacagugagauuaucucagacaaauauuccugugugaaaagauucccaauuuauuugugauugcugcacaguaugugucugcagagguuagacuauuuguguauagaaggugugugaggacagaccaaugagauggcucaguggggaaaaacacuucccacgcaagucagauggccugaaucccagccacaaaacacacauaaaggugugaggagagaaccgacucuacaaacugaucucugaccucccaugcuggcgaugaaccaaccuaccugccuucuuuccucccucucucccucccuucauucuuuccuuccugucucucuuucuuucuuucuuucugcacauggaaagcguaucuggcuggacuuacuugauuuuaacgugugaacuuuauacuuucucuuugagggcaaugguuuucaaccuuccuauugcugugacccuuuaacauaguuccucaugucguggugacccccaaccauaaaauuauuuucauuacuacuucauaacuguauuuugcuacuuuuaugaauuguaauguaaauauuugugauuaccaguggucuuaggcugcccuuguaaaggggucacuugccccuuccuccccccaaaagagguugugacucacagguugagaaccacuguuuuagggggagauuuuccuuugugcuaaugaaggauuucaggaauauagcaggcgcuuugaugccaaugccacaccuuuccugugagcagcuguuaaccuguuuacagaugggaagacuaaggcucaggagaucaaauaugaggccuugauugcaguguuggagaccagcaggacguaaacaccagcacagaccugucugguuucugagagugaucucagcugcuucugggagcaguuccaagguuacacuagccacuuguuugagccucaggagguggcccaagcugugacccuaauagcugucaccaucagcauauucuugguggccagcuucagacuuuucugccugccugcuguuugauuuaguguguucauuuucuaucuucauugcucuacuguuaucgucuacuguuucuuggccuuccuuuaucaguaugucugugagcuaggggcuaggacaaucugaguaagaucccaugcucugcugcacagugcagugggcucagccuuacuggcuuugaauccccauggugguaccucugcucaggucaggugcuuuggcuguucccugugcuaggacugggcugcagagugccccccacagccccuguucaucauagucugguccaggagugcagggcacuuccugagaggggcaggcugacgucugucucuuccuagggcaugagaucgccagaccccacuucuagaagguucuucuucaguuguggcacaggaggucugaacaccggaaagcgugaaaguguguggguaggcucugagaaauacaugaggaaguagauuguucuggagcuagcuuuuaugggcucuucaggggagguagaaggccuggcugcuuugaagggacggggaugggccacagaguagacaggcuaaguggcccuguggagguuuagaaggcccccucguaauugugagcccugugcccuuacacugauuuuugaaauaggaguuggcuguaguagcuacuuggauguucucagucucccuugagguggguugcugaaaaugacuuaggugugugguuuuucuuuguuuauuuccuauuugucuucucgucuacuuuggaacucauuucauuuuuucugcuuaauaugcgagguucugaguccuacaucagaagggaucagacagagugaucuuggguuguguuguagccagauuuauaguaggacuuagcauucccuguguugcuuucagugaggaauaagcuagaaaguagcucuuacauugcugaaguuuaccucccagcucagcugauguucauaggcgcucaugccugaguggggggugcacauagcaaacauuagcaggguuuuuuuuuucagaguuucaggguaauuucagaguuuguuugagacuguugaauuugaaucccagguuccuuuguggggaaugaauucggcuuuuuuucccccccaguucagauagugcuagaagauuguguucaagguaacaaagagaguccugggcgagagcaggcuccucguguuuguuuugcuaguuuguacccaaauuuaccugucucauuuaagaugugguuuuaaguuggcugugaucauagcauugcucuuagauuagaagacuuguuuuuaaaaauugggucauuaaauuuaauucaugggggcuggcgagauggcucaguggguaagagcacccgacugcucuuccgaaggucuagaguucaaaucccagcaaccacaugguggcucacaaccaucuguaacaagaucugacucccucuucuggugugucugaagacagcuacaguguacuuacauauaauaauaaauaaaucuuaaaaaaaaaaauuuaauucaugguucagaaauguggggaaauuauaaugucauauuuucuuuacuucucagugcaacagaaugggauacgacacgggucuuacacagccucucggaaacauaucuauauugauaaaaauacgaagauuauuugccaggguuucacaggcaaacagguaugugcaucuacauuuuuauuuaaagugaagacuauagauguaaaaaagugacuucuauuuuuaguaacacaaaaauaguaauacaugauagcacagaacuauaccguacagaaaggggcuguguguccggaagaagugcagguggacauuguaaaauggacauugcgcuuaaacuucccuugagaauacauaggagcgauaguaucagagacgcugucuuucagcaagcacaagacuccugguuuuccucuacuauuccuuugaacacuaggcaaauagacucuaaagaaaagcuuguguuaaguguggaauccauaccucugagagaaaugcacaaaugcacagacgcuccuggaaagugugggcaggugaaucagcaugggacuucccacuauguccuggucucugaaggagccagagggcaaacucgcccuuggguauuugaauugcuucuccuucucuucucuucccaccucuccucuucccacuugugccauagaauuugcauaguugaaauauaccuacgguuugauucugcaguaaaaccaucaugagucuccguuccuucuuuccaaccauucugcucaccaggaacccucuguuaaguuggcagauguccuccagaugaggaauacaggcaguuuucuuucugaggaaugaggcgguaaacuucaguauuucucagcuuagaaaaaguuagauaguugucauugaagaggaagccccagagagggcaaggcuuguguuugcuuuuuagauuuauuucuggggucucugugucucauuauaaucucuuguacaaacauuuuguauguauacagaaugcaaguaggcaggcagguugugucuuuugccacaucuguacuguagaacuguucuaauacaauguaauucaccaaagaagaugcaggcagucuuacagaccagcuagccaagucuuaaucugcaggcugccagcagaaugccagccacauguuacagauaccacguucacacacagacauguccccaagggagcugcacgucccaagggagacgcacgucccgagggaaggaugugugccgugcguccauccaccuucuccuucccaggcagacagucuaguuuguguauguuauaauagcauagaaucaaccugcaaucaagcucuuggggauguucauuaugcuugacuuguuuuucuguuuguugaacuuuaugacauucuugugacacuuuagccucugauaucuuuguaagauguauggaacugagucugcuuccuaaauuaguuaaugauuuauucaagucuuugagucuaggguuggucuugcuauucuuuuucuuucugcucaccaccuucuucccuuccuuucuuuucuuuccuucuuuuuuuuuuuuuccuuuuuuaaacagagucuugguauguaguccagguaaccuggaacucacuguaguuccaggcuuugaacucauaacgcucugccuaccucugcuuccugaaugcuaguuuugacgucuuaguucccuccaccuuagcuguuuuucauucaccuuccuugugcuugcauuucuucgcauugugcguuuuaguggucucaggguuuuggcuggcuacugagcugagggccacagaagcgugaggauugucacacucacuaguuccuuuucagugcacaugcacuguguucacauaggugagggaugcucuaugugaggauggauucaagccacacacauugccucugggugcugcaggauuucuuuccuggcacuuaggagcugcagaaauuauuauuccuauucuaaauugugaacuggcugaugggaacaugaaaacuaugggaaacagcucauuuugaaugaaaguauuacuuuuauuuaauagcacaguaggacuaggaagauggauucauuggcauuuacuuggaaguauaguccuuugcuagaagccuagaccauugcuucuuagacucuggaguaaaaagaucuguugauguaauaugaucaguacuuuugugaaauacaguaaaccuuaaaacacuuccacacuaauuagauuuuugucauucuccuuugguauuuuuuuuuccuucugucuuguucauuugucacuuuaggucagcugguuguagaccagcugguuaaagacagagugcaaagcacugacugacuuguggcucuuucuaaaacuccaucacuagcuucaaacugguugcuuaauuugcuuagguugaguuugcuaguauaaagggaaauuuaauugaaaaauuucuaagguucuuaaagccauaauuuuuaugcuuuaaauaauuaagaacuugaguaguuggcucaucguggucaggccccuguagagugaccacacagaccuucucacuguugauuggucauuguugauuggcuauauguaauauguugaauuuggugucauauugcaacaagaccaguagacagacauuacuaucuucauggacugugccucucagcugagaggacaaauauauccacaaaauccaugacuaaaucaugugguacacuagaaaguacgaucacuauggaagagcaagccaggacagcaagagugcauguccuguguagagucguaugguuggugugggggagaagauuuuauaucagaugguggggaagucugucucagagucaggguccaaaggagaugugcgagugacucacugagugcucagcaaggcccacaggcaggcaggcaagcaggcaggcaggcgugugccaugggagcuccaagccagcguggcugcagucagauauccucacuaguaaugaggacucacagggauggauggggccugccaugggaaaacgagguguguguuaguuucacggcucuugcugcuauggggaacugauucaaagggagcaaggacaagacgcuucuaggaguugaggugacaucagccaacacaguucccagcaaaagguaggacagagacuggcuggauagaguggcucaacagugagaagaaucuagugugacuuugagucugagcgucucugggaguggaguugucaacagauggagcagguugagaggagagccaucaaggcccaguuugagguguucagucagaugccugcucgcucuccagggagaguuagguaggcacaugaguguaugauugaaggcagaggucuuggcuaguugugugagagcuaugaguagcaagggucaccguagagauuccacuugcugccuugguaaggguggcaucccagaaggcauuggcugagauggagaagaaaauccgagagaacaggaggaagcagaggucuaaauguuagugggaaugaucuugcaaucuccagagccacuguccuugcuucuguuugguggguuuaggggagggugcuguaaugcaugucaagggaagaguuuggggaaaacuguuaaauaccuugcaggacggucucccauaacaaggaagccccaugucccaaagaccagguaggcugucagagaaagugagucacagggaauacaggaacuggcagggaagucuaaaagauccacugaggaucaaccaauccuuaaagacagaccaguuagcucagccuuggguuuucucuaguuacuguuuggcugugcgugugugcuuguguguguauguaugucaugggggcgguggugaguuagaguaaaccaaguuauaauuuauauguguguguguguguguauguacauguauuuguguguguauguauauguauauguguguguauguacauguacauguauguguguguguauacguguacauguacauguauauguguguguguguauauguacauguauauguguauguaugggaaggagccaggcuuggauaaauauaaucauccaucaugggugugcaguuggacaaaguggggugcaaaaaaaugaggaaaggaaaaaugggguggccuuuuaaacaaguaacagacuguuccagauccgcagccaguuacagcagggaauggcaaaggacucuuccaacggcuguucuggcuuugcagaaacugguuuuauuggagguuggcagcaguuuacugaguggaagaaagggcuuggcuggggcuccugccugggagcaucuaacgugcuuggauuucuguccccauguugcugagcgagccuuugcuucucagcugucuucgucagccucuuucaugguucuugugcuuuuuccucacaggguaccuuucacagucagcaggcuuuggaguacggcaccaaacucgugggaggaaccacuccagggaaggguggccagaagcaccugggcuugcccgucuuuaauacugugaaggaaguaaguaacggcuuccgagaagaagcagcagggcagagacaggcauccucuggguggggucuuaacugugcgcuuuuugccuuucuaucuggauaucagugaccaagagaaauugggauugugguaaaauccaguagugaguuuugcaagagauguucgucaucuguuaaaggaagcuccguggucuggcuucuggcuggcuccugaucucuucacugccuuucuuccagagcggugcuacaggugucagcagcaguugcagaagccccuguuucagagggggcugucaggcaggcguggugugggugcuucaugcacagugccccagccaggccuugcauacccacagcaggugcccuuauggcagcccaggaugcugcuguugcagagucugaggguucugucugucugaggugucccagcugagacgugacaggcucggacuguucugugccaucagacacuauugagaugacaugguagggucugcuuuuuucaccaguugcugguuucuuuaaggugauuuuuuuuuucaggaaguuuaaaauauagaaauuacaaauacagguuuuuaggugaaucagucuuuuuucccuuucaguuuuuuaggcuuuguaaaccaauaguuuuguucaaucaguucauauguuauucauugugacccaggcagaugugaaauuuggauauccuaaguuccuugacaaauauuguuucuuauuuuccuauucaucuuuuacaaagaacuuucggaaugaauaaucauuaauuguguaguaugacuccccguguacagcacuuguugccagcaucuguaaguauuuguagccgugagauaggagaauguggggacuuggguuuccagugaaauguuguaugccugugaucugguuggcccuggccuugauuuccauccuuugcuucauucccuuuauuguugcuuccccugccccacgaggucuucucacuagcccaguauagucuugaacccaugguccucuaguccagugguccucagccuucccagugcugugacccuuuaaugcaguccucauguuguggugacccccagccauaaaaucguuuuccuggcuucuucagaacuauaauuugacuacguuuaugaauugugaugcaaauaucugugcuuucugauagucuuaagacaaccccugugaaagggucauucgauccccaaagugguaguaacccccagguggagaccauuguucugauucguaucugaguccugagugcugggauuauaggcacaggccaccacaacaggccugucauucucuccugagagaguuaaaacauaaaugacuucuaauccuucgugucaucuauaggcgcugucagugccugcucuuuggacacuguugaggugaugcuguuuauggggacauaguggucagaagcucggugucugggagcacggacucaucccggggugaccccugaagagacugucuguggucuuuccucugcgugugcccaugcagucugucacuguaguuagacuuuguguagcaucccuugguacaaccuccgaacgcguuuugguuauggagaauccucugcuuugcugcacugagcagacaccguggagucagauauacucaggguuaaauauuggcucugcuauuuccuagccaugugauuuagugugguaacuuacuauauuuuguuuggugguuuguuuugagacagggucucuagguagccuugucuggccuuuacucagagaucugccugccucuggucugcugacauuaaaggcaugcacuaccacaccugugguauuuauuuacuguuucuugaucacagcaucuuuuuuuuuccuuuaaaauuuuuuuuuuggcagucucauauagauggaucucuugaguucagaacagcauggucuacauacuaaguuacagaacaaucccgggcgacauagaaagaccaagucuuagaaaaacuacaacagcaaaaaaaacaaaacaaaacaaaaaaaaaaaccaaaccccaaaggaagcagaagauggaugugcaaggccaccuguggaucaguuacuaucaaauggagacuaguagucagauuuacauuccguaaggcuuuguauaaaggcuuugcaucguggugggugacaacauuaaaaccuaauguuuguuuuguuaacucacauucuuacucuguggccauguauguauaugcacuugguuugacuugcuauauucuaguaaguauguauuaaguaagaaaugucaaguaagaacacuccacuuggggcuggagagauggcucagcuguuaagagcacugacugcucuucugaagguccugaguucaaaucccagcaaccacaugauggcucauagccauccauaaugagaucugaugcccuccuuuggugugucugaagacagcuacaguguacuuacauauaauaauaaauaaaauaaugaauaaaaucuuaaaaaaaaaaaaaaaagagaacacuccacuuaggcacuggggaaauggcccagcagugagguugagagcacuugcuggucaucuagaagaucuaaguugggcauuuuccagcacccacauuggacuccugacaagugccuguaacucaaguuccagaaauccaacaucuucugaccucugagagagagcaccuguaugaauguaagcucucacaggugcgugugcacacacacacacacacacacacacacacacacaccguaaaaauaaaucuauauaaaagggaacacuacuguucauuggucauauuuaccauggauuuaaaauagauguuugaaggcuagauucugaagaccuggggucccuggcccugguucuucuaaggagaaacagaguuugaagcuggauagguggcaccaggucuugugagucuggggaggaaaagugaagcugugcauagcuccagagaggagggagcacaggugcaauccuccagggaggagggagcgugggugcaauugggaagagcucucagauuuacuguccuuuuguaggguaagauguacggaaccuuuaaauucacaauggcauucagagaggcuuugcuuggauucugcucuuuuuuuugacuacgucacggacuacagaaugggggaaugaggauagccugccugugaccccuuccuaaacauuaaucaaauuaugcugcugaauauauuuuauuuaugauucaaucgguugugauuaauguuucaggccaaagagaaaacaggagcaacggcuucugucaucuaugucccuccuccuuuugcugcugcugccauuaaugaagcaaucgacgcggagauucccuugguugugugcauuacggaagguauuccgcagcaggauauggugcgggucaagcacagacugacacgccagggaacgacgaggcuaaucgggccaaacugccccggcgucaucaacgugaguguaggguaggagggaagucagaaggcuauggcuuugaauuaaaguacgugugugugugugugugugugugugugugugugcgcgcgcgugugcaugugcgugcucggguguuugugugugcucgggugugggugugcacaugugacuuagggguuagaauuuucuuuggaacuuuucugaaacugcaguuuacuuuccuccagccuggagaaugcaaaaucggcaucaugccuggccacauucacaagaagggaagaauaggugagugacucuguuacuuucugauagauuaaaacauagaaauuccacuuuccuaacucggcucacagugacggugacuguaagucaaugugucucuguaauaaguuauuuuuucuuacagugagucagaaauauaucucaaauaugaugggccucuuugagaaucacuuguaguucuguggaaccagugaugaucguggguagugguuccuuuucugcucagacucuggguucugcuguguauuuuguguucguggugaauaccagcuuccugcucacagccuccugccugcucuguggcuuuaccacuguuuauccauuuucuuaguggucaucugggcuguuugcagguuugagcauuaggaacaagacuaaaauacaggccuugcuauggauacacuuugauuucugaagggcaacauuugcuagaacacacauuuaguaugcuugccuuuuaaggaaguugccagggagugcuaggagauguccgugcuacuuuguauuccgucagcagagucccaguuacccuuccuccuccaggcuucuccucuccagcagacuugugcuugcucuuugggggaugaaacagcuuuuguugugaugccccugaugggugaggucaaagagcgccuucucagucuuuacccuugauccgagggugcacuuggaccaacacacagaggcaggaagugaguuuggcuuuuagucuaacucaggugcugccuggccuggccucauagucuacucaguuggcuccucugaaaagaauuggcugggggaguuggaagaggagggaagggucacugcucccagggagaaaaggucacucacugcuccagggcauccaauuccuagaauagagcucugggccuuuguaugaacaaagcuuuuacugggugaauuuuaauuccuugcccuaaaacacaaauuucauaagauuagauugaaacgauacauauuuggcauuucuuaucaauccuuuguuuucuuuuuucuuuuuguuugcuuguuuguuuguuuuuuguuuuguuuuguuuuuguuuuucccaagacagaguaccuccuuguagcccugacugucuuggaacuuacuguugacaagccuggccuugagcucagaucugcuucccacugagauuaaaggcaugcaccaccacugcccagcuugcuugcuugcuugcuugguuccuuccuuccuuccuuccuuccuuccuuccuuccuuccuuccuuccuuccuuccuuccucccucccucccucccucccucccucccucucuccucuuucucucucucucucucuuucuaucuuucuuucuuucuuucuuucuuucuuucuuucuuucuuucuuucuuucuuucuuucuuucuuacucuguuuuucuuuaaaacucuguuuucuuaaaacucauuaagaugccagcuaagaagcuaauccugagguagguuuuccauuagcauggcuuaaagugagcccacauuccuaggggugguuuguuggccuggagauuucccuggccccauugacuguuaggucugccuccaggccagacacguccauucucuuuagcuggagugguuuucccucagcccuuauugcugcuuuaacauccugcuuuucuacagaggcauugagaaucguguaggaccgaucagagcuccgagcucccaaagcacuugugcuaucuuuggccucuagcaggcaugaagcuaccaagaggacaucucuggcuuuuggccaauaaagaaacagcauacuuuuccuugggaucuuuuuagcccaaacuugaccauuuuaccucauguucuuaucauacuuguuccucuggagaaguaauccuaaccuccauuaugggauuaagaugaucugugcuugcagcugaauuuugggugucaggugcagcaguauugggguaccccuucagagggccuauuuaaaagacuccaacugucagaccuagggagaaaaggaaauccuugacugcagucugaaaggauucuaaaauguccaaagcaaagcccuuuagcaucucuuguugggcucauauuagccuccgucagugggacuccuuguuggucuccagagugaugagcuugcagucugcuuuacagaaucuuugauaacuguugcaauccccuaaaagucaacacgauaucugucccguguggcucugcccauauuauaacuauggacacggugagcuucaucugcaugugucuuggcuuuuccuccucccccaggcacaaguuguuacuuggccugccuucuuuacuccacuugaguguuauaugggcugagaacagaugggucugugccugccuauguaggcaggaauuuaauaccuuugggaaccaacuaguuaaaguaguuaauccuaauuuacuacguaaguagccuugugguacuuuugcccaacuagaaaaguagcagcuggauggcaucauauaaggcagucagaccuaaccaugucgcaggcuggcugugguccuuccuccacaucugccccaagguuucccagguucucugagggaacuggagauaaccuagacuuaucuucccauccugacuuaccuugugcuuaacccucuucagggauguuucuuauacugaguuuaauguccaaggcacaucccagcucuaggacacccugacaaccacaggacuguuugguguccccacagcaucucuucccuuuggccugugcacagagcagucuuggucccuugggacuuucuuugggcuggcucucccaguauuguccagagacuuccaaaccuggauucuuuuccugauuugaagaaugccaaaggcccaggacccaaaagccuuuaaaaaaaaaaagaaagaaaaaaagaaacaagaauugguaggauauguuucccagaggaggggucugaggcacucuuucaggugagcuagauuccuggacugagcacccaaauuauuagaaauaaguuuggggucacaaagaaagagacugccauucuaucugaaggcaaagguuagucuuagucaagagguucccuugggaagaaugagccaggaacauuuuuaucaguacuaugucugugucuauccgagacuuauuuugcuuccuggauuucacaaacuuucucaagaugcuaugggaagacuguacuguuacuugguugguuccuuaaggaaauagccaggccacauuucaaagcuagcuguucuaggcuugaaguuggauucucugcagcuaacuuugacccacuuagauuguuucuccauuauaauagcuaggggcaguguucuuuaccucccaccauaacuauuaauguuaacuaagagcagucaucacagugggacgacuuguucuuaccugaaaauucuuaggguugcacugugugugcuacgugagguauaacuucuggaccucccgcuguuaguaggcucaauagaaagcagaaacgggacugagagaagcagaucccaucucauuccuuugggacaguccaggaagggccugugugggaagcagcacacaagcuuucuguguggcuuggcuagguaguuggugguucuugucaggugauagaggugggcccuccauuuuaagcagaguacaugugaaaagguagggaagcgugaaggagcacgaggcccuuaggagaagggaaugguagacgcaucuagggaguaggccaggucugugcugggcuagggaggcagugcagaguuccccacgaggugaagcucugucagggagcggaguggaacucaccuaaaagaacaacugggugaugugugggagguccaggcaugcuugcuuccaguuuuacuguuugauguggagaaucugcagucuugugugccuaaguauguagggcaggcaaagaguacauuugcauagauagcauacauccugaccaugaguauacagugacagcugagacacacugcuuuuggccuaagauugaacacggcugugcugaagccgaggucaugguuagcugaugcucauggcuuuuguuuuagucagacaagaauucuccucgcccuauaggaaggccauacuguuaggaugaggucuuacccaaaggaggagauucaguaacccguggacaugccagagcuucagagucgugcacugauguguuuuaauugacaucuaaauuuuuuuuuuuuuuuugguuuuucaagacaggguuucucuguauagcccuggcuguccuggaacucacuuuguagaccaggcuagccucgaauucagaaaucugccugccucugccucccgagugcugggauuaaaggcgugugccaccacacccggugacaucuaaaauuuuuaauauuuuguaacaacuuaaaugaauuaugcuuguauauaguugggaaucccagcucugcaucaugucucuguuguaaauacugcauggauugcugccugggacuaguggccuuugggcagggcgggguggggcagggcggggcagggcagggcaggcaagccccuugaacugcucuucuaccauagacccugguugugaaguuagguguucucagcauaggcuuggugcaguaaggaaguuaaaugugagacuggcugaauuagggagggagcuuaccaacuauucuaagaaugugaacauucuuagaaaaacaguugcagggaggauguagguaguauugcuaaauacaauuaauucugauuuuucaugguuuagugaugggguaccuaaagccagucuguuccacugccuuaagcaggauaaagcuuaccaaggucauauuaauauuauccucucuguaaaaauucccaaaagagggguuuuaagguuuuuuuuuuuuuuuguuguuguuguuucuuuguuuuggcauugguuuuaaagucauaaaacaacccuaacuaaugacauacuucccuuugcgucuucaucugaagcugcuauugaucuaaguggcaaaccaugcugugaauuguauacagucuguguuaguuucaucaccauuuggccauaugccauccaugcagacugauguuuuuacucucuuccuuuuaagguaucguguccagguccgguacucugacuuaugaagcaguucaccaaacaacccaagucggauuggggcaguccuuguguauuggugagugcuuggccggagucuuuuuuuggagcauagcaauggagcauuccacucauggaaugauacagugacagggacaccagauggcuuucaguaggaaggugcuauggucucacagcuaauuugcuggugcuguauuuucuguuucucaggauuugauucuggguuaagagagugcacaggugaccagaagggugggcacugugcccaaagcuucugauauugcuuacugugaagaaauggcuccucagauuuagcauugugcuaucacaauauguccuguguuucauaguuaucgcagucuuugccucauugucucucccugggccaccugggugcuccucugagcugaagcuuuagugcguagcuuauugggcagagucaagguugaggacggcuacaugcccagggcuucucuauguaccauacaagacugcgggacacuuuaaaaagccacagcagguuuuacaguuugaaauuaccugccuuuuuguucuuuuugcugaaaaguagacaagauucuuauuuuuuuuuaaucuuuaaaucuuuagaauacaucuuaaaagccuuuuaaaaauaucucuuuguaauacaauaaaauaggccccuggaauauucaauaagcaauuaaacucaaaucgaaaacaugugcugagccucucuacuuucaggacacaguguuaggcaugauaucauucggugugauguggacucagagcuggcuuugaaacagacuugccgauuccaucuucucaaggcucuguucuccccuuguaauggaggaucaugaugccgcagcaggguuggggacucagcaguggcccgucugccccugugaagcagagcccaggacuugaccccuggcugccuccuccucagugcuauggccuguucucagcugcauuucucaaagauguguuggaacaagaacaugggcagccagagaguaggggacauuugccucguggcuguccaaguucucauuguuaaaugucacgugcucggaggagaggccugugugcaggcgcugccauuucccaacuacagaagagggcuauggagccuuccgcccugcugcucacugacagugucuucaaacucagccauuccucuguaccucuccuguuaggaacuucucugugggaagacaucuguucauuguuuuagcuuuuccuguggugcacauaaugcaaaaagcucucucuuucugagcagaguuuucagguuuauuaaguauaugcucaaagcaauagaaucaaggacaaguggcaagagacacucacugccccaaacacccauuucuuucaaggcacaguuguuaguguggaguaguuuuauggguuaugugaagaggacuggguuugugaacaugggcagccugucgccuuuuaccugcauccagucucauaagugagagucgguuugagagguuugaguggugagagccaugcgucaucugaaauacuaaagagcaggggacgggauaacaauggaguaaaacguuucuuaacguaaguucuacgcuuucuccuuacaguuuugacucauauugacauccuuugaccuucucaggcauuggaggugacccuuuuaaugggacugauuuuauugauugccuugaagucuuccugaaugauccagccacagaaggcaucauacugauuggugaaauugguggucacgcugaagaaaaugcugccgcguuucugaaggagcauaacucaguaaguauguguggaagaccucagcugucugcuccugacagacacugggcuugcuucagagguuaucuuuauuuuucacagauuucauuucucaagaaaacaugaaagcucacuuuaagcccaggcuuuuuauucucuaacacucaggauguucuagauucugaguucauuuguucccugcuucuccacuuugaacccuccccuacaggcgucacccaucauuguguaguugaaauguuggacucuugcugagaggagagaguuuaggccagaagccagaagccugaagcccagauuucauuugaggcuuauauccgcugucccugguguucuuccucuagauuccaagggaaauaaauguccuuggcuuuugcaagguugacccucuaaagaaccuuucuuuucuaucuuucucuguuguuuuuaucuccugcuaacuuuagucuuugcuuguagaaagcccucagcacugaagaucaaguagaaaagcuuccuauguacaccuggggaagucuuuguuguugccucugccuuccaguuaaauaugugaaggaguagugugcugcuguauugcugucaguuagcucagggagcuaagcugcuuugcuggauuuggccgguaagggugagggaggaggggccacaugcugggagcagguugcuguccagccuuggugaaugagucugagagcugaggagagaagugugcagugccugaguuaaguguccuuuucugcugaugacggugacaaguggucuucaggaggccaggccagcggagggugggacugcagaagaagccaggcaagaggagacauggcacuggagggguggcucagagcuuaagagcacuugcugcucuugcagaagaccuagguucaguuucccacacccacaugguagcuuacaaucaccugcaaguccaguucuaggagaccuugugcccucuucuggucuccacagguaccaggcacacacuuagugagccuguguccaugcaggcuaaacauucauacacaguaagauaaaaaauuaaaauucggaauaacuucacauuggcacuuaugggaaaaagcaaaaccaaaaccugaggaguaaauaaauuaaaugccagaagagaaauagggacucuggcaguguggaaggaggcagucauggcacugcaggccugguacguagugcaccuccucuuguuggugcuuucaggaacuuuuaaggaccgcuuuaaauguccaugucuucugggagauugaaagccccacagaguuguaagauguggcccagcucucucuaacaucaggucucuuuccuuucccuucauucccuaagcccccagcauucucguuucugcugaggacauuccuuggccuugcugcuuuggcaccgcuuggguguaugaggcaggaaccuagggagcagccuuggugaacugagcugcaguguugugcuguuucugggaagguucccaggagccuccaguuagaccucagacuuccuuugacauccucuggggcuccuauagacucccucccugcuccuacuccuggucccgggcuguuuccugcaucucugccuaagcugugggguugucuugcauucucccauccguggcagacaacucaggggucucuuucauugcucucaccccccucugugucugcagugauggauccagaucagaggccucagcucgaguacccugcgucccuccacacugagccucaucuugcucacuuggacugucucggucaugcccuacucuacucuccagccacugguuucuccccaggcccagaugccuuuuuucucugaguaaaaccaaucaggauuuuccacuucggauguaaagugccccauaagcuuauauguaaaggguguggccucuggcugcuagcacuguggagguucugaaacuuuaggagaggagcccaguuggaggaagaggcaaguucuugaagcauuaucuugcccugcuccuucuccucgcucucucugcuuacugcugcaaugaugucagcagggcgcacuuugcuuguucauaccacaggggaggagcaugcuaguguguacugaaggaacccucugaaacaaugagugaagauucaucucuucuuuuaaguuguccauucacaugugucacacuguggcaggguggcugaaggccccacuuggcacaugugaguucuugcagacucuucugccaccuccucagaucugugcccugucugauguuccaggguauggaugucagggugcugguacucuguacagccuguagaaagcacugaugaguauugcuaagugaggaggguggguuguuaguggcugucuuuuuucuuuuuuacaaaugauuuaguuuauuuuacaugcauugguguuuugccugcauucacggcugugugagguugucaaauccccugggacuggaguugcagacauuugagagcugccauaugugugcuggaaauugagcccuagguccucuggaagagcagugagugcucauaaccucugagccaucucuccagaaaaguuuguaagcuuaaguaaaaagugcuuucuauucaggaaaaaaaaaaaaaaaucugauaccguguuacacugucaaauugaauacuaaaguguauuagggcccaacucugaauucuuugaauuguuuacaaguuuaguggcaauauguguuuguuucauuuauuauuucugguuggguuuuacagagcuaguguauuuauuuuaagcagcuuaagacaaagugucacauaagagucagcagugucugccaaagaggguguuggauccacuggaacuggagucaugagcaguugugagcuggcagggggugcugagaauugaacucagguccuuuggaagaguagucaaugcucuuagcugcugagccaucucuccaucucuaagggcuuuuagcauuuuuuaaugucagaaucccaugcagugauaguuauguaaauaauuuuguauacuagaaugcacuuuuguugaauaaagucaaccuugcucauuuuucuuagaguguauaauuuuaaaguaaaaagaaugauugacugucaugcauguaguuucauauuuaagaaaguccaggucuauguuagugaugugcgugguccauggacuuacagccuuaguaggaaauugagugcgagucuugggucuuucccugugucccaacaccccucaucuuuuccuuugaggacauuuauuaaggaugagaacuauaacaacaacucaggaugugaaguaagauaagcgauugaccuugagucuuuuuuuuuaaaguagaaaauacaaucuuuuauuuaaaaaaaaagucuccaugaagcucauucugaauaauucuuaaacagcaucaguagcuauucaugaacuggcuacauuaucagauccacucucuccugaaaucucccacuacucuccaaggugcgcaacacugucuccaucuuaaaacucuccaaggugcgcagcacugucuccaucuuaaaacucuccaaggugcgcagcacugucuccaucuuacagcugcgagaauaacacugucuccaucuuacagcugcgagaaugagagucuccagaagcugcaugcucugcucaaaacuccaagcuccccagugacagauguggcgcuuggccccuuugcugccuggcaccaaagcuuacacagugucccccugcacugcccugcagcagguggugaacccaagacugcgcucuagucuagccggccaccuccugaucuugagucuuaaguuauugucauaagucacaaaacacaauuuucagguguauguacuuuuuauuuaucaaaagaaaggcccaggugcguguguguggaacagcuuaugaagugccgauggcgcugcuaccggcugguggaagugcuugcucagugacuucugaguugguguggagcucugagucuccugaaggagaggacuucagugugugcguugagugaugggcuuucccauccuaagccauucacugcuugccaacgucacagcuuugagguccaguuugacugacuuagucuucaagcuuucacaaccucucucucucucuccaggguccaaaggccaagccuguaguguccuucauugcugguauaacugcuccuccuggcagaaggaugggccaugcaggggcaauuauugcuggaggaaaagguggcgcuaaagagaagaucucugcucuucagagugcuggggugguugucagcaugucccccgcacagcugggaacuaccauuuauaaggugagcacacgauagcuguguccuucucucuccauagcucacugcucugaggcccuaauguaaaaccuuccugacgugaagagagacauuugcccuuugucauugacaaggugugcaaagcauuucagaggcaacagcauccugaauugcagccugggcuguggaaggaguuguagcuuugugguucaugauugggguguuccaggggaacccuuggaauauagccauccugacuccaaaggcaucuguuuccagagaggggcugcaauucagcaaagaagcaacaguaaagaggugugggggugggugccugaggagggcagggccgagccaugaguggcugugugguccuauccugugcccacaguuagaggagcugcauuccaccauuuggcuuuuccuuucugauagaacacuguggugcacgcucaguugauagucuguagucugcagugcucucaguaugucuucuuuaguaucaugucucuccugcucucuuuacgagaguuuuaaccuugacaaaacaaaacaaacaguagauaagacaacagcucacgaugacauuugucucuuaacaacaaaacccugucucuuaagcugaaaauaggcacaaauuauuucccuagauaggaacaguuuccagagaauucaaaauuucugcuuuguugugaacuuugcccucgucuuagggauucuaagccagacuccuuguuugaucaagucuuugcucaugugcuuucaauaucauauuccugagugguuggaagaagcgggugauuaguaaaguaugagaaaguguguuuaguugguggcuguugcugcagucugacugcuagccuguuuguuccuuaugucuagggcauuuguuuguuuuaagcauuucuaagcuuuucaacauuuuguucaaauacaaaaugaaucaguguuacguuuuagucucugagaaaguccucauugccuuauuaaagggccuuuugcaugugggugcacauuguauagguuuggauaaacaguggugcccaucagccacaugcaguaguucugcagugaagacggaaggauuguuaaagcagcccuguuugcuucggggucuaaaggaaaaagucaagcucugucuggagcuuagacugauaccagcaaaggcugauuugaaaguagcugguuuuccagcaaggucccuguucccacacauuuuaccucugcagagcugagguccuaauggugaccuagaauuugaaaaucacuuuuccaugaaugucauuugcauuuuuucuucuuuccuguuugugaaggaguuugaaaagaggaagaugcuuugaaggacacaacaagaaauucuuuaaagcuguggaagaaaucuagacgugagggccaguccaggcugucagcccaugcagcugacacugguuggucucucaguaugugggaaauccaggcaaguuuuagaauguccuaaauugagcuauuuucacuuacuguguaacagagacagauaauaaaucuaucauuugauuugaacuugg

SEQ ID NO: 3088 - RNA, 598 nt, Mus musculus
cauggcugauccucgugugaggcaggucaagaucaagacaggaguagugaggcggauagaggccgaaaacaccagagacugggucugaugggcuuuggacaccucagugucacacccccuccuacaaggcccaaacagcuccagcaagcagucagauuggucaaagaaagagugaugcacgaaaaagaagcaaagcaggaagaagaaaagauugaaaaaaugaaggcugaagauggagagaacuacgccauuaagaagcaggcagagauccugcaagagucccggaugaugaucccagauugcuagcaucgguuagaggcuguguauacugaucuucagcagauauuagaaagugaaaaagacuuggaagaagccgggaaguauaaagaaguccguguagugcuggauucuguaaagcuagaagccugauauuuuucuguaugggauuuuuuuugcauuaaauccugggguccauucuauaauucauuauuuucagccacugcuguguuuaauaauaugaaaaugugguucuuuuuaugcaguugcauauauuuuucuuugcauaacuuaaugugucaaauaaauaagcucaucuaau

SEQ ID NO: 3089 - RNA, 2125 nt, Mus musculus
gguuuuuuuuuuuuuuuuuugugccaauuuaaauaguuuuauuauuccauguuacuuguuuugggucccuguggaacaaagcuacaccuucuucuuagacugacuuaauccaccucuucaaugguggggccugaagaagcaccaccagaugggggagcuccuccaccugggaagccacuaggcauucccccaggcaugccaccuacacucugguacagcuugguaaugauaggguugcagacuuucuccaguucuuucugcugaugcucaaauucuuccuucucugcagucugguucuuauccagccagcugaugauuucauugcacuugucaagaaucuucuguuuguccucaucauugaucuugccuugaaguuucucaucuuccacaguugcuuucauguugaaggcauaggacuccagugaguucuuggaggaaaccuuaucucucugcuucucauccucagccuuguacuucucagcuucuuggaccaugugcucaauaucuuccuuacucaagcggcccuugucauuggugauggugaucuuguucuccuuuccugugcucuuaucuacagcagaaacauugaggaugccauuggcaucaaugucaaaaguaaccucaaucugagggaccccacggggugcuggagggaugccugugagcucgaacuuuccaagcagguuguuguccuuggucauggcccuuucaccuucauacaccugaauggguacaccaggcugguugucagaguagguggugaaagucugugucugcuugguggggauggugguauugcguuugaugaggacagucaugacuccgccagcaguuucaauaccaagggaaagaggagugacauccaagagcagcaaauccugaacauucucagacuugucuccagauagaauggcugccuggacagcugcacccuaggcaacagcuucaucgggguuaaugcucuuguucagcucuuuuccauugaagaagucuugcagaaguuucugaaucuuggggauucugguagaaccagccaccaagacaauaucauggaucugugacuuguccaguuuggcaucucgaagggccuucucuacaggguccagugugccacggaacaggucagcauucaacuccucaaauugagcccggguaauggagguauagaagucaauucccucauagagagaaucaaucucaauacuggccugggugcuggaggagagggugcacuuggcccgcucgcaggccgugcggagacggcggacagcucucuuguucucacugaugucuuucuugugcuuucgcuugaacucagcaaugaaaugauugaccacucaguugucaaaaucuucuccaccuaagugggugucuccagcucuugauuugaccucaaaaauuccauccucaauagugaggauugacacaucaaaagugccaccucccuagucaaaaaugagcacauuccuuucagcuccgaccuucuuaucuaagccauaagcaauagcagcagcaguugguucauugaugauucgaaguacauugaggccagcaauaguuccagcaucuuuuguugccugucgcugagagucauugaaguaagccggcacugugaccacagcauugguaacagucuuucugagguacgcuucugcaauuuccuucaucuuugucagaaccauggaggacacuuccucuguguagaaacuuuuugucucuccuuuguauuccacuuggaccuugggccugccugcaucauucaccaccaugaaaggccagugcuucauaucagacugaacaacagcaucaucaaaccuacgcccgaucagacguuuggcaucaaaaacuguguuggugggguucauugcaaccugauucuuggccgcauccccaauuaaucucucuguguccaugaaagcaacauagcucggcguggugugguuacccuggucauuggcaauaauuuccaccuuuccaugcuggaagacacccacacaggaguagguggugccaagaucaaugccaacugcaggucccuuagacauguuugcuuguguguaggcccggcugcgcugacgacaagaccacacuaaugcccggcagcugccuccgcguucaaugagcg

SEQ ID NO: 3090 - RNA, 640 nt, Mus musculus
gugacaaagauugucuaaagccacagggaagaugguggaaaauucaccgucgccauugccagaaagagcgauuuauggcuuuguucuuuuccuaagcucacaauuuggcuucauacuuuaucuugugugggcuuucauuucggaaucuugguuaaacuccuuagguuuaacuuacuggccucaaaaauacugggcgguugcauugcccgucuaccuccuuaucacaguuguaauugguuaugugcucuuauuuggaaucaacaugaugaguaccucuccacuugacuccauucauacgaucacagauaacuaugcuaaaaaccaacagaggaaaaacuaccaagaggacgccaucccagcauugagagaugaccccauuagugaaguaaacaaaauguuuuuccuaggagccaaagaacucaauaccuaaaacugagcuguguauaaacauccuaaaacuagacauuuacaguugugggcugaauaauuuugagcauaauuauauugacccaauauugacauguaaaaacaugacaguugauuccuuagauuaaguucaauugguauuguaaauauuuucaacugaguuuuuaauugacaauaaauaaaauaccacauuauacuauuaaaaaaaaagaag

SEQ ID NO: 3091 - RNA, 906 nt, Mus musculus
cauggcgucuagccaugcagagaaauuuuggucaagacaacagaagaauguauagcacaaguacauacugcuuaaaauauuauagacuuuuauuuuggaaggguagcuacaggagaaguuuacuagauuuaaaguaugcaucuugugguaccauaagcccagaaggaggaggaggaggagcagcagcagcagcaacagcagcagcagcagcagccaggaagcucuggaaaggcuucugguugcuaggagaaguuuuagaucuggguggcuugguagauuugauugguuucagcaaggaaggaagaauuaacuucaaguguggucuguauugaagaagaugauuauucaagaaaaagaccccuuacacuguuuggggcaacuuuguuaacaugagcuuucugcucaacaggucuauccaggaaaauggagaacuaaagaucgaaagcaagauugaagagauuguugaaccauuaagagagaaaaucagagauuuggaaaaaaguuuuacccagaaauacccgccuguaaaguuuuuaucagaaaaggaccggaaaaggauuuugaucacuggaggugcaggcuuugugggcucccaucuaacugacaaacucaugauggauggccaugaggugaccgugguggacaacuucuucacaggcaggaagagaaauguggaacacuggauuggccaugagaacuucgagcugauuaaccaugauguggucgagccgcucuacauagaaguugaccagauauaucaucuggcaucuccagccuccccaccaaacuacauguacaaccccaucaagacacugaagacuaauacaauuggaacacuaaacauguugggauuggcaaagcgcgugggugcccgucugcucuuggccuccacuuccgagguauaag

SEQ ID NO: 3092 - RNA, 906 nt, Mus musculus
cuuauaccucggaaguggaggccaagagcagacgggcacccacgcgcuuugccaaucccaacauguuuaguguuccaauuguauuagucuucagugucuugaugggguuguacauguaguuugguggggaggcuggagaugccagaugauauaucuggucaacuucuauguagagcggcucgaccacaucaugguuaaucagcucgaaguucucauggccaauccaguguuccacauuucucuuccugccugugaagaaguuguccaccacggucaccucauggccauccaucaugaguuugucaguuagaugggagcccacaaagccugcaccuccagugaucaaaauccuuuuccgguccuuuucugauaaaaacuuuacaggcggguauuucuggguaaaacuuuuuuccaaaucucugauuuucucucuuaaugguucaacaaucucuucaaucuugcuuucgaucuuuaguucuccauuuuccuggauagaccuguugagcagaaagcucauguuaacaaaguugccccaaacaguguaaggggucuuuuucuugaauaaucaucuucuucaauacagaccacacuugaaguuaauucuuccuuccuugcugaaaccaaucaaaucuaccaagccacccagaucuaaaacuucuccuagcaaccagaagccuuuccagagcuuccuggcugcugcugcugcugcuguugcugcugcugcugcuccuccuccuccuccuucugggcuuaugguaccacaagaugcauacuuuaaaucuaguaaacuucuccuguagcuacccuuccaaaauaaaagucuauaauauuuuaagcaguauguacuugugcuauacauucuucuguugucuugaccaaaauuucucugcauggcuagacgccaug

SEQ ID NO: 3093 - RNA, 3204 nt, Mus musculus
uagcucuugcucuugcuccuucgccugcuugcugcgugagacugaguaacugcuagauccuuggacuuccauucacagcugcgacugaacaauuguugggaauugggcugccgacuguaagucaucaauaaauuccuuuacuaucuagagacuauccauaaguucugugacucuagagaacccugacuaauacaaagaaggaaaagaaucgaggaggaggggaguggauggagaaggaggaagaggaggagagaagaacaaaagaagaagaaggaggaggaggaggaggaggaggaggaggagguggaggaggggaagggagagagggagggggaagggggagggggagagaggggaaagaggaagaagaagaggaggaggaggaggaacaagagaggaggaagaggaggaggagaaggaagaagaugaagaugaagacaacaaagaugaagaugaagaagaagaaauagaaacucagaugcaaggcccuacugaguagcacuagcaucuaguugcauauguagcagaggauggccuagucagccaucaauggaaggagaggcccuugguauugugaagaucauaugcuccaguacaggggauugccagggccagggagcaggaguugguggguaggggaacaggguggggggaggauauagggggcuuugggggcagcauuugaaauguaaaugaagaaaauauguaagaaaaaaaaagaaaaaaagauacauuaaggagugaucccucacaucucucuagcuaaagugguugagcagagcaggacugaaguuuauuuugcuacccuguguauaacuacaucaaaaaaggcauacccacaugaucauuuuguuuuguuuuguuuuuaauuuuuauuauauauuuucuuuauuuauauuucaaauguuauccacuuucccugccccccauuaaaaccccuaucucauccccucucccccugcucaccaacccaccuacucccacuucccuguccuggcauuccccuacacuggagcauugagccuucauaggaccaagggcuucacuucccauugaguccaacaagucaauccucuguuacauauguggcuggagccauguguacucuuugguuggugguuuagucccugggaucucuggggguacugguugguucauauuguugcucccccuauggggcugcaaaccccuucagcuaccuggguccuuucucuaucuccuccauuggagacccuguguucaguccagugguuggcugagaacauccgcuucuguauuugucagacacuagcagagcuucucaggagucagcaauaucaggcuccugucagcaagcacuuguuggcauuuacaauagugucuagguuuggcaacucuauauugggaggauccgcagauggggcagucucuggauggccuuuccuucagccucugcuccacacuuugucucuguaacuccucccauggguauuuaauucccccuucuaagaaggauugaaguauccacacuuugguauuccgucuccuucacaggucacaugaagcucacaugaccaucuuuaacuuacugucuuugaaaaacauuggcuauuccuuauauuuuuauaauaaugcuacucaguguucuuucuuauuggacaaagauggcacucagaagaauggaaauuaaaauaaaaauuaaucuaagaaaauggguacaauaaacucucauuauuauuaucugagcauuaucuuuaacaaaaauugaauuccccuggggugguggugcaucaagcaaccacccauuagcauggauuucuuucuagcuaccacuuauuucccauccaucuuauucugaagucacagcacaaaauacacuuuaugauccacuagcagggcucuuuuaacacuucacauuuaucuugcaaucccuuugguuauggcaacccagcugcucuuucuugcccagcucauucuuucuuauucuacaccauuauacauucuuuuaaagccuuacucuaaaacccauaaagcuuagaacacaagaucuuucagauauccacagaauuuucuuaaaacagcuuuuagaaaaugaugcuuuuuucaccaucugaaaaugguaguucuuacauuuuaauuucuuaucaucuucaauuaacuuacuuccuaaucauuaaucuguuaccuaaauauguuuuucauaaaugucuuuuuaaugucuaacuuaacuuauucauauuuuccuggcuuuugguuuacaguauucaaaacgaagucaaaugcaauucucuuuuaaauaaucccuccccaguagauuaagcugaacuguaaacuuuauuauuuuccuguauuucaucucuuauucaaauggaaucacagaaaaaaaaaagccauucacugcugagggaaaagccaacuguucuauauaagaaugauacaaauuuauugugcuucuaguccuccuaucaagcacauugucuucauuuuauuggaauucaaaaagaaaauacaugaggaaagggagaacauaaaaucagcucugugagggauacaauguaagaggaauuuaauuaccugugaauggaagaugcaucccagcaauguucaugcacacugcacaagucaguguaaaagaaacagaccaacacaaauuccaaugaaucacauguuuuauuggugcuucuuaugugauauuaaauugacauagaaguuuuuucuauagcuuuuaacuucugaaaauguuucaaagccauuaucucauuucauuuaauuuaacuggcauuaaaagauaauuucugauuuucuuguuguugcacauuaagaacagaaauaaaccagcauaauuucuauaugcauucuaaauacuuauccuuauuuccacaguugaguguagcucucaccccucaucaaagaagcuuauuuuuucuguaaugaaugaagaccauuacagaaagcaacaacuggucaaaaugcaaagcacaaaugacuauagaguaaccauuccuaacugaugauacacaauauaaccucuacaacccaaggcuccaagaacauguuggaaagaggagcagaaaggauaugagagugccaucgcaugcucuggagcuccagagugaagacaaacagaagggaacugaguaucaccaucauccucucucagccaccuuguuuaagaugcaauauggcaugacaagaggcuucauaccuuugcucucaugauguccu

SEQ ID NO: 3094 - RNA, 2447 nt, Mus musculus
uuucuuaaaaagauccccccucacgggaaaauguccacguuuaauguaaaagguuaagcacuggguuauuuacacgugccuuagaaaagauggcagaggcugagggucuucccgaggggcuccgagaaaacaguucauaucaaucaaccccauuaaauagaagcuucuguuuccaaacagggccucggugcaccagcaccagcuucagaugaggucagccacguucaugggcaucucgucuaucuggguggaguaguacugcucgaugucccugagaauccggaugucaucauucuucacaaaauugauggccacaccuuuucguccauaccgacccgaucucccaauucugugaauguacaguucucuguuguugggcaggucauaguuaaugaugagggacaccugagggacauccaggccccgagcccagaugucuguggagaugagcacccggcuggcaccugaccggaacuccuucaugauagacucucguucuuucuggggcauguuuccaugcauggaugacacagugaaauuggcuucucucauuuucucugugagccagucaaccuuccucuugguguugcagaagaugacggccugggugauggucagcgugucguagagaucacauagaguaucaaacuuccauuccucucuuuccacggccacaaagaacuguuugaugccuuccagagucaacucaucacgcuucaccaggaugcagauggggucggucaugaacuuguuggucaucuccaggaucucaugaggcaguguggcacugaugagaacgaccuguguggcugguggcaaauaccuguacacaucguagaucugcuccuugaaaccuuuguucaacauuucaucagccucauccaaaaccagcaucuugauagcccguguccguaaacuucuccggcggaucauaucaaagacgcgucccggagugccugccaccacaugcugcccguaguccagcuuccggauguccucgucgacauuggugcccccgaugcaggcauggcacugcacguucauguaaucccccagagugagcagacccuucugaaucuguaccgcuaacucucugguuggagccaggaucaaagcuuggguuucucgaaccuggauauccaagcacugcagcauugagauacugaagguggccgucuugccugugccagacugagacugugcaaugacaucucugccuuucauuaucugcuugauagcacgcugcuggaucgcugaagguuuuucaaaaccguaggcguagaugccgcgcagcagguccucucgcaggcccauggugucgaacguggggguccuguccaccuccucgcucgucucgaacuccacuuuggucauguccucuucuuugagcagccgcuuccgcgccgagccagaccucgccaucguggccguggccgccaugaucccaauuccgcugaaagaccuuaaaauuuuuuauuuacuuacauuucaaagguuaaccccuucccugguuuccccucugcaacccccuaucccauccuccuuucuucuaugaggcugcucccccacccaccuacccacucccaccucacugcccuagcauucccauacacuggggcauuaagccuucacaggacaaagggccucccuuccuacugaugccuaauaaggccccuuuagcuccuucaguucuuccccuagcuccuucauuggggucccuguaucaguuccaugcuuggcugcgagcaucuauauuauuggucgagagcuggcagagccucucaggacacagcagugucaggcucaggucagcaagcacuucuuggcaucugcacuaguuucugagugugguaccugcaugugggauggauccccagguaaggaacucucuggauggcuucuccuucacucucugcuucauucuuugucccuauauuuccuuuagacaggagcaauucuggguuaaaacuuuggagcuggguagguggccccaucccucaagcggggggaggguguguuugugggguugccuaaccucuggguauggucucuccagguucucccuccccuuugcaugguauuucagcuaaugccaucccuguaggguccugggaggcucuugcuuucauggcaucugggacuuugugguugcuguccccaacuccccaccccccauugcuacacaccucuguucaauuuccugacccucuguacaucuccuccauguccuccaucuccucccauaccugauucuuccccucuguauuagucaggguucucuagagucacagaacuuauggauagucucuauauaguaaaagaauuuauugaugacuuacagucugcagcccaauucccaacaaugguucaguugcagcugugaauagaaguccaaggaucuaguaguuacucagucucacacagcaagcaggcaaagugcaagagca

SEQ ID NO: 3095 - RNA, 3133 nt, Mus musculus
ugcccuuccuucaaauccuaucauaaagcagucaccuuuguccugacaaaccaucucagaucucuacaagagagguaagugggagcugaaugauggugagagccuugugucucuuacuauagagcgaagauacagaagaaucucugucuucacauuaauuagggcucuuagaaauagcaaagucuuccccagucauuuucugggcaaggaaaaacauuggauucuucauuucauuccagaccaauccaaagcugugauggagcugagacuacuguagcccuuuagaucuaggcaaaagugaagggagggauggccaucuuugcuuguucugucuacuacacucucucuggugcccuguuuguuguucucucaaagacaagaugcugccucaccugguccucaacaguauuuccuggaugcugcucuccugccuguuguuuguauuucagguacaagguaagucuucucugaccuagucuguaauuguccaugagcgauaagugaugagaagcaaagaaguguucuuagaauuccugugugguaauugugagggauauccacacaggaaagucaccuacacuucauccauccucuugccuucuucuauguugcuggugggaaaaaaguaucaugguauuccaucauucccugagugagaggguuucuauuugccaggaggcucucaauuaugauaguaagcauguaggagaggagaagaaauaugugagucacuaaugaagcaugcaaguagaccuuggggagaauggaguaucacagacagugaaauguguagaaagaguaaaaugaaaggaagcucuuucacacuauauauauauauuuaaauguggcaccuagcuaaguauaguaccuagcuaaauacauaacuugaaaaccagcauucagggaggaguuucaggaggauaccucugaguucaaggccaacuucaucugcacaguaaauuccaggacauucaggccugcagagaaacuuugucacaaaggaagcagaagcaaacauucaagcaacaggaucacaagauggaaagcuuagugaggcugucaccaccuuaauuguagccacccacucuacaaaaaauguccuuuauaaacauucccuugaguguuccuccccauucaauucccauucucggugucaugacaucccucucauuaucucucuccaccccaggugaagacuuccagaaggaagugcccucuccacguaccagcugccccauggguuacaaggcuuaucgcucccacugcuaugccuuaguuaugacaccuaaauccugguuucaagcagaugugagugguaaagggugggguugaagauaccagcacaaagugcaaguagguaacaggagaguagggcucauguuuccaugguuccauggggggggagcgagugggucacaauauugguucuuccuuuuuuuuucuguaaucuuuuugcucauggacaucuggaguaucagucuuucucgccuucugucccucauguagcuggucugccagaagagacccucaggacaucucgugucuauucuuaguggaggugaggcuuccuuuguguccuccuuggugaacggcagaguggacaacuaccaagacaucuggauugggcuccaugauccaacaauggugagauucuauuuuucucuguuuguucucuaggagcuaaugucucccaaacacaauuuucuguguguucucucuguguauaauguaagguggaucuagcacucaagcugggugacauuagaguaaggaauauccucaacacuggggugaaaggcugaauuauauagagguuccucauauucagcuuaauuuguuugccuauugucagcuuuuacauuuuucuuuuauuuaagaaaguccacgagugacuucuuucuuuugucuucaaggaaccuucacaaaaaguacugagagcauuguaaauuaagauuuacauuuauucauugaaaaaauagauauauucauuuuauuuguauguuuucucuaaauguaugugugugcaugaugugcuugccugauacuugaagcagucagaaaugagcuucagaucccuuaggacuagagccauagauuguuaugauccucuaugugggugcuggaagccaauccuuaggagcaggccauauucuuaccugcugagcuaucucucugccgucuacuuuuguuguuuauugagacgauacugugagaucaagaggcuauucugcaauguaucauucauuacucauuguguagcaaggaccuuguuacuccaguucuugugauuauuggcaaggaggaaccuguaggagauagauaucaggucagaacuuccaagugaaaaggugccugaacagcaugguagaauugacuaaauuccaugaaucucucucucucucucucucucucucucucucucucucucucucucucuuucucucaucauaccucuacuguguagggucaacaacccaauggagguggaugggaguggaguaacuccgaugugcugaauuaucuuaacugggauggggauccuuccucuacugucaaccguggucacugugggagucugacagcaaguucagguaagaaauggaggaagagccaucuuugcccaagauauucacacauucucucuaccacagagucugaccucacuauuaucuccugaacuagggaaagcaguaugaauuuguguccuucuaacuuucaugucucuaccuagggaaugaguucagcugaaugaaaggcucugagcauaggacaaauucuaagauacccugccaugauagcugaaagagccaaggugucuccuuucucucuccaggguuucugaaguggggagacuauuacugcgaugggacauuaccauuugucugcaaguucaagcaguagacaagcagcauccagcauuuaucaugaagcuccccaugacaagggaugaaauacaagaauucacccggcaaggcuguacuugcuuuacaguugugcaucagacuuauucugguuuucuguccucuuucauccaucuccuuccccuuacuucaggcuuuucaauauaguuccugcuuugcaaucuugcagauaaauaauaaauacaacauuuugguuuuacuuuuguguuuua

SEQ ID NO: 3096 - RNA, 691 nt, Mus musculus
caugggcaagggugaccccaacaagccgugcagcaaaauguccucauagccuucuucaugcagaccugccuggaggagcacaagaagaagcauccagacucaucggccagcuuggccgaguucuccaagaagugauccgagagauggaacacuaugucugcaaaggaaaagucgaaguuugaagauuuggccaagagcgacaaagcacguuaugacagggagaugaagaacuauguuccuuccaaaggugauaagaaaggaaagaaaaaagauccaaaugcuccgaagagaccaccaucugccuucuuccuguuuugcucugaaaaucgcccagagauuaaaauugaucacccuggcuugucuauuggagauacuucgaagaaacugggugugauguggucugaacaaucugccaaagauaaacaaccauaugagcagaaagcagcuaaaccaaaggagaaguaugaaaaggauauugcugcauuccgugccaagggcaaaagugaagcaggaaagaaggguucugauaggccaacaggcucaaagaagaagaaggaaccagaagaugaagaagaagaggaagaagaagaagaggaagaugaagaggaggaagaugaagaggaggaagacgaagaggaggaagaugaagagggggaagaugaagagggggaagaugaggaugaagaauaaa

SEQ ID NO: 3097 - RNA, 35601 nt, Mus musculus
caggcgccggacaccuagccuuaaggagacgcgccaauccuacuuggaacauggcucucaggccccagaggacuuucaggcggcgccaggucgaguccagcgauagcgauagcgauagcgacggcgcgaaggagcagagugcggaggagccggcgucugccggcggccgaacagagggagcggagcggccgcgcggggcccgcagcgcccggggccgaggucgggucugggcgaguucccgccgcagcccgggagcugcuccccgcggggacggcggagcaggugaccgagggguggaaagggcuccguugcucagauccagaggccucuauggccgucugcacccgcauugcucaaugccgggguugcccgaagccucccauagaucuugguggcacuuugcaguuugcauccucaggugacccgcaccgacuagagcauacagccauuggugugcacacacugaacccaaauccucagagagguccugaacgacuccucgugcuguuagcuguuaaauguggaugaaagucgugugagccuuugggagcuugucuaacaguuuucuaagaacaccagacagugacuaaaagaauaaggacaggguuuggaacguugucauuuuuaaaaucagucaucugcaacaacaacaaaaaguagauuaaaaauaauguaaaacgaggugcugugacugagauuggugacacuaaggaccguuccauucaugugaucaaauaccaagucauuugagggcuggcgaagccagucagcaguuaagagcacugguuacucuuagaggacccgaguucagugucuagcaccaacuuggugguucaggaccgucuguaacucugggacauuggaacuccuccccuaacccugucaggcagcagacacacacaguguaggaagaucacuguguuguacaauagauacacuaaacuuauucuuguaaaauuuuguaaccuuugccaacauacauucccacauuggcucauauuaaccaccauucuauucagugucugugauuuccuucaaauuguuuggauucuacauauuaaugagagcuuaacauaucugucuuucugugcccagcguauagcacuuaaaauaaugacuucaaggcuugggaucuuacugauuucuuagucaaugucaggggcccgguucaucuaaaguuugauugaucuuuuuuguauuuguaacaaaguaugccggucaucuguuuaccuugaguuaaguaaguacuucucuucccuccuagaucagugguucucaaauuucuuuggccuuugaacucucuuuguaacucuuaaaaauagaggucccaaauagcccagguuucuauagauuauuuuucuuuuguuaccacuauccuuaagauagugguacucggcucaaaguuuuacaaaauuaauaauuugcauugcuucaucaacaaacgugaaugaaaauggcuuucuuuucccuuucuugguguguggugaagaauacaaugacuguguacgagcugaugucacugccuuugugcugaggcgagcgcuuuuacccaccacacuuguaccuuacuacaaugucaacccagagaaaagaacaaguaacgugugucuguuacaaucaaagugguuuugagugcacacaucaccucacgagaccccgagggcugugaaggauaacuggagaccgugcuuugccuugguuggaggcagagguugucucucacagcaguagcuaagacgugagcgguggcuuuauuuuuuuccauauuuuauucuguguuuuagagauguauuuucauuuuuguguauguccaugugugaguacagugaccacagagaccagaugugucagauccccaggagcuggaguuucagguagcugugaauugccugacacagaugcugggaaccagacucaugucuucugcaaggacaguguguguucuugaccucugauucaccucucagacucuccuuuaaauguuuauuugcaccaaucuuuuugagcuucauguagucuggaauuaagaggacaucuuaugaacauguuuauuuugguuauugauucaaauauuuugacucuuucuugcuuccaucgguauccucuuagaaugcagaacagcugagcucucaacggaugaagaggaaggaacacauaccuugacaggaaguaagggugaucggaguccguccucugauagcucuugcucucuggaagaaagagacguuucacccauagguugguaauuuuuguaauuuuauauaacuaacuuaacuagcuuccuuccuuuuuuugccacaaggucucacuuuguaccccaggcuggucuggguuucauccuguagccuaaacuggccucagacucacccucugccuccugagccugugauggauggcaugaaaaagcucucgcaucagcacaguauacaccagucauuuuaauuguugauaaagcaguaaaaaguaugcaacagauaguuauaucauuauuuauuacaugauauaacugagaucagacagcuuagaaguagcccagacaaggcucagaucagggagucugcuccgcaguguguucugagccccugugcuugcuggguaguucccccucccaccuagaagcugguaagaauuuauccugagauuguugcugaugucacauguagcgugucuaaaaccugaaggaggacaauauaacauauguaacucauaaugacucgaagaggcuuuuuuaaagaaagauugcuuaguucaguuguuagcuaagcgcauaaccaccucugggccaaaucuaacccaaugcucauuaaagcucuuucagauauuaguuaccuaagucugcuuuggcauuacgauggcaaaguggagaaguuauccugggccuuacucuauagcccaugaagucagaaauauuccuccggccuuuuaaauguaaucagguguucauaacuuguuuccuucuguagagacucuuuuuuauuuuuauuuuuucaggcuagugacauguaagagcccuuugagaaaaguagcucaguucccagcacccaugucggccugcgcacaaccacucagaacuccagcuccugcagagucuggugcuuccggccuccucaggcaccagccccucacaugcacaaaugcacauucauaauugcaaauagugaauuagaucuuuuuaaaaauugagcuucguaauaagcagacauagucuggggugaauucugggugcggcacuguccaguagaacuuuuguuaugguagaagaaugucuauaucuucaccaugaguacaguagccacugccgcaagaagcuguugagccgagucuuuaccuaaguugauauggugcgauaugacuaguggcugcaguacucagcacugcuucugaggauggacagugugagggacagugugagggacagugugaggguucugaagcgcagguagcucugcucuccugaggagaagccagucgggaacaauguguggcauaauuucuaauaaucacagagaguagaguuggcaugugggugguaaauucccuucagaguacaggacaguuccacgguaaagaguugucauuccuccaaauacaccaucgagauagcagaugugcuauuuaaagauggcagggcuagguaugauggcacauggcugucacccaagcacaaagccguguguguguguguguguaugaagaauguauuuguuauguguuuggcugugagaauuaaccagugauaggcugucugccuugagauguucccuguggcagagguucuucuuacaaaagagaucacaguugaucucagcuuauuagaugauugcuugucuggugggcgaugcauacgcuaaugccacuuaucagaaaaagcacgggggugucuguauccguucagcccucgucugucugacaucugcugugugggaacuguggagacgugaggggacaggaugggaaacacagucuucccuucccugaacucugacauguaacuugggagaggauuacuuccugugacaccagcaucuccccaccaaguccugcauugagucagguccacuugauguguuguuuuccaguccacuuggguauuggcgacuaacgccgcuucauaaccccacugcuacauacaguccccuuagaggcucugcucagcuccaguaccgcgcugagaagguguuuccagcgagucccuaggguuucaguuuuuaagucuuggaucccgugauggguuuggaacuuuaaucuacuuuagacaagaauaacugcacuuauuaucagagacauguuggcuucuucucccuuacuccacaguagaaucaugacuccagauuagggaagguucgcagcucugccuggucccuacuuaaacuucaucagcaacguuuuucuuuuccaguauucacuuaggaaaagaauucagcaaaugauuugauuuaugcuuuguucauucuguuuuaucgucguuucugagauguggucuuguguaguacugaccagccugaaaaucaugaugaugcccagacuggccuugaacucccagcagucuucguuccucagcuauuuaaugcuaggauugcaggcauguggcccauggccacacauauuuuaucaugaucugcuaaauccuguaagagaauacagaccauccuuuuucccaccgauaauaaucuuuaacuaaauacugguccagcuggauguggugacaccuguauguaauuccagaaaaucacaaguuguaggccaacuugaccuacaugaggcccugccucaaaagagaaacaaauaacuaggcuagugagauggcuucuugggggcaaagcuuggcagcacuaagccuaaggaccugaguuuggucccugggacccagugguagaaggaaagaacugauuccuacaagcuguccugacaucugcauuuguaccacagugcuugcucugccccugcuuuuaguugaauaaacaaacaaguguaacuagacuuuuugaaagaacaaacuaaguaaauacugucuacuuaaaaggaaaugaauuuuuuuaaagacuuaauuuuuauucauguguauguauggguacauguggcaggugcccacagaguccagaagagagugucagauacuauggacuagaguuacacacagguggugguuagcugcccaccugaaugcugggaaccaaggugguucuugggggaaauugucaaccucucuuaacugccaagccagcucuucuccuccuugcauuuauuuauauauauguaauguauauauuauaauagauaaauauaucuuauauaauaauaugaaaaauauauauuuauucauucacugauucauucuccccacuucucucucccucucuuccucucccucuucuucccccucugucucucuccucucugugugugcacgaguaugcauaaauauaaauguguagaucagaagacagcuuacaugaaucuuuucucuuucccccugggggucccaggcgucaaacugaagucaccaagcuuggcagcaagcgccuuuaccuacuaugccauuucucuggccccaugauugauuuucuugucggugaauguuuuggauuccuaacaauugucauguauuguuucaugggugaccacacguuuuauuuccuuuagggcugaggucccugagucuuguauaaagaccgagacuucuaaaaucucuuacuuuuucuccuguguuuuaaacauuagagccuuugcacaucucauguuuucuauuuaccuagucauaucuuguauuuauuucucaaaauggggcucagaauuucucaaaauggggcucaggauuucgguauagcugagcugguagacugaaugccuagcaggcucaggauagaggaguagcugagcuguagacugaaugccuagcaggugugagauccuggcucuggauucucagcagcacacaaacuagucaugcgguccaugccugugagcccagcauuuggaaauggcaagaaaggaggcggaucagaaguuccaagucauucgugccugcauagcugcugccuggaauacauggcaccuggcaucucuaauguuucagaugcuuggaaggguagggaucucucuugccaucuuauuuacacugauaucuucuuaaaacauuuuuuauaaaauauaaaguuaauuccauucaugaagaaaccucaguuacuaaauuauaagaauucaugucagugaauauauacuauacaaauaaaaacaaaaaaaauaaagcuguauuagaguugucauuuaggggcaggagagaugcagcugaugcccucuucuggcuucuauuggcaccagguguacacauguacauugacauacauguaggcaaaacauccauauauauauauauauauauaaaauaaaucuuuguauaaauauauauaaacuaacucuucaaaagcaaaauaaaaaugucuaaaaauaaaaguuguaguuucauuuagcuggugaaaaauauuauuuucuuuacauuuaacuucucucuuuccuuucaugugagucacacuacaaaacagagaucugacgugagugugugcuguugcucugacgcucugaugggcugcgugcugucaucaucugucucuuacuucucuguguggaggagccuucaugaggaggugcucugguguggccucuacaucaggcugcugaguuuacccuucuugcuacaaucucacugacugcucagcucucauguuccuguccugacagaacguucagaaguuagagcaaagggcaauucggaauggugucugccuauuucccgaugguacuagguuagguucguuucccuaaugugcuuuuuauaucuguucuaguaauuuucuuccuuggccagacuuugagccauccaucuccccagucgcgcaagucuauguaaauggugacguuuaggagcacggugccuuguguugccuuggaugugagcagcgugcccucccucugcagcaguguggugcucacuguccucuucauuuguuucaguugagauccccgaugcagcuuuuauucaggcagcccgcagaaaacgggaguuggccaggaccccaggggacuacauuucauuggauguaaaccacuccugcuccacuucugacuguaagagaagcaaugaagaggacccagagagcgauccugaugaccacgaaaagagaauacuguuuaccccaaagccucaaacacuccggcaaagaauggcugaagaaacguguacguguuuaacugauuuaccgguaucuaaagaucaugacguuuucacugcaggaguggacuugcucuuugcucauucaucacccugcuaucuguuaugucucaaaaccugauaucggagcugcaugcagcucagcuggcagagccgugccuagcgugauggcucauucuuguuaucccagcccacagugagagcacgcgcgcgcgugugagcacacacacacacacacacguacacaguagcacgaagcugaauccccagugcacauguuuggaaagaguguuggucuugguuguuguuauuaguuugguccacagagucuuggcuuuuaaaugauacgauucuaucuuaccuauuaccucagcguauguguugugauguuaccaaugcugaauccugccccugauuuuugacagguaaaagaauuguacagacuuuuuucauuuucugaaauguuagaaauuaucuuggccaccuuuuagauuuuuuuuuuuguuagcgugaaagguucuauagaaauuuuagauaucauaugcuaagaucuucccuacuauaauaaaacuuucaucuugacaggaaugcuuuaauugcaaaggacuguucagauuucucucucucucucucucucccucucucucucucucucucucuuuuuauaagauuuauuuauuuuuauaugaguacacuguagcugucuucagacacaccagaagaaaucaucagaucucauuacagaugguugugagccaccaugugguugcugggauuugaacucaggaccuuuggaaaagcacucagugcucuuaaccgcugagccaucucuccagccccagaucucucauuuguaacauuuauagauuaccauaguuuucugcaaaguaaaacugguuccuuguacccaggaauuuuugcguguguuugagacaucaucucauguauguagguuagucucagacuuaccauguagcuaaagaugaccuugaauuucugauccucuaaucccuacuucccaagugccaggauuauauaggugugugcuugagacuuacccaguccugggaauugaauuuagggcuucaugccugcuacucaagcaccuugccgacugugcuacauccuaggcuucaggaaccauuuuuaaauguucauuucucagguaugaauuaaguauauuuuuccuuuuaaaaaaaaucacauguauuuauuuuaauuuuuauugcacuuuuacuuauuuugugugugagcucacacauuaucuguaaaugugaguguuugaguagacauguuuagucagugugcacauguggagguccagaggacuaauuacaguaguggauuuucuuccaucaugaguuaugaguccuaggguuggaacucagaugccuuuaaccacugggcuaccuugcuagcccuguuuaccuguuuuguguugugugugugaguauggacacacacaucccacaauguaagcauggaggucagaggacaacuuuugggaguuggauuucuccuccuaccauguggguccuucaggguugaacucagguugccaggcuugguggcaaauuacuugcugagccaucucgggaccucuuaaucauuaaaaaaaaacaaaccuuucauucucccagccucuuccauaugggaaagcgggcgguugaaagggagugcuggcccuggaguccaguguguccauuugaguucucacugcaaaacagugcucugaccgguuacuuaguucagaguuuggucucauuuuuaaaacgaagguaauacuggcucucccucccuggauuauuaugaagaggaaacagcaaugugaagugcuacuaagccugcauaaaauaacuccccagaucugagcacugccgucagacugggaaaauacuggauuaauauguuaacuucugguuuuaauagcaaucaggagugaggaaucaagugaagagagucaggaagaugaaaaccaagacaucugggagcagcagcagaugaggaaagcagucaggaucccggcgguaagcauccugagggcacugggacaaauuaccccaggcccagugacuucaguuuuacucugaaguuuuuguuagagugguggggacacccauaccacagugcauguguagaggucagaggacaacuuuguagaguugcuucugucuucucagugacauaaauucugcagaucagacucagaucuccaggcacacaugugcauguaugugcccauacauacauguaaauacacaauaauuucccucuuaagugaccacacugcuuacuaauaagaagugugcuucuauugaugcugcaugacuucuccacaugggacucagguugcacacugaagucuaguuucuuuauugaucuucauguaguaucuuuucccacagcaucuuaucugcccaaaagccagcuccacgaaugugcauucaucagagguugcaguuguagagacuggggaggcagcucagugguuuaggguacuugcugcucuucuugaggaccuggguuaaagucccagcacccacauggugguuuccaaauaccugaaacuuaguccuagggaugcagugcccucuucuggccuuuguggguaccacaugcucuuggugugcagacauacaaguaaaacaacguuacacauuaauuaaauaaaaagguuaaaagcaaagguugcagcuuaaaguccagcagauauggaagauggcuggguuuuccugggcaauacaugaagcuuugcuaugugcuuuugaguguacuauaacaucuucaugcacguugagcaugaacucagauucccuuacauggccuaucuuccuuucugucagcauggcacaaacagagccaccuuggaagacggaaugucagcggggaacugcauucauccaguuggacucuggacaagucuguagucauuuuuuugauugcugauuuauaugagagagagccccucccugugggcaguaccaccacugggcaggugguccuggguuacauagggaagcagguugaguaagccauagugaacaagcaagaaaacaacacuucuuccauagucucuacucuuguuuagagguucgagccuugaguuuccuuguuuccuugaugauggacuguuguuugccuuggucaguguuuuaccacaacugagaagcagaugaggauacccuguuucuaccucguacaaaucauuucagugguugccuaacauucuugagaguuggcaaaucauaauuuacuugaccauccuuccucuugaugaauaguuuagguacuguuauuuuccugcuugcaaauaagacugacuauucagauauuuuccuccuccuucucuucacaugucaguuuaggacuguucccuaggaauaauugcuaagauagcauccacccccaaucaagggcagaaaaccuuucguaggucuuuguugcguaaauucuauagcucuucaaaggaaacaucuccguuucggugaucacuguuaggaaaugucucacuacagucucggcaucuugcggugcagauuuaauggaugaaacugaaaccucuuacuuauuucauuugcaucauuacccagugugugaugaccuccaguguggaggucugucacugucugauuccuguggcugcucuaaaagcucaccacugauuugguaguaguuuacucuaacaaaacaaacaaacaaaaacaacccagaaucaaaauaugagcugaucugccauauuccagaaucucuagaagagaauucacgccuugacucuugcggguucuguuggcauucuucagcaugcgcuuguauuucucacugcaucacucugccucucaugaggacccaagcuacugugggcccuuugugcauaaucagauccaguccuacuacccaaagccgccucagauguaucugcugccauguaagacaacacugacguaaauggaaguguuaagggguuuccauuagcauacagcagccaguuacaggaaugcgcagucugcuugagugacagaugaggaaaaucccugcagugaguuucugugcuacacgucucaguguagccccaaugacguaguguuguaagaaagugggcacacgggagagggaagaaaguccucccagaagugauccuccaggcacuauuaaaagauauccaugacuuagggaguggaaaccugaaggaaugucaggacuguguugggauucgcgauuagauuggaccuggaagaggcuuggagacaacugaggugagccacaaugccugauggaaaauagaagcaguggcugagucucugguccgugucuucauguugcuugucugacaguggacuuugagaaacugcugugcacugcaagugugguaguggaaacugaugggaagggcuguaggauguucucuuaggagugcauucucugcagguucccagcccuagacagccauggaguuacucauucacaauuccucaagaacucugccuuuccacagugcaucagaauaucagcaaacuucaggaacuaacugucauggaagucagaaguuuagaauucaucaugcccauaugaauuuaauagucucaaggcuagugcuguagcucagcgguagugcaccuaccuggcauacaugaggcuauagguucaguccucaguacugccaagcuggggguggaguggguggaaguugcaguuuuugguuuuguuugauuuugguuuugguuucuguuucucuaggacagggucucugugugcagcccuggcugcccugggacucgucuauagaugagacagacaucacacacacagagaccguccugccucugcugucugagugcuggaagauaaggcauuugccacaaugccuggcuggaaaaauaggcaugaauauauucuaaaacuguugggagauuuaaaaaauguuuuauugugauugugauauugcaaagcauuggggcuuuacucaguuuuucuuuguaugguaaaugaaguguuuuuuaaaaauaauuuuucacauuuuuuagggacaaaauacagaccuuucccacagcaguaagucucaaacccugaagaaguuugauacuuccauuucauuuccaccgguaaauuuggaaauuauaaagaaacaguuaaauaauaggugaguaaugcuuauuuuguaauuuauauuuaucugagugacuaauaguaaaaaaagcauuauguucuuuaaguuauuaaacauuaauauuaaacauuuaggaaaaauaaaucuauuauuuuaucauacacagcagauuuucauuuucuuuuuuuuuguuggucuuaaugacaaauacccuuuacaugauuaaaacuauuaauuccauuuuuuuuaauaugacuauaggcauuuuucuacacugcuggauuuuugucuuuaaagacauggucuuaguuugugccccagcuggccuugaauuccuguccucugaguuccuaaguuauaagaaccucugcuucacccaugucucaucaggauuaccuucuacaguauuaccuagacacaucucauguuuguuccuauaguuaguucacuguaauuauuucucuguucuaagucucaucucugugucacuauaguagugaacauggugcuuuguuguugcuucuguuuuuugagguagggucuuuuucuauauaacucuguagcuguggcuggcuuugaauccaugcuccuccuaccuuggccuuccuacuaucacaggcauguacgugacuguacuauuggcuuuuuguguguaugcauguggguuuuguuugguuuuucuguuuuggaguuuuguuuguuucuuuuguuuuguuuucgagacaggguuucucuguguagucuuggcaaucuuagaacucacucuguagaccaguaugacuucaaacucaaauccaccugccucugcuucccaagugcuggcauuaaaggugugugccaccggacccaaccuuuuguuuguguguuuggcuuuuguuuuacuacauuaauaggagaaauucaccaugacuaagaguuuacuuauaugauugguauggugucuucugaaagcacaguccuuuuuuuuuuuaauauuugggcauugauaaguacugaagcaaacgguaauuaccuaaugaccucccauuuucuauaauuaaggcauguccugucagaaacuguuuuaaguauuuuauuauauaauguacagagcaucuauugucugccggucccuguguuuaucaaguaguaggugugauggucaggguuugauuagccuauaugauaguuuauuaccaggagugcauucaauuaugcugccuuuuaaagaacauccucauuuuuuucuccaagauguauguacgcacaugcauggcacauguguggagucagaguacaacuuuguggaguugguuuucuccuuccaucucucuguggggucuggagauugagccaauggcaucaggcuugugcguuaucccugagccaucucacuagcucaagauguguuuuguguacauuugaaaauagguucaaauuuuucuauaucauaagucagcuuuaaaguaauucaauuccuuaaucauacuacagaaugugucacuguaguuguuugauuaaauggagauaguuuuauagaaaagucacuuuauauuuugagauaaauauuugaaaucuucagguguaccagcacuguguaccagucuguauucugugggguuggcugacuccagcccacgcugugucuguaaaugaaguuuuauuggaacacaguuuagugcuuccuguuggugauauagcacagagcugaguagcuccaagagcaauuauauagcucuaaaagcugaggcuguuuacuuucugaccugcuacagaauaaggcuuagaccuccugagugaguguucucaaauagcgaugcugaguggaauuaccucaacagauucaacauuguuccugaaguacauucauuaucauuuacugguguuuuaauuggcuuuccuuaaaaauaaaacagaauuaaagcuguuacauguagaauuguuuauacagcagaacccguaugguguuccuugaaggacuguguuugagagaaucgccuuuagagugagaauuacaaagacagugggucacguagauuaaugguugagauccucugaccuaaguaacugcuacuuuuagcuuuauucuauuuucaacucggaucuuuguuuuuguuuuuuacuaagcaaguauaagaugguaccaaaaaggauguuggcuuuccgaaggaaacaguuugccaccaguuuuuuauauuuucuucugugcccugugcgugccugccuuuucacugcucuagcuaguaacgcccacgcuugggagcuccuggugccgagacaaggccucucacugccccgggacuuuccaagcagguuguggggauuacaggcgugccuccaugccaaccuuccuggguggcauuggaguucucacucagguccuccugcuugcaaggcuggcacuuuccugacugagccuucucccagcuuagcuugcacuuuuaucuccauaaaguaagggaagguuuuuagacauguagugugucuccacuaaacuuagaaacacgauauacugcuuaaaggcuaaauuucuuuucaggaccagguuagcaggauuaguugaauuaaguuuuuaguucagauuaaaguccauauacuuuuaauuuauuucauugucuauugauuuguuaauccuaaggcauccauagaguucaaaugcuaauaggauauauauucugauucugugaaagaaauauguuucauguguuucuguuggcuugcgucugugauagguaacauaguuuuaaaagauaaacagucauugaauugaugugugugauauucuucagagcuggaucaagucugcugucuucacuuuagcagagcaguguagggcucaugcaacaggaaaggcaaugguccccauguacagcaaauucuuacuggaaaauaaucaccccugagucacaaaccagauaaguuauaccaaaccggacugugccuagauggugcuaaugccaggucggucaguuuuccaagcaagacaacagauuuguaugugcuccuuuguuucguaugaaaccuuuggguauucuuggaacucccuucauuuauaaguucuggucaaucuuagccuaaaaccaagucaucuuuuugauucuuagugaauucaaggccaguuuggguuagagacccaguuucaagaaaaacaaaauaaaauaaauaaucccuguggccaccuucuguugcuaagucucuuuaggugguuuuuuguuuguuuguuuguuuuguuuuguuuuguuaucuuuuccuccugagaacaguaauuguggucucucuagcuucacaagucuaauaaaucaagguuucuacaguaaucacuaugucuguguuugaaaucaucuuuauuagaguacugcuuaaaaggaagagaaugaaaaaugaaacuucuauuuuuuuaaauuuuauuuagauuaacauuacuacaggagucucaucgcucacaccagagagaauaugaaaaauaugaacaagacaucaagaguucaaagacggcuauccagaaucuugagagugcaucagaccaugcucaaaacuacagauucuacaggggcaugaaaaguuauguggaaaauauaauugauugucuaaaugaaaagguguguauaaaauaugcaugaauagagacucccccugcccccuuuagucaguuaguaaagaagagacaggcucaguggguaagguguuguguaauuaugagguccugaguuuugauuccaagaagcaaauaacagaggcagcagugauguggguuuucagcagguucuuacugugcaacccagggugacuccuaauucccugccucagccucugacuucugggauuauagucaucugcuaccucacacauuuaccgugguauugcucauccucuugcuguuagacaugggccagcguauucuccagaaugaagggugguuuauuacuuugcuagauuaguaaaacuggauuuuguaaaauguugauuuugaugacagaaaaaaaaucuuuguaugauuagcugcauguaauuuugccugugaagaaggccacagucugaagcuuaggcugucuuagagcuugcaguguagccgaggucggccucauacuuguggauucucaugucucagccuccugagugcugggauuuccgcggugugagucaccaugcccuguguagaucucuuucuucuaaauucucuugaguccuuugcucuuucacaccucgguucaucguggcaaacuuuuuuucucuuaguuuuuagugaauuuaaacaaaugguuuaaaacauuuuuuauuuaauuguaugagugguuuugcuagcauguacauuugugcagcacgcgcauucaguuucuggaguccagaaaagaacaucagauccccuggaacuagaguuacagaugguuguaagcugccauauggaugcugggaaccaaaaugugauccucuggcuggaagagcagccggugcucuuaaccacugagccaucucuuuuccagucccuggcuuagaguguuuaaugcuuauucaguaugaccuaaaauuuacacuuuuauuugugaugguucuuuaauaguuguauguuuaaaauguuuacaccaucagauuuuuuaaucuuucauuuacuuuguguugugugcacacucagugcugacuugggauccucuauuaccuuuuugcaagguacuuuauuuaagccccaguacuuuaaaagaaagcgaucguuaaaguaguuaaauucuccuauaucuauccauaaaauauugcuuugucaccauguugucaguugguacugugguguuuuuuacaguguagauuuuucuucauucauccuugaauuacacuucugaaaugcuacuggcccacauggacugcuguagcuguauuccuggaagcagcagacaugaaguaacugcuccugagaaggaggauuccaguuucauccagucacacauucuggagcauagcccucuuaucugucccuagugacucucuuccauuuaucaaguuuauucuggugccgggacucaaacccggggccuuagacaugcucagaaggcauugugcacucagcuauagcccagcccgguucuucagauuuucagauuuugcccgcuuccucuaguaucuccuugcuaucugucagcauuucccccucagcauucucugacaaggauccuuccuuuuauccaucucgcaagcacauucuccucaccccauaucauuugauuucauaauuugugacuugcacuaauauuggaacuauuuauucaagaauugaauguauacaugugauuacaaauaauaccuuuuauacuuuuuauaauucacuauuggugaacuccagcacacuacuuuuguguuucagauugucagcauuguggaacuagaaucauccauguacacguugcuuuuaaaacggucagaagcacuuuugaaacgcaggcaagaugaauuaaaaugcgaaucaucauauuugcagcaguuaucacguuaguguuuuuuuauauuccauuauuuguuaagcuaaauuuucauggagaauaaaaauauuuuuaguucuauauuuaaaaagaaaaaaaaaaagcuauuuacuugaggggagguuauuauugcuaugaagaaacaccgugaccaacagcagguuagggaggaaaggguugauuuccuuacacuuccgugucagaguuuauccucaaaagcagugcgugcgggagcucaggcacagaaggaacugggagguagagcggaugcugaggccacgcgggugcugcuugcuagcuugcuuuccgugacgugacgugcuuagccugcuuucuaauagaaccguggacugacccagggauggccccacccacaauggccugggugcuccccaugaaucaugauuuaagaaaaugcccuacaggcuugcauacagacagaccuucuggagacauggaaauucucaguugaggcucucucuucucugaugacucuagcuuguuucaguuugacacagaacuagccaguacaaaagcuuuuucuauauuucacauuaauccuuuaccccgcaccuggcauuugaaggaggaguuucaguauaccuuguuuaagguuaaaaauaaauaugagacucuccagucacuuaagcauuugagacaauuuuuuuaaguguauuuuucuagguacgugugugugccugaguagauguaagugcauuauaugagugcaggaguguucagacguccaaaugguguaaguuccccugggacuggcaaucucuagacacuuagcagccauguagguacuuggaacugaacccuggucaucugggaagacaacuacugcucuuaacugcugagccaucgcccaggcuccuugacacagaguauuuauaugccauucagugaacagagagugguuggacauaacuccccagcagucgagcucuguaguugaaggacugcacagaugggugagccucagcagaguugguaaggagugaccucucagcuuccucacgccacacuacugcugcugcacucgugucuuagcuugggugcuuagggaaugaggucccguguggcugacaaggaagagugaaguggcugucaagcucccacccacauuuggucaguuguaaagaguagagugugcugaaauaaaacgggacaugguauaaauaagauguacgcaguauaacuaucucuaguauaaugacuaugggggaaauugggguaaucugcuagaaaagacaccugcuaugguaaacggcauacaccaggacgguucaugugcuuaggccaacagccgugaugacugaacacugagaguuaauggacauugcauuguauggcauaacaaaauguacauuuugagcacauuacuuguucuuauacacagacacagacacacacacacuucaugaaguuaccuguagcuuuagugauucaccguuuugagacuguaguacaaagcuaauuuugugaauuaacaggcaaagaugagacaucggcaaauggaagcuuggcuguggaugaaaaggaucaacggauuuuagaagagauugaagcucggagguaucuguauaaagugcagacuuaacacacugagcacggacuuacuacucuuucaguagaauuagcuaugugauaaucacccagccuggcaucccaguuuucaagaaugauguaagaccaaagcugaguuaguucaucuggccuccagcucagaaacaaacuggagcucagguggaauuggugagguggccuuuguuagagaauugcuuugaacuagaaaucacuuguaacaaguguacucucuuuauagaaguaggaaaucuuuauauucagagaauggucuaagcugaacauuagaaccaaagcggcuaaagaagcaguguccaagaauaguuacauaaaaugcugucaguacaugauguguuccauuguaaaauacuaacauuguugccuuacuuuacuuuguugcacaacacaggaugcagagaagacaggccagggagcucucgggcagcugugaccaucaggaagggaugucuagugaugaugagcugucuccugcagagaugacuaacuuccacaagugccaaggucaauugccaagauucuaaccuauuuugagauguugaaauagugaggaaggcuuuguuguggcugccuuuaaauccauauuacuaagacagggaaauacaagaaagauguaaacauuuucugcauaagauuugcugccccguccacccagcaggggcauccacaccucuaauaaaccuuaccaaaaaaaaagaaaaaagaaaaaaagaaaaccuuggaaaaaaccuugagaaacaaaacguacuugccaguuagugaaaguacagacacccaagaggcuucaggccuccaugcugacuggagaguucacugagaugcacaguugggaaguugacaaaugucugguuugaggguuuaauuuaaucagcuuugugaugcuuuuacuuugaguucauuauaauaaagugccuuuuaaaguaguucacugacuuaguugugcaaguuacagaugaugccaucuaaggaaagcaacgcagccacagugcccacuguaacccagcaggcagcaacaaugcgcccugggagcagagcucacagcacugccuguccagaggcagcaagaaguguaugguauuuuggcauauauacaggaacucaauacacaguaggauuuauuacuguugauauuaucacuuuugguauuaaagugacuuuuuaaauaaaaugaauauaugaaauaacaaaaguuuccagcccaguugguuagguagcaacucgugacuguugguaaggaaacaggcuuaaaaugcauaacauaaagagacuuacuuuguuugcaggugacauuuuacaggauuguaagaaaguuuuugaagaugugcaugaugauuuuuguaacguccagaauauuuuauugaaauuucagcaguggcgagaaaaguuuccugauuccuacuaugaagccuucguugguuucugcuuaccaaagcuuuuaaguccccugauacgaguucaguugcuugacuggaauccucuuaagguaucaguguuucacaugugacuguccuggucaugucaacugcuuuugugcccuugcugucagguuaggucuaaacuaucacaaccuuagccuggcagcauggcucagcauauaaaggugcuagcugccaagggcuauggccugacuuuggacucugaaacccaugugauacaauccuuuggccucuacacaugccaugcccuuccacucccuucccccccaccccccccacccccgcaagaaugaacaucauuaaaaagcaaaaacaaaaccauuuacccuuaaaguuguagauaaaauuuagagccuuggaacaacuguccagaaauguacgcuaaacuguauuacuugggaugauuacaugauugggggguggggggguagacagagacagggacagacagagaaaaguuggaguaaaaucuagggccuucuugugugcuaaacaaucaucaaaccauugagcuacauccccagccaucuugcucgauucuuaaggcauagcaggaccaaacaucaguaauucaaacacauuuuuaauauucuuauaauugugaaaauuuccccagaauuuugugguauuaaguuugguuaaauuugacuuaaaaaccuguucugaggauugugaaguuggagaugacaaacuggaaagaguuggguagcagcacacugcggaggaggagggcuguaagagaggccuagggacaugcgggaauuugugggauacacugucuugaaaguggggaaaaaauggcaguucagggugagcacccuggccuucaaaccuagauucagggcugagagcuuacuuauggaaguaauaggaaaugugauauagggaugguaauguggcguuguuuuuguuuuguuuuguuuuguuuuguuuuguuuguugagacaggguuucucuguaugcccuuccuguccuggaacucacucuguaaucaggcuggccucaaacucaagagcucugccugcuucugccuccugagugcugaauuaaaggugugcaucacuaccgguagccugguaguaauguggaguuuuuaaaauguuucauuacauauauacuguguggcuguguguacacaugcauggcacacauguagaggucagaggacagcauaugcgaguugguucucuucauuauaugagucucaaggauccaucuuaggucaucagaccuagcaagugccuguacgcuccgagucaucucagggacuugaaaguaauguuuuaggaagccacuaaaccuagcuggauccugcaugcuaugaaugaagcucucugaggaaagcucugagcaugagcuuacagaguaaaugauggagcgagcgugucagcgucuccuccuuggucuuagccaugugucugcaggcuuccuaggcccacaccaccuuccagaguagagcaaggucaucucuuuggaacuauuagggaaugcaugggcagcaccuggaguuagccauccuggaucauuccucuagaaguaguagcagccauuugcuguuugcugauuggcuaacaagcuaagccacaugcacauuacacauuuauuccuaagugaaaggacugaagucaacuuugcuugaggcagaugaaugaauuuuaccagugaauuccaagugccuaacucaaacacuuauuucacucuugucagagugcugccauugcuggucucugcauguccuggcacauaguggaccuuugucacauuuuuguuguaugaugaaugcaugaaacacaguucuuaguuauucugccucgaugcugggaugccgugcuuccugccuuaccuugguggccuagugggguaaacauaguauuaaaacaugugauuauucucuuugagccuuagggaaagucuagggauuucggaauaaguuaacuuacaaaauacacacauuuaagaauguauaacuuuuaucaucucaucucauagauggacuccauaggucuagacaagaugcccugguucacagcuauaacagaguuuauggagagcagcauggacgauauagggaaggaagaugguucugauaaaaaaaucuuggcugcugucaucaacaaaacaguuguuccucgacuuacagguaaucuuaauucuguuauaaucacaaagaagcuuggagauaacaaggaaauacuguauuaaagagcaauaaauuucaaauugaccugcuuggaacaugcuuguuugcacaauuguuggcuguccacagcaguagugguaguauuugaauauuuuuaccauauuccagagaaaugaguuuugaacuugacuaaacuuugaagaugaauauucauucugaugauuuucuuuuuaccucucauucuugagccgaccaucccauggcuauugagcgucgguucucuguguucugaagacagcacucccagggugugcugaaggagccauuguugggcacgggagcgggagaacaugagagugguucugggguuuugacucaguugccuuuuccugacuugggaaucugaaggagguaguuuagaguggaaguggcgaguggcgcucugguggcugugccagucacugaguggggugguagaugguuguugaguauaccagucagaggaguucaggcaggaggcagcugcgugugggugguacugaaugccacaaagcgaugugaaauauuaaggaagugaaugcaggaaggaaugagaaagaaauuaucucaguccuaagggccuuuuagcauuuaaaagccacagaagugacaaguaccagccaagacuagagaggauaccaggaggacagucaaaagaaauuaugucccaaagucaaaaaaaauauuuccagggagaaaggggccuaguugugguuguugauuaaaaucacccuuuggagcuuacuguacaaauguccugugggacuugagagaugcacuugccacucuguggaaauugagaggauuccaggaacaaacaggaagaagauuaggagguagacaucuaggcaguacuuuauuuuguuuuaaaaggaaaggaaacaauggucaguacuggagaaaguacuagggggcuggggcuggaagauagugcaguguuuaaaacucuugcccucaacagugaggaccagcgcccggauccccagaacccacauaaaaacaugguaggcaugguggcuggcauguaaugccaaguguuuguaacauggagacaggaucccaauagcaagauggcaugccagacuugcagccauuggccucaagcuucacacacacacacacacacacacacacacacacacacacacacacacacacacacgucaacaugcauacauagcaugaggacagggagaagaaggaaggagagaguuccuucaacugaaagaaugaaccaggaaaaucaaccagcaagcaagcaggccagggaaguaauugcugccuaacauggaggcuuacuugaauuuuggggauuugguuugguauagcuuucuuuacagcuacauuuuaacugcauauuacaggaagaguuagugagaaggugaaucuagugaggguuguagguuaaccugacagguggagcaaaacccaaggaagaauaauugaggguaugugcagaggaaaugguaaagauagaaauuggagcacaugcaaauagugucaugaugagccauggauuuaaccuuaccauggagugggauaggauaugcuaaagacuugguuauuugugcgugaucuaguaacuuguguaaccacugaauguguuucagauuuuguagagaccauuugggauccccugucaaccucacagacaagaaguuuaacagugcacugcagaguggcuuuugaacaguucgcuucugaaaaugaaguuaguaaaaauaaacagguaaugauaucugcagacuugggguuuagcucaaugacagagugcuugccuagcaugcaagagacccgaguucaauuuccaguaccacaaaaguaaauaaaauaauguaugcaugcucagauucuauugcguggagauauuaccuagaaagucagaauucaaagaauuuaaaagaugggguaaaauaaaauuugaguuuuguucuugauguucuaaaaauugauauaggucucuugagauaaauaguacuuaugguuaaguggaaaaagaaaaacaaacccugcucuucaggaaaacugagaugggacuaaaccaccaagaucugccugccuugugcugggauugcucgcaugugccaccauguuuggacuccccuuagacacagcuaguacuacaaugggucaccacuguuggguuuuguuguugcuuugguuuuguucuuguuuuacuccuuauugauuaaauucguccucugaccauuucauguguauguaguacauugcuuacucuccccuccccuucacauauacacccaucucuugucauccccuccuccucccacaggucccuuucuauguucacaucuuuuuguuuuauucuguuuugcuuugucuugugcccaucuaauucuaaccaggacuguguaugcccauggauuuagaacuaucuauuguagccuauggacugcaguaauuguccuuucccuggaaugcaucaguugccaguaguuccucagggaggacuagggcccuguggccucuccaauccaugacuggcucuuggcaggcccggucuugugugggcagccucugcugaucaauucucauguuugcaagggcugugccaugaccugaagacaguauuucauaucucuucucccugucuucugcucuuacauccuucccauucucucuuccacggcauuccuuaaagagggugguagaaauguccuauuuagggcugagcaugugaguaucugcauucaucauuguuuacugcaaagacaagcuucucugguuaagugugaguaucacgugucuauggguauaaacauaaauaucuaggcuguaguuugauaccagcuagcuaaaccauaguggggagguugccccuaggucuaugaucucccaaccaccggguuucuaguaucagauacuaccaucuuaguuuaugauucuguacaaguugaauacaaggucacgaguuguauuccagcaguuccauuuccuuguguauaccuauuaacugcucuuacacacacugagacuucugcaagguauuuuauagcuucauuaagcacaaugaacccucuaauuggaaaccaucaaaugucuaaugaguaguauucgugcaacaaacugcaguacagcagugagugaucuagugacaaccacaugcaucuccuaaguucucacaguauuaaaacgucuggcucuaacugcagaccgauuugcacuauuaaaauuacuugauuuaguuauuauauuuauaauuauggcuugcugaugcuuuucacauuuuuaauaggauuuacuuaaaucuauuguugcaagaaugaagaagucaauagaagaugauauuuuuauuccucuauacccaaagagguaagagcucuccauguuuauacuguuugagauagcuuuucuuuugaggauaguaggguaggguaagacacagccugguguaccucaggcgguccucgaacuguagccacccaaugguacucccaggguggaaguuggggggcuuggacaggacuuugagcuuccugauuaucugagucaggaagagauaagaauccuacgaauaaaaauacgucccaguagguuuuguucuguacucuuuuagguaacuaauauguucucaugguucagaauaggagugcgguuaaguuauauuuaaggcagucguuucugagccuuuugacuaaaaucaagcauaucuuuaaaauaauaaaaaaggggggguuguuugcuuuuaauuuauauauugugagcauuugccuguguguauguauauguagcaugugagugccugcagaggucagaagagagcauuagcuccccugaagacggaacuacaggcaguugugagccacugugugggugcuuggaacuaaaaucuacauccucugcagaaacagcaaguguuuuuaaccaucggacuauuucuccggucccuaaaaugagguuuauuuacucuuagacuucugaguguaguagauuuuugccauucaucuuaucucugcugugaccuuaucacccccuccguguauagcaggugaaguauauuauaagcagguacaagcaguuuuguaccuuuuucacuuaguagauaguugaagucauuucauauccuuauguaaguaaguuucuucacuuuuuaaaaguuccucaauaggcauugucuugguuaggguuucuauugcuucaacagaacaccauaacuaaaaaguaacuuaggcaggaaaggguuuauuuggcuuaagcuuucauauuucuguuucucaucgacggaggucaggacaggaaccuggaggcaggagcugaugcagaggccauggagggauacugcauaccggcuugcuccaccugcuuacuuauaaaagccaggaccaccagcccaggggauagcaccacccacagugggcugggccuuucuccacuaaucacuuauugagaaaauaccuuacagcuggaucucguggaggcauuucuucaacugaaguuccuuccucucuguugccucuagcuuauguuaaguugacacacaaaaccagccaguacuggcauguugguauccuguaacugaccagcacaugagugguaaucucuuacuagcaauaagauuauaagcaaacugugcaaaggcaaucauaucuacaaaacucacuugcagaaacccacuguuggcugacuguggaugcauuuguaauucuugguagauaccaucagagugccuugauucauuuuucauugagacuguuuaguugcuuaauucaaacaaacaaauaacagggaccuggagagaucacggguggcuuagaguguccagugcucucccagaggacuagaguuugauucucugcaccucgguuggacagcucacggccaucuguaacuccaacuccauggucacccauggccucuuccagccugugcagccacugcacucauguguacaaaccacacagagauauacaaauguacacagaauucaaaacaaaaacaaacaagaguccuacuguugaggcuuuauucugagagaauaaugguccuguguauucccuccccucccucuccccauuucuuccuccuuccucaccggucucacauuagcucugaagaaggaaaaaugucaccacacuccaaguuccaagaaagacaguucuggggagcucuaaagguaagcagaguacuguucuuuaaaugugucuauauuaaucuuugcagcuaaauaauauuguugaaccacuccacucugccacuacagcacaaaacacucacaggcuaucaguaugcaagcaaaugaacuguguuuggauaaacuuugcuuaacaacaccaaaauuugaauaucacauaauuuucacaggacagccagggcuacacagagaaacccugucucaaaacaaacaaacaaacaaacacacaaacaaauucuauauugaauuuguuguguugcguuguuugagacagucucacuacauagcccugacuguccuggcacuugcuauggagacuagacugaucuuacacuccaugguaugccuuccugccucugccuccugugcacuggaauuaaagguguaugccaccuguagucuguuuuguuuuuuaauauuuugaaauguccuuuaaaaauguaaaagcuguucuugucucauggacacuccagcuaaauuuaauuucggugaccugauggucaaaaagcuacaguuaagacaaauccaggccgguggagguagauauaaggaggucgguuguuuaaggacuccacagugacucacuacaggugaggaacacaagucugucacagccaagugccagaugcuggcacugugugccuguguucgucuuagcuuuuguaggagauggagggagggagcuuggagagaccgugaagucuguguuggauauagcaaacugcacacaacuguggagauggaaugaauccaagaacuaaacugugauuuaaaugccaagauaaagggucccaggguacugaaauguccaucauguuugagaauacaaggacguaaauguccuuagcaggagcaguuucagugcagugaguguacgugugucauggccaagucaggaagaugcuuuccccggacaggcaggcaggucagcgacagugaagaguagugugugucagucuccauucagaauacuaagggaagacucagaauucagccuuccaaauaaaaccaguauuuacucguagaucucacuacagggcacuucauccccuuuaucagcagacuugugccuuguucuguuuuacacaucagcagugagguuucuggcauugccuggcuucccacacauggguaccagccuugacagugcuuucugguccuggcaaccacagucuuacacuuagugggccagacaauagggaggauggguuacaguggggcgcugaucuggagaggcuccgguggaguuccauggggcauguugccguugguuacccuagaguggaaauaggaugagcacaugcauggaggcgagagucggguauucucuuggggaauuuuuucucuuccaaagcugacauguacaacaaggccagcuaguagugagagucggggagcucgaccaguucuuuaugucccacuauagcugcuagggaggacacacaugauuacuugguguuuucuuuuagcucuuccgaaauauucuucuuuggaauggccuucucccagaugacaccuugcaagaucugggacuggggaagcugcugaaucgcuaccuuaucaucucucuuacuaaugccgucccuggaccagaugugguuaaaaagugcagccagguaaguuguauagagaccaauucuaauuauaacauuuuuauauauacugcucggcgugguagcuugcaucucuaacuccagcacuagagacucugaaguagaggaaguguuggaagcuccagacaaccugggcuacaggagggugagacccucucaaagcagccacagagcaagagcugagauuaggcaaggguuggacagugaaggcugcaugaggaagaccugaauuagcucauaauccccaccccuguaacuuaagcacugacggggaguccagugcccucuucuggccucuucagaaacuuggacauacauacacaaagacgugaauuuauugaaaucuauauuguauuacaaucaauaauuaaauuguggagcuugcacaugaauaaacaaaugaguuucacagagcagaacccagaagcuauuuuaauauuuaagaaucaguauucugguuugaaagaacaguaguggggagaagcauuuaguaaaugaugccaggagccagcugcccucugcacacaccuggggcucagugcuugaggcaggaagggcgugugcucaagacaaaccaagaagggagggaggcagggagggaggaaaggaggaagggagggagggagggagggagggagggagggagggagggagggagggagggagggagggaggaaaauaggaaggugguuguuguuuuaggaaaagggguuauuucuaaauggcagaagaaaugggaaaaggcaauaaauuuaugaaaauaauuugacaaauaugaacuggauaaaaaaagaacaugucgaaaagguauggagauaaaguugucauuaguaaguaaacuuaaaaguguguucagguggcuugcuguacuauucuuucuccuguaacuuauauaugacuuuuuauauacuaaaaaauuaaaaagaguuaacuagauuagaaacuaggaaaggagcuauaacacauaagauuaaaauccacaucaaauuuaaaaagccaguaaauaauuuaaagacuguuauuggaaaugaccccaaaauaggcaagucaaaucaccacaaauggguauagaaaacagucuaccaacugugccacaaugguaacaccagcagagaaugcuagugaacauacugugaagacgcacaggaaagugggccugcugcuauuauucaacuaaaauccccaguugugaggugagccugggaugcugccgaucuggggcuguagaagccuguguccugcagugugggggcacugguauuggaaaacaagucuguuacugccaggagcaacacagcucuaaguauuuaucuuaggacaaaagucagacuugcacauacugauuuuaagcacauagaauacuguaccauuaucugauagacgguaacccacgcuaccugcauuaguuacuuuucuuuugcugugauaaaacaccauggccacaggagacaaagaaauuaguuuauuugggauuguaguuucaaaagagagucuauaauggaggggaaggccugacaguaggagaacacugggaguucucuacuugagucacaagcuggcaguggggccaggcugugaaucucaucccaucaucccgugaugugaugugcacccuccacagguucuuaacgucccaaagcagcaccaccuacccagggccaagauucaaaguuucaaauguuuguaccuagaaaggguguuuuugugaaaacacuaaaauacucaauuugauccacccauaauguaaaagucaugguguuaaauggugcugaggaacgcgccugcaacuccaucauuauaguucuuacauucaaaucauucucuggguggacuguuuccaaguugacuguaaaggucaacucagaaguacugaaggggagguguguuuacacagcuucuccacagcaggucuggagagcugagccacaggccaguaugugguacuucauauaugggcaggcuugcugguucacacacgugugagauagcaaagcaugggaaagcggguaccagugaguaacuuccaagccagucaggacugguucuaaaacuuugggaaacggauauugcuugccaagcaagucuuccaugccucugccuucugcagucacaugucugcuuuuuucccucaacaauuaaagacuaauacagugagccuuucuuuucccugccuucaccugcuuugucuugcauguguugauggugcugcugcugcuacaucagauucaaggccccacacacuuaagcaccuguucuaccaccuacacauucaacaacacccagcugucacuauucucucucucucucucucucucucucucucucucuuucuccauaguuauauauauuuauauauguguguauguguauacauauauguguguguauacauauacauguacauguauauguguguaugugcauauauauauauauacauacacacacacacacuuuuuugaggcaggcugugucugcugccuaggcuguggaacucagaguccuuucugccccuggcucucagaugcuggacuuaaacaccuaucaccauccccaggucucauccuuuacugccauuuuaaggcugcuuuuaaggcuggcccuagauguacuucuuucuagcccuuguauuccuuuacaaugcauguuugguguuuuggcuuucuccuuuccggucucagaucuuugucuugugaccauucaagaacucuguuuuccuucaucgaguucccuucuuuuccuuccuguugcuaugaggaaguuuuuuguuuucaacauuuuccugacuuuccaaaaacuccucuccaacauguuauuuuuggagaaggaugguuuuggcuugucauucugcaugcaagguauugaucugucuggccuccaugggcauggacagcacacuggauaaaaguagauagacugccaugaauuuucuucccuucaguauacuuauaucgaguccccugcuguuuccuucucucggaugucuguuaggacuggggaacuguacgcauugcuggagaguucagagcagauuccaucugcuuuaugcuuuuagccaugaagaaugacucuaaucaagucguuuuuguuuuuuuuaaucucaauuauuuuauauguauggguguugugccucuguguaugccuauucugugacugcaguaccugaggaggccagaagggggcaucagaugcuuuggaacuguagauagagauggcuaugagcugucaugcggguuauaggaauugaaccuggguccucugggagagcagccauugcugguaaccacugagccaccucuccagccgggaagagugaccuuuuuaaugccauguuacuuuugaugcagggaagaaaaaucucaagcuuucuuugccucuuguauuuuaaaccugccaugugucuugacugacagauagcagcaugucuaccagaaagaugguuugagaacucugcuaugaggacaucaauuccccagcuagaaaacuucauuaaguuuuuguugcagucugcacagaaauuauccucaagugaauucagguaaugcucacuuaauuuuucaccuccaaagcauugugcaaagauuuuuaauguuagcgguuuuaaggaaguuuugcacuuuuacuauaauuuuuaaaucugggucuugggauauagccaguuuaauggaggauuugcccagcaacaagaggcccuggguucaaucuaaacacucaucagccaggcauuguggcacaagccuggaauccuuccguaguguugaggaagugucgaugugacugcucccaucagcugccagcauagugaccacugaagcugccagcacagcacuguggagagccugaugacaggccucuggguucugcuucuuacggccauccgcacacaaauuuuccagaauguuguguauuggaccuuugcaauuacaaucaugaggccaugaaacuguagucauucuaagaacgacaucauuggcagucuuaugucuguguguguuuauacaaauggaugauacaggcugcuaucaguaggcuauaguguacauguuuguauagcuaauacaaaaguauacaauguggccacaguauccaguaugugaaaugugcacagcugcaugugcccugcuuugauagaacuaucagcauauuuguucauaccagcagcaugacagcauguaaugcuucgauguggcacguuagcuagugucacugugccuuagggacugacuaacucuuggccuuuaccugaagcaucccugcauauaaugagguauaaaagggacagcaccucuguacuguauguggcccuagguacuggcuuagguccucagucaccacuguuacuccccucugaccuguuacagcacuucaccaccaccaccaccaccaccaccccuuuccuuuuauuucauuuuuuuuuuuuuuuuuuuuuugcuaaggaucaaauuuagggcccacugccugcuaaaggcuuuaccacuccugcgccucucgcuuggcugcuaaggggagaguaagugcuuuuugguuguuuuucaggaaugaagucagugaaauaauucuuauccuggugaagguaaaagcucugacucaagccgaaucccucagagaagagcguccccuggagccccucccagcccagaguacagguguuugagugcgccgugugggagugcccagagucaagaugaccgugucacagccgaugccgccuuugcugggugcccacuugggguguggccaggccuccugaugcuucguagcugagggaaguaaugcacagcagcagccgagcucagugugcugcucuuuuacucucucaauccggaaggaaaugaagcaaucugacacacagaagcaugccugaaucaaaaccaucuucagcaaacuccaauguuugcagaucagcuaaugaggaagcucuaucucuggaugguuucuuuuaucuuauucuuugguggggacucggucucauucugaaguguaaggaauuacuuauuaaauagcuaacacauuuuuauacaaacuguccuuucaaaaucuguacugacuuacugugugaaaucagugcaagagagugccagugaucuccagauuuugauucauugucaauuuguuaaaaaaaaaaaaacuuugaaaaaagauuuauuuuuauauguguggucauguauguaccuggguggguuuagcacuaccuccauguaggggccagagggcaucagguccccuggaacuggaauccaggagguugugggccaucuaaugugcuuggaaccaaacccagguccucagaagagaucuucacccucccugugaagaaugaagcuguggucugagucaucuguaaguccuuaagugaggcuuuuuugcuauguuuuguguaacucaugguaggacuaaaaaggccauugcucuuuuaaauacagaaauguaaaguauuucucuaauuaagguagucugaggcaaggugauuaagaaauuaugaacuuuucucaaaaugacuguauuaauguucuuaaguauauuuguuaagcaacucaaugaugauccuguauuuauuuuuccguguugucacuuuagacauuugcucguuacaaaagcauguguauaugugugcagaaaguuuuguauauaaauggcagagacuuuauuuuugcuguuaaagggcacuuuuggaaacuguucucuggccuuggcuucuucgagauggacguguggauggcugugcucucggucaucaucucucuucuucaugggaugcagaguaguaagcuaucgccuuuaaauuccauuacgccuggcaugugagcuuccaagcgucuuuaaaacauauugugaugcua

SEQ ID NO: 3098 - RNA, 8135 nt, Mus musculus
auuuuuuuuuuuuuuuuuuuuuugcuaaggaucaaauuuagggcccacugccugcuaaaggcuuuaccacuccugcgccucucgcuuggcugcuaaggggagaguaagugcuuuuugguuguuuuucaggaaugaagucagugaaauaauucuuauccuggugaagguaaaagcucugacucaagccgaaucccucagagaagagcguccccuggagccccucccagcccagaguacagguguuugagugcgccgugugggagugcccagagucaagaugaccgugucacagccgaugccgccuuugcugggugcccacuugggguguggccaggccuccugaugcuucguagcugagggaaguaaugcacagcagcagccgagcucagugugcugcucuuuuacucucucaauccggaaggaaaugaagcaaucugacacacagaagcaugccugaaucaaaaccaucuucagcaaacuccaauguuugcagaucagcuaaugaggaagcucuaucucuggaugguuucuuuuaucuuauucuuugguggggacucggucucauucugaaguguaaggaauuacuuauuaaauagcuaacacauuuuuauacaaacuguccuuucaaaaucuguacugacuuacugugugaaaucagugcaagagagugccagugaucuccagauuuugauucauugucaauuuguuaaaaaaaaaaaaacuuugaaaaaagauuuauuuuuauauguguggucauguauguaccuggguggguuuagcacuaccuccauguaggggccagagggcaucagguccccuggaacuggaauccaggagguugugggccaucuaaugugcuuggaaccaaacccagguccucagaagagaucuucacccucccugugaagaaugaagcuguggucugagucaucuguaaguccuuaagugaggcuuuuuugcuauguuuuguguaacucaugguaggacuaaaaaggccauugcucuuuuaaauacagaaauguaaaguauuucucuaauuaagguagucugaggcaaggugauuaagaaauuaugaacuuuucucaaaaugacuguauuaauguucuuaaguauauuuguuaagcaacucaaugaugauccuguauuuauuuuuccguguugucacuuuagacauuugcucguuacaaaagcauguguauaugugugcagaaaguuuuguauauaaauggcagagacuuuauuuuugcuguuaaagggcacuuuuggaaacuguucucuggccuuggcuucuucgagauggacguguggauggcugugcucucggucaucaucucucuucuucaugggaugcagaguaguaagcuaucgccuuuaaauuccauuacgccuggcaugugagcuuccaagcgucuuuaaaacauauugugaugcuaacucuacugcccuuuuagaguucuuacucguuccuccugguccugugaaaugaaggcgcugacacaacaggugcacacacucaccuggugauucgucucacagacccagugagcugcgggccagcuggggcuucaugagaccacgacaaaaacuuaagaaccagaaacaacaaacuuucacuguccaucucugaugguuucuuuuguggagacugggucucauucugaaguguacgugacacugaucuuggaacccuccugccucugccucccaagccuuuggauuaccacaccuggagaggggaacuuaaaaggccuaacugcagagacaccguguucgugaguuagaaaacuaauuuuagguaaagucuuauucuccuucaacugacucaugaauuuauugucaacacugaaacagguucaggaaaaugaagcauacaggagaacagccuagggcccuuucuacccacccacacagacaggucuaucgggagaccugugugugucucagagacuggacagacucaguggcauucccuucccagcacccacaccagguggcucacaaccaccuguaacuccagcucccgggggucugaugcagucacacaagcaugcacuuaaauagaaaagagguacucagcaucuaaacuccaaauaaugguuccaggaagacagaagcagaggagagaaacucagcagcaagagccaagucucccagaacucgagucagcacugagaggcuuacccacagcccuaaacuagguagauaaauguaccugcccgugcaccaagcacagcacacguucucugcuguccagucaugcccaaggagcagaaacccggacgacgcuggguuucucaaugcagcacuaaaacuauucaaguagacucuguagcauggagaccucagagaagagagagaguacaggccagauaguacagucucucucaagaguaaaacguggccaacgugacugaaaggacuccugagccugaucaugagguauauguaugcccauggcgguccacacacaugcacaucucuggaaacuagaauaauuaaggaguuagcagccaggaaaaugacacggaaugcagagcagcucaccagaaaaauaguccugagauccaggcuggcacugugauguuacaaauggguuagccuuuacucugugaggcaucccagcuucccagcccauguucagcugcacucugccccacuagagggagugcugacccccaaaagcugaagcuugauucauagggaagauaacacucucugaccaucuuccugcuggacauucacacccaguucacacaggcucugccagguacccugaggucugcuuagcagacuucacuuggaauucuacccauggaauuccucacaaguggcuuuuguaaacuugggggaaaugaagccagaauacaacaacucagauucccacauucuucuuaaaacugccauguagcaaaacaggacccuuuucuaccagcuaaugagccugucaaaacuagacauuuaacaauggagagauuaucagguggguuguguuagcugggguuucauugcugugacgagacaccacgacuaaggcaacucucauaagggacaacauugaauuagggcuggcuuaacaguaucagagcuucaguccauuaacaucauggaaguguccaggcagacacacggcugagaguucugcaucuugauccaacuacagcuaggagagucugacgcugaccacacuugaacaugagaccgcaaagcccacccccaccgugacauacuucauccaacacggccacacuuccuaacaguaccacuccauaugggccaagcauauucaaacuaccaccugugucauaagcagcuguaacuccaguuccaggcagucugauacuuccuggucucuggaaccauguacacacauacaggccugggugcuaggaacuaaacguagggccucugcaagaguagcaagugcucugaacuacugagccaccucuacagcuccuauucuuacauuuuaacuugcacacuguuguguguuuaugguuuuuucccuacuccucuugcucagaucccaguucaucuuauucuggugaugcuaacuucacuggcuauagaaagggaaugacugucaggugauugcucuuuugagagcaauaaacugacaugcagacuuuaugcuagguaccgaaaagugaggaaugcucauuuaaucacuauguccuuacaaagcaaacuuaauggcuuucaaaccaaagagcuaauacauuaaccaaaggcauucucagaacaagggcuuaaaagaaagauacuuuuuuuuuuuuuuuuuuuuuuuuuuuugguuugucaagacaggguuucucuguauagcccuggcuguccuggaccucacuuuguagaccaggcuggccucgaacucagaaauccgccugccucugccucccgagugcugggauuaaaggcaugcgccaccacacccggcagaaagauacuuuuaaguguguguguaauugcaguacacauacgcaaggaugugcaguagaagccaaagggcaacuuuuaggaguuguuacucgccuuccgcccuggguuccagagucaaguucagggcaucaggccugagccaacaggcauguuuaccuguugagccauucacuagucccaggaucaagacuucuucgaugcuucuauuucuucccacaaugcagcuucaauuuuugaagugucauauucucucaucauaucaaacucaauccauggcuuguuccacuucugggcuuccuucauuugcucuucaguuaaagcaaggucaaaucugauucccuuaauguugaaguuuggacguucccagcguuuggaccacggcuuuggcuucauuuuaacuuucagcuuagcaaaacaaaaacaggaauugugggcuggugaggugcacacaaaagucuuccccccacccccgcccccacccccgcccccucccccgcccccaggucuucugcaggcgcuucucucuuacuugccccugaacaaaugcacagcaucuaccuuguuaacaggcacuuccuggcaggccuccugugggaccggcuucauguucacgucaaaggugcuguacucgggaagggcgucccguaaguacagcagguugucauccagccgcuucuccaacuucaccaccuggaucuccuggauucgaggauuauacaguucaaagcaaaucuccacaccuagaaagggaacaggcugcuucaagccauggacucaccacauuaaguccagacucccgcaauacuuuaccguacaguauaaagaagcuagcaagugggaacugagcaaacacaugucauuuuuaaaagaucaagauuaucaaagcaaaacaaacuaaaucccauuugaauugaaaagugagaaauugaaugaugugguguaagacgucuauaaauacaucacccccaccucuucaacauacauuacccugggaagagaaagccucggcuggagaacuguguagaccggacuggccuguggguaugucuguagggccaauugauauaaagggcccagucccuugugggagguaccaucccugggcaggugguccuaggcuggaugacgagguggcugacagagcccacgagugaaccagcaagcagcacucugccauguuucugucucucuugaaacugaccugaagauguguaagcugaaauaaacucgaacugcacuggcuacagaaaggcaaugagugucaggugauuucccuuuuuagagcaauaaacggacaugcagacucucacccuccgaguugcuuuuggacauaguguuucaucauaacaacaaagauugcacuaguaugccagggagaggcccuccuggcacaaacaguaacgugguaagcaagcugccguuaugaaugugacccuccaagauucaccuucaagaccugcucucaugguagcucacuggucagaaccccaaagugcacccagaagaauaaacacucuuacuugccguuucaauucuccuuucuagaacuuuaccauuuguucugcugugucagucauggcaugugugacugcuucugacaccauaaccugucauaacagguuauaacaugucacaacauaaaguagagaccuucauuuuaggagucccaguggacuucgggguauuugcucagaaaggggugauccugcuaaaugugacagcucacaucucuaauccucuaaucccuguccucaggaggccgagauuugaggauauuucaaguuugaagucagucagcucuauauagcaaguuccuggccacccauggccuauauggaccaucccguuuuaaaaacacuacuagcaaaaacaaaaggaaucucucuucacugcuuuauacacugucuccauacuugaaaauaaccauguuuguuuaggcaaggucucacuauguaguuucugccucaggacaucccuaugcuaggauagcagacaugucaccaugcccaggccagucuaguccuaauggguguugcccuauaauaaaagaagcccucaaaagaaacuaaacaaugcacguuaaacagugaauacuaaucuguauccaaggcaaagcacacauuaucucuuggggaaaucccaguuucacucucuggaugcucaagaagaaacauaccuuguccuucaaucguguuccugagggugaaaguagccccgagcccauucccugaucgcuugaugcaaauccccaggaacuggcugguuuuuccacuggcauaggggucggcuguggugacucgaaguaugcuuccuacagagucagaagagaagcaagcucugacacagaugcaggaaugaacaaauaagguuuauaucuuaguaugucagaaauaaauaacagcaaaacccagacaucugaacaauaaucugaaggcaaugaaaacuagcgcccaacaccugcugccagacaccguuacucaccaacauagaacucuggaaucggaagcaccuuucuccugucuagcauaucuuuucuuucuaucuuaaauuucagaggguuuguucucccccugggagggaugaauucaggacucaggaaccuauaaaaaaauuaaaaaugaaaggugauuuaggccagcauaagaaaaacaauggguauaauguagauguauuuuauucuuucaauauggauugcaauguuauuucuaaaaccaugguuuccaaaaccauuguuaaugcucacuccugagaacgcaccaggcauuguguuuaaaugguuaucauacaucaaguagcccucaaggucuggaccuuauuguccaagaaggcauuugugcuaaggguuuguuuagcugucauccugggcagcuacuggggcuuagaaagccuuaaagaguuucaguccgguacaggaaacaugucacugggcaucuaaccuugaaggcaaggcacagaccccggccccuuucuguuucucccuuugcuuuuaccuagcuaaugcuuccugccacgcuauacugugucacugcagggcccaagugacagggccaggaccaagcaaaauuaacuacaacuguccaaacccugagccaaacgaauuuguucccuuuaggcuggcugucucugguguuugucaccacacaggcaagcugacccauaguagcauaaauuaauccugagaccaguuagauguuuuauugucaucuuacuuaaaaaaaaaaaaaacaaagcacaacuggagcguaaaggugaugaaccgcugacauaauuacuauuuguuacaauuuugucacaguuaauacgcugcauuucucucagucugcaaaugagcacaagucucccacugagcuauaaauauggagaaaauauauacaaaucaccagcugcaaacugacuuuaaaagaaaucuuccaccgagcauagggauucccaccuuugauccuaacauuuaggaggcaaaagcaggcagaucuuuuuugaguucaaggccagccugauacacacccacaaauuauuguguauugugguuggagcgcccagcauaacauucauguggggauuugaaggcaaacuuuggaguacggucucucuuuucucuauggguucuaggcauggauuuggguguacagguugcaacuuucacaaccgaaccacccugcggguccauacuguuaagcuucugaagaugcauuuauguagguaagacgaaaaagagugugcuggauccacgugccugagccgaucugaccuccccaaacccuuccuccuggauagaaucuguuggccaaggcucaccgugguggauuuuaggacaaacugagggaagggaguccaagccugcgucuuucgugaucuagagaggggcagacccggaacccgauuucgugcagcccagcuauaaagcggguaucaaagugugcgcacucccacgcggccucggccgccucaccuucucucgucuuccgggacucggcgccgguccacgaugacagguuucggcgguggcuugaacccaccgggcucugaaggcccggugcucugaaaucggcuugggcccgugcagacacggcaggcaucagaugcgaaggcagcaagccguggccuggccauucggacgcuccgggccagguacagggacgcccuacaacuuucugccauggaggccgccaugucuacacccucaaugaaggacuacaacuccc

SEQ ID NO: 3099 - RNA, 8135 nt, Mus musculus
gggaguuguaguccuucauugaggguguagacauggcggccuccauggcagaaaguuguagggcgucccuguaccuggcccggagcguccgaauggccaggccacggcuugcugccuucgcaucugaugccugccgugucugcacgggcccaagccgauuucagagcaccgggccuucagagcccgguggguucaagccaccgccgaaaccugucaucguggaccggcgccgagucccggaagacgagagaaggugaggcggccgaggccgcgugggagugcgcacacuuugauacccgcuuuauagcugggcugcacgaaaucggguuccgggucugccccucucuagaucacgaaagacgcaggcuuggacucccuucccucaguuuguccuaaaauccaccacggugagccuuggccaacagauucuauccaggaggaaggguuuggggaggucagaucggcucaggcacguggauccagcacacucuuuuucgucuuaccuacauaaaugcaucuucagaagcuuaacaguauggacccgcagggugguucgguugugaaaguugcaaccuguacacccaaauccaugccuagaacccauagagaaaagagagaccguacuccaaaguuugccuucaaauccccacaugaauguuaugcugggcgcuccaaccacaauacacaauaauuuguggguguguaucaggcuggccuugaacucaaaaaagaucugccugcuuuugccuccuaaauguuaggaucaaaggugggaaucccuaugcucgguggaagauuucuuuuaaagucaguuugcagcuggugauuuguauauauuuucuccauauuuauagcucagugggagacuugugcucauuugcagacugagagaaaugcagcguauuaacugugacaaaauuguaacaaauaguaauuaugucagcgguucaucaccuuuacgcuccaguugugcuuuguuuuuuuuuuuuuuaaguaagaugacaauaaaacaucuaacuggucucaggauuaauuuaugcuacuaugggucagcuugccuguguggugacaaacaccagagacagccagccuaaagggaacaaauucguuuggcucaggguuuggacaguuguaguuaauuuugcuugguccuggcccugucacuugggcccugcagugacacaguauagcguggcaggaagcauuagcuagguaaaagcaaagggagaaacagaaaggggccggggucugugccuugccuucaagguuagaugcccagugacauguuuccuguaccggacugaaacucuuuaaggcuuucuaagccccaguagcugcccaggaugacagcuaaacaaacccuuagcacaaaugccuucuuggacaauaagguccagaccuugagggcuacuugauguaugauaaccauuuaaacacaaugccuggugcguucucaggagugagcauuaacaaugguuuuggaaaccaugguuuuagaaauaacauugcaauccauauugaaagaauaaaauacaucuacauuauacccauuguuuuucuuaugcuggccuaaaucaccuuucauuuuuaauuuuuuuauagguuccugaguccugaauucaucccucccagggggagaacaaacccucugaaauuuaagauagaaagaaaagauaugcuagacaggagaaaggugcuuccgauuccagaguucuauguuggugaguaacggugucuggcagcagguguugggcgcuaguuuucauugccuucagauuauuguucagaugucuggguuuugcuguuauuuauuucugacauacuaagauauaaaccuuauuuguucauuccugcaucugugucagagcuugcuucucuucugacucuguaggaagcauacuucgagucaccacagccgaccccuaugccaguggaaaaaccagccaguuccuggggauuugcaucaagcgaucagggaaugggcucggggcuacuuucacccucaggaacacgauugaaggacaagguauguuucuucuugagcauccagagagugaaacugggauuuccccaagagauaaugugugcuuugccuuggauacagauuaguauucacuguuuaacgugcauuguuuaguuucuuuugagggcuucuuuuauuauagggcaacacccauuaggacuagacuggccugggcauggugacaugucugcuauccuagcauagggauguccugaggcagaaacuacauagugagaccuugccuaaacaaacaugguuauuuucaaguauggagacaguguauaaagcagugaagagagauuccuuuuguuuuugcuaguaguguuuuuaaaacgggaugguccauauaggccauggguggccaggaacuugcuauauagagcugacugacuucaaacuugaaauauccucaaaucucggccuccugaggacagggauuagaggauuagagaugugagcugucacauuuagcaggaucaccccuuucugagcaaauaccccgaaguccacugggacuccuaaaaugaaggucucuacuuuauguugugacauguuauaaccuguuaugacagguuauggugucagaagcagucacacaugccaugacugacacagcagaacaaaugguaaaguucuagaaaggagaauugaaacggcaaguaagaguguuuauucuucugggugcacuuugggguucugaccagugagcuaccaugagagcaggucuugaaggugaaucuuggagggucacauucauaacggcagcuugcuuaccacguuacuguuugugccaggagggccucucccuggcauacuagugcaaucuuuguuguuaugaugaaacacuauguccaaaagcaacucggagggugagagucugcauguccguuuauugcucuaaaaagggaaaucaccugacacucauugccuuucuguagccagugcaguucgaguuuauuucagcuuacacaucuucaggucaguuucaagagagacagaaacauggcagagugcugcuugcugguucacucgugggcucugucagccaccucgucauccagccuaggaccaccugcccagggaugguaccucccacaagggacugggcccuuuauaucaauuggcccuacagacauacccacaggccaguccggucuacacaguucuccagccgaggcuuucucuucccaggguaauguauguugaagaggugggggugauguauuuauagacgucuuacaccacaucauucaauuucucacuuuucaauucaaaugggauuuaguuuguuuugcuuugauaaucuugaucuuuuaaaaaugacauguguuugcucaguucccacuugcuagcuucuuuauacuguacgguaaaguauugcgggagucuggacuuaauguggugaguccauggcuugaagcagccuguucccuuucuagguguggagauuugcuuugaacuguauaauccucgaauccaggagauccagguggugaaguuggagaagcggcuggaugacaaccugcuguacuuacgggacgcccuucccgaguacagcaccuuugacgugaacaugaagccggucccacaggaggccugccaggaagugccuguuaacaagguagaugcugugcauuuguucaggggcaaguaagagagaagcgccugcagaagaccugggggcgggggagggggcgggggugggggcggggguggggggaagacuuuugugugcaccucaccagcccacaauuccuguuuuuguuuugcuaagcugaaaguuaaaaugaagccaaagccgugguccaaacgcugggaacguccaaacuucaacauuaagggaaucagauuugaccuugcuuuaacugaagagcaaaugaaggaagcccagaaguggaacaagccauggauugaguuugauaugaugagagaauaugacacuucaaaaauugaagcugcauugugggaagaaauagaagcaucgaagaagucuugauccugggacuagugaauggcucaacagguaaacaugccuguuggcucaggccugaugcccugaacuugacucuggaacccagggcggaaggcgaguaacaacuccuaaaaguugcccuuuggcuucuacugcacauccuugcguauguguacugcaauuacacacacacuuaaaaguaucuuucugccgggugugguggcgcaugccuuuaaucccagcacucgggaggcagaggcaggcggauuucugaguucgaggccagccuggucuacaaagugagguccaggacagccagggcuauacagagaaacccugucuugacaaaccaaaaaaaaaaaaaaaaaaaaaaaaaaaaguaucuuucuuuuaagcccuuguucugagaaugccuuugguuaauguauuagcucuuugguuugaaagccauuaaguuugcuuuguaaggacauagugauuaaaugagcauuccucacuuuucgguaccuagcauaaagucugcaugucaguuuauugcucucaaaagagcaaucaccugacagucauucccuuucuauagccagugaaguuagcaucaccagaauaagaugaacugggaucugagcaagaggaguagggaaaaaaccauaaacacacaacagugugcaaguuaaaauguaagaauaggagcuguagagguggcucaguaguucagagcacuugcuacucuugcagaggcccuacguuuaguuccuagcacccaggccuguauguguguacaugguuccagagaccaggaaguaucagacugccuggaacuggaguuacagcugcuuaugacacaggugguaguuugaauaugcuuggcccauauggagugguacuguuaggaaguguggccguguuggaugaaguaugucacggugggggugggcuuugcggucucauguucaaguguggucagcgucagacucuccuagcuguaguuggaucaagaugcagaacucucagccgugugucugccuggacacuuccaugauguuaauggacugaagcucugauacuguuaagccagcccuaauucaauguugucccuuaugagaguugccuuagucguggugucucgucacagcaaugaaaccccagcuaacacaacccaccugauaaucucuccauuguuaaaugucuaguuuugacaggcucauuagcugguagaaaaggguccuguuuugcuacauggcaguuuuaagaagaaugugggaaucugaguuguuguauucuggcuucauuucccccaaguuuacaaaagccacuugugaggaauuccauggguagaauuccaagugaagucugcuaagcagaccucaggguaccuggcagagccugugugaacugggugugaauguccagcaggaagauggucagagaguguuaucuucccuaugaaucaagcuucagcuuuugggggucagcacucccucuaguggggcagagugcagcugaacaugggcugggaagcugggaugccucacagaguaaaggcuaacccauuuguaacaucacagugccagccuggaucucaggacuauuuuucuggugagcugcucugcauuccgugucauuuuccuggcugcuaacuccuuaauuauucuaguuuccagagaugugcauguguguggaccgccaugggcauacauauaccucaugaucaggcucaggaguccuuucagucacguuggccacguuuuacucuugagagagacuguacuaucuggccuguacucucucucuucucugaggucuccaugcuacagagucuacuugaauaguuuuagugcugcauugagaaacccagcgucguccggguuucugcuccuugggcaugacuggacagcagagaacgugugcugugcuuggugcacgggcagguacauuuaucuaccuaguuuagggcuguggguaagccucucagugcugacucgaguucugggagacuuggcucuugcugcugaguuucucuccucugcuucugucuuccuggaaccauuauuuggaguuuagaugcugaguaccucuuuucuauuuaagugcaugcuugugugacugcaucagacccccgggagcuggaguuacaggugguugugagccaccuggugugggugcugggaagggaaugccacugagucuguccagucucugagacacacacaggucucccgauagaccugucuguguggguggguagaaagggcccuaggcuguucuccuguaugcuucauuuuccugaaccuguuucaguguugacaauaaauucaugagucaguugaaggagaauaagacuuuaccuaaaauuaguuuucuaacucacgaacacggugucucugcaguuaggccuuuuaaguuccccucuccaggugugguaauccaaaggcuugggaggcagaggcaggaggguuccaagaucagugucacguacacuucagaaugagacccagucuccacaaaagaaaccaucagagauggacagugaaaguuuguuguuucugguucuuaaguuuuugucguggucucaugaagccccagcuggcccgcagcucacugggucugugagacgaaucaccaggugagugugugcaccuguugugucagcgccuucauuucacaggaccaggaggaacgaguaagaacucuaaaagggcaguagaguuagcaucacaauauguuuuaaagacgcuuggaagcucacaugccaggcguaauggaauuuaaaggcgauagcuuacuacucugcaucccaugaagaagagagaugaugaccgagagcacagccauccacacguccaucucgaagaagccaaggccagagaacaguuuccaaaagugcccuuuaacagcaaaaauaaagucucugccauuuauauacaaaacuuucugcacacauauacacaugcuuuuguaacgagcaaaugucuaaagugacaacacggaaaaauaaauacaggaucaucauugaguugcuuaacaaauauacuuaagaacauuaauacagucauuuugagaaaaguucauaauuucuuaaucaccuugccucagacuaccuuaauuagagaaauacuuuacauuucuguauuuaaaagagcaauggccuuuuuaguccuaccaugaguuacacaaaacauagcaaaaaagccucacuuaaggacuuacagaugacucagaccacagcuucauucuucacagggagggugaagaucucuucugaggaccuggguuugguuccaagcacauuagauggcccacaaccuccuggauuccaguuccaggggaccugaugcccucuggccccuacauggagguagugcuaaacccacccagguacauacaugaccacacauauaaaaauaaaucuuuuuucaaaguuuuuuuuuuuuuaacaaauugacaaugaaucaaaaucuggagaucacuggcacucucuugcacugauuucacacaguaagucaguacagauuuugaaaggacaguuuguauaaaaauguguuagcuauuuaauaaguaauuccuuacacuucagaaugagaccgaguccccaccaaagaauaagauaaaagaaaccauccagagauagagcuuccucauuagcugaucugcaaacauuggaguuugcugaagaugguuuugauucaggcaugcuucugugugucagauugcuucauuuccuuccggauugagagaguaaaagagcagcacacugagcucggcugcugcugugcauuacuucccucagcuacgaagcaucaggaggccuggccacaccccaagugggcacccagcaaaggcggcaucggcugugacacggucaucuugacucugggcacucccacacggcgcacucaaacaccuguacucugggcugggaggggcuccaggggacgcucuucucugagggauucggcuugagucagagcuuuuaccuucaccaggauaagaauuauuucacugacuucauuccugaaaaacaaccaaaaagcacuuacucuccccuuagcagccaagcgagaggcgcaggagugguaaagccuuuagcaggcagugggcccuaaauuugauccuuagcaaaaaaaaaaaaaaaaaaaaaau

SEQ ID NO: 3100 - RNA, 998 nt, Mus musculus
caacucuucaguuaaucccugagccaucucaccaggccucuugcuucuuguucucauuucucaccuugauagcccuguuagaagauacuuuuccugccucggucaaaaaagaggaagucaguuggcaaaugcucuuuggaaauguaguuuguaaaggagagaagccauggggcuuagaaggcgaacaugaaucuugccagcagcacucagugcuagggaccagggugggaggaucaaaucacaacaucacacaugggcacccuacgccugagccaugccaauugugaucguccaguacguugaggacuccagagagccggauggucuagcaggaugcuggggggagcauccgcaccugccugcuggggagugguaagugaagacauuguaaaagaggugacacugaagcuggaacuugaaggaugagucagggguaagggcauaaaagggaagguagguaggguugggaagacugggaggacuggcuggcugaugggagacugggcuggaagacaacgaaccuggagacaauggcaaacaaauaacauaauuauucaucacguaauucaucacacccuuugguguuuccuuauugcuuaauggaggcacccuuaguuccuugcaggaauaugagagucugcucuccuccguuggccucagcuuaaccucuagcgugccugagacuccaugcaccuagcaccccuaccccuccguaagcauauagagugcacagucuccccuuuggugcuucugaugguuuguauaugcuuggccuacggagugcacuguugggagguguggccuugugggugugagcuuuaauacccuuguccuagcugccugagagccaguaugcugcuaacagccuucagaugaagaugcagaacucucagcuccugcaccaugccugccuggaugcugccauguuccugccuugaugaaaauggacugaaccucugaaccuguaagccagccccaauuaaauguccuuauaagag

SEQ ID NO: 3101 - RNA, 86582 nt, Mus musculus
ccuuuucugcaucaagucacaggggcugcugaccaauacgggcuucccuuuagucagguucaccucacugcugagcgguucugcuuuguccugcaaagggcgccugcauggcuccuggcugaccagacucgaacugaguagagucuggugggaauuugaugaccgccuguuccaaaguuggcagguaagugacugacuuagguuguacugucccuugcuaagacggggcuaauaguuucuuauuuccugacccauuuagaguauuaaaguaauaguggaugguucuaguguggaggugcgugccugucauuccagcuuuugggaaguggaggcaggagaacugggaauucaaaguaggccuuagcaguuacguacuaaguuccaggacagccuggguauuggcugguuuugugugccaacuugacacaagccagagucaucagaggaaggagccuucguuggguaaaugccucuaugagauccagcuguaaggcauuuucucauuagugaucaaugaggggagggcccagcgcauugccggggaugccaucuuguggcuugugguccuggguucuauaagaagguaggcuucagaagccuggggaagcaagucagcaagcagcaccccuccaaggcuucugcaucggccccugccuccagguuccagcccugcuugaguuccuguccugacuuccuccaaugauggacugugaucuggaaguguaggacaaguaaacccguuccuucccaacuugcuuuuggucaugguguuuuguugcagcaauagaaacccugacuaaguccacccggcuucauaagacauugcuucaaaaacagcaagggcaaaaaaaauuaaucaggauuggugacacucgagaggcagaggcaggagaaucucugugaaugaguucagccuggucuauacagugaguugugggccagccagggacacacagagggacccugucucaaaauuaaauaaauaaagugggugucugggucucccuucuccugggggaagcagagucaacaggcagguuuggaagagccugugaguacaacagaaauagcagacuuaucuccgggaucagcuucagggagacagaucaacuuuucuuggguuguauaguuuuggggaagguuguaggaauaucgagggugggcaaaggucauuggcugaaggauaaggaacugagacgccucauuagcauggagaggcuuuugggggauuucaggugcuugcugaauggguucugugguggaagaaaggcagcugaaacugugagcuaaucaaggcuacgaaugugacaaaccuuugguagagggugggggcucugaacuccucagacaaggucagagaaggagaaucucugcugguaaagggagucucccauuuugugcugagcucagaaggcuaucuggacaacgguagacuuugaccuuaauuagcaggacaacagguauuaaguacccagugcaacaagggucucaagucuauacucuagagccucaguauuguucccugugcuggugaacaaggucaaacuauuauaaaaaacccaaugauuuaccuguggaugggugagggccuauguaugugcaaaucugugguugggggauauuugaugaacgcagguugucagguuugccuuucacccucugaguuauuccuccagccccaacaaggccacauuguucaccggugagagcaagcucuucucugcuggccccgaacuccugccuugcucuguguccccgcaggucucugauccucucacggcagacacagacucccuuucucaacggcugccuuuucuuugugcuucuucaaugaagcuguuccuccugggcaaaugcagaacugagggaaguucgcucauccacaccuggugccucacuuucaccaucucugcuccaccacuggcucccucuuccucuuuucucuuucuuccucccuccucucuuucuucacauccaugugugugcacagguauguggguguguguggcuguguguaugucugcccugggaacuucuugcucuccaucuugaauauugcagcagggcacuagccucacuauucagugccuagaaggcacugguuaggcuaauguggugggccagcuagcuuuggggucuagcugauuuauauaggcagccauggcuguuuggcuuuuauauggaugcugggaaucucaaugcaaguccucauguuagcccaauuuaacaaguucugccaucucccuagcuacuggguuugguuuuuuguuugaugguuuuguuuuauuuuucagacagggucuuguguagcuuaagcugcccucaagcucgcuguguagccaaagcuagccuugcauucuugauucuccugccuccaccuccccagugcugaauuggccuuccuagcuccccugcucuuaagagcacguggccucgaguagaucucagagugaccaccagguggcgcccgccccucggaggugcugaaagagcucugcggagcuacacguguugugcagugucacaggcgcuagaaaccagcccuugggaaccacgggccagacaugacuggcugacugaugcgcaguuuauguuccgguugcaccuccuuugacuguauucugcagguguguuaggauuguuccuugggggcagggaaguagggaagcagggaugggggccgggggcccgggugaugguggugaugauggugguacaccugccagucuuuuacgagguagcuguuucagcugacaguuaccggaguggggucggauagagggggagaagccacaugcccuuucuuauaagccccucaaccucuccaucagcugccucugucuucucuuggcuugcccuggacgccuccuggaauucaguuggcugguugugccgggaggacagaggccagugugaaacuaacauucaggguccuugauuagaacguuuaaaaaguucgagcuggagagauggcucagggguaagagcauuacuucucuugcacuagaccaaaguucucuucccucaguggauagcuuuauaaccacuguaacuccagcuacaggggaccugacacuuucuucuggauucucucagcaacuacacgugugcagccaccccuacucaacacacaaauagaccuuuuuuaaaaauguauuuuugcauaugagugauuugccuguauguauguauguauguaugugcaccagccacauauauauaguguauacguggcagaucccugcaaaugugagccaccaugugguugccaggaguugaaccugaguccucuggaagaauagcaauugcucuuaacugcugagucaucucuucagcccuaaaacaaaucuuuaaaaaaauguuucggagccaggcagugguggcacacaccuuuaaucccagugcuugggaggcagaagcaggcggauuucugaguuucgaggacagccuggucuacagagugaggacagccagagcuauacagagaagcccugucucgaaaaacaaacaaacaaauaaauaaauguuucagaaucuguagccugauguggugacacaugcuugcauaaaacucuggggaagcuuagcuuacuggggacccccugagugaaccauguggagcugggguugaugcaaaaagcaagaggaacuuauuguuccagugcacuggggucgucccagaccugaaggagaggcagcgaccaccagcagcaguucggccaguuuuuauaugguuuccagggccaaaauagagcaucagcaacuaggcacaauaugauugguggaacagugcacccuuuaaacugauuggucuuuagggaaugaggugacaaggacuucccugucugaaggugagcaggguuagccauguggaaugugccccccacccccguggucugagaaauguuaauuagccuuuuccuuccagaggggcaaguguuucaugacguucccaaaguuucugagcugaccuuuucaccuguaaucccaguacugcggagguagagacaggugaaucuuugccacuuagaggcuacucauucuagccaacuugguguuccccaaaccagugagaaacugucucaaaacaaacaaacaaacaaacaaacaaacaaccacagugaggccuuugagauggcacaggagguaacagggcuugccaccaagccugacagcacgaguucuauuucuagagcccacacaauggaaggaaagaacugacucugacugcugaguauaggugcucacaacaaauaaauguaaagacagaucacagcaaucccaagguggcaaguaacuaagggacuugugagguugacaucugccauccacagcugugcgauugcacacaugccuauguaaaccaacuccuccccccccaacacaccccagaacccaaaaccccacuuuaauccacacacaccuacccaccucccccuagccacucacacuuuugagacuuuccugcuggagaaagccuguuaauagcucaggucacacacccagaaaggccacacacccaggucacagucucugauccuaaaggugcauuugaauuuucgcacaguuuccagggucaucugcuguccccuuggcccucuccaugagcccaucaccaucacuguucccagcucuuuuggcuucuuccugcuucccaagcuuugcuugccaucuuucgggaagaucagagugccugcccuguuaccuggaacguggcaugguagacagagucuguugugggugagccccucuguggcugcugucccuuucccauggguucuggacuucaaauauagaugcuuacaucuauuuaaugcuuacaaggaaagcacuuuaccagcugagcaucuccccagacucucuuuaucuugauuuccccuuuuuugccuuuccagcgccugcucaaacaacagccuagauuaaauccuuuuuauugaaguaacgcaggccauucuugcuuuccuaaccccgauagacuuauggcuaaugcagcccccgaaggcaucaccugagaaccacggugcugcuucucuggggugcuucagggugcccagucucagaauccuugcugguaugcucagccuguuagucucccagguaaaggaaacaguguauaugagcauggaaggaauguuuaauuugagaaagccaguagagaccguuuuucuucuuaccccaaucaaagcugucagagcuaguuagcaucagaaccagucaagugucucccaaaaagcugcuguguguaugugcacagcagcccauccagucaccaaggaaaccacgcaucagugaaaagagcccccaggaaccagcuacaaacucaguugccugacaagucugucauuugcaacugggcccaaguguagaaggaacaauucuccacaacuuccccggcccaacccccugccgucugcagcuucccccauugaaaaucugcucaccccagagagacguguucuggcaggugugaccaacagcaggaagagugcuugcuuauuucccaacaaauaagacaggcugucugcugugcugguccugggacucaaauccuuuggggguggggggauaccaauccaccuucccagguccuagugucuucuggcucccagacaguggucaccgagucugcccaacaucucugggcagugauaaugaggaagcuuguuccauaacuacucuuuacccuucuucccucccuccuucccucccugucucucaugccccuuuccguucuguuucucuucaaaguauugucuuuauuucuauuuuaugagugugugugugugugugagugugugugucugaggaugccagaagaggguccucaggagcuagaauuacaggggguuguagccuguuggacaugggugcugggaagugagcuggggugcuuugccagaacagcaugggcuccuaagugcugagccaucccuccagucaauucugcuuuguuucuuugggauagggucucauguaacccaggcuggccucgaaccugcuauauaaccaagagaggucuuauauucaugauuuuccugccucuaucucccaagugcugagauuacagguaaauaaucucauaucuggcuugaacugguauuuguuacuaucauugcauuaaauauaaauugcaaaauuuuauuaaauuaaauaucauuacaaaaauuuuaaauacuccccccccccagcucauuaaugagucuaaugugacaagaggauucauucauuuguacagucuacaaauauccauugagugcuucuuguuugccaggaaguaguaggcuaaguguugagguuacuagagauaguaauucacugguuguagaugaagucaaggagucauuagagggcaugugggggagagggcaguucuugcgaugaggacucauuggcuguguucuaguuauuuauugcuccuuagcaauccaccccgacacauaaugacuucagguaaucaugguuauuauucucuccaagaauuuucagcuuaggugggaagaggggaggguacagagugacagagucaacugaugggggaacucaaaacauccaagggcuuucuccuugguauguugaguccauuggugguggccuauuaauagggaucuuaggcugaagagucaauugagacaccugcaagcagcuucuuguuuuugucacagcaugguggcugaguuguaggcgugggucuuccaauaaaagagccagauggaagccauagcagcuuuuagucuuagaagucacacaguauuuuauucacgaacucacucaagacacugcaucauugaggggaaaggaacuagaagcuaccuuuugguagaauaaauucaagggaugugaggacauauuuuaaagccuuuugucuaugaucuaaaggagaaggggugugugugugugugugugugugugugugugugugugauaccauuucagggagagaugcuaaauaaagucucugaagguaggcaaugagugauguguuuaaggaagaaaagggcacuaagggugcaauacagcuguugccggaaauauuaaaaaagaccagugaguuccugcacuccugcuggcaacucugcuucggugcguucccaccaucucugccucuagaguagccucaccagcgaccaaucgccaucuacccaacucugguucccuugucucauagcugcccauaccgucucagccauaaucccccugugguugguggucccaccuuccaggaacccaguaaaacaaaacucuagaagcuuauaauuaacaagucagauuuauauaucaauaaauucccaauucucaagaugccuacacaauaauuucggagccaauugauaaugauacaagcugcccaccuagaucagacaaguaauugcaauuauucuaucccgacaugauggucauaacuaccuguggcuauuuaaaaccacaugggaucaggaucuucuuccuguccaucugccuccaucuuggcuucccuucucuuccaagaugcugucaccccaacucuuagcuccgcuucccuuuacucuguccuaacacaggccuccugcugcacuaauaauuuaauguaauuggacagggaaaauccugucauauacagcaagcuaagaggaacaucugagaucauguuagagguagcuggaagcuguuaucagguaguuacaggagccuggauuuuauuuugugcucucucucucucucucucucucucucucucucucucucucucucuguguguguguguguguauguguguguguuggggggaggagaugggauauugcaagauuuaagguuuauauauuuguaucuuucuguuuguauauucauuguauauggcauuuguuuuugcccguguauggaaacuuguuagcgauuguggagcgcuauaugguuagaauguggaggcccaagguugaugucuggaaucauccucccucguggcucuuccaccuuacucacugaggcagagucuuucaacgaaaccagagcucaccaauauggcuugucucauuagucagcuuacucuggggucuccugucucuggaauuacagaugggcugccauaacacaccaggcauuuacauagguucugggguuccaaacuuaggccuccauuccugggcgacaaacauuuaaucccugagccuucucucugcccuccauucguauccugguaggacuguuccagcugcugcccuuagacuugagaugagaccaaaaccccgguaaggacaugaauggagugguucaaaaagaagccggugauggcuuggacaaggauguuggccucagagauaaagaggauggacuggugugaugguuuaaugaaaauggcccccaggggcucauaaggaguggcacaauuagaaggugugaccuugcuggaaaaaguaugucccugggugcagugguuugaauaugcuuggcccuggggaguggcacuaauaggagguguagccuuguuggaggaagugugacacugugggagugggcuuugagacccuccuccuagcuuccuggaagacaaucaaucuuucccuaucagcuuucagaugaagauguagaacucucagcuacuccugcgcccugccuggacacugccuuguugcaggcuugaugacgacagacugaaccucagaaccuauaagccagcccuaaugaaauguuucuggggccagagauauaaaucugggaguuaucaguauagagacagucugcaaagccaagggugaugucaccugaggagaaauggcagugagcaaauccugugaagacagaguucugggaagagagggaagcuuccaaagaggcugaggaagaccgggcgagaaggagggagaccagagcugggaauauuaugggaugaagagagauuuggaaaagaagaguuaagaaagaauuaucuaaaugaugcuuuaggccccucuagaucugaauuucugcaauuccagacauuucucaaguucuucaaauugagauguucuaugacuaaucagccuuugggaaaugaagaaucacugggucucuccaaagacucaaauuugaucuuuagucccuaggggaagaguggcuuuccuguaguuacuggggcaacccuugggaacauuucaggaauccuggcauaucagacauccuagguacacagggacaacuggcagauuguacacuacugguaaaguugggcuuggaacacgggcacguucacuuacuggggcuucuguaagaacauaccacaaacuugguggcuuaaaccauaggacugaguugacucagaguucuaggguuuagacaucugagguggagguguugggagggcuggcugugucugaggacugagggaauggguuccuuuugcacguggucaucaucuugcucuuguagccuuguucaucuucccacgucugucuccacaguugccccuuuuauugagacguugauuauuugcugaacaucuuaauggcuucauuuuaaccuaagcuccccucaaacagcccauuuccaaggaagaucacaugcuaaggaacaaaguuaaguuuguaguaguuacuuuucuguugcugugacuaaacaccaggacuaaagcaacuuauggagaaaagagguuuuaugcuuaugguucuagugaguuagauuccaugaugguggaguggaggcagggccagcgggguagggggcaggagguggagguggaagcaggagcagagaggggcaggcagcaggcauggcggguggagcagcagcugacaaagcagagagagaaaacuagaagaaguggagucuuuaaacucuaaaagcccacagggaguggacacacuuccaccagcaaggccacaccuccuaacugcucaaauagcaacacuggcuaggggucaaguauucaaauguccuagacuauggggacauucaagccaccacauuccacuucuugguccccuagucucuugaucacaacauaaugcaaaugcauuuaauccaacuucacaacuuuuuugaaaagcccaagguccagaucuuuucugagccuuaacuguaacccucuguaagauucaaaauaaaacaaaaaagcaaauuauacacuucugauauaaacuucauucugaauauuuuugggugggggggggggauacaauucaguccacaacugcuugcuuacuguuggcugagaagcuaggcgagaggugagagugcccuccgcagugccgaacguucuggauaguuuuaaauagauaaacauucugaauagauaaacaaccccuuuugaguagaaugagucugcacuucuucccuagaugggaagaccuagguggucuaaguggauuuauuccgagguuccucaaaccgggaagacaauaaaauaaaaacaaaaaacaaaacaaaacaaaaaaccccaaaacucugagauugacgucaccgaaggaacaauaccuugcggacuugacuuccguuagcagccagagcggcuggugcgcagcuccagaggccacgguugcccugguuacucuuuuccgggaucagcugggacacaguggaguugguggguucucaaauuagaagugcaggagccucucuacaggaugcgcacacugcaggagucucugggaucaaauuuguaucccaacggggagcucuacuugcagguuuggcugggaauuaaguuuaugggaaagaauagaaaguucggaagaacaaauuaaguaaguucgugggagacaguucugugcaucgccuggacuuucaaaauggcccacuacaguggguaacgaaccagggagggaaucucauugaauccuaccccagaaagaauuuucuuugcuucucugcaucucagagcaccuuguagcauacuaaugaaucucuugccaucaccacagcgugugugcccucucuucucaauuuauauguuggaaugccaacccucaauugacuauccucggugguaaauuuuauacuucuaggaauuaaggucagaugagggauuuuaugaguagaaccuuguuccuaaaggauuaggacuuauagggcuagcucaaaucuuucccauuucuucugagaaagcacaacaagaaagggggguccucaccugaaccagaucagcuagcgucuugacucugaacucacuggccuuucaaacuauuguugacauuucccaaccucugauauuuugucauaguagcaaaauacacucaugcaguugauuuacauuuucuuuuccccaauuaaaaggcaaagcucuucaucuuaguguccccaaguaccagugugccugacguggugaaucucaccuugcaggugugagugauuaauaagucauugacaggauggagacuuuuaacucacugugaaucggagaguccagacagcuaugaacacacacuuaaucagccugggacacaaauggcguuuccaggacuagagauaauugaaaguggauugggaccaaauacuaccuucagccacagacuacacacaaaagucgucagucagucuggccagaaagggaagcugcuucccugauuuauggcuuuuccuucucucuaauuaggaucagagcuuugccaguccacaucauccuaucucuagaaucuaacacucucagagucaucagagacauagaaagcuuagaggaaccccauugccuaaggccgggugggguaucaggcaacaagcauuugacuuaucucagggaccgcacgggguuacacugccucugcccgggucuaggucucuggaguuuaagaaccgagucuuucagcacagcagacacagauccaucugcagcuuuuucucuaauuaauuacgcuaugggagcugaugcaugaaaccaccaugccaaucuauggaauccugagggcacugggaccaugugugacuggagugcucucauccuucucucugagcucucacauccuuccacugcagauggaccucucugaggaaggcaaguaaguaggagaggguuccuuggagaauguggagucuaaacgcaggaggccaggaugugaaaguucuuggaagcauugaagggcauugagcugggcuagccugaggaaaaccauucuuacugcuagcauguuccucauaguaaccucagggugggggugggggguggggguggggcaugcuuuccuucccacagccagaagcacugaaguuucuacucaaggcugcuguauuaguauuuauggugcgggaaucuggagugcagagagagaaaaugggaacuagagaccagcucaguggcauccuagggaccaauuuuccuaggacuucuaaucccagucaccauuuuuccuucuuuaaaaaaaaucuacccccacaccccguuaucauguagcccaggcuagccucauugcucacuauguagccaaggauaaccuugauuuucucauccuucuaucucaaccuucuuagugcugggauuacaggcaugugccaccauagcuggcuuacgcagagcucuuugaggcuguguaagcacacuuuacccaucaacccacacaccaagccaucuagccugacguuuuuaugugugaccuucaaggcuuugguacgccugcccuugaguuucuaauccuauucaagcuugagcuguucuuuuuuuuuuuuuuuuuuuuuuugguagccucacagcugaaucuuuaauuuuagcaauguguccucugcauaugugaguacucagaauaguuguuucugcauggcuaccagugaaacuuugccuggaguaacaggcauaucaguaauuaaaacaaccucauuucaucaguuuaagaucugaagaaacuaaauuauucugugucacaggaccuauaaaagccaacacaagaggcaguuuucugccgccugggaguggggacucuguccuuguaggguggucaucuguaccugagagcagaggcuacugugauggcucuccccacuucacuuucuacagcccucauuugcacaccagcauguagccucuggucacauguggcaguuuugagaguuuaugucuguagccccaacuucacucccaaauuccagaacuuuguauuaauguucauacccuauggucuugggacccucggaugcacuauacauacaguccccaacacuuucccucuaucagggugauggcucagggggucaagugcuugcuguacaagcauuaggacuucaguuugcaugcacagaaacucacacauaaaagcuacacaucacagugaaaacccagagccccagagcugggaggugcagacagggacaucccauaggcuugucggucagcuagccuagcuaaaccaaggagcuucuucagguuugcugaaacccugucucagaaaguaacauggagagugaucaagggagacacugcauugaccauuacauacauauauauauacaagggggugugaaugcauaugcauauacaaacauauauaccauauacgcuaguuguuuuguuuuguuuuguuuuguuucuuuaucuguacauuuuuucuuauucugucacuuuggagucccagggugcucuuuccaucacuuccuaaggccuacuggugacccuaacaguuuuguguuuccuucccuaauucguucucuggcuaggcugaguucuucacuaccucgaaccuacaagaccgugguguucucuccuaacucagcuccgugcuccccuuugcuccuuccuuaucuuccauagagaucuuucuccgacucaguuguuccccggucuuugucaugccuacaguuauccagauguucucccuaccucucacagugaaguaccuacucuuagcaaaguucucaaggacagccugacuucucagaggguuaaacuucucacuccagaaguggagcuggaagcauguucuuuuuacuaccugauuccuaagauauggcugaauacagguaugugaacaugcuuccuucagaagguagagagagucuagccacaacggaaucugggguuccaucuccaucacugaaaaggaagcuuggggaauuagcaugaacacuaacaguagaaguguagucagagagguguugcuguguucacugaagacuuagaaacagcccaucaucaggagcugguggggacugaugaagguugggcucuguuucagaacaucuaucguucucucuuugaaaauauuuauuuauuuauuuguguguguguguguguguguguguguaugugugugugugugguccaggaaggcuagcaggggauaugagauuccuuggaguuggugguaucagagcuugguaacauccacugugggcccucugauggagcaguaagugcucuuuaccacugagcugucucuucugccagaacuacuucuuuaaggagcuagcuuaguauagccuuaacuccuuaaaaaauauuuuaaaauuuaauuuuaugucuuuggauguuuuaccugcauguauauacguguacuacacaugugccugauguccacagaggucagaagaggguuucagaucccuagcccuggaguuacagucgugggccaccaggugggugcugggaauugaaccuaagucuucuggaagagcaguccguguucuuuacugcagcugaaaagaaguuagaucacugcaggugugccuuugaaggaggauaucgggacccugcccccuccuauuucucucugcuucauggcugcccagauaugaacagacauccucugucauguaccauugacaugaugaacuaucugcugugucucaaagcaacaagacuaagaguccuuugacugaaaccuuugaaacugugacccacaauaaaauuuccuuuuuaaaguugauugccagugaucuuuuaucauaguaaagguagcuugcuguggugguuugaauguguuugccccagggcaaguggcacuauuagaagguguggccuuuauuggaggagauguggccuuuuagaggaagugugccacuguggaguugggacuuugaggucucauacauaugcucaagucuggucagugggaucagagucuccuccuggacaccuuugguucaccauguagaguucucaguuccuuguccagcaccauguuugccugcacacugccaugcuucccaccaugaugauaauggauuugaaccuuugaaacuguaagccaguuccaacuaaauguuugccuuuauaagaguugccuugaucaugguguuucuuuguagcaauaaaacgcuaucuaagauacuaauaguccaccauuuaaaaacagaugcuagucucaaguuuguaccuuacacacggcaguaaagcccuaguucagucuccugucacacccuucuaauuggauuuguguagcauccuuucuggucugacuauuuugaggguggacccucuagagucucuaagguggugguuuaauuaguuuuccuuugaagcauaggguggauagauggauuuuaucucuuauugaguaaggacugugagaucugaaauggagugguuuuuaggaccuugaccuuuggguucaucugacugagggggcucagcagcugaguugcugucaguuuguccuauuuuagauggcccuaugcacuaacuaauugugguuaagauuggcaaaaacucaugggagggcguuuuacccucucggguaucuuuguuuuugauaagagaaucgacucugauccaugagucugggcuauaaauauuaucauuggccauacauggugcuaucugaaggacuuccucccaaaauaaggaggcuuggguuuuuuuuuuuuuuuuuuuuuuuuugucuaucuuuaucccucuguguuuuaguagggcacauauuucccugagcuggggugguuuuuuuuuauaugauggugaguuucacaugguagaaaagaugaaaaacgcuuguccaaugggaauguucccuuggccuauugguccaaaugcuaagccuuucugcagauuuaagaacuggcagccacccuguggcucuuaauuggcugcugcauuaccagguuuucuuuguuuuaaggagaaguuaagagucuuugccaacgccauuggauuuagacagaggccagaggaaccuucggccaacaccagagaguagcucuggccagaaggcuucaguugucccuuuagcuugucuaaauccaugugaucaccuucccggaguauuaguucuguguggucguuuuguucacucuugccccacuuuggucuccagaugugggccuaaguaccagaaguuuuccacggagaccccucuccaagcaaggugggaaggccacagcaagggaagugaguggaggcagggagacagacgaagccucugccaugccuucuggguugcucaguaacucugagccugggucugugaaaagccuacaauccagugaggaaugcagcagaacucaggcacagcucuucgggagagaucucuucccaaguguuacagcucuuggaacaaaagggucagacaaaggaauaguucucacauuccuuuaauucccugcauggcucuccuauacacaguucuggcagugauuuagaguuugacagcaagccccucucauuggcuugggcugagaguuugggggaaaccuuauuugcaugugagagggcuucgugcuguucuuaaguggcugauagccacgccucucugguggggguuguggaggaggguccaggagccaugagagaacuuccaucccauguaagugaauugucacuaccgggucccgggguucaagaucuagccucgacuggaaaccaggcugucuguacauagcccauugccccacauucaagaauaagguuuaggcccaggcccacaucacuccuuucuuuaggcccaggcugcuucaagagucaggcugcuucaugagucaggcauaggcuugcaugucuugcauugggcccaggccucuuuaaauuucagggauagucucaggcccacaucacuucuugcuuuggacacgccucuucaagccucauggauaggcccaggcccucaucacuucuugcauaagggcccaggcccucaucuuuuuugcuuuugguccgguccucuucaauguucaggaauaagccugggcacacaucacuucuuucuuuaggcccaggccucuucaaaguucagggagaggcccaggcccacauaacuucuugcuuuugucccaaggcucuucaaggcucaggcccacaucacuuuuugcuuagugcccaggccucuucaacggucagggauaggaccaggcccacaucacuucuuucuuuaugccagggccucuucaaagcucgguauauacccaggcucuuucacuucuaccuuuugucccgggccucuucaaacgucagggauagucccaggcccacaucacucuuugcuuuuggcccggaccacuucaagggucacaggcccaggcccacaacaaauuugcuuuuggcaaggguguuuucaaggaucaggaauaggcccaggccaauaucacuccuugcuuuuagucucaggucucuucaauguucaggaauaggccugggcacauauuucuuucuuuaggcccgggcugcuucaaggguuaggcguaggcccaggcccucuucaaauuucagggaugggcccaggccucuucauauuucagggauaggcccaggccuacaucacuucuugcuuuuggcccgggugucuucuaggaucagugaugagcaaggccuacaucacuuuuuacuuuuggcccgggccucuucaagggucaggcacaggaacaggcccucuucacuuguuguauuggacccaggccucuuucaauuucaaggauagguccagguacacaucacuuauuucuuuuggcccaggcccucauuuuuuuuuuaguuucuguccgggauucuucaauguucaggaguaguccugggcacauaucacuucuuucuuuaggaccgggccuuuucaagggucaggcauagacccuggcacaugucacuuuuuuucuuuagacccuggcuucuucaaacuucagggauaggcccaggaacccauuacuucuugcuuuaggucugggccucuucaagggucagggauaguccaaugcccacauuacuuauuccuuuugucccaaggcucuucaagggucaggcauaggcccaggcccucuucacuucuuguguugggcacaggccucguuaaauaucacggauaggcccaggcccacaucacuucuuucuuuaggcccaguccucuucaaacuccaggaauaggcccaggcccccaucacuucuugcuuuuguccagggccucuucaaggguuaggguuaggcccaggcccacauuacuucuugcuuuugguccuggcccuuaucuuuuuugccuuugguccgggccucuucaauguucaggaauaggcccgggcacacaucacuucuuucuuuaggcccaggccucuucaaaguucagggagaggcccauucccacauaacuucuuucuuuuggcccaggcuuucaucuuugcuuuuggucaggcccucuucaguguucacgaauaggccugggcacauaucacuacuuucuuuaggccugggccucuucaugggucagugauaggccaaugcccacauuacuuauuccuuuugucccaaggcucuucuaggaucaggcauaggcccagguccucuucacuuuuguuaggcccaggccucuuuaaaugucagggauaggcccaggcccacaucacuucauucuauuggccugugccucuuccagggccagugauuaucaaggccuacaucacuuuuugcuuuuaauccaggccucuuguaaugucagggauaggcccaggcacacuucacuucuucauuuuggccagggccacgucaagggucagggauaggccuaggcccacaucacuucuuuuggccagggccucuucaacguucaggguuaggcccaggcccacaucacuccuugcauuuggccugggccauuucaugggucaagguuaggcccaggcccacaucacuucuugcuuuuggcccaggccuucaucuuuuuuacuuuugguccaggccucuugaauguucaggaauaggccuggggacauaucacuacuuucuuuaggccugggccucuucaagggucaggcauaagcccaggcccucuucacaucuugcauuggucccaggccucuuuaaauuucagggauagacccaggcccacaucacuucuugcuuuuggccuggggucucuucaagggucagggaugggcccaugcccacuucauauuuugccuuuggcccaggccucuucaagggucagggauaggcccaggccaaaaaacaaaaagugaugugccuuuccuucucuucccacuuucccccuuucccccuccccccuuucccagacacuugaagaggcccaggccuaaagcaagaagugaaaggggccugggccuaucccugaaguuuccuuuuuccuuuccuucccuuccccucccccuucccccucccccuuccccccucccccuucccccuucccccuucccccuuuccccuuuucccuuuccccaggccucucaaagguaaguagaugaccaugcccacaucacuucuugcuuuuggcccaggccucuucaaucaagggucagggauaggcccagacccucaucacuucuuucuuuaggcccggaccucuucaagggucugacauaggcccaggcccucuucucguuuugcauuaggcccaggccacuuuaaauuuuaggaauaggcacaggcccacaucacuccuugcuuuuggcccgggaucuucaauguucaggaauaggccugggcacauaucgcuucuuucuuuaggccuagaccucuuuaaguguuggggauaggccaaugcccccaucauuucuuccuuuugucccuuuugucuucaagggucaggcauaggcccaggcccucuucacuucuuguguugagcccaggccucuuuaacugucagggauaggcccaggccuacaucacuucuugcuuuaggcccgggccucuucaaacuuuagggauaggcccagccccccauuacuucuugauuuugacccuggaacucaauuuuuuugcuucuaguccgggccucuucaaugugcaggaguaggcccgggcucauaucacuucuuucuuugggcccgggccucuucaaacuucagggacaggaccaggcacuuuaacuucuuucuuguggcccgggccucuucauaugucagggauaggccuaggcccacaucucuucuucuuuuuggccugggccucuucaagggucaggguuaggcccaggcccucaucuuuuauuuacuuuggccugggccucuuuaauguucagggauaggcccgggaacauaaaacuuuuuucuuuaggccugggccucuucaaacuucagggauaggaucaggcacuuuuaacuucucucuuguggcccgggccucuucauaugucagggauaggccucuucauggaucgggaggauaggccaauacccauaucacuucuuccauuugucccaaggcucuucuagggucaggcauauuacagggauagccccaggcccacaucacuucuugccuuuggcucagucccucauuuuuuugcuuuuugucugggccucuucaaaggucaggcauaggcccagacccucuucauaacuuguauugugcccaggccucuuuaaauuucagggauaggcccaggcccacaucacauuuugcuuuuagccccagccucuucaagggucaggguuagguccaggcccacauuauuuuuuguuuuucagcccggcccucuucaauugucugggauaagcccaggcccucaucaauucuugcuuuuggccugagccucucaaaguuagguauaggcccagcccacauuacuucuuucuuuaugcuaggucucuucaaaggucagggauuugcccaggucaacaucacuucuugcuuuuguuccaggccucuucaagguucagggacaggcccaggcccacaucacuuuuuuugcuuuuggccugggcccucuucuggggcaggguuaggccuaggcccauaucucuauuugguuuggaccugacuuccuuccaggucagauuuucccauugcccacacucuuuuuuuuuuccuguuuguuuggccaggccucuuucuuuucaguccuacuuaucuagguccagaaaaccucacuaucaggguauaugauucuuuuuauguuugaaguacuggauucuuuugaguucaaauuuguccaaagcuucuuuguuuuuagccuugaucuuggucaauauuuuggggaaaaaggagacagauauugauugauauauuuaguauucuucucuggcaucucaaauacacucagaucaucauugaccuauccacuaggaaacaugcucagacuuuacacucauagcuuacguacaguccagguaaaacacauuauacacuauacaauuagaaagauuaauaaaaaaagaucccuguugcauagcuguccaugccugugguagagaguacccaugaacucauguggaaagauuguugcuucuaaguugugagagccacaggagagucucaccaaggccccaugaugcauaacccuccuuccggaggucucaugacuuaauaucacagaaaguuaggggaaacaauagagguuaguccuccaaaugucuugcuaaggcacugaaggcugugcagaucuucacaauuuccuauaugggauggguuuucuuucuauguguuguacauggccaugcucugugaggauauuccucuaguccuugcuauuaccacgucuguccuguccaucaaaagcccucagauacugaacugugccuuagucaccccuuucacaaaaagcccucugucaaguacauguccugaugugagaucaggucuuuacccaaagauuuuccuacauugacuuaccuagaaaggaucucugccaccuucuccuaucauggacucugcugcccucagaacuaggguacacccacaaccaugacagugaccccuucugugaggucacagaggccaagccucacucuuuuuaggaaagcucaaaggguguccaggcacacaggugccuuuuggacugguaucaaauugauugaaauuuuggccucuaaccugucucuucaccaccuuuaaacacaacuuguaguaagauuucccagcaagcagcauuucaggaaguuucccucccuggccucaucaugauagucgaugacuucugagaaugucacuaaagaaacaacugauaugauccuacacacacacacacacacacacacacacacacacacacacacacacauucauucacaaaaacauuaacagccauaaauauaaauauguuaaguagaugaagaagggaugugauaucaaugucuguggccaugcaggaaagggccuuugaguugaaaauaaagauuucuaggaagguucauguuuaaaagaaaacacagagaagguccugggaaagcacuuccuuaugaaccuguguagcauauguucccugaaauaaugacauagggggcaguguaaguaguugaucacuugcgugaguuuugagucuuaaaagcaggcacugacuugacaguuucuuccagaggccucccuuccuggcacguguauggugucuucuuccugagucuauguauagcaugccauucggcaggcacccuuguauuuacugcuguucuggcuuaacagaacuccuguuguguuaaauaaggaacaccucaagaacuucacagagccccugucacugccauucagguccuugcuccugcacuuuccugcaugccuuuauaccugaaggcacauguacucccauauauacacucccagaccaugcacacuaaacauacaauuuaaauauaauuauguauagugugcaggguuagguagagugcuagaauaauauguccuguuuguggggcaaugggcuauacacagacagucuggucuccagucaagcugaggucugaacucugagacccaguggugauaauucaccuacaugggacggaaggaguucucucaugucuccuggaacuauggcuccugucaaaguuaccuuccccucagcccccacaggagaagcaugguuaguagucauauaggcaaugucccaagcuucugaccuucaggcuagacuccuccccaguuaccuagcaacaguaaagauaacagcauaccauaaaaagggcuguuugaccucuccucacucucucacuccucuugcucuuaauccccuuacuauccucucucauuuccucucuuuucgucucucucccucuuacccucuagcucuuaaaccauagacuaucucugcucaucaaggcccacugcacagacucucaccugugugggaaccucucucccucagcccucacucccauaaccccggggcuacagggugucauuccagggcucccgguugggggcugccccuuguccgccccccauugaguggggucaguggcuuagaugccuacccggggcugaguggaaagcgucuggcagcccucccaugucugcuugcccagagcauagguggaacucuggcuggacgugggcuauccucccucccccucuuccccagccucccuuuuaguucccacaccuguugaguaccugcuuucggucaugcuggagacaaccccuggacauacaagacaagauuauuacugugaagaagcaaagucccuucagaagcccagacaguaggacucuguaccaucuccuaccugcccuggacacaaugggcugccauagcugauaguuguccauggcuuagggcacaacagcagagcuucauccugcacuagucuggcgccuggagucuuuccaugugguacaagcugggugugaccauucccuaggcuuauugguguuguuucccugaguacuuguuuggcaaguucuuuagcauguucaugugcauaugcacaaacacacacacacacaccugcuaauacuuacugcaacaguuucuacugcuuuagcacaggcccugcuaaaggucacuucaaggaccacauuaggcuucauacacuuccucacuccuaucucccaguauagcacacugagguuuaggcaggacuucaucauggagaucuguauauauucucccaacauacagcccaacaaaccugcaguuccuuccagaucccagcccaucccugagcucccucacaccaacaccacagccuuuaaccauggcaacaggcuauaugagguaacagagcugaccacaccucucuccagcuucuucccaugugccuagauguaacauggggaacgaccaugcuuucucucuuaacauaaaguaccccgacuuguguaacuacaaguggugagcuguagguguugucucccugaguacuuguuuggcaaggucuuuagcaugcgcauaugcacacacacacacacacacacacacacacacacacacacaccuugcugauacagcaacuguuuauacauauuuguagcaagauauguggcauaauuccauguccuccucaugcacuuucacacauauggagguggaccugcagacaugagcacauacauaagaacauauacaacacaccuacaaagugaaaauauguauuuauauacagaaugagaggggaaggugcugucauggcauuucccgugauacuggcauugauguuugacucaucguggcagcucucugaguacacaugcaaagauuguuacugccagggacugaaaucaccagggaagaucagacaccagugucagggaugcucugccuccuucccuggacaagcuauguaugaugguuaaauggucaaaugugggcauggcaaaagcacuguuccguccuuccuggccuaggcugggggcucaaguccagguccauauauauguguguguguguguguguguguguguguguguguguguguguguguguaucuucuuuccaaggccucuccuccuggugagugagggguucuucuuccuacagucuugaguggccauucccacuacugugagacuucuguuucuagcucuccuuagcucucuugaagaaagucuuagagcugucuucacucagaaacauuuuaaguuccucucccuauuucugccucccccgcuuaagaccccagugaagaagugccuugcacugagugagcuacucacgugaugaauuucagguaguccaucccagaaaacagcccaagccuaggcagacacacgugcucagugugaaucccagaccuccuugcuggacucugaguuauccucaggcuaagcacucugcaguuacuaaggcagggauuuacccugugaugucacagagggcucacuucauggcacucugagaaucacaagggacauccggugcucagucaucucccaguuugguccauccuguucucuacacaacuguuucaagcaucuuuggaaacacuuagcuuugggaaaguagcugaaaguguuucuaggacaccucccugggaaucuccuacaagcaucuccugucagcccuccaucuucccacauuaccuacauccuugagaggagaaacacaguggauagcacugcuuccucagcucaagugucuguccucaucaucucagauccucuauugccaucaugguuuauugcugccccucagcccgcagggugccaucgucugccccuugucucugacaacuguaaccauacauacauaaauacauacauaauacauuuaauuaauuuuucuauuauuuuaaacuacccaauccaucacauuuguuaaagaaaaugacuuaucuuguauacuagagaaauggcucaguggcuaaggucacucacugcucuuggaggggaccugaguuuuaaccacagcaaccacauggcaugacucacaaccaucuguaacagcuccaggagauucaaugaucuuuuuuggccuucguggguacuuaagugcauaaacccacauucaaauauacacauagacauauaauuuuaaaaauaagcagucagugagauuccaccucauaccagccagaauggcuaagaucaaaaauucaggugacagcagaugcugucgaggauguagagaaagaggaacacuccuucaauguugguggaauugcaagcuuguacaaccacuccggaaaucagucuggcgguuccucagaaaauuggacauaguacuaccggaggaucccgcaauaccucuccugggcauauauccagaagauguuccaaccgguaagauggacacauggacacaugcucaccuauguucauagcagccuuauuuguaauagccagaagcuggaaagaacacagaugccccucaacagaggaauggauacagaaaaugugguacauuuacacaauggaguauuacucagcuauuaaaaagaaugaauuuaugaaauuccuaggcaaauggauggaccuggagggcaucauccugaaugagguaacccaaucacaaaagaacucacgugauauguacucauugauaaguggguauuagcccagaaacuuaggauacccaagauacaauuugcaaaacacauggaacucuagaagaacgaagacaaaaguguggacacuuugcuccuucuuagaaucgggaacaaaacacccauggaaggaguuagagacaaagauuggagcugagaugaaaggauggaccaucuagagacugccauacccggggauccaucccauaaucagcccccaaaugcugacaucauugcacacacuagcaagauuuugcugaaaggauccugauauaguuuucucuugcuaggcuaugccagggccuagcaaacacagaaguggaugcucacagucagcuauuggauggaucccagggcccccaauggaggagcuagagaaaguacccaaggagcuaaaggggucugcaacacuauagauggaacaauaugaacuaaccaguacccccuggagcuugugucucuagcuguauauguaucagaagauggccuagucggccaucagugguaagagagguccauuggucgugcaaacuuuauaugccucaguacaggggaacgccagggccaagaagugggaguguggggguggggaggggaguugggggaaggguuugggggacuuuugggguagcauuggaaauguagaaaauaccuaauuaaaaaaaauaaaaaaauaaaauaaauggcuauuaucagaaaacaaaaauaccaaaugucaaacuguaaaagcaaaguuaaaacauugguacaugccuauucuugguggaaacuuaaaauguuguggucucugaaugaaauaaaaauacagucguagcugggcaguaguggcacaugccuuuaaucccagcacuugggaggcagagguaggcggauuucugaguucaaggccaaccuggucuaaagagugaguuccaggacagccagggcuacacagagaaccccugucuugaaaaaccaaaaccaaaaccaaaaccaaaaccaaaaccaaaaccaaaaccaaaacaacaacaacaacaacaaaccaaaacaaacaaacaaaaaaggcagccaggagauggcagcacauaccuuuaaucccaaaauucgggagucagaggcaagcagaccuuuugaguuugaggagagccugguauaugcagcaaaucucagaacagccaaggcuacacagagaaacccugucucgaagaaaaaaaaaucaauaauaacaacaauaauaauaaacaauuuaaaaaagaaagugguuuaucuugccacuucucuguuacaagaucuuagcagcuguaaagagcuaaacaacuagcuauaagaauguaugaagacuaaccaaugcccaagacguuuacagugagccuaauacugccucagugaauuagaggucagccugaaaagggacagucucaggcaguguaagaaccugaggcuccugggacucugagagccagccaugucugugcagcugaaaacacagggaaaccagaagacugaaaugguaggcagaguucaguucucuuguucuagguucuuuagacuuaaaugaaaagacaacucaguucagaauuaauccacuggauagagauuucuagacuauauuguagaauuauagaacuuaagagagaaaaccaaaacaguauguuaauuugaauaggaauggcccccauaaggaucaaauauuugaaugcuuggucauuagggagugccacuacuuaaagagauuaggagauauggccuugcuggaggaagugugucacuagggguggacuuuaggguuucagaagcccaagccaggcccagugacucuccauuuucccaaugcuuguggaucugaauauagaacucucauuuuuccuguaccacaaugucuuugcacacgcuaccaugcuuccuagccaugaugacaaugaacuaaaccucuaaaacuguaagccagccacaaucaaaugcuuuccuuuuuaagaauuguuaugauaaugguguuucuucacagcaauaacugacuaagacacuuaggaagauuaaaauuauagacaugucauugggucucccuaauuauuuuuuccucccuccuuuauucucucgucccaacuuuccuuagccauaccuacucuauccuuccucaucucucugcuguuguaccucucaaugaagucuagguuaauccaugugcagucuuucauguauuauagguuagaguuagggguagagcccugaacucaugccuccccaauuuuucuaccagaaaaaaaggguccuauuuucuugguucuuauuuuaacccuccagagaauccauuugagccuggcuuggauccagugcuaauuccaugguggggaagaagaacaugagaaaugagcuguauucaaguccuacuguuagggcaggggguggggaaucucccccagaacagaauacaguuccagugaaagucauggagacaugauggcuaugagaacccugaaagagucaugaacuuagaagaggaaggcagauuuuagaaguauuucggacaacaaagaaaaaauugugcauaggaauugcacccauaggugcuagaaagaugugccuccagcuguccccuaucauaggauauaacacaauugcccuucaaugauuagaacagccuugccuucccugagggaagauggaagaaaagguaaaagguaguauagaaagaaaagacaguauuccuccucagagaaagugaguuccaagauucaucaccccagaaguacacuuucucucaggcagaaaguccuuacugugccaagaggaacccuguagagcuccaaaagccacucagugucugccuuauagccaucuacugauccaucuugagaacuucuguggccuuagcaaugugugggaagagauacacugaaacguucugucuuagucaggguuucuauuccuggacaaaacaucaugaccaagaagcaaguuggggaggaaaggguuuauucagcuuacacuuuccacguugcuguuaaucaccaaagaauaucaggacuggaacucaagcaggucaggaagcaggagcugaugcagaggccauggagggauguucuuuacuggcuugcuuccccuggcuugcucagcccguucucuuauagaacccaagacauccaacccagagauggcaucacccacaaggggccuuuaccccuugaucacuaauugagaaaaugccccauagcuggaucucauggaggcguuuccucaacugaagcuccuuucucugugauaacuccaguuugugucaaguugacacauaaaaccagccaguacaaaugguauaucuacuaguacuaguuuucauaagccacaccaccugauuuuagauuuuauuccucuucugaguuuccuuuccccucauauauuuguuuuuauucccaaaucaucaaaauggguuuugccuuaagauccucagggaaaacaggucagaaauuaauuuauugaugcuuaugucagucacugucuaaaauuuuucucauguaugaugacuucagucaauagcuauuuaaguucauuuaaauucuaagaaagaaauauuaaauauacuagacagggaaggggaaagggaaggggaaggggaaguggaaggggaaggggaaggaagggaaggaaaggagaaaggaaacuucaggaauaggcccaggcccccaucccuucuugcuuuaggccugggccucuucaagggucaggguuaggcccaggcccucaucacuuuuuucuuuagguccaggccucuucaaggguccucugucaaguacauguccugaugugagaucaggucuuuacccaaagauuuuccugcauugacuuaccuagaaaggaucucugccaccuucuccuaucauggacucugcugcccucagaacuaggguacacccauaaccaugacagugaccccuugugugaggucacagaggccaagccucauucuguuuaggaaagcucaaaggauacccaggcacacaggugccuuuuggacugguaucaaauugauugaaauuuuggccucuaaccugucucuucaccaccuuuaaacacaacuuguaguaggauuucccagaaagcagcauuucaggaagcaggagaggggcucugggaauggcuuagucaguggugcaagcacaagagccugagucccagccccagccccugcacccacauaaaaacccagaugugugugugugugugugugugugugugugugugugugugugauuaagcacauucuuguaaucucaguucugggagacagggacagcuagguuccugaggcuuauuggccggccaucuuagccucauugacaagcuugaggauccagugagagauccugucucaaaagccaaucuggauggcuccugaagagcaacacacaagcaugaagcugaagaaaagguaguggagaaacagcuuccuggcuugcucuuugcugguuuauucagccugcuuucuaacagcacucaggacugccugccuggggcaccacccacaauaggcuggacccucccuucaugugcacaugcauucacacucacuaggucaacagagauguaagcuccgagggaaaaccaguagagaaagaacuuuggcguuggcuguggggacuuguguuaaguaacaacacaagucuagugcuguggggugagcaguaguggugagaugcgcacaggaguaguaacugaaaugccugaaauggcugucaggaaagugugcugggggccugugagaugccucagugguaaagguacuugcugcagauccugaagaccugagcuucaugcccaggaccuauaaugugaaggagagaaccgacccucuuuauccucuuaccacuaagggcccucauuucuccagcucuucucagugaccguauccaugagcagaaucauagggugaugagucacagccuccacagccucaguguuccuuucuucguaugauccuaggaccuucagagucuuccugcuugucagaaacuugggguuugguccagacuugacuuuguauucuaagaacagacaauuaucauugauagaagugucuuaauuggguuucuacugcugugacaaaacaccaugaccaaacacaacuuggggaggaaagguuuuguuucaguguacacuucuauaucacaguccauuauggaaggaagucagagcaggagucuggaggcaggaguugaagcaaugaaagaacauuacuuaccagcuuucucucuccugacuugcucagacugcuuucuuacagaaccuaggaccaccuaccuagggguggcaccaccacaacgggagggaccuucccacaucaaucaguaauuuaaaaagugggcuucaggacuggagagauggcucagagguuaagagcacuggcuauucuuucagagguccuauuuucuguucccagcaagcacaugguggcucaagauugucugugauggggucugauguccucuaauagcaugcaggcauacagcauacagguagagcacucauacauaaaauacagaaauaaauuuaaaaguuucaaaaagaagaugcauuacagacuugcccucaggcagaucuuauggaaguacuuucucaaucuguauaucucuuuccugcuagcauugaugcguugacauaaaacuagugaggacaggcaguaacuaugcuauguaauaaccaugcuauguaauaaucaaagccaucauuuuuguggguguauugugagcaugccugugugugaguguguguguguguugguguguguguguguaguugcaggugccuauguuugcaugauugcacaugugggcauaucuauguagaggccagagcaccaccuuggguauuauuauuccucagggagugucuaucuuuuauuuauuuauuuauuuauuuauuuauuuauuuauuuauuuauuauggaggcucuccugggccuggagcucacugguagucuagcuagccaaugucuccugggcuuccacugucucugucuuccuaggucugggauuacaagugugugugugugcauccacacacaugcacauaaaauucagggcaauggguauucaauggguauucagggcauccugagaugcaagcuggcaaggaaaucagcagagcgagaaccuaggcaguugcuacaggggaagugggagcacaggucaaguagagcacagccagcuuuucuuuacgugagcucugggcaugaagcuugguucuuuauauuuccacagcacacacuuuaucaacugauguucccccaccccucgggccaauuuucauuagaacugugguuauuuuuaguaauucauccuauacuuccauaggaacaucuauaaagggauuuuuaaauuuaauuuuuaugugaaugaguguuuugccugcauguaaauauguguaccacauguaugcccaguguucauggucgauaaccaacaguggugcugagauccaaauucagguccucucauaagagcaguaauugcucuuaaccauugaacuaucucuccauucucuaaagacgacaaguauuauuauuuuuucuccugagacaggcuuucuccauguaguccuggcuguccuggaacuugaucuguacccuuaacucacagaggucugccugucucuaccuccugaguacugggauuaaaggugugcaucacaaccaaucagcaaauauuaucuucuuaaaaauuaugagaauuguuaaugagaucuuaaggaaggagauugcaagaagaauaaugcccauggaauucucacuuuaauauucauauuaaucacaauguuucuaccagacaugaauauucaucucucuacacaguggcuaauccauucagugccauaggcacugaaucuagaaacaucuucaaaaggacuugagauaauuugccucuaagacauucuguucucaaggcccucaagucaauagaguuuuuacagacugcugcaugcugagguaauuaucuccccauugacuuggagcaaggucagcugcugugucugcuccugagugacacuaugacauaucagcacccccuagcauguuaguguggucaggaaggaagggcaguagguguguuuugucuccaugguuucugaucucugugggcacauuuauuuacuagguauaacuucugguacacaaaggccaugugaccccuaucacucgccaucacauuuguuuauuauuuguguacggagugaggcaugugcauguguggaggucugacaaccuugagagccaguucucuccuccuaccauguggguucugggacucaaacucaggcccucaggccugguggcauguaccuuuauucacuaagccuuguugcuguaacugucauucuuuauauaucaucuugucauucucugaaaucuuauaaugaacaaaauuuuuuuucauucuuuuucagguuagucuuaucauuuuuaagauuauaaaaugacaugcauuuacuguaaccagagagacgauguuuagaucugaagagaaaaauuuaguaauuccauccucucucaacucucucccuauccccaugaaguaauaacaauugggcaauagugucauguauaaguuuguacaucuuccauauuucaugaucaucacacacacaaaauacauauauauauacacaaacaugcacguacacacacacacacacacacacacacacacacacacacacuacccagggguaagacgugacugcagggaagggaucuucuuuaauacuaugaggaaauuacuaaauaaaacaaaccacucaguuuucuguauccaaagauuccaugguugaaguggaaauuucugguuucuuuguagacucagcugugucauaugcuguuuuucuggaaacugucuuaaaagagguuguuugugcugaagcagacacaugggaggauguuuugcugagaacagacaugugguguuuucuggaagcugccugggaaaagggcaugagauguuuugcuagaguggacacuugagagaaaugugauguuuggagagauuacaaauauaacccaacagacaguggauacugcugugugguauugguucaccuugccacucuuugcugguuauuauuuguugugacuucauagagagaaacacaccaaagaacuccuggugguguuccugugguuuccuguugcuucuacugacucgggcugauugacagagccuugcaguuucuucuggauagaacugcuguugcugauuuaugaguaguguaugugaguggauugagcuauugcuacugauucaugugaauuuaacugcugauauccugacaauacagauuggauuuguuauaaacccaaucuauuucuaaacagguccacauccuccuuuacccuauuaacuuuuccuuucuacuaucucugguaaauggugggcuagaagggaaauuaaagcauuuacauacacuucguuguaguuauuuuuaaucccaauccgggguuucuaucgugacuuuaaucauucaguuccuggauaaaagacauacugugaugguuuggccuagagaguggcauaauuuggagguguggccuaguuggaguaggugugucacugugggcauggguuuuaaggccuuugucuuagcugccuggaagccaguauucugcuagcagccuucagaugaagauguagaacucucagcuccuccuguaccaugccugccuggauguugcuauguuccuuccaugaugauaauggacugaaccuguaagccagccccaguuaauuguuguucuuauaagaguugccuuggucauagugucuguucauagcaaugaaacccaacuaagacaccacuuaugucucuucugcccagcuguugacuguuggcauuuuuauuuaccagucagaaaaauuugggcauagggucacauagcaucacucgagucuauaugcagacuucaggucuugggggcccacacuuagcauuacaauagacagcaagaccaaaccucaacaacacuuauuaaaguagguuuugaaaaauauaagcacacacauggucuucuguucacauguuuuuuaaagacaaggucucauauagcacaggauuggcuugaacuuucuauguagcugagaaugguccuuuugucucagaugcugggauuauagguaugugcuuucacuuuuucuaugcucuacauuucugaaaacauaaugccuuaaaauguaauaaguggggcuggagagauggcucugugguucagagcauguacugcucuugcagagaaccucgguucauuucccagcacccacacauguacuaccacugauggcucaagcuccagugggggacccaaugcugucucacaccucuaagugcacacacagaacccccccaccagauacauauacauaacauaauuuaaaauaauaaaaaauuuuaaacuguaauaaaguugacaagauaguucaguggauagaagaacuugauaugcaagccugauaaucaaaauuugaucccugaggccaccauggaaggggugauguuauucucacaagucauccucugaucuacacacacacacacacacacacacacacacacacacacacuuuuaaaaaaauuuuuguagaucgucuauguuuauuuacuuuuauaacaagcuauaauauugacauuuuauacaagucaacuaccaauaacaauacguucaaguguaauaauaucuucauaaaaaucuagcauuaaugcccaauguacuauucacagauuuucuuuuaacuucaucaaaauaaacccagcaauaaaaaauccuccaaauagccagguggugguggcacaugccuuuaaucccagcacuugggaggcagaggcaggcggauuucugaguccgaagccagccuggucuacagagugaguuucaggacagccagggauacacagagaaacucugucuugaaaaagccaaaaaaaaaaaaaaaaaaaaaaaaaaaaaaaaaaccaacaacaacaaaaaacaaaauccuccaaauagaugaucaauagagugauaauauaaagcauuauacaaaucuuauugaaaauaucauuaaaauuaauuuauagacuaauauauagcauauagccuaugcagugugcuacaaaguuagguauugacaauauguuauaaaguuggcauaagccaggaaggaagaaauauggaauugggcagguguaaaauaauuauuuauaaaaguagaaaauuuaaaaacuuuucuacaacaaucugaaucuacaacaaucaguucuauauagcuucauuaaugauguuucccuuauaaauaagaaagacaucuuagaacauuucccauuuaagaagaaggauauaggaucgggagcuccaaaauggacaugaauauuuuuuuuuaucuuuuuaaaaaaauacuguuuuuauuagauaguuuuuauuuacauuucaaauguuauccccuuuccuaguuuccccucugaaaacccccuauucccucccccucccccugcucaccaacucauccacucccacuuccuggcccuggcauuccccuacacuggggcauagcaccuucauaggaccaagggccucuccucccauucauugccaacuaggccauccucugcuacaugugcagcuagagacaugagucccaccauguguuugcuuugguugguaguuuauucccaggagcucuggggguacugguuaguucauauuguuguuccuccuauggggcugcaaaccccuucagcuccuuggguacuuucucuagcuccuucauuggggacccuguucuccauccaauggauggcuguaagcauccacuucuauauuugucaggcacuggcagagccucucaggagacaacuauaucaggcuacugucagcaagcucuuguuggcauccacaauagugucuggguuuggugguuauauaugggauguauccccagauggggccaucucuggauggucauucuuucagucugugcucugaacuuuaucuguguaacucuucccaugaguauuuuguucccccuucuaagaaggauugaaauauccacacuuuggucuuccuuuuucuugaguuucauguguuuugcaaauuguaucuuggguauuccgagcuucugggcuaauauccacuuaucagugagugcagaucauguguguucuuuugugauugaguugccucacucaggaugauauuuucuaguuccauccauuugccgaagaauuucauaaauucauuuuuuaaauagcugcgcaguacuccauuguguaaaugugccacguuuucuguauccauuccucucuugagggacaucuggguucuuuccaguuucuggauauuauaaauaaggcugcuaugaacauaguggagcauguguccuuauuacaaguuggagcaucuucuggguauaugcccaggagugguauugcuggacccucugguaauacuguguccaauuuucugaagaacuaccaaacugcuuuccagagugguuguuccagcuugcaaacacacacacacacauguaauuuaaaauuuuuaaauguaaaaauagagagugaaauccccacucauugaucagcaagagcucauacauuagucuucagcuucaugagucucaguagcugggggcagauggguagggauucaccaggagcucagcacuuauuaaaugcuaaacacaaagaaauucaugcuucuauugcuaugguaauggagaauaugugagcacuuguguuagaaggcacaaauauaucacuuuuaaagaagugagaagcccaguucagccuggacaagcccagagcagugcaaguggccaaggucauaaacaaugagaucccagaaguguggccucccagcuaaaaucuauaguuaacaggcacagauaggcaugcucucugacuggggaagccauccaguuuggcugugguuuuguauacuuuuacaugguuggcuggaaaugaacuggaacaauucagcuuuuaaugggaaaauucuuaguuauggacuaggugcuacauccaagugcuuggcugugcugccugaaaagaucuuguggcucugauguugcucuguacucuaaugaucuggagagacccuuuugaagaauagacuucaagggcugcugugauccuuugaaugaaaauggcucccauagguucacagugagugguugggccuucuuggaauagguguggccuuguugguggaagucugucacugggggugggcuuugagguauuagaaacucaagccaaucccaguggcucacucucuuuuccugcugcuugcugguccaguguagguuucucagcuaccucaucacuaccauuucugccugcaugcugccaugcuucccaucaugaugacaauggauuaaaccucugaacuguaagccagccccaguuaaauguuuuuuuuuuuuuuuaguuguuuuuuguuuuuuuuuuuucuuuauaagaguugccauggucauagugucuuugcaagauaccuucuguucugggccuucaacugccacugaggcugcaccuucaccaauggccuuuccuggccucucacagugacaagcaucagcugcucuccauaacuccgucaucccuucaaaaccuguaucucaugggaaauucuuacacauuaccgaguauugcugccagcacaaggucugucucuggaaaauagcuucuuugugguuucagaaaacacuucccagaagauuucccuucagugauguugcucucuucuuaaucacugcuaauuuuuuagcuccagucuacuagcaucauuuguaccaguaaucccuucuauucuugacucuaaaguuacucuuuacaugguccaagcagcucaguucugcugcuugcugguacuggaacauagccuccuuauucuauuacaucuucaccgcuuucuguuuucaauuauuuccugcacugccuaagcucaggugaccuagaacuugcucuguaaauugaucuugaacucagagaucuguaugccugucucccaagugcugugauuaaaaguguauaccaccacaccuagaccuaagauuuucuuuaccuggaacuuguucuguagaccaggcuugacucugucuccugaguccugggauuaaagaugaguaucagaaccuagauuuucuuuaacuucuuuucacaagaucuuuauaagcauggcuacucugccucaagauccugaucaaaaaagccugugucuuccagucucauggucuggauuacuugggugcccuccauuucuagauugcaguucauuccauauauagucaaguugacaacaaagaguagcugucaccauccaucccuugcugauuugacacacaguuguaucuuuuuauguccaaaagaaaacaauaagcugcucauaauaacaccuaacaugauauaacuguuccuuguucaacugcaaaugcauaaacaauuacacuacccaggugugaucuugcccugagguuaccacuccuuuaauugcaauuaacauccuugaacacaggauuuaccucuauuccacuuccugaugucccuuuaaucuuugaaccauacauuuuguauuuuuccuuucuaugcuugcuauguuugaucaaaagguucuuccuaagagugaaccacaggauagaaucuaaguuaugcuguuuugagauuuccauggucaaggcaaguaaucuaaaacucuucacuuuagccgcaggcagauucuucagacaagggcaaaaaagaagcuacauccuucaccaaaauaucacaaguacaguuucuaggucacauacuaaaauuucucuccccugaaaccucuugagccaggcucucacaguucaaaucauccucaacaccauugucuuccaugguuuugaacaucuuuccuaggauagcacauuaagacacacuuaccacaucccauugcuuuccaaagucccaaaauccauauuccuccaaacaagagcauggucaggccugucauagcaauacuucagucccugguaccagcuuccaacuuaguuaagguuucauugcuuugaggauaaaucaugaccaaggcaacuuguacuggcuaguuuugugucaacuugacacagcuggaguuaucacagagaggggagcuucaguugaggaaaugccuccaugagauccaacuguagggcauuuucucaauuagugaucaagggggaaaggcuccuugugggugggaccaucucugggcugguagucuuggguucuauaagagagcaggcugagcaagccaggaaaagcaagccaguaaagaacaucccuccauggccucugaaucagcuccugcuuccugacuugcuugaguuccaguucugacuuccuuuggugaugaacagcaguauggaaguuuaagcugaguaaacccuuuccuccccaacuugcuucuuggucaugauguuugugcaggaauagaaacccugacuaagacacaacucuuauaaaauaaaauauuuaauuggagcuaacuuauuauuucggagguucaguccauugccaccaugucaggaagcauggcagcauuccugcagacuuggugcugaaggagccuagaguucuauaucuugauccaaaggcaacaagaaggagacugucuauuucaggcagccaggaggagacuauguuccacacugagcggagccugagcauaggagaccccaaagcccaucuacacagugacacacuuccucuaacaaagccacaucuccuuuaacaaggucacaccugcuaauagugccacucccuguggcaaagcauucaaauacaugagucuaugggugccaacccuauccaaaccaccacaguauuuaaucuggguuuguccauauggaucuaaagaaauccucagguaaggaagacuuuuagcuaaguacauugugaacaagaacucccgagaagaggcugugccugaaauaacugauuggcugauuagaauuucaguacugugaagagauuuaaauguugcagguccaaaggcuaccuugaacuaguucuagcucuguggaacagccauucauugcccaucucuguaucagaacuaaaaucuucucucuaauacauaaaaaccuuuuggaaucuacuaacuuagcagauuaauagcuuccaccaccccagaaguucauauaauguuuugggucuauaguaaagguugggcccaucuugcuguaccugccucucuaauguacccaccaauguauuuuaaacuugccuugaugugugacuuucuuuguucuguaaaaugauuaaaaaccucaugaaacugcuucccuauuggaacauagaauuagagagauaauaaaucuguauuccuuguuuguagaguuucacucaaaauggcuccacaauaaacugucuuaauuccauuuaggaugggagcugugacauugcuucaacgauauaaagagaauaucuuccuugaagaggcuuguuacauuccuuucccacaugaaugaaugucuguuuauuccaguuagggcaccaauggaccaaaggaaaaaaaaagccaucugauuuuggcuuaguguucuaaugaguuguugggguuacugcagaaacaugggugaggagucacuuacaggaguagguguaauucuacauugucuucaucucugggaucuccuacccuagcacaggugguagaaaucacaaaaugugcagagaguuuugccuucaguuagccuuucuccuauaguaccuccuggaaugaaggacaggaguaugugacuguagucucaaaugagugauggccacccaccacuccaugaaaggaaugugucuuaguguuucuauugcuauaaagagacacuaugaccaucacaacuuuuauaaaggaaaccauuuaacugggaccuugcuuaugguucagagguuuaauccauugucauccuggugggaagcauggcaucauacaggcggacaaggugcugggaaaauagcugagaguucuacaucuggauggacaggcagcaggaggaguguguaacaccgggcuuggcuugaguuucuaaagccucaaaacccacuuccugugacacacuuccuccaaagccacaagcccucuaauccuuucaaauaguuccuuucucuauaagccuaugguggccauuuucauucaaaccaccacaggaaugaaaauaggugaaaaauugugaggguuuccuggggguguaaacacagcuucuuaauuuccaaauggcaguggcuauaguuguaaggaaggcagaauuucacaagcucuucuucauaacuuuaauucacuacuuccuccgaguuuuugcauuuucuuucaccaacauccauugaauuuguuagccuguagagucccaggccuagggaaggaaucuguacuccuucuaaugacauauugaguuacugcaacucuuccauacaccucacauaacgauuagguggcaugagagugaucaguggcaagaggcugagggaguacaaacaucuguggaaagcaaguuuggugugacuguaaauaguuacaaagaauaguuauaaaauagucccuuccauaaaccaguugaauucuccagcugaugauaaagcaagacugggauuuuguuuauaauuaaaacugucaggaaaguucuuccucaagucauagugaaagccaaaguggaacucacauuguguacgaucagaguucuaggccagcacaagaacaagcaaugacaacgauggacauguccagaccuaguaggaacugaauauuugaccgugggccaccaagucaccauacaaccugagcugcccaucaugaaucugacucgacaaaucauaaaguaggaugugcacagcagcaauucauuaucaaauggaaauaguacauacaugcuagggccugagccagucccgaaggcacaagcaaguuacaugaaguugcucaaaugacuaucauuuucuauuccuguuacaacgcucucugcuaccaagcaugcacccauugccucaugggauuauacccaugauugguuggcuaaggaugagaggacuacugaugacucugcuuguucuguuguccacccagaggugggcagcugcagccuuacaaauccuuucuggagcagugcugaaaggcaugugugaagggaaaucuucgcagcgagcagaacuugggcaguacacauaaucauccacuuuguuuagaaggagaagcggccagaagugcgauuguucacugauucaugagcuguagccaguugguuggcuggaugguuagggacuuggaaagagcaugacuggaaaauuggugagaaagacaucuggggaagauguauguggauagaugucuccaaaugggcaaagguugugaagauacuugcgucucauguaauugguuaugaaaaggugacuucagcugaggaguucaguaaucaaguagaucggaugacccauucugugaacagucagcucuuuuccccagccauuccugucauucccaaugugcccaugaaugacgugucucugguggcacagauaggggucauauaugggcucaacaacacggacuuccacuuaccaagacuggccuggcgacagcugcugcugagugccaggucugacaacaacagagacaaacacuguggcccagccauggcaccugaggugaccagccagcaacccggcggcacgcugaccgcaugcgaccacuuccucuguggaaggacgacacuuuguuuuuauuagaguagauacgguuauggauuuucauuucucgcucauaauguuucuguccagaccaucacauauggacuuaauuaaugccuuaucuacuaucauuagaguccacauaguauuauuuuugaccaaggcucacuucauggccugagaaauaggagaguggguccaugaucaugaaauccacuggccuuaccauguaccccgucaucuugaagcagcuggccauauggaauggccuuuugaagacacaguuacagugucaguuagguagcagcagccugaagggcuggggcaaggcucuccccaaguaggugauagaugcuuugaaucagcauccgauauauaguauaauuucucuucuagccaggaucuauggguccaggaaucaagacauggaaaaggaaaugccauuuauuaccaccccacuagugacccacuagucuguuccugugaccuuaaaagaauugauaaaaugccagaugucaaagaagcaagaaacuuuauuuaaggagacaguacaagauacacugcaaaggcgcagcaggaugccuuagcuagagcgcaggaugccugaguugagcuaagcacaguguguuauuguuuguguucuucuuuuaugggauccagacugaggaguuaguugcuauggguaagguagguguggauuucugcuuugauugacaggcuuaaguuauguaagcuuuucuucauuaugcuugccauuuuccaugaugcaucuuauuuuacucacaugaauucauaaucuugcauagacauaugaugguagauagauuuuuuuccucucuaaaaggucaaaaaacacaguuugcauuacuguguguguucccuaaagugguucaggcugccuuaucuccuuuccucucguuacuggauguuugaauaaaaaccgaccauagcgguuugaaugagaaaugucucccuagguucauauauuuaaaggcuugcuucauacuugagaauaauuggggaguguggccuuauugaaggagauguaucacuaggauggcuuugagauuucguucuuuuuucuuuauugaaaguagauuuuuuuauggaauauauuuugauaauguuuucccucccccagaucugucccaccuccuaacuuccccaaaucuacaucacauugucucuuucucucauuagagaaccaucagacauuaugguggaauaauuucauuguguguacaaccugcauuuaagggcauguuccaugccuggcaguagaaaucaaaacucaaaauguuuggaggguuuuugucaauuggagauagcuucuggguuagaaauggggacuugugaccaguuccccuuucagacccugucugacuuaggcuugauccacugcugugcaugcugccaucaucccugugaguucuuaugugcaucaguccugucaugucugaaagucuuuguuucucugguguuguccaucccuucuggcucuuacagucuuuccaccagcucuucuucagaguucccugagccucgagaguaguuguuugcuggacauccuauuuaguagugaguguuccagggucucucacucucugcacauugucuggcuguggguaagguucaaaaacaugagucuaugggggccauacuuaaacauagcauaaugcaaaaugcauuuaguccaacuuucaaaguccucauagucuauagcagucgcaacaauguuaaaaguccaaaguucaaggucucuucugagauucauucaacuuaauuaacuguaauccccaaagcaaggcaggaaaccagcugggcaaacuccaaacucugcaucuccauggcugaugucaaagccgucuucagaucuccacuucuuuuucaucuuuguugauugcaacaaacugcuuucuccugggcugguuccacucccuguuagcagcuuuucucagcauguaucugaagcugccgaguucugcugcuuacaggaacuagaacaugauccacuuguacuauuacauuaucacuagcuuuauguuuucuaaacccuucacugccuaagcuugccuauccugguucuugcucuguagauugaccuuaugcugcagcuguccacuucuggguggugccugcauaacgugcagagccaucaguaaaccaggcccuagucuucuccucuucggucagucgaucauagggaacaccccaugaggcuauaggcgcaugcuuggcagcagaugacauuguaacaggaguagaaaccauaggcauuugagcaacuucuucauguaacuugcuugugccuucaggaccugcucuggcccgaucacguauauaccacuuccauuugauauuuggucccaucuauugcaagaggaagcuucucugaugaugccugaggaagacagugauccauggaucuaacagaaugucauuaggagccacuucacugcuacauuccuaguuuagcaaagcaguaguauuugguuuucuccuaggucuauggccuaucuagccucaaguucuuggcuaccugagcaguguuggacauggguucugucucauggaguaggcuuuacuuccaaacagauagugguuaguuacuaccacaacuuuuaugccacuauuuuacucagguaucuuuuuggcagaucaggucaccauugcauauuuaaggguuuguagcuggauugcuguuuaucuuuucuuuuuuguagcaugcagaguacauucuaguaccaugaaugcuuuuaguaggagugaagguuccugguagacugcaguucaacuucuucaugugcagugaguuauguagguguuguuuucagcaacagggccuugcugucaguuuguggagaacaacuaacagcuuuggcaguagcccgauaucuuaggauuuccauuguugugaagaaacaccaugaucauggcaacucuuagaaaauaaaacauuuaauuggggcuggcuaucauaugucuaugcaagauuaugaauucauaugaguaaaaucagauguaucauggaaaauggcaagcauaaugaagaaaaguuuacauaauuuaagccugucaaucaaagcagaaauccacacauaccuuacccauagcaacuaacuccucagauuagaauuacagaauuuuaguccauuaauauuacagcaggaaacauggcagagugcaggcaggcaugugcuggagaaggagcuaagaguucuauaucuugaucugaagucagcagaaggagacugugucacugcguguagugugagcacaggagaccucaaagccugccccuacagugacauacuuccuccaacaaggccacucccacucuaacaaggucacaccuccuaauagugccauuccuuuuggccaagcauucaaauauaugagucuguggaggccauaccuauucaaaccaauacacuuggguuguuuaggauauucccuuuggcuaauaucuugaauagaugugacccauucccagcacugggcuuugagguuucaaaagcccacgucauuccuguuagcugucuuucuuccucaggguuguugucucaacauguaaguucuuagcuauugccccagcacuaagccugccugccugcugccacacuauggucauagaguaauccucuaaauguguaagcaacucccaaauagaccuuuucuucccuauaaguuuccuuggucauagugucucuucacagcaauagaaaaauaacuaagacaugaaccacaaaauggaagucaucaccaaguuguuagaaaggaguaacuuauucuauguuuugaagugggguguacaugcagguuagaguccuagauugcuagaugcauuguuagcagaucugugugcacauagcccaagucaagugaaguccaggcuaaguuauucccuaugcuugcuuguaccaggaugacuucuuucuagccugaaucaggacaaagacuuauuugagccagguuuccuaacccuauaggaaauuacugaaucauaucaacaugaucaauaagaccaaauucugaacguaaagcaagaacaagucuuagucagguguggguuugcugcuguuuauagcucccacucugcucuccuuuuuucuagaacucucucccauuuuuuuccuuucgauaaaacacaauguacacuauuauuacucccaucuggucuccgagagacagggugcuccacauccuccagcucuuccuucggucuacugcggaauauuuggucuacaugauuguuggcugccucaugagcucuuuucacucgaaacguugugacagcuugcuguccacagugauggcagcuagugcuaucuuaacagcagugaucuuuccuugcuucaccaaagaucugugugauguugcccgucggguagggauucugcugccucuuccagaagcagcugaagcuucuaauugcucuucugcaagugaacagaaugaugguuauacaaacugacuuccugaugaugccugcuaccagguucaucucagcuuauauggaggcuuuccagguaggccaaggccaucaugguugggcucauaggacccugaauuucauagugugucucagucuagcuagcaagcacgaugggugagacaacuugcagucucagcuggguauuauauaucuauaaucagaguauuugggagguugagacaggaggacugccacuaauuccaccucucuuucaaaaaccaaacugaaauaaaacaacauaaaagagaauaaaauuaaaauuaaucuuugugaauaccauuccucagaggggccuggagagaugaugcagcaguuaagagcacuugucucagaagacccaggcucaaucuccagaauccaugcugggugguucuaagcagacccaauccucugaucucuuagguacacacacacacacacacacacacacagaaaaacccucauaacaacuuacauauucucuggaaauuaaacuuagcauuaagaacuaguucaaaauaaaagaggacagaaaauugggucauaguggagugggaauggagcuggaaggaguuaacaggaggaguuucaggugaaugugcuuaaaauaugcuguaugggauucccaaugaauuaaugaagauauuuaaaaaugcuucuaauuauaaguaguaaaagacuaauacaugauucuuaaauguaugcuuauuuggaaaacaauuccaaauauuauguuuguuguuguuuuguuugagguugggucuugcuauauagcacuggcugcucuagaauucaguguguagaucaggcuagccucaggguuguggccaucuuucagcaccaucauacucagcuccacgcaucacuuuaguuuaugacugccaaguuacugugacagagcucauugacagagggcuugaaccucacacuccccucuguucucuucuuauagacuagccacaguuccuuuucuucacauuacuucuugagaauaaaaaaauccaauauugcagaccacugaacugaaaaguaaucugcugggaaugaguuaggauagccuucuguccuucgugacugccauucagagaggcucauaaaccaucccaagggcagcuggauccuacagaggagagcucaggacaagcugagugcugccuucugagcagggccgcugugaacaaagggagaacgugaccaaaggccucaguauaccuucuaacugauuuucagggauuuaaaguuaugaaauguauuugcuuucuauuaaacaaaguccauaagcaaaugucaaguugauugcuuaaagcugaaugcaaaggcuggagccuguaacuccaucacuugggaagccgaggcaggaggacugucaccaguucuaggcuagccugggcuacagucucauaauaccaggaaaaaaaaaugauugucuaaaacagugcagaaaggacuagagacccuuagcagacauuuucagauaaugacuuuugcccucagauucuaacaugccuucugaggcgauuuuaguuucagaugagcuauuguuaaugauccauugacucuguaaauacuuacugaauacccaaguguuggguacuuuaucauagucucaagacaacgaacaaaaccagacagaacaccuccuuucaggaauuuucaaucuggggaaaguaggacuagagaaguaaaaugcacagggagaggcuccgugcuacugugggaccagcacucuaaaggacagguguucaguaguaugacugauuuaacuucaucuguggagcuuuaggugggaagagaaguuuccauaaugaagagaaccugggaucugaaguagauaaaagcuuugggggaagaacaaaagaacuagagacccagucuauaugguccaggugcagagaggaccuggagguguuacaaaauugagaggguggaaggagcccaguacagugauccuuacagguuacauuggauuuaaaucauuucaaaguuggggugaaaagauuggaaaucuauguaaucaauuucuacgaacaaucaaccaauaagaauaaaguuucuugguuuuuuuuuuucuuuuuuucuuaaguacacaguagagagcacucaagacaaagguccuaaggaaaacucugguacaauguaacucaucgcuccuccccuggagcuuuuaauucuggccaaaacucauuuuguuccaguggggccucuguguauagacccaguuaaaguuuauugcuuaaauuuggaaguaaaugauuucagguuauuaugcaaugagcccuuggcuuccccuuauuccacagguacacuguggaacagucuguggcucacucauagcuguaaauaaaauuacuuaccugcaucaauaguacaggcauuaugacuaaacauuaauauuuauauaaagcaauuaacuagguacacaguguucuuauuaugccuuauauuaaaaauuuaguguguguuggaugcauuuguugguauaaaggcccaagguccacaagcucacugauuugguucggcuagcuuagcuggccaaagaacuuaagcaauccuguucucuuagugcagaaguuacaggaguucuaucacacuagccuuuuacuguguucuggugauucgaacucagguccuugaugagcagcauacacuuuacugaguugucucucuugccuauugcgaauauuugccacacuuccaugccagaucucugguucgguaugagaacucauagguaagaagaggcagggagaggcuucuuggagauccuuugcagaggccggcgaggucaaagcgauuuucuguuuuaaagauagggccuuacuaugucguccucgcuggcuugggaacucccucuguacaccaggcugguuucaaagagcaugaugugcuuuugcuacuugagugcuuauauuaaaggcgugcaccaccacaccugguaaaaguuaucuuaaucuuagucauucucauucucucaagaaggugcaguggaauuuuccauaacuaugcaaaaaaacagauaguaaaauguugagaagcagcuagacgaucaaauuguuuucuaaaggagacauuaauuuuuuucucaucaauuuuuguuuuuguuuuguuuuguugguuuugguuuuuucgagacaggguuucucuguguagcccuggcuguccucgaacucacuuuguggaccaggcuggccucgaacucagaaauccgccugccucugccucccaagugcugggauuaaaggcgugugccaucaccgccccgccaauuuuuguuuuugaaaaguuacuugucaugauaauguuuugccaacacuacauacuaguauuuuaaaacauaaacccuaugcaauuaauguuccuagagaacacaguuuuuaguuuuguuguuuugaguaaggagaucaguguucugagcuaacccuuguuugaccaaccacagacaaaacuugcucuccgugucugcacgccuuuuuugcagugguuuccucccacuaaaccgcacuuccaauucugcccgucaaacgucccauuccaccuaaaacaugauccccggcgcuggcccgggucugucgcugcgcggggcagcguuguggggacacccacggguuccccuccuguuggccuagagguuaaacucagcaccuacugaggcucuagagaagcauccggacuuccggcucagcuaggccacgcccggccgcuuccaggcuguggccgcccggaagaguacaucagaccccggagucagagggggcgguucuggcgcgccacgccuagugaggguggggccacgcccacacggagaggcguggucucuacccggcgcgggaaaggggccgaaaucgcgugcgcgcgcucagucagcgaccgcgcgccacacguuucgggaggggauggcggcagcggcggcugcugggagcgggacgcccagagaggaagaggcucccggaggggaggcagcggcuucgcaggcccaagccccgacgagugcacccgggggaguucgccucucgaggcugccucuggcgagaguaaaggccuuggugaaggcagacccugacguaacgcuggcgggacaggaagccaucuuuauccuggcgcgugccgcggugcgacggggaagcaagggcgccugggucggggaaaggggcguggcaucuagggggcguggcgcuagggggcguggcgggcccugguacgccgaccugacuugacugagaccuaggaaggccucugugggccccguuugaguugguuagccacucuccucuucacgaggacccacgcaaauuuaguuugcauggcucccacggcucacacagaacuugaaggggauccuaaugaaugaguaggguggauuuggagauauuagagcagggggauuggagcuauggagagggauagcagaaguauuuucauaaguucaguacaaugguagcuucuagaacuuuccugugugguagaguucccccuuuacccuucuuguccacgucuacacaggauugcucaucucagugggcuagaguccacuaaucucugcuugcuuuuuuuuuuuuuuguugcaggaacuguucguggagacuaucgcaaaagaugccuacugcugugcucaacaaggaaagaggaaaacucuccagaggagagauuuggguagagucgcugugguaccccaggguggacaggggagcuaugggcugggcuuucuuauagcuguuucacaaggcaucauugaagcaaggggaaauuuggcuuuugguuuauuugucuaccugguaacccuuccacauguguaagccuuuagagacuguaccucucauucccuucuaugcugccaaacucuuuuucuaguaucuuuuuuuuuuguuuuuguuuuucgagacaggguuucucugcagcccuggcuguccuggaacucacucuguagaccaggcuggccucgaacucagaaauucaccugccucagucucccaagugcugggauuaaaggcgugcaccaccacgcccggccuuguucuagugucuuuagaguagagagaaaagugaauuuuggaauaagacaggauuguaggaugccuugaacagcauuuucgcuggcuuuugaggugagacaguuaaaagaauagugaguguaaagauggaucuuaggaccucuggguuacaguuuguaagugaugucauuugcauaaaauuccauguugggucugaugucugaauggcaagagccaaucaaguaucccuuuaccuuguguuucagauaaugcaauagaagcuguggaugaauucgcuuuucuagaaggugaguucacugccugcacagacuauuucucuguugaugaugugagcuucaaaccuuauaaaaccuuauaaaacagaugugugguuuuccuuuguauacauggcagcaauucucccuguuuugauagaaaaaaaaggaacauuuuccauucuuggggaauuagaaauucuacagggaaauugcaagcuuaaaagaagaaggagggaguauauaaauuaccaguagaauuggauuuagauuuugaauccuguuuauaucuccaaacuaaauauuaauauugcuccuuuauaauguuaagaauuagaaacaauuuguaacuuuuuuuaagauuccuuuuuauuuacguguauguguguuucuauaugccaaauguauguagguacccccauaagagccagaagaguagugugagcugcuaaacaugggugcugugaacagggcuucuggaagagcagcaagcacuuuuuuguuuuguuuuugcucuauuugagacuuggguuucucuguguagcccuggcucuccuggaauucacucuguagaccaagcuggccuugaauucgcagagauccuagaacuacuugccucuaccuccagagugcugggauuaaaggugugcuucacaacugccugcugaugagcaugaggucuuuuuuguuguuauuuuuucgagacaggauuucucuguauagcccuggcuguccuggaacuuacucuguagaccaggcuggccucgaacucagaaauccuccugccucugccucccgagugcugggauuaaaggcgugcgccacuaccgcccagcuagcaagaggucuuaaucacugagucaucucuccacccucaguuccuaacuuaagacagggucuuauauagcucagacuagccuugaacucucacuguguagcugagagugaccuugaauuccuuuucugucuucaccuccaaaaugcuaguaauaauaaugauaagucaauacauacauaaauaggcauaugccaccuugucugacgcugaaauauuuucuucuuuuuucacucuguucugcuucucuguguuaaccuuugcccauggcacucuuuagauguucucuuugauaucuucuaagaucucucuccaaugucugcuucaagucuagauuuuugaguauucucuuugaguuguagauuuuguuuuuccaccuauuugucuuaaaaauaacuugaauuaguugcccaacuuguuuuauaguccaguguauggucauccuuggugguggucuuuauauucuugaagagaaaguacucuauucuguucugcuugcuuguuuuaucaguugcugaguaagaauuguccauuaaauucuccuaccacaacuguagauuauuuucacuugaauuuuugauucuguuuauuuuguaagaccaugugauuagguauguaaaaguuuacuacuauguuguuuuugacagcccauaguauuuaauuuauaguauuuaauugauuauugucauuucuagugauugguuauuagaccuucccauuuaggcagacugcaguuugauucuuaucucccucagccugccacacagccccucucagaccucucagauugguaggugccuucagggacaccauagcuuuggagguuggccuuacuuugugacuuugccaucccuuaauaucauuuauuucaauuauugagaaguuuuauuuuuaaaauauauuuaguuuuauucguugcuuuaaacagagacuugucaucaacaaaaucagaguugcuagguaagguggcucaugccuguaagugccaguccuugggagagugaggcagcaggauuuuaugucugaggccagcuugugcuacaaggggggcuccagccuaguguggccagugacauacugccuuaaucagcaacagaaaauuccaaagaaaguuacuauuuuuuuaguuagaaguauugcugguuuaguuuuccuaauguucauuccccugacuuaugcuuuauaauaggauuaagaaauaacuacgaggcuccuucaguccagugcuuuuccuucugugugaacauaaaaugaggcuguuuuggaagcugguggguuuugccuugcagcuucacuucagggugaagaggaacagaugucaugcuugcggccccacaggccaaaaugcagaaugcuuccuaggagugggacugccagaggcugcucugguuuucccagauaggccacuugguucuuugaagaaaguccuuugauuuuguuguuuuuguuuuuuguuuuucuucucuuucauagauguuugaaucuguggcuucuccauguagggaggguuguaagaggcaugggaaggaagccuguguccugugggucuuuauuagcuccuuuccuuucacuucuucuucugucaguguagguaacugugucuaggacagugcuucccaaccuuccaaaugcuguggugaccuuuuaauauagcuucaugcuguggugacccgaauuacaguuauuucauugcuacuuuauaacuguaauuuugcuacuguuaugaauuguaauguaaauauuuuuggagauagaggcugaccaaaggggucacaacccacagguuuagaaccacuggucuagugccuucugcugguucuagggugggggauagcuucuccucucuugcacccucaucugcauuuggcucagggcuuugcucuauuuauaaacaugcucagugagaaguugauaauucauucuuuuuuguuuuuggaauugcccaacugcuagugacucuuuguucuauauuuuaaaaugcuuuuucuuuuuugaauagacucuuggagggcacacaggugagcucaggugcccaaacugaacugagacuuucugaaaaaagaauagagggacuggagagauggauuaguaauuaagacuauacuauagcaaaggagccaaguucaguuccaguacucacaaccuccuguaacuccauccuucaggggggaucugaugaccucuucugguccuuauggguauuguagacucacaaguauacaucuaauuaaaaaaacaaacaaacaaacaaaacccuuuuuaaaguuaaaaaugcuuuguuuagaaagccucucccuuuuugaauguucauuaagcaguguggugauucuuuagcucuguuccagcuuuaauucuaauucugugcauuggcaggguuacuuaccaauggacuaccuucucuaaugacaucucccuugggucuuuuggaucaauaauccucagauugcaucauguuaccagcauguccuugugugcuuuaacuuugcccuguuugugacacuaccccagauugagacauguccuuauacauugcuuuccucuguuuugaggcacuuuggauugagacauguccuuguacauugcuuuuucuguuuuuaggcacuuuggauuaauuguggagcuggauggucugagccuuggcugcaucugucaccuuuccccucuguaagccucagcuuuggagaaagucugcgcauguacacaaucuucuuacucuuuuuacccaagauagaagaagcagagagcucuuggauaacguucuccaccaagucuuccauuacuugagucugucuuccaauucaagccuggauguagcugaugcuguuuggggcagagaugaaaggacuguucugcauagcuggcuuaaugagcacagacuagaauaaaaggucuuuguucagcuucuuuccuguguuuuauauugccuuugcucuugcccugugacugggaacccaugugaucaggcacagacuuuccucaucuuucuaccaaccacuccaagucagucuuuuuauuaaauuuguucuuucucagcaugucauuggaauguggaucgauaauauaugggauaccucuucuccuuagaagucaaaucgauguggucccaacaguuuuauucaaguauaauucaugugucauauucaauucaaacuguaacauucggugguuuuuaaaaaaauauucauagauauauguagugagauuuugaacauuuuccugugaauggauucacaugagucuuguguauggcaaaauuuagauaauguuauuuaaaguuaaucuaugcuaugauauguauuuauacccuuuaaguugugaaauauaugugauauaaaauuucccauuuuaacugcuuuucaguguguugcucagugagauugaauauuuucagaguguugcacaaccuucaccaucauuggccuccagaacuuuguaacaguguucucagccuggaacauugugcacauggaacaguaucuuccuuuccuuuucucaucucacguuaggcuaaauuaauuuuguuguuguuguuauuuugugaagugugggcagugcacuuuuaguaccuagaauguagugcuucaggaaagcagcagaaagcuguggcuagggcuuccuacaguguucugcaguguagaucucuuaggauagagucugcaggaucuucucccuagaaugauacauucaguccuguaauacguuaaaaauaaacuuucagaaaaauacuacauuuguagaaaaguguuuuuaggucuugcuuacuaaguccacccaaaacugacauuucaggguuaccagaaacugacugacauuuauggcuuauuauuuauugaguucaguuuuuauuugaguucaguauuuuuuuccauuaauauccuuuguuuugagaucuaaucgagauuauuaaauuguuuuugcuucuugagacucuccagucuuucuugaagugucuuaguuuuguuuuuaauuuguguguguuuucauauguggagaccuacuuucaaaucacugggcagcaagugacuuauuuucugauccaucuugccagcucccuuuccuuguuuugucggucugugccugugccugugggugugccacaucauaggaguagcuuccuuucauguugagccaucuugcuggccuguagcuggaguuuugucuacaucauuguguguuccuggauggucgcaugcaugcaccggcccagaagcaaaauagaaaacguguaccaguaauucuuaaaaugccuugguuaacucagugacugggcacuccuaaaucuucccguuaccccaggcccaguuguggaaguagccaguagccacuugcccaaaaucucgugacugguuggcuuuauguccuccacuacugcauccccuucucucccccagucuucugauucucacucuguguccuaccugugcucugucauuggcuauuggaaucuuuauugauagaucaaaauccaacugggggcaaggaccuuuagcgucaguaaacacagauucuugaggaaagcaucagaacugugcucuacauuucaucuuuucuguccaguuaaaacaaacaaaaacccccucuucucucagauauaaguugagcagaaccauaacaaucauguacauugcaaaguauauauaguuaacaucuagucuaucauauuugucuguuagauaaaguacucuaccgucauuccugacuuaaagaguuaaaauucuaucccugaauuauguuuagauuuuagccuguaacaccauccaaaaaccauguuuuuacuucuauaucauagcuuuauuguuaaacaacuuuuaaguuugcuuaugggacuauaauuagucccaguccugucagaaaucuaagaauaaauuaaauauuaccugaguauauaggaagcaccaaacauagcuucuaaaacuuaaauuguagagauaacugacugccugggcagccuccuaauuucuuacaauguaagagcaucuguguucagcuuucuggcccaggaucaucuaacagaccuuuagaaggagagcauaugaaggacuagcuuucuuugucuugguagaacuuaacagucgacuauuccacauaauguguccuuuuccgcggacaguauuuugucugcaggugaauaggcaauuucugccucaugucuaccuugcuacaaaagcaaccuugucuggaggugaagauguuuaauucuuugaaggagaauggggaagcugucaggagcagacaugccucaucgucacaugaucuuuaauaaugaaauaucauuaaaugucauauucuggauuccugauguuuugaaggcugucuauauaucugaguaaaguauauugaacuguuaaaccuuagcuacucuuagccauuucugaguaaauugaaaauaauuuauuauaauuauauuagaauuuaaucuagccaugaguuuacuaucuggaccuuaacuugaguuacuugaucaucuuguucuuaaaugaggugcauaggcgcaaugccuaagaguaacaauauuaauuucaaaguuuguaucaauauacagauucauaccaaugaaaaucuuaauucuauauccauauauaaauucuguaccaauauaagaaauuauaacuucaauucuagaucaauuacaaagauuucuaccuauguaagauuauggcuacacaauguuuuguucaagauaauuuagcaauccaucccaucuauugccuccguguucaaaauuaugaccauucccaaacuaucccuuaacaugacaaccuaucuaauuuguaaaauaacucuaaccagacauccaaacccgaggaaucaggcugacagcucuccauagcuucuuccugaugauuaggggcgaugagaaauucuuuaaugggguggggagggguaggaaaauugguuauacuuaagaaagcuagcuggauaauagcauccauuauccagucucuguaugcuuagaaggcucagggcuugacugaaguucuaacuggaucugucugaaagguugggugaagcgaaaugaucugaaaucagcagcaauccuaaagcuuuucuagaagcaagucucuggacaguaucaggaagcaggggccuggagcaccaggucaguucagcaucuuugaggaugaaucuugucaaaguuguacauucuguaauauaugaaucuuacaacaaaaauuuuaguaucauuaagauuuuuguauggaugguacaggaugcacacagauuaguuaaggaugaaauuuugcuucuuugacaacuaggggaaagacaacuuuuuuuuuuuuuuuuucgagacaggguuucucuguauagcccuggcuguccuggaacucacuccguagaccaggcuggccucaaacucagaaguccgccugccucugccucccgagugcugggauuaaaggcgugugccaccacgcccggcuugacaacuaucuuuuuuaugaauuaauuuuaucaauaaccaaauauaauaaaucuucauucaugccaugugagggagggcacaaagaaucuuagggauuccauaaccaauaagacuuaauguuucauuuuagcugaaguuuugcuagagacaauuuuuaugccuaagccaguuacugggcuguucccauguugaagaucaauuuaucuguuuuguuugauuuucuugaauuuuucguaaucuuccaguggucuuccccugucaugucugauccaugucacucuggaagggguucagagccauucuccuuuccuguuauaacacaaauacagaacauuucucccaaaguagcaugacguggguccaguaacuggaaugcauuaaggguauaguuuuaccucucccagaggaacuuuaacacaaccaccaaacucauagcuauacucaucuugguaaucaaaucaauucaaagcaauuaaagcaaucuaaacaaauauuaucuguugagaccgugcuucuacuguccccugccccuucaugagaucaaggccuaaaugauuuaaucaucuguguaaaugaauccucccuacuauggagauaaauaucuguggggacagauuguaguaugccccuuucuccauguaauucccaaggccuaaguuucugagguaggcuaggcucccuacuucccccuucuaaucuaauuuuucaagauagaaugcuuagagaguuauauaucucuguauuuaacuuuaauuaaagucccuucugcuuacuguguaagccuguuuacaggcucuaacuuuuaucguacauucccagaaaucccgugucaaccacguucaaagaucccaagaaacuguccaggcaaggcucucacaugccuuuaaaucauuuguucauucauuuccccuaacuucccccuucgguggagcguacuguuugcugugucuaccaucuggcucucaucucaagcucuucguaucaguuccgaacuaugggaagaaauugccacguggcuugggcaaacucuguuuagucccuucuaugcuuaaauauaauuagaucagauuuauaaaucucuaucuguuauuuaucugguggcuggaggcaggcaccuccaguuugcuucucgaugucuccugcagguagcagcuguauucuuuugcuccaguuuuacuugcuggaaccaugugacucgguucugcucccugagaaaccaguccuuccuuucucggaaacuauaucaugauguauguguaauccaucugagaauuuuuaaaauuaauaguggauucuugccuuccauguggggugccauacgaagcgugcauuuugucuacaccacuuuguguuccuagcugaguauuucugauccacgaauagaaaacacacacacacacacacacacacacacacacacacacacacacacacacacacacacacacacacacacacaccuuggcuaacucagugacuggacacuccauaaucuuuaccccaggcucagucagggaaauggccaguggccacuuaccagaaaccucagauggcuggcuugcuugaucuccucugcuacugcauccccuucuucuuucccccagucuucugauucucuguguccuacccuugcaacucucaguguccugcccuaugcucagacauuggcuauuggcaucuuuauuaauagauaaaaauccaauugggggcaaggacccucaguaaauaguaaacacagauuuuugaucaaaacaucagaaccacccucuacacuguuuuuuuuguuuguuuguuuuuuguuuuuuuaaacacauuugcagucuugucuaaugcugcccgaauacccuguagccuguuucccagccugguuuguauguuugucugugauuaguuaaauuugaauguuacaaagacccaccaauagucauguuacuagaaauacugaaagugcucacuuucauuuaagagaaaguuaaaaaaguaaguuuuggccaauagugggagagauuaauaaauauauguuaucagcauuucuuuauaaaacaaagcuaaucauauuuuuuucuugucuguguauauguugugcaugcauguucacaugugcguguaagccagaguuugauguuggcugucuuccucaguugucccacuucauuuauuaaguuaagcccagagcuuccuaauuugguuagcugguccccggagccucaucucugccucuguguugggaugauugguggguugccaugcccauccaacacuuaugugggcaccagggaucugagcugucccucaugcucaugcaguggguacuuugacauuuauuuuuagcauuuccugaaaaauaaaaauuccuuaauguugguguacucuuucaaaauauaaacagaaagaauguuagaugcugucacaagaaacauaugaauuaacacauuuaaaaaaauuucuggguauaguggcgccuaccuuugaucccaguacucaggaggcagguucaagcagaucucugaguuugaggccagccuggucuacagagugacuuccaggacagccagggauacacagagaaacccugucccuaaaccccuucccccaccuccaauaaaaaauagaagaaagagagaaaacuagguagauagaaccaucucauauggggcuggcgagauggcucagugguuaagaacacuuuuugcucuuauagaagaccuggguugguucccaguucccagcacccacauguuagcucacaaccacuuuuaacuuuaguucuagggaaucugucauucuuuuaggaccucuguaggcaccaggcacauaugugguacacauguaggcaaaacacucauaaaguuacaaacaugaguuaaaaagguaguaguauugagccaggucuaguaccacaugucuuuauucccaguuuucauggaucucugaguucaaggccagauggucuaccaagugagauccugucucagaagaaaaacaaguuaguauugaauucaguaaggauauuuuaauuuuuguuuuccuuucaucuuugggugcuaggucaugguguaaaaugcauauagaauaucaaaugccauucgaccucuuucuccugguaucaugccugugaugucacauuauagguaaaaaaaaaaaaaagaagauguagauauaacuuagguugacuagucaauugacuuuaaaguugauuauccugggcugucucagcaggcccuaauaaugcaugaucccuuaaaagcagaacuuucuccugaccaagaguaaaaaacgcaugucaaauucaaagcauggaagaaaggccuuucccccuuaaccuccaccccaguuucucccugcagcccuggcuguccuggaauuccuccuauggaccaggcuggccuccaacucacagaguuccaccugccucaguuucaaagggaaaaggccuuucuaauuuuccuggcuuugaagauacaggagacaagaaacgugggcagucuuaagcuaagaacuaugguggccugcauagggagagccaucgugacaaauaccugcacagguucugccauagugacaaaucugugaguacuccaggaaauggugcuggccguuguagauucagcaucuggcuuuggugcuuggcuuucuucucugcugaucucaguuucacgagguccccuccccugccccacaucuauguucuauauaguaauuuguugauggaagcucuugccuggucccugcugcauauuuuaucauugaauaaaagugagcuggcucuugaaaaaauaaaagaaacauuuagucaccguaauggcuagcagcagcucacugugguuuuaauuugcauuuaucaaaugugcuaugcaaauacuuugucccaggcccaccacuuacauauuuuaaagucugaugacuaauuuuuacauguguucagcucugcuggugggaugacuucaaugaggcacuugggcuucccaggacuucucgcauuuuugcaugccuuuuuaaggcuguggaaaagcagaacuucccuucagcgucucuugugcucugcuugcuuagugucugucauucgugggccaaugggccagaagggauugggcaucucuaugucuggcuggguauacuagaguagagacagauggaggaaaaaguaaauuaguaaaaccugaugauaacguuauauaaagcuuaaagaucaucucucuguugcuuuuuuuuuucccauaaaaacaccaaguguaugcaugugugugucugugcauguaaggucauuugccugaggaggccagaggugucagguggguccccauggagcuaguuauagucucucccucuuccccucccuccccauccuccucccuccccccucccccucccuccuucccucucccuccccuucccccucccuccuucuuuucuucucuccccccucccugugugcaugugcucucucucucuccccucuccacccaucucccuaucugcaugaugauuuccuuggccuaguuccuuacuggcccaaaagcugcccccaauuaaaucugccuuuugacucuuaaaauaaaauggaaaaauaaaauaaaauaaaagaguuauaggcaguugugagcugccagacauggggcugggaaucgaacucccaucuucuggaggagcagugugcucucuuaaccacugagccaucucuccauucucgauauagcauuucaagauagucucauguaucccagcauggucuugaaauugcuguguagcugaaggugaccuugaauuucuacuccucacacccugggaucacaggcuacucccaacauuuaugcuuugccggggaucaaaucugguuuuugugcauacaaccacuggcacuaaauccuaagugucuaaaaagagcaucucggacuggcgagauggcucaguggguaagagcacugacuguucuucuaauggucaugaguucaaaucccaacaaccacauggucauaaugagaucugacgcccucuucuggugugucugaagucaguuacagaguacuuauauauaauaauaaauaaaucuuuaggccugagcaagcggggccaauuggagguagugggugggguugaccagagugagcagagguccuaaaaauucacaugcaaccacaugaaggcucacaaccaucuguguagcuacaguguacuuacauacauucauacauacauacauacauacaucuuuuuaaaaaggaacaucucauuaaaaaaagguuagaaaaaccugcaaucugccugguucuuucuuuguauuagaagauguuuccacuucaugcuaaguagcucugagcagcucaaauuuaaggcauuuuucuguuauguuuucuaacuauuggcucuggguucucuaucuugggaucccccuuccuuucucuuagaaauuugguuuucuugaggucuuuuuguuucauucuuuuaauuuuaaaguuaguugcaauauuuuuuguuuugaauuugaaaugacaauucuacaggaaaauucuacauuuuuagagagacaaauacgucucuaggucaauucuagauugcuuccuuuguuguuuuguucuugggccaaaagcaacuuagaggaggaaagaguuuaguucaucuuguuuccagguuacaaucugucauaaagggaagucaaagaagaaccugaaacagaaaccuugggacaaaugcugucugcuggcuugcuccaggcucaugcuuagcuagcucucucauccugcccagggcuaccugccuaaggauggcgcugcccacagugggcugaagccucguguuaguucauuuaccaaaguaaucuaccacagacaugccuacaugucaaucucauccuggcaguuucucagcugaggcuuuccuucucagacgacucuagguugugucaaaugagaucaaguuuaaccaggacaagauccuuuagcauuuauguggcucuuuauguuaagguccucacaacuacaaagugacuuuagucauaaucauuuaaaauuuuauuuaaaauuuuuuaacuuuaaaaaaauuacuuuuuugacaguuucaugcauauauacaaucuauguguucaaacccauuauucucucuucuacucccaccccugcagcucuccucuuuccuaaauaguaacccaccuccuugggcuuuuuccuuuuccuccucuucuucuucauccuccuccuuucuucuuucucccuucucucuuucuucuuucuuuccucuucuugacaggguuucuccgaauugcccuggcugcccugaaacucgcucuguaaaccaggcuggccuucaacgucucugucuccugagugcugggauuauaggugccaccacugccaagcuauuuuauuuauuuauuuguguguguguguguguguguguguguguguguguguguguguguguguagguuuugugcaguuaccauaccugcuguguguccauugcuacaugggcuauguuguauccagaagauacacaguaugucaccauguacuuuaagucuucuaucccuucuuuuguguagucugcugggccuugaaaggugugauauaaagguccuguuuagggcuuucaguagucccuuauucucaguccuuugaacaguuuagccucugcauuaacugucucccauuggagaaagaaacuuuucuggccaagagguagaaagcaguuugauaccaugucuacuuagcauaauaaguucuccccuagggucucuggccccuccugcuauggacuuucaaacaguuuauaguacgagguauauauuuguucccaaggaaagggccucauauccaaccagcuagggauugguuacucuccaaacacucauaaucacuaucguaccugugggaacaucuugacuggcaggucaguauaguaguaucauguagggguuggugcugaugcuaagguccuauacccaguugguucuugaucaagcaauaaagaugccaagggccaaucuaggcagaagggaagaggcaggacuucuggguccucagaggaggcuaagagaugcaggaagaggaaaggagauugggugaccagccaugugagaucauagacugcuuccucaggugggagauuagaaacgcaacuaagcugagggcaguuuugaguuguugaacaaugagaagguagcugagacacuaagcuaagagaagauuaagaggugcugagcuaagaguauuggaaggggcacacuagaugugaaagauuagaagugcccagcaauugagucaguaaggcagguugaaagugagcuacauguguaugucuguguuuuucacccauggauccaauauucucuggguaggggcugguagggcagcccauucucagagcauugaaaugugguaguuaaaaggcaacccacgggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauauaauaauaaauaaauaaaucuuaaaaaaaaaaaaaggcaacccacuacaguauccuggucuauagcuagguaagacugcuaacacuuuuucucccucagcagccugcauaacacuuuccaguacuaugaaugcuagucagaggggaggaagcuacaguuccaaccugacuuaucuguguguuuccaaaguaugugguagcuuuagcaguggggcuuuauuaucuuguucugauaaaugaucaagagcaaugacaauaaccuccauuuuacuauuuauuuauuaauuuauuuugagauaagaguuucuauauguagcuuuggcuguuccaaaacucacuauguagaccaggcuagacucuagcucacagagacccaccugccucugccuucuaagugcugagauuaaaggugugcagcaucacagccugcaacuuccauuguuuugagagucucugaggucuccauggcuagcaacucacugggaguuaucccacaucugcacuagaauuuuuguuuaaugaccuauggcuucugagaacagaauuauguauuuaugcagggugccacccaaguguugauguuuguaagaaucuucaagaaacauagaaugcuuccuccaagugguacacaccuguuaucccagcuuuugaaagguagagguugaagaauuaggaauucuaggccagccuaggcuacauagaggacuuugagaccaacuugggcuacaagagacccuuuaucaaaacaaacaaauaaaugaaauaaugcaugcugaucuguagguguaauauccaaaaugaguucaagaucacccaguaccuucccccuucuaaaagggcuuuccacacuauacuagcaggucaaguacagagccggauaaagaagcuggcugauuaaacaaauauaaaaacauaguuuuagcagucaaaaugauuaagucuacagcugccaaaacaauaguaacuguucucagagaaauaaccauaacaagauuagcaaucucccuacccugccccacacugaauucugagaaaaacuacaaaccacccugaccuuguugauagcugugagauuaauagcugacccauaaguucaaaacauacuguugcuuugcugaaaaacaacaagggaggacagagugagagacuaggccaaaggguuauuuugucacccuuugcaaaccaaccagugccugaaaggguuacuugcuacaccaauuagaacaagccagcuacccuguugcucaaauaugcuccuuacaagguauaaaaaguguguucuuucuuuguucugggucucuccucuggccugcgugcugagggggggggggucguccccaacauguuagaucaguaaaaauacucaugcaguuugcugccauggugaucucuguggucuuugugagugagggucuuaugaacucuaacauaggaacuaauauugugguugaggaaagugugugauauacaauauggucuuucuucucuaaugccuauuuuaaaaaaaugaauauuuuccuuccucuuauuuuauauuaauaaaauacuugaauguacuugaauacuuguacuugaaugucuuaguuaggguuuccauugcuguaaaaagacaccauggccaaagcaacucuuacaaaggacaacacuuaauuggcacuggcuuacugguucagagguucaguccacuaucaucaagacuggaagcauggcaguguccaggcagacacagugcuggagaagggacugagaguucuaaaucucaauccaacugcaaacaggagaaguuuggcuccuauguggcuaggaggugggucuuaaagccuaccccuacaaugacauacuuccuccaacaaggccauagcuauuccaacaggaucacaccuccuaauagugccacucccugggccaagcacauucaaaucaucacauugaguaaugaaaugagccuaacagauuguagcaccacacauuucaaaaggcaguggaaagcuggggauguaguucacuggguagaguacuuguccagcacaugcagugcucugggcuucacuccuggcacuguauugaacuugguggugcaagcauguaucuccagcauccaguagguggaaacugcauggucaggagucugaaguuacccucagcuacagagcaagcugggaacuagccuggcuuucaaacaaacacaugaacggaaccaaccaaccacuguaacugguacuuuuguuaauuuagaucuuugcuuacugaguauuguggacuuucuaguugugaauaugggucaccugggguaacaggaguucuauauaggaaaugagaguuagaaaugauuucuaucucucugcaaggaaaugcacaaaggaagacuuguaggcacaucagauaccgagucagcuaaugaguguuccuuucugagaaaaggcucauuuugaugugcuaauaaccccagguuucuuagccugaagcacacucgcagagauuacaaaugucacccuuaagggccucuuugcagacaauuggagagcuuuuaccuaagacagagaacaugucccuucuacucccuguuccuaauagaguccagggccauagaaagaaacuugguuuuaaaaagacaucuauguuggucaguucaugguguauuuccauugagcugauaaugaacacaucucuaccuuauuagggaagauaaauagaaacugaccagggagcuucagggcucgccauucucaucugaggguugucauauccacaugucauaaagcagagaucaacauccagccuuucagacagcccaacucacuauaaugaauucucugaagaugcucaugguaucuucaggaaauucgcaccaccucaggacaaagugagaauuauuucaaaacaacaggcuacugacagcauugccaacucuccuugcucugagaaacucuuugccuuuugugcuauggaauaguaaaauaccagggggaugcuggcuagguuauugaaggauuauuucuggauuuuuccuuuuugcacugguaggacaugguugcaugccaaaaaagagagauacaaaauuaucuuuuuccuuauagucacucuuaaugacugcagacauaaaauagugacuucaucaagcacuuuuaccuguaacgguaaaaaguugagggaggaggggccccugggagggugggacagagagagagagagaaagagagagagagaaucuauacuaaaagcagggguacuuggacacaaggcaagaagcagcccuagggugacagaauuugacaagggcuuugcucuucaguaaacuuuguguauguaugugugcauguguauauaugcaugcauauuugugugugugugugugcauguguaugcacauguggaggucaaaggacaaccuuaggugucauuugucaagaucaugguuuuugagacaagaucucucacugucauugaaccggcaaguugacuaggcuggaggaccagugagcuguagcaauccuccugccucugccuccccagcgcugagauuacaggcauugugccaguuuuuuuguauauggguuuugggauugaacugagguuuuuuuuacuuuguauugugaacacuuuaccaacaguacuguuuuuucacucuggugcuagacuuuuugaaaggacuguacuucuccaaaguucuacuaguuuguuuguuugagucagggucucaguguaguucaaaaagauauugguuuccuaaggguucccaggguuccuggagccccuucaacuguacuccacuagagcuacugcugcagugacucugcucagugugguccaggggcccugagcaucagaacacacaggauaugguagacaagaagaugcucuccagcaugcccugcgcucaugcaaacaguagagccacuugcuucuccagaagugucuagcagagguugccaggacaauacauuccuagguccugagacaucugaacacuucuuuauucuagccuccugugacaagucacagaugccacauugaaauuuuugcuuuauguaacucuggagaacaaaugaaugguugggaugguuggggaguaggguuaggaagaugcaagggguuuuaagagcccugugaacagacucccaagcaaucucuaaaucucuacuuucaguccucuguauuaccccuacuuccucuggacauucuuuccaugucucuagacucccacgccuggguaugcaaaccccuuuuccuuguggcugcucaugucugcucaccaaagacaccugguuuugugucuuuggucccucuuauuuucuuugcauuuuuaaauuuacacuucauucauuaugucagcauuuccuuaauugugucccaauaucuauauuuguguagaagucuucuuuuuuuuuuuuuuuuuuuuuuuuccauuuuuuauuagguauuuagcucauuuacauuuccaaugcuauaccaaaagucccccuuacccacccacccccacuccccuacccacccacuccccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccuccggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuagaaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguugauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggggaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccugcuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggccgccuccccagccgggugggcaccuguccuccgguccggacgguggccggcuguccccggcccacacagggugcugccucagcgccucugugcuucugccuguuccagaagcugucagguucucuggcgcacccucucaccuguucagacuaauuuccuaaguucggcggguccuggaccaagauggcgaccgcugcugcuguggcuuaggccgccuccccagccgggcgggcaccuguccuccgguccggacgguggcuggcuguccccggcccacaaagggugcugccucagugccucugugcuuccgccuguuccagaagcugucagguucucuggcgcacccucucaccuguucagacuaauuuccuaaguucggcgggucucggaccaagauggcgaccgcugcugcuguggcuuaggccgccucuccagccgggugggcaccuguccuccaguccggaagguggccggcuguccccggcccacacagggugcugccucagcgccucugugcuucugccuguuccagaagcugucagguucucuggcgcacccucucaccuguucagacuaauuuccuaaguucggcgggucccggaccaagauggcgaccgcugcucguguagaagucuucuaagugauuuuaauuauuagcaugaugucuuaguuaggguuacucuugcugugaugaaacacuaugacaaagcaguuuugggaguaaauguuuauucagcuuagcuuccacaucauaguuuauuggcaaaggauguuaggacagaaaugcaagcagggcaggaggcaggaacugugcagaccauggaggggaacuguuuacuggcuugcucuuuauggcuugcucagccugcuuccucccucccucccucccucccucccucccucccucccucccucccucccucccucccucccucuuccuccucuaaauuauuuauuuauuuauuuauuuauuuauuuauuuauggaauaucucaaccaaccaaccaaucaaucaaucaauaaauacacaaacaaauaaauuuucuuuguaguucugacuguccuggaacuaacuuuguagaccagauuggcuuugaacuuagagauccaacuacugcagccacugccaccucuagccagccuacuuucuuauagaaccuaggaccaccagcccagggauggcaccacucauaauggacagggcccuuucccaucaauuacuaauuaagaacaugccuuacaggccugucuacaguccaaucuuaugugggcauugucucaauuaaggugccuucccccgcccccgggcugguaagauagcucaguggguaagaacacugcucuuccgaagguccugaguucauauuccaucaaccacauggugguucacaaccacccguaaugagaucugacguccucuucuggugcgucggaagacagcuacaguguacuuaaguauaauaacaaauaaaucuuugggcugaagcaagcggaauugaccagagagagcagggcugaccggagcaagcagagaugcuaaaaauucaauccccaacaaccacaugaaggcucacaaccaucuguacagcuacaguguacucacauacauaaaauaaauaaaucuuaaaaaaaaaaggcucccuccuaacugaugacuccagcuugugucaaguugacacaaaaucagccaguguguacacuggguguagaagugcugcucucuagcaggcuaaauuuuccuggggcugggaugguggcugagcaggcaaagugcaagcaguaaccugaguuuggauccccagcaccaacauagaaauccaggugcaguggacacauuuguaaccccagcacaggggaugcagagagagacaaguucaccuggagcuugguggcuagccagucucgcugaguggacgagcucuagguucugugacagacccuguuuccaaacagaaaguggaaaacugauugagggagccaccugggggcagcucccagccucuguccacgcgugcacaccccgcaggaacacaugcaugcauauuuacacaaagaguucuccauuuuucauuuuuucauaugugcuuuauaaacagcuugccacaucccucugcuguguugucacuuuuauugagaugguauuaaauuuauaguuuaauuuagggagaaucaacaauuuaaaauuacugaguuucucaagaguggggucugcucuuccauuuauccaauuauucuguuauguuccucaguggaauuuuaaaaguuugcuucuugcagauuuugccggugucuugaauuuuauucuaguugcucuggugaauaaaaucauccuagcugacaugugcuguaacuuugugacauuucacuuagcuguuauagcagugaagucuuuugaacuugaugugcuuaaauccucagaucuuacaauguauuaacaggaguuagcuuaauuauagaaguaaugcacaacauuguuaaaguaauuaaaaauauguaaaaagauaauacaaugaaggaaaaaaacgucuucuuuuucagguuucucacuuuccccuuagaauucaugucuauaaauuguuucuuuuguucuuuuuguuuuuuuuaaaugaauaaacauuuauuaaaacugauuguuuuugcuuuuuauuuauuuuuccaaacuguuuuugaaaauaauuuacuuaauuuuuauuuuuuguguguuggugugagggugucagaucccuuggaacuggaguuaaagacaguucugggcugccauaugggagcgaggaauugaucccugguccucuggaagaacagccugugcucuuaacuauugaaccaucucuccagccccuccaaacuuguuuuaaaacaugcaauagcuauaucuagguccuuucagcaaaaucuugcuaguguaugcaauggugucagcguuuggaggcugauuaugggauggauccccggguauggcaaucuuuagaugguccauccuuucgucucagcuccaaacuuugucucaguaacuccuuccauggcagcuauuggauggaucacagggcccccaauggaggagcuagagaaaguacccaaggagcaacccuauagguagaacaacaauaugaacuaaccaguaccccccggagcucgugucucuagcugcauauguaucagaagauggccuaauaggccaauaguggaaagagaggcccauuggucuagcaaacuuuauaugccucaguacaggggaaugccagggccaagaagucagagugggggggggaggguaugggggacuuuugggauagcauuggaaauguaaaugaagaaaauaccuaaaaaaaccaugcaauagaacauauuucuuuuuuuuuuuuuuucuuuuuuuuuuccauuuuuuauuagguauuucgcucauuuacauuugcaaugcuguacgaaaagucccccauagccacccacccccucuccccuacccacccacuccccuuuuauggcccuggcguuccccuguacuggggcauauaaaguuugcguguccaaugggccucucuuucgagugauggccgacuaggccaucuuuugaugcauaugcagcuagagucaagagcuccgggguacugguuaguucauaauguuguuccaccuauaggguugcagaucccuuuagcuucuuugguacuuucucuagcuccuucauugggggccaugugauccauccaauagccgacugugagcauccacuucuauguuugcuaggcccaggcauacucugacaagagacagcuauaucaggguccuuucagcauaaucuugcuaguguaugcaugcaauagaacauauuucuugaacuacaggucacuuuuuuuuaaagucaaaaaucauggcugagaguugggaauagagcucaggaggagagugcuugucuagguugaggcuuuaaauucauuucucauaaguggaaaggaaaggaaaccaaccucacugaggaacacggaguuuuacacagcuuaucuaaacgguucuguuccgucucaugcuucuuaccuagcugcugcuccuggcauuuucuaugggaagcacaacugccucuucaccauuuauuuucccucugguuuucucccagguuuguuccaacgcuaacaccacaauaaccaaugucacuacagcgacauguccgucuucuugcugaccucacacuggaugucauuuccacuugauaaaaaaugcaaacaaaccccacaaauuuagauaauaaaauuagacugagaaacuuuugaagacuaucaaccauagcagagaaagaggggcugaccacucagcuuccagauuugaaagaagagugaaacuugaguaauaaguaauaaaaaugaugaguaauaaauaacucauacccaaaaggacaugugugguaugugcucaacaauaaguggauauuagccaaaaaaguacagaauacccacgauacaauccacagaagucaagaaaguugacaagcagaagggcccaagugaggaugcuucaaucccacucaggagggagaagaaagcaaucucgggaggcauagagagggaggggucugggugggagaaaggagggggaggggaaaaggggaacaugaucagguauuggguggguggggggagacaggagagaaguccugaggaccagcagaaugaauggaaauaugcaaccugggggggcaggguugggugggaggugaagggacucuccagaaaguaccagagaccugggaggugagagacucucaggacucaaagggagggagggaccuuaaaugaaaugcccaacaguggggagagggaacuuguauaguccucuuccaguagaaaaacaaggcaucaaguggagggaugguguugccaucccacaguccaaaacucugacccagaauuguuccugucuaaaagaacugcagggacaaaaauggagaagagccugagggaaaggcaguucagugagauggaauccaucucaaggagagucuuuaagaccugacacuauuacugaugcuauguugugcuuauagacaggagccuagcauggcugcuuucugggagacccaacaagcagcugacugagacagcugcagauacuuauacccaaccauuguaccaaagucagggacccuuaugguugaacauagcaggaacuguggugcugccucuauguaaaugccacacauuacucuauguaaggggcuacacagcugcaaaagcaucuccugcaggaggaccugauugagaacugcuugagagaccaaagauuguugguguagucagugucaaucaaucaacaaugcuguuuagaagagaugguucuuaggaccaaugggggcauggguggaggguauuaaaggagcuugcagcaguauucaggaaccuugcugcaguguuucucacuugcuuccagagucugugucccugacucugcaccaacucaccuccaacccccaagggggguuagcccaggggacaggcaguccaggggacaggcaacaguugaauuggggaaaggcuggaagaugcugaggaggaugaugaccccauaggaggaccagcagucucaacuaaccuggaucccugagaucucucagacacugaaccaccaaccaggcuguguacacgagcuggcccaaggccuacaacaaacauaacagcagaggacugccuggucuggccucagugggagaagaugugucuaauccuugaguuugaugccucagggaguguggaggccuagugggggagcauccucuuggagaugagagggaggaggaaugggaugaggaacugugggagggugggccaggaggagggcaacaacuggacuauaaaaaaaaauaaaaguaauaauaauaauaauaauaauaaaaagagcaagagaagcaaagcccaaggccuucaugucuaacuucauuaacagaagccggagaggagcacacccucucugcagguuccccugagacuugcuggcuacucaguuuccuuggcugggucagcaccacuaugcuaagaaugucuuaaguuuuguuuuuguuuuucuuuuuucuuuuuuuaauugaaaaguagauuuuccugccauacaauauauucuggcuacaguuuucccuccuccaccuucaccuaguuucuuucuucccaucuggauccaugcugucucuguuucucauuagaaaacaaacaggcaucuaaggaauaagaagaaggauaaaauagaauaaaauaagguaaaaacaagaacaaauaaguuagagcaggacaaaacaaacagaagaaaaauagccagagaaaaagcgucagagacacauauagauggaaagauacaccuguuuguauacauaggaaucuauaaaaacacaaaacuggaaggccuaauauauccacaaagggccagaggacuuguaagguaaacagaaaaaaaaaaaaaaaaaaaaaaaaaagaaaagaaaaagaaaaagaaaguugugaugcagcuuuaugcaaugcaggaccuccaaggcugcuguugaguuuguuuuguguuggucaucuacugcugggcacggaguucuacaaugaagaugguuuguuuccccagugagacuccuuuggagacaacuaauauuucauuugcaauugguuaucaauuggagcuaccuucuggauuagcaauggggggcauauguccuuuuauccucucagcuccaggaccccauccagcgcagaccugugugggcucugugcaugcugucucagucucugugagcacauauguucaguucuguuaaguuuaaaagguccuguuuccuuccuguccucaaucccucugacucuuacagucuuuuugucucuucuucugcgggcuuccccgagccuugauuggagacauguagcuggacuuuggcuacuuuguggguucuuuuuuuccuucaccuuucuucuucccuuuuccuccacccuuucaacccacuaauccuagaugggagagauagaggggaaaaggggagacauuauuguuagacuacuuccuaggggugucgaguuccuuggggcaaguuugaucuucaaugucaggauaucuaauuucuuuuuauuguuuccuuuugcacaggacuauuuaacaaacugcaaucaacagcaaucaacagcuaugaaccagcaaccuacccugccucuugggacccuagcauuuauauacccucugaagaguucccagaauuccagaugucacacuaucacagaaacuauccucagcuggcaaaaaaucauaccccugcuagagcaugaggcaaaucauagucagcugcuguggacagacugaaccagccccauaccacaccugggauuaaaacaaaaacauguucuuauauuucuguuuuucuuuuucuuuuuuuguagaacaugauuuuaauauuuucaacuguuaauauucaacaaacagaauaauuauuuaagauauauuuca

SEQ ID NO: 3102 - RNA, 30990 nt, Mus musculus
gggauucacacugagcacgugugucugccuaggcuugggcuguuuucugggauggacuaccugaaauucaucacgugaguagcucacucagugcaaggcacuucuucacuggggucuuaagcgggggaggcagaaauagggagaggaacuuaaaauguuucugagugaagacagcucuaagacuuucuucaagagagcuaaggagagcuagaaacagaagucucacaguagugggaauggccacucaagacuguaggaagaagaaccccucacucaccaggaggagaggccuuggaaagaagauacacacacacacacacacacacacacacacacacacacacacacacacauauauauggaccuggacuugagcccccagccuaggccaggaaggacggaacagugcuuuugccaugcccacauuugaccauuuaaccaucauacauagcuuguccagggaaggaggcagagcaucccugacacuggugucugaucuucccuggugauuucagucccuggcaguaacaaucuuugcauguguacucagagagcugccacgaugagucaaacaucaaugccaguaucacgggaaaugccaugacagcaccuuccccucucauucuguauauaaauacauauuuucacuuuguagguguguuguauauguucuuauguaugugcucaugucugcagguccaccuccauaugugugaaagugcaugaggaggacauggaauuaugccacauaucuugcuacaaauauguauaaacaguugcuguaucagcaaggugugugugugugugugugugugugugugugugugugugugcauaugcgcaugcuaaagaccuugccaaacaaguacucagggagacaacaccuacagcucaccacuuguaguuacacaagucgggguacuuuauguuaagagagaaagcauggucguuccccauguuacaucuaggcacaugggaagaagcuggagagagguguggucagcucuguuaccucauauagccuguugccaugguuaaaggcugugguguuggugugagggagcucagggaugggcugggaucuggaaggaacugcagguuuguugggcuguauguugggagaauauauacagaucuccaugaugaaguccugccuaaaccucagugugcuauacugggagauaggagugaggaaguguaugaagccuaaugugguccuugaagugaccuuuagcagggccugugcuaaagcaguagaaacuguugcaguaaguauuagcagguguguguguguguguuugugcauaugcacaugaacaugcuaaagaacuugccaaacaaguacucagggaaacaacaccaauaagccuagggaauggucacacccagcuuguaccacauggaaagacuccaggcgccagacuagugcaggaugaagcucugcuguugugcccuaagccauggacaacuaucagcuauggcagcccauuguguccagggcagguaggagaugguacagaguccuacugucugggcuucugaagggacuuugcuucuucacaguaauaaucuugucuuguauguccagggguugucuccagcaugaccgaaagcagguacucaacaggugugggaacuaaaagggaggcuggggaagagggggagggaggauagcccacguccagccagaguuccaccuaugcucugggcaagcagacaugggagggcugccagacgcuuuccacucagccccggguaggcaucuaagccacugaccccacucaauggggggcggacaaggggcagcccccaaccgggagcccuggaaugacacccuguagccccgggguuaugggagugagggcugagggagagagguucccacacaggugagagucugugcagugggccuugaugagcagagauagucuaugguuuaagagcuagaggguaagagggagagagacgaaaagagaggaaaugagagaggauaguaaggggauuaagagcaagaggagugagagagugaggagaggucaaacagcccuuuuuaugguaugcuguuaucuuuacuguugcuagguaacuggggaggagucuagccugaaggucagaagcuugggacauugccuauaugacuacuaaccaugcuucuccugugggggcugaggggaagguaacuuugacaggagccauaguuccaggagacaugagagaacuccuuccgucccauguaggugaauuaucaccacugggucucagaguucagaccucagcuugacuggagaccagacugucuguguauagcccauugccccacaaacaggacauauuauucuagcacucuaccuaacccugcacacuauacauaauuauauuuaaauuguauguuuagugugcauggucugggaguguauauaugggaguacaugugccuucagguauaaaggcaugcaggaaagugcaggagcaaggaccugaauggcagugacaggggcucugugaaguucuugagguguuccuuauuuaacacaacaggaguucuguuaagccagaacagcaguaaauacaagggugccugccgaauggcaugcuauacauagacucaggaagaagacaccauacacgugccaggaagggaggccucuggaagaaacugucaagucagugccugcuuuuaagacucaaaacucacgcaagugaucaacuacuuacacugcccccuaugucauuauuucagggaacauaugcuacacagguucauaaggaagugcuuucccaggaccuucucuguguuuucuuuuaaacaugaaccuuccuagaaaucuuuauuuucaacucaaaggcccuuuccugcauggccacagacauugauaucacaucccuucuucaucuacuuaacauauuuauauuuauggcuguuaauguuuuugugaaugaauguguguguguguguguguguguguguguguguguguguguguguguaggaucauaucaguuguuucuuuagugacauucucagaagucaucgacuaucaugaugaggccagggagggaaacuuccugaaaugcugcuugcugggaaaucuuacuacaaguuguguuuaaagguggugaagagacagguuagaggccaaaauuucaaucaauuugauaccaguccaaaaggcaccugugugccuggacacccuuugagcuuuccuaaaaagagugaggcuuggccucugugaccucacagaaggggucacugucaugguuguggguguacccuaguucugagggcagcagaguccaugauaggagaagguggcagagauccuuucuagguaagucaauguaggaaaaucuuuggguaaagaccugaucucacaucaggacauguacuugacagagggcuuuuugugaaaggggugacuaaggcacaguucaguaucugagggcuuuugauggacaggacagacgugguaauagcaaggacuagaggaauauccucacagagcauggccauguacaacacauagaaagaaaacccaucccauauaggaaauugugaagaucugcacagccuucagugccuuagcaagacauuuggaggacuaaccucuauuguuuccccuaacuuucugugauauuaagucaugagaccuccggaaggaggguuaugcaucauggggccuuggugagacucuccuguggcucucacaacuuagaagcaacaaucuuuccacaugaguucauggguacucucuaccacaggcauggacagcuaugcaacagggaucuuuuuuuauuaaucuuucuaauuguauaguguauaauguguuuuaccuggacuguacguaagcuaugaguguaaagucugagcauguuuccuaguggauaggucaaugaugaucugaguguauuugagaugccagagaagaauacuaaauauaucaaucaauaucugucuccuuuuuccccaaaauauugaccaagaucaaggcuaaaaacaaagaagcuuuggacaaauuugaacucaaaagaauccaguacuucaaacauaaaaagaaucauauacccugauagugagguuuucuggaccuagauaaguaggacugaaaagaaagaggccuggccaaacaaacaggaaaaaaaaaagagugugggcaaugggaaaaucugaccuggaaggaagucagguccaaaccaaauagagauaugggccuaggccuaacccugccccagaagagggcccaggccaaaagcaaaaaaagugaugugggccugggccugucccugaaccuugaagaggccuggaacaaaagcaagaagugauguugaccugggcaaaucccugaccuuugaagagaccuagcauaaagaaagaaguaaugugggcugggccuauaccuaacuuugagaggcucaggccaaaagcaagaauugaugagggccugggcuuaucccagacaauugaagagggccgggcugaaaaacaaaaaauaaugugggccuggaccuaacccugacccuugaagaggcuggggcuaaaagcaaaaugugaugugggccugggccuaucccugaaauuuaaagaggccugggcacaauacaaguuaugaagagggucugggccuaugccugaccuuugaagaggcccagacaaaaagcaaaaaaaugagggacugagccaaaggcaagaagugaugugggccuggggcuaucccuguaauaugccugacccuagaagagccuugggacaaauggaagaagugauauggguauuggccuauccucccgauccaugaagaggccuaucccugacauaugaagaggcccgggccacaagagagaaguuaaaagugccugauccuaucccugaaguuugaagaggcccaggccuaaagaaaaaaguuuuauguucccgggccuaucccugaacauuaaagaggcccaggccaaaguaaauaaaagaugagggccugggccuaacccugacccuugaagaggcccaggccaaaaagaagaagagaugugggccuaggccuaucccugacauaugaagaggcccgggccacaagaaagaaguuaaagugccugguccugucccugaaguuugaagaggcccgggcccaaagaaagaagugauaugagcccgggccuacuccugcacauugaagaggcccggacuagaagcaaaaaaauugaguuccagggucaaaaucaagaaguaauggggggcugggccuaucccuaaaguuugaagaggcccgggccuaaagcaagaagugauguaggccugggccuaucccugacaguuaaagaggccugggcucaacacaagaagugaagagggccugggccuaugccugacccuugaagacaaaagggacaaaaggaagaaaugaugggggcauuggccuauccccaacacuuaaagaggucuaggccuaaagaaagaagcgauaugugcccaggccuauuccugaacauugaagaucccgggccaaaagcaaggagugaugugggccugugccuauuccuaaaauuuaaaguggccugggccuaaugcaaaacgagaagagggccugggccuaugucagacccuugaagagguccgggccuaaagaaagaagugaugagggucugggccuaucccugacccuugauugaagaggccugggccaaaagcaagaagugaugugggcauggucaucuacuuaccuuugagaggccuggggaaagggaaaaggggaaagggggaagggggaagggggaagggggaggggggaagggggagggggaagggggaggggaagggaaggaaaggaaaaaggaaacuucagggauaggcccaggccccuuucacuucuugcuuuaggccugggccucuucaagugucugggaaaggggggagggggaaagggggaaagugggaagagaaggaaaggcacaucacuuuuuguuuuuuggccugggccuaucccugacccuugaagaggccugggccaaaggcaaaauaugaagugggcaugggcccaucccugacccuugaagagaccccaggccaaaagcaagaagugaugugggccugggucuaucccugaaauuuaaagaggccugggaccaaugcaagaugugaagagggccugggcuuaugccugacccuugaagaggcccaggccuaaagaaaguagugauauguccccaggccuauuccugaacauucaagaggccuggaccaaaaguaaaaaagaugaaggccugggccaaaagcaagaagugaugugggccugggccuaaccuugacccaugaaauggcccaggccaaaugcaaggagugaugugggccugggccuaacccugaacguugaagaggcccuggccaaaagaagugaugugggccuaggccuaucccugacccuugacguggcccuggccaaaaugaagaagugaagugugccugggccuaucccugacauuacaagaggccuggauuaaaagcaaaaagugauguaggccuugauaaucacuggcccuggaagaggcacaggccaauagaaugaagugaugugggccugggccuaucccugacauuuaaagaggccugggccuaacaaaagugaagaggaccugggccuaugccugauccuagaagagccuugggacaaaaggaauaaguaaugugggcauuggccuaucacugacccaugaagaggcccaggccuaaagaaaguagugauaugugcccaggccuauucgugaacacugaagagggccugaccaaaagcaaagaugaaagccugggccaaaagaaagaaguuaugugggaaugggccucucccugaacuuugaagaggccugggccuaaagaaagaagugaugugugcccgggccuauuccugaacauugaagaggcccggaccaaaggcaaaaaagauaagggccaggaccaaaagcaagaaguaaugugggccugggccuaacccuaacccuugaagaggcccuggacaaaagcaagaagugaugggggccugggccuauuccuggaguuugaagaggacugggccuaaagaaagaagugaugugggccugggccuauccgugauauuuaacgaggccugugcccaacacaagaagugaagagggccugggccuaugccugacccuugaagagccuugggacaaaaggaauaaguaaugugggcauuggacuaucccugacccuugaagaggcccagaccuaaagcaagaaguaauggguuccugggccuaucccugaaguuugaagaagccagggucuaaagaaaaaaagugacaugugccagggucuaugccugacccuugaaaaggcccgguccuaaagaaagaagugauaugugcccaggacuacuccugaacauugaagaaucccggacagaaacuaaaaaaaaaaugagggccugggccaaaagaaauaagugauguguaccuggaccuauccuugaaauugaaagaggccuggguccaauacaacaagugaagagggccuguuccugugccugacccuugaagaggcccgggccaaaaguaaaaagugauguaggccuugcucaucacugauccuagaagacacccgggccaaaagcaagaagugauguaggccugggccuaucccugaaauaugaagaggccugggcccaucccugaaauuugaagagggccugggccuacgccuaacccuugaagcagcccgggccuaaagaaagaaauaugugcccaggccuauuccugaacauugaagagaccugagacuaaaagcaaggagugauauuggccugggccuauuccugauccuugaaaacacccuugccaaaagcaaauuuguugugggccugggccugugacccuugaagugguccgggccaaaagcaaagagugaugugggccugggacuaucccugacguuugaagaggcccgggacaaaagguagaagugaaagagccuggguauauaccgagcuuugaagaggcccuggcauaaagaaagaagugaugugggccugguccuaucccugaccguugaagaggccugggcacuaagcaaaaagugaugugggccugagccuugaagagccuugggacaaaagcaagaaguuaugugggccugggccucucccugaacuuugaagaggccugggccuaaagaaagaagugaugugugcccaggcuuauuccugaacauugaagaggaccggaccaaaagcaaaaaagaugagggccugggcccuuaugcaagaagugaugagggccugggccuauccaugaggcuugaagaggcguguccaaagcaagaagugaugugggccugagacuaucccugaaauuuaaagaggccugggcccaaugcaagacaugcaagccuaugccugacucaugaagcagccugacucuugaagcagccugggccuaaagaaaggagugaugugggccugggccuaaaccuuauucuugaauguggggcaaugggcuauguacagacagccugguuuccagucgaggcuagaucuugaaccccgggacccgguagugacaauucacuuacaugggauggaaguucucucauggcuccuggacccuccuccacaacccccaccagagaggcguggcuaucagccacuuaagaacagcacgaagcccucucacaugcaaauaagguuucccccaaacucucagcccaagccaaugagaggggcuugcugucaaacucuaaaucacugccagaacuguguauaggagagccaugcagggaauuaaaggaaugugagaacuauuccuuugucugacccuuuuguuccaagagcuguaacacuugggaagagaucucucccgaagagcugugccugaguucugcugcauuccucacuggauuguaggcuuuucacagacccaggcucagaguuacugagcaacccagaaggcauggcagaggcuucgucugucucccugccuccacucacuucccuugcuguggccuucccaccuugcuuggagaggggucuccguggaaaacuucugguacuuaggcccacaucuggagaccaaaguggggcaagagugaacaaaacgaccacacagaacuaauacuccgggaaggugaucacauggauuuagacaagcuaaagggacaacugaagccuucuggccagagcuacucucugguguuggccgaagguuccucuggccucugucuaaauccaauggcguuggcaaagacucuuaacuucuccuuaaaacaaagaaaaccugguaaugcagcagccaauuaagagccacaggguggcugccaguucuuaaaucugcagaaaggcuuagcauuuggaccaauaggccaagggaacauucccauuggacaagcguuuuucaucuuuucuaccaugugaaacucaccaucauauaaaaaaaaaccaccccagcucagggaaauaugugcccuacuaaaacacagagggauaaagauagacaaaaaaaaaaaaaaaaaaaaaaaaacccaagccuccuuauuuugggaggaaguccuucagauagcaccauguauggccaaugauaauauuuauagcccagacucauggaucagagucgauucucuuaucaaaaacaaagauacccgagaggguaaaacgcccucccaugaguuuuugccaaucuuaaccacaauuaguuagugcauagggccaucuaaaauaggacaaacugacagcaacucagcugcugagcccccucagucagaugaacccaaaggucaagguccuaaaaaccacuccauuucagaucucacaguccuuacucaauaagagauaaaauccaucuauccacccuaugcuucaaaggaaaacuaauuaaaccaccaccuuagagacucuagaggguccacccucaaaauagucagaccagaaaggaugcuacacaaauccaauuagaagggugugacaggagacugaacuagggcuuuacugccguguguaagguacaaacuugagacuagcaucuguuuuuaaaugguggacuauuaguaucuuagauagcguuuuauugcuacaaagaaacaccaugaucaaggcaacucuuauaaaggcaaacauuuaguuggaacuggcuuacaguuucaaagguucaaauccauuaucaucauggugggaagcauggcagugugcaggcaaacauggugcuggacaaggaacugagaacucuacauggugaaccaaagguguccaggaggagacucugaucccacugaccagacuugagcauauguaugagaccucaaagucccaacuccacaguggcacacuuccucuaaaaggccacaucuccuccaauaaaggccacaccuucuaauagugccacuugcccuggggcaaacacauucaaaccaccacagcaagcuaccuuuacuaugauaaaagaucacuggcaaucaacuuuaaaaaggaaauuuuauugugggucacaguuucaaagguuucagucaaaggacucuuagucuuguugcuuugagacacagcagauaguucaucaugucaaugguacaugacagaggaugucuguucauaucugggcagccaugaagcagagagaaauaggagggggcagggucccgauauccuccuucaaaggcacaccugcagugaucuaacuucuuuucagcugcaguaaagaacacggacugcucuuccagaagacuuagguucaauucccagcacccaccugguggcccacgacuguaacuccagggcuagggaucugaaacccucuucugaccucuguggacaucaggcacauguguaguacacguauauacaugcagguaaaacauccaaagacauaaaauuaaauuuuaaaauauuuuuuaaggaguuaaggcuauacuaagcuagcuccuuaaagaaguaguucuggcagaagagacagcucagugguaaagagcacuuacugcuccaucagagggcccacaguggauguuaccaagcucugauaccaccaacuccaaggaaucucauauccccugcuagccuuccuggaccacacacacacacauacacacacacacacacacacacacacaaauaaauaaauaaauauuuucaaagagagaacgauagauguucugaaacagagcccaaccuucaucaguccccaccagcuccugaugaugggcuguuucuaagucuucagugaacacagcaacaccucucugacuacacuucuacuguuaguguucaugcuaauuccccaagcuuccuuuucagugauggagauggaaccccagauuccguuguggcuagacucucucuaccuucugaaggaagcauguucacauaccuguauucagccauaucuuaggaaucagguaguaaaaagaacaugcuuccagcuccacuucuggagugagaaguuuaacccucugagaagucaggcuguccuugagaacuuugcuaagaguagguacuucacugugagagguagggagaacaucuggauaacuguaggcaugacaaagaccggggaacaacugagucggagaaagaucucuauggaagauaaggaaggagcaaaggggagcacggagcugaguuaggagagaacaccacggucuuguagguucgagguagugaagaacucagccuagccagagaacgaauuagggaaggaaacacaaaacuguuagggucaccaguaggccuuaggaagugauggaaagagcacccugggacuccaaagugacagaauaagaaaaaauguacagauaaagaaacaaaacaaaacaaaacaaaacaacuagcguauaugguauauauguuuguauaugcauaugcauucacacccccuuguauauauauauguauguaauggucaaugcagugucucccuugaucacucuccauguuacuuucugagacaggguuucagcaaaccugaagaagcuccuugguuuagcuaggcuagcugaccgacaagccuaugggaugucccugucugcaccucccagcucuggggcucuggguuuucacugugauguguagcuuuuaugugugaguuucugugcaugcaaacugaaguccuaaugcuuguacagcaagcacuugacccccugagccaucacccugauagagggaaaguguuggggacuguauguauagugcauccgagggucccaagaccauaggguaugaacauuaauacaaaguucuggaauuugggagugaaguuggggcuacagacauaaacucucaaaacugccacaugugaccagaggcuacaugcuggugugcaaaugagggcuguagaaagugaaguggggagagccaucacaguagccucugcucucagguacagaugaccacccuacaaggacagaguccccacucccaggcggcagaaaacugccucuuguguuggcuuuuauagguccugugacacagaauaauuuaguuucuucagaucuuaaacugaugaaaugagguuguuuuaauuacugauaugccuguuacuccaggcaaaguuucacugguagccaugcagaaacaacuauucugaguacucacauaugcagaggacacauugcuaaaauuaaagauucagcugugaggcuaccaaaaaaaaaaaaaaaaaaaaaaagaacagcucaagcuugaauaggauuagaaacucaagggcaggcguaccaaagccuugaaggucacacauaaaaacgucaggcuagauggcuugguguguggguugauggguaaagugugcuuacacagccucaaagagcucugcguaagccagcuaugguggcacaugccuguaaucccagcacuaagaagguugagauagaaggaugagaaaaucaagguuauccuuggcuacauagugagcaaugaggcuagccugggcuacaugauaacgggguguggggguagauuuuuuuuaaagaaggaaaaauggugacugggauuagaaguccuaggaaaauuggucccuaggaugccacugagcuggucucuaguucccauuuucucucucugcacuccagauucccgcaccauaaauacuaauacagcagccuugaguagaaacuucagugcuucuggcugugggaaggaaagcaugccccacccccaccccccacccccacccugagguuacuaugaggaacaugcuagcaguaagaaugguuuuccucaggcuagcccagcucaaugcccuucaaugcuuccaagaacuuucacauccuggccuccugcguuuagacuccacauucuccaaggaacccucuccuacuuacuugccuuccucagagagguccaucugcaguggaaggaugugagagcucagagagaaggaugagagcacuccagucacacauggucccagugcccucaggauuccauagauuggcauggugguuucaugcaucagcucccauagcguaauuaauuagagaaaaagcugcagauggaucugugucugcugugcugaaagacucgguucuuaaacuccagagaccuagacccgggcagaggcaguguaaccccgugcggucccugagauaagucaaaugcuuguugccugauaccccacccggccuuaggcaaugggguuccucuaagcuuucuaugucucugaugacucugagaguguuagauucuagagauaggaugauguggacuggcaaagcucugauccuaauuagagagaaggaaaagccauaaaucagggaagcagcuucccuuucuggccagacugacugacgacuuuuguguguagucuguggcugaagguaguauuuggucccaauccacuuucaauuaucucuaguccuggaaacgccauuugugucccaggcugauuaaguguguguucauagcugucuggacucuccgauucacagugaguuaaaagucuccauccugucaaugacuuauuaaucacucacaccugcaaggugagauucaccacgucaggcacacugguacuuggggacacuaagaugaagagcuuugccuuuuaauuggggaaaagaaaauguaaaucaacugcaugaguguauuuugcuacuaugacaaaauaucagagguugggaaaugucaacaauaguuugaaaggccagugaguucagagucaagacgcuagcugaucugguucaggugaggaccccccuuucuuguugugcuuucucagaagaaaugggaaagauuugagcuagcccuauaaguccuaauccuuuaggaacaagguucuacucauaaaaucccucaucugaccuuaauuccuagaaguauaaaauuuaccaccgaggauagucaauugaggguuggcauuccaacauauaaauugagaagagagggcacacacgcuguggugauggcaagagauucauuaguaugcuacaaggugcucugagaugcagagaagcaaagaaaauucuuucugggguaggauucaaugagauucccucccugguucguuacccacuguagugggccauuuugaaaguccaggcgaugcacagaacugucucccacgaacuuacuuaauuuguucuuccgaacuuucuauucuuucccauaaacuuaauucccagccaaaccugcaaguagagcuccccguugggauacaaauuugaucccagagacuccugcagugugcgcauccuguagagaggcuccugcacuucuaauuugagaacccaccaacuccacugugucccagcugaucccggaaaagaguaaccagggcaaccguggccucuggagcugcgcaccagccgcucuggcugcuaacggaagucaaguccgcaagguauuguuccuucggugacgucaaucucagaguuuugggguuuuuuguuuuguuuuguuuuuuguuuuuauuuuauugucuucccgguuugaggaaccucggaauaaauccacuuagaccaccuaggucuucccaucuagggaagaagugcagacucauucuacucaaaagggguuguuuaucuauucagaauguuuaucuauuuaaaacuauccagaacguucggcacugcggagggcacucucaccucucgccuagcuucucagccaacaguaagcaagcaguuguggacugaauuguaucccccccccccacccaaaaauauucagaaugaaguuuauaucagaaguguauaauuugcuuuuuuguuuuauuuugaaucuuacagaggguuacaguuaaggcucagaaaagaucuggaccuugggcuuuucaaaaaaguugugaaguuggauuaaaugcauuugcauuauguugugaucaagagacuaggggaccaagaaguggaaugugguggcuugaauguccccauagucuaggacauuugaauacuugaccccuagccaguguugcuauuugagcaguuaggagguguggccuugcugguggaaguguguccacucccugugggcuuuuagaguuuaaagacuccacuucuucuaguuuucucucucugcuuugucagcugcugcuccacccgccaugccugcugccugccccucucugcuccugcuuccaccuccaccuccugcccccuaccccgcuggcccugccuccacuccaccaucauggaaucuaacucacuagaaccauaagcauaaaaccucuuuucuccauaaguugcuuuaguccugguguuuagucacagcaacagaaaaguaacuacuacaaacuuaacuuuguuccuuagcaugugaucuuccuuggaaaugggcuguuugaggggagcuuagguuaaaaugaagccauuaagauguucagcaaauaaucaacgucucaauaaaaggggcaacuguggagacagacgugggaagaugaacaaggcuacaagagcaagaugaugaccacgugcaaaaggaacccauucccucaguccucagacacagccagcccucccaacaccuccaccucagaugucuaaacccuagaacucugagucaacucaguccuaugguuuaagccaccaaguuugugguauguucuuacagaagccccaguaagugaacgugcccguguuccaagcccaacuuuaccaguaguguacaaucugccaguugucccuguguaccuaggaugucugauaugccaggauuccugaaauguucccaaggguugccccaguaacuacaggaaagccacucuuccccuagggacuaaagaucaaauuugagucuuuggagagacccagugauucuucauuucccaaaggcugauuagucauagaacaucucaauuugaagaacuugagaaaugucuggaauugcagaaauucagaucuagaggggccuaaagcaucauuuagauaauucuuucuuaacucuucuuuuccaaaucucucuucaucccauaauauucccagcucuggucucccuccuucucgcccggucuuccucagccucuuuggaagcuucccucucuucccagaacucugucuucacaggauuugcucacugccauuucuccucaggugacaucacccuuggcuuugcagacugucucuauacugauaacucccagauuuauaucucuggccccagaaacauuucauuagggcuggcuuauagguucugagguucagucugucgucaucaagccugcaacaaggcaguguccaggcagggcgcaggaguagcugagaguucuacaucuucaucugaaagcugauagggaaagauugauugucuuccaggaagcuaggaggagggucucaaagcccacucccacagugucacacuuccuccaacaaggcuacaccuccuauuagugccacuccccagggccaagcauauucaaaccacugcacccagggacauacuuuuuccagcaaggucacaccuucuaauugugccacuccuuaugagccccugggggccauuuucauuaaaccaucacaccaguccauccucuuuaucucugaggccaacauccuuguccaagccaucaccggcuucuuuuugaaccacuccauucauguccuuaccgggguuuuggucucaucucaagucuaagggcagcagcuggaacaguccuaccaggauacgaauggagggcagagagaaggcucagggauuaaauguuugucgcccaggaauggaggccuaaguuuggaaccccagaaccuauguaaaugccugguguguuauggcagcccaucuguaauuccagagacaggagaccccagaguaagcugacuaaugagacaagccauauuggugagcucugguuucguugaaagacucugccucagugaguaagguggaagagccacgagggaggaugauuccagacaucaaccuugggccuccacauucuaaccauauagcgcuccacaaucgcuaacaaguuuccauacacgggcaaaaacaaaugccauauacaaugaauauacaaacagaaagauacaaauauauaaaccuuaaaucuugcaauaucccaucuccuccccccaacacacacacauacacacacacacacacagagagagagagagagagagagagagagagagagagagagagagagcacaaaauaaaauccaggcuccuguaacuaccugauaacagcuuccagcuaccucuaacaugaucucagauguuccucuuagcuugcuguauaugacaggauuuucccuguccaauuacauuaaauuauuagugcagcaggaggccuguguuaggacagaguaaagggaagcggagcuaagaguuggggugacagcaucuuggaagagaagggaagccaagauggaggcagauggacaggaagaagauccugaucccaugugguuuuaaauagccacagguaguuaugaccaucaugucgggauagaauaauugcaauuacuugucugaucuaggugggcagcuuguaucauuaucaauuggcuccgaaauuauuguguaggcaucuugagaauugggaauuuauugauauauaaaucugacuuguuaauuauaagcuucuagaguuuuguuuuacuggguuccuggaaggugggaccaccaaccacagggggauuauggcugagacgguaugggcagcuaugagacaagggaaccagaguuggguagauggcgauuggucgcuggugaggcuacucuagaggcagagauggugggaacgcaccgaagcagaguugccagcaggagugcaggaacucacuggucuuuuuuaauauuuccggcaacagcuguauugcacccuuagugcccuuuucuuccuuaaacacaucacucauugccuaccuucagagacuuuauuuagcaucucucccugaaaugguaucacacacacacacacacacacacacacacacacacaccccuucuccuuuagaucauagacaaaaggcuuuaaaauauguccucacaucccuugaauuuauucuaccaaaagguagcuucuaguuccuuuccccucaaugaugcagugucuugagugaguucgugaauaaaauacugugugacuucuaagacuaaaagcugcuauggcuuccaucuggcucuuuuauuggaagacccacgccuacaacucagccaccaugcugugacaaaaacaagaagcugcuugcaggugucucaauugacucuucagccuaagaucccuauuaauaggccaccaccaauggacucaacauaccaaggagaaagcccuuggauguuuugaguucccccaucaguugacucugucacucuguacccuccccucuucccaccuaagcugaaaauucuuggagagaauaauaaccaugauuaccugaagucauuaugugucgggguggauugcuaaggagcaauaaauaacuagaacacagccaaugaguccucaucgcaagaacugcccucucccccacaugcccucuaaugacuccuugacuucaucuacaaccagugaauuacuaucucuaguaaccucaacacuuagccuacuacuuccuggcaaacaagaagcacucaauggauauuuguagacuguacaaaugaaugaauccucuugucacauuagacucauuaaugagcuggggggggggaguauuuaaaauuuuuguaaugauauuuaauuuaauaaaauuuugcaauuuauauuuaaugcaaugauaguaacaaauaccaguucaagccagauaugagauuauuuaccuguaaucucagcacuugggagauagaggcaggaaaaucaugaauauaagaccucucuugguuauauagcagguucgaggccagccuggguuacaugagacccuaucccaaagaaacaaagcagaauugacuggagggauggcucagcacuuaggagcccaugcuguucuggcaaagcaccccagcucacuucccagcacccauguccaacaggcuacaacccccuguaauucuagcuccugaggacccucuucuggcauccucagacacacacacucacacacacacacacacucauaaaauagaaauaaagacaauacuuugaagagaaacagaacggaaaggggcaugagagacagggagggaaggagggagggaagaaggguaaagaguaguuauggaacaagcuuccucauuaucacugcccagagauguugggcagacucggugaccacugucugggagccagaagacacuaggaccugggaagguggauugguauccccccacccccaaaggauuugagucccaggaccagcacagcagacagccugucuuauuuguugggaaauaagcaagcacucuuccugcuguuggucacaccugccagaacacgucucucuggggugagcagauuuucaaugggggaagcugcagacggcaggggguugggccggggaaguuguggagaauuguuccuucuacacuugggcccaguugcaaaugacagacuugucaggcaacugaguuuguagcugguuccugggggcucuuuucacugaugcgugguuuccuuggugacuggaugggcugcugugcacauacacacagcagcuuuuugggagacacuugacugguucugaugcuaacuagcucugacagcuuugauugggguaagaagaaaaacggucucuacuggcuuucucaaauuaaacauuccuuccaugcucauauacacuguuuccuuuaccugggagacuaacaggcugagcauaccagcaaggauucugagacugggcacccugaagcaccccagagaagcagcaccgugguucucaggugaugccuucgggggcugcauuagccauaagucuaucgggguuaggaaagcaagaauggccugcguuacuucaauaaaaaggauuuaaucuaggcuguuguuugagcaggcgcuggaaaggcaaaaaaggggaaaucaagauaaagagagucuggggagaugcucagcugguaaagugcuuuccuuguaagcauuaaauagauguaagcaucuauauuugaaguccagaacccaugggaaagggacagcagccacagaggggcucacccacaacagacucugucuaccaugccacguuccagguaacagggcaggcacucugaucuucccgaaagauggcaagcaaagcuugggaagcaggaagaagccaaaagagcugggaacagugauggugaugggcucauggagagggccaaggggacagcagaugacccuggaaacugugcgaaaauucaaaugcaccuuuaggaucagagacugugaccuggguguguggccuuucugggugugugaccugagcuauuaacaggcuuucuccagcaggaaagucucaaaagugugaguggcuagggggagguggguagguguguguggauuaaagugggguuuuggguucugggguguguuggggggggaggaguugguuuacauaggcaugugugcaaucgcacagcuguggauggcagaugucaaccucacaagucccuuaguuacuugccaccuugggauugcugugaucugucuuuacauuuauuuguugugagcaccuauacucagcagucagagucaguucuuuccuuccauugugugggcucuagaaauagaacucgugcugucaggcuugguggcaagcccuguuaccuccugugccaucucaaaggccucacugugguuguuuguuuguuuguuuguuuguuuguuuugagacaguuucucacugguuuggggaacaccaaguuggcuagaaugaguagccucuaaguggcaaagauucaccugucucuaccuccgcaguacugggauuacaggugaaaaggucagcucagaaacuuugggaacgucaugaaacacuugccccucuggaaggaaaaggcuaauuaacauuucucagaccacggggguggggggcacauuccacauggcuaacccugcucaccuucagacagggaaguccuugucaccucauucccuaaagaccaaucaguuuaaagggugcacuguuccaccaaucauauugugccuaguugcugaugcucuauuuuggcccuggaaaccauauaaaaacuggccgaacugcugcugguggucgcugccucuccuucaggucugggacgaccccagugcacuggaacaauaaguuccucuugcuuuuugcaucaaccccagcuccacaugguucacucaggggguccccaguaagcuaagcuuccccagaguuuuaugcaagcaugugucaccacaucaggcuacagauucugaaacauuuauuuauuuguuuguuuguuuuucgagacagggcuucucuguauagcucuggcuguccucacucuguagaccaggcuguccucgaaacucagaaauccgccugcuucugccucccaagcacugggauuaaaggugugugccaccacugccuggcuccgaaacauuuuuuuaaagauuuguuuuagggcugaagagaugacucagcaguuaagagcaauugcuauucuuccagaggacucagguucaacuccuggcaaccacaugguggcucacauuugcagggaucugccacguauacacuauauauauguggcuggugcacauacauacauacauacauacaggcaaaucacucauaugcaaaaauacauuuuuaaaaaaggucuauuuguguguugaguagggguggcugcacacguguaguugcugagagaauccagaagaaagugucagguccccuguagcuggaguuacagugguuauaaagcuauccacugagggaagagaacuuuggucuagugcaagagaaguaaugcucuuaccccugagccaucucuccagcucgaacuuuuuaaacguucuaaucaaggacccugaauguuaguuucacacuggccucuguccucccggcacaaccagccaacugaauuccaggaggcguccagggcaagccaagagaagacagaggcagcugauggagagguugaggggcuuauaagaaagggcauguggcuucucccccucuauccgaccccacuccgguaacugucagcugaaacagcuaccucguaaaagacuggcagguguaccaccaucaucaccaccaucacccgggcccccggcccccaucccugcuucccuacuucccugcccccaaggaacaauccuaacacaccugcagaauacagucaaaggaggugcaaccggaacauaaacugcgcaucagucagccagucaugucuggcccgugguucccaagggcugguuucuagcgccugugacacugcacaacacguguagcuccgcagagcucuuucagcaccuccgaggggcgggcgccaccugguggucacucugagaucuacucgaggccacgugcucuuaagagcaggggagcuaggaaggccaauucagcacuggggagguggaggcaggagaaucaagaaugcaaggcuagcuuuggcuacacagcgagcuugagggcagcuuaagcuacacaagacccugucugaaaaauaaaacaaaaccaucaaacaaaaaaccaaacccaguagcuagggagauggcagaacuuguuaaauugggcuaacaugaggacuugcauugagauucccagcauccauauaaaagccaaacagccauggcugccuauauaaaucagcuagaccccaaagcuagcuggcccaccacauuagccuaaccagugccuucuaggcacugaauagugaggcuagugcccugcugcaauauucaagauggagagcaagaaguucccagggcagacauacacacagccacacacacccacauaccugugcacacacauggaugugaagaaagagaggagggaggaagaaagagaaaagaggaagagggagccagugguggagcagagauggugaaagugaggcaccagguguggaugagcgaacuucccucaguucugcauuugcccaggaggaacagcuucauugaagaagcacaaagaaaaggcagccguugagaaagggagucugugucugccgugagaggaucagagaccugcggggacacagagcaaggcaggaguucggggccagcagagaagagcuugcucucaccggugaacaauguggccuuguuggggcuggaggaauaacucagagggugaaaggcaaaccugacaaccugcguucaucaaauaucccccaaccacagauuugcacauacauaggcccucacccauccacagguaaaucauuggguuuuuuauaauaguuugaccuuguucaccagcacagggaacaauacugaggcucuagaguauagacuugagacccuuguugcacuggguacuuaauaccuguuguccugcuaauuaaggucaaagucuaccguuguccagauagccuucugagcucagcacaaaaugggagacucccuuuaccagcagagauucuccuucucugaccuugucugaggaguucagagcccccacccucuaccaaagguuugucacauucguagccuugauuagcucacaguuucagcugccuuucuuccaccacagaacccauucagcaagcaccugaaaucccccaaaagccucuccaugcuaaugaggcgucucaguuccuuauccuucagccaaugaccuuugcccacccucgauauuccuacaaccuuccccaaaacuauacaacccaagaaaaguugaucugucucccugaagcugaucccggagauaagucugcuauuucuguuguacucacaggcucuuccaaaccugccuguugacucugcuucccccaggagaagggagacccagacacccacuuuauuuauuuaauuuugagacagggucccucugugugucccuggcuggcccacaacucacuguauagaccaggcugaacucauucacagagauucuccugccucugccucucgagugucaccaauccugauuaauuuuuuuugcccuugcuguuuuugaagcaaugucuuaugaagccggguggacuuagucaggguuucuauugcugcaacaaaacaccaugaccaaaagcaaguugggaaggaacggguuuacuuguccuacacuuccagaucacaguccaucauuggaggaagucaggacaggaacucaagcagggcuggaaccuggaggcaggggccgaugcagaagccuuggaggggugcugcuugcugacuugcuuccccaggcuucugaagccuaccuucuuauagaacccaggaccacaagccacaagauggcauccccggcaaugcgcugggcccuccccucauugaucacuaaugagaaaaugccuuacagcuggaucucauagaggcauuuacccaacgaaggcuccuuccucugaugacucuggcuugugucaaguuggcacacaaaaccagccaauacccaggcuguccuggaacuuaguacguaacugcuaaggccuacuuugaauucccaguucuccugccuccacuucccaaaagcuggaaugacaggcacgcaccuccacacuagaaccauccacuauuacuuuaauacucuaaaugggucaggaaauaagaaacuauuagccccgucuuagcaagggacaguacaaccuaagucagucacuuaccugccaacuuuggaacaggcggucaucaaauucccaccagacucuacucaguucgagucuggucagccaggagccaugcaggcgcccuuugcaggacaaagcagaaccgcucagcagugaggugaaccugacuaaagggaagcccguauuggucagcagccccugugacuugaugcagaaaaggcugcuucacuacuguggagaguguuuuauugucuugcagugcuggagagcaaacaggaaguccucgccaugcagggggagcacacugccauugagcuguacucuccaccaccaccccacccccuuuguuuaaagauaguuuaagacaggaguuguguugaggcuagcuuuauucacucaguagcauagguagacuaggggcuacagggcugugucacuagucccaguuugacaagauuauuauugaauuaauaaauuuugggaccugagaaauaucugcaccuuccauaaucccccuccuacccaggaucacgggguccuagugggccaaggacguuucuucucauaacucugcuugcugggaaaaagagcugugguucuccauauaugcccugcaccuugaccuggaucacuggagggcaugguuuccuuagcuagucccuuucggcuuuucucauggcugugagaccaccugacagaacuggcuuaaggauaggagaguuuaucugggcuugugcuugcagggcaccauccaccgugcugagaaggcacagugacaggagugugagguggccauguugcaucugcaguaggaagcugggcaagacggaugcugguccucaguucgcuucuuccuuuucauucaguuuggaaccccaguccguggaaggaugcugcccacaugcagcauaggccuucccuccuugguuaguucucuuuagaaacucuuuccuagacuuaccugaugcuguaucuccuaggugacuuccaaaucuacucaggcugacaaucgagaugaacccucaggacgucucguauuuaugaacauucuucuaucuacuggaucauucucauaaacauguguggcacgugcuacaguuuugccguccuacaauaaauaaauaucugggaagaugacucaguuggcaaagugguucaaguuugaggaccugaguccauaaaaaggugcacacaguggcacgugcucacaaacccaggacagggguggcacgggcaggaggaucccuccaguucucuggccagccagucuagcugaacuaguggacuccaugauuaucaaaaagcugucuccaaauguaaggugacugugggacccugaaagguagcaugguuccugguugagcuaaggcuagaagccccggagacccugaagggacgguaggagcucugccugcucccaggcacaaggccccugucacuagacacagcucccacaccccagauuuguggccaucagucacguaagccccuccacacauggaggacacguaggcucaagauagagaucgacauucuaaugagguaccuaaaaggcugaagggcuuagcugauaagcuuuccuuccaagacauccuucccugcaaaaggcauuuaaucucaggcccacccggagaagugggguacgacuuuacacaaucacuuucugccauaacaauaaacgccuuaaaaccauggacugccucuuuucaacacaaccaucgguggggagccacggagauggccuucgccuacaaagcuucugucuaaucucccguagaaagccucucugugucccaaccacagcugccaccaagccaaguucaagcccucuacuguccagccaaggccucuuucccauggcaccagcuggagcuccccaaggccccgggcuagauccagcccucgggcccccacuuuguucucagcuuccucagcauccaguggcaccuggauggccaagagccugaggaccagauggccaccacccucuuuacaggccuggggacucacaagccagcucuggcugucccauaccucagacugugcuuucccaaacccggagcagugccccagggcuucccuacagcccaacaccuaucugagcagccgugcccuguggcagagcggacccaaaaagcauaggacucuuaaucccagggucagggguuugccccacggugcugauggaaagagacaguagcugugcuccaucuguguuucgguagcccgcuagccagugcaagaggggaucuagcuuuuuggcccacagagaccuuggucuaggguuggcagucaaaagaagcagagagcucgaggcaguggccaucugccaugcagcucuguuagcuguguaguaggcaaagcucccaccguccuucaaggucuccagggcuucuagccuuagcgcaacuggggacuacacucguuuucacggucccacaggugacaguaucugaaaagacaaccaacaucucuggcuuccacauucauucauauguacagguaccuacauacacaugcacgcucgcucacacacacacacacacacacacacacacacacacacacaccaguaaauaccuccuugauguguucuucccucucccugucagcuccacagcucuccucagaaggguucuuuauccagacacucucucuccucccgaaccgucucaagcacacuuugauuuuaugcucuccauucugccacaauugcucuccaccuucucuuugcaucacuacacuuaggaccaaaacaaaggccaaggacacacacacacccagaggugaccuauaggcuuuguucucuccugaguuucuugccugauagcugcugugccuacuuugugguguucccaccaacucucacacacuucuuuucugccugcccucucugaacaucaagccgucaauccagcaugugccugugugccuggccucagcccaucauucuguucucugucacugacagccuuagcugugaggaugguguugggaaccacgggcccacacuccugauggcaccagaauugccuuucugaccgccagugagaggaggugaggaauuugcugagaaagugugagaguugcccaagaaugugauuuugugugaacuuguccugggccagcauggaccuuaccaagugccuugugcggguccuugagcaccacacccagugggccuuaaccucauuucccuugcuacucccagaauggccaugagggcaucaaggcuguaccaauguuucaaaugcuaaagagaccacagacagccucucuccucugucuuccagagaccccacuucucgggguucuucucuggacuaccuaaaacauuucugguccaggugaccagugaucuaacccacacgcaugucaaaggcaccagcucucagcaugagaacaucugacccuacagcacuugacaugggagccacauugucccgugugccaguguaaccucagagugccacucucucuccucucacuuccuggggacacucuccccuuucugccucucacuuccuggagacacucuccccuuucuuccucucacuuccuggagacacucuccccucucuuccucucacuuccuggagacacuguccccucucuuccucucacuucauggggacacucuccccucucuuccucucacuucauggggacacucuccccuuucugcuucucacuuccuggagacacuguccccuuccuuccucucacuuccuggagacacuguccccucucuuccucuuacuuccuagagacacuguccccucucuuccucucacuuccuagagacacuguccccucucuuccucucacuuccuggagacacuguccccucccuuccucucacuuccuggagacacuguccccucucuuccucucacuucuuggagacacucuccccuuccuuccucucacuuccuggagacacuguccccuuucuuccucucacuuccuggagacacuguccccucucuuccucucacuuccuggagacacuguccccucucuuccucucacuucuuggagacacucuccccuuccuuccucucacuuccuggagacacuguccccuuucuuccucucacuuccuggagacacuguccccucucuuccucucacuuccuagagacacuguccccucucuuccucucacuuccuggagacacucuccccucucuuccucucacuuccuggagacacuguccccucucuuccucucacuuccuggagacacuguccccuuucuuccucuuacuuccuggagacacucuccccucucuuccucucacuuccuggagacacuguccccuuucuuccucucacuuccuggagacacuguccccucucuuccucucacuuccuggggacacucuccccuuucugccucuucuuccucccuuuuucaguuuugaggaccuucacaguuuagucuguaauguauaaaguucucauuucacacauaugucaauuuuacauuuucauacauguaaauagcauguuuugaucaugcucaccccauuauccuccuucuucuuauaacgguccucguucuacuuucauaucuguuuuuagacccagugaguuuccuuaggguugcucacaggaccaugggcaccuaaccuacaucgcugacaaaaaugcuuuucccucucacagcaacaagcuaccuggagguccccaggaaggacccccuaccuccccgugugacacagagaagucccaucuugguugucuggguuuuugagacagagucucaacccaggcugcccucaaacucacugcauagacaaggaugaucauguuggcuugcaugcuaaaugccucccauagucuccaaugucugaggacuugcuccccuacggacagcauuguuuggaugaguuuaggaagugcggccuugauggaggaaggauggugggcuuugaguguaaagauccuugccuacuucugggcugcucucucucucugcgucucuugcuuguaauucaagaucugcaccccacaccucugcuccaggggcugugccugcugccuuggguggagccucccugccaugaugggcucucaucccucaggaacuguaaacccucauaaacuuuucucaugaaguguccccuagccuuggauuuagcugaaugugucccguggcucccuggagccaagcccauccuccucuaagucaucugcaagauggucuuuggacucuugguggggguguagcuucuugucggggggaacuguguaugcuugucucugucgaaugcaggguucuuucugcuccccgccugagcccaucaccucaguaagacugccaaacaucaugguggugaccagcaaacugcauuccccuccucucacucauuggcagggguaccacagucaagauaaaugucugaugucagcuguuucucucccuucugcacaguaugcauagcaaaagcaaaauaaauguuuauucuuucccucuaaaccacuagccuauuuucugaauaaugagcccuaccccuguaauucugcaacagaggcuaauuacaagauuaauuuuaaugucaucagaaacucuugggauucaacacauauggugaugacguggucuccuguaauuuaucuucauccaggaccagauccuggcaucuuuagcaggccagggacagggauugaggagcugcaggcaccauaaccgucuuugauugcuuccuuggcugugugggugggauaccaagcagaccaucuucagguuccugcuugaguucucguccugacuuucuucaguggugacugcaaccuguacacugcgaucaaucuuuccaccucaauguguccaaguguguuaucacacuaacagauaggaagccagaauaccagcuauuccauaguuugcuuugugucgucuccaucacuccaggaugcccagcagaagugcguccacuucauugauacccagcagaagugcauccau

SEQ ID NO: 3103 - RNA, 30990 nt, Mus musculus
auggaugcacuucugcuggguaucaaugaaguggacgcacuucugcugggcauccuggagugauggagacgacacaaagcaaacuauggaauagcugguauucuggcuuccuaucuguuagugugauaacacacuuggacacauugagguggaaagauugaucgcaguguacagguugcagucaccacugaagaaagucaggacgagaacucaagcaggaaccugaagauggucugcuugguaucccacccacacagccaaggaagcaaucaaagacgguuauggugccugcagcuccucaaucccugucccuggccugcuaaagaugccaggaucugguccuggaugaagauaaauuacaggagaccacgucaucaccauauguguugaaucccaagaguuucugaugacauuaaaauuaaucuuguaauuagccucuguugcagaauuacagggguagggcucauuauucagaaaauaggcuagugguuuagagggaaagaauaaacauuuauuuugcuuuugcuaugcauacugugcagaagggagagaaacagcugacaucagacauuuaucuugacugugguaccccugccaaugagugagaggaggggaaugcaguuugcuggucaccaccaugauguuuggcagucuuacugaggugaugggcucaggcggggagcagaaagaacccugcauucgacagagacaagcauacacaguuccccccgacaagaagcuacacccccaccaagaguccaaagaccaucuugcagaugacuuagaggaggaugggcuuggcuccagggagccacgggacacauucagcuaaauccaaggcuaggggacacuucaugagaaaaguuuaugaggguuuacaguuccugagggaugagagcccaucauggcagggaggcuccacccaaggcagcaggcacagccccuggagcagagguguggggugcagaucuugaauuacaagcaagagacgcagagagagagagcagcccagaaguaggcaaggaucuuuacacucaaagcccaccauccuuccuccaucaaggccgcacuuccuaaacucauccaaacaaugcuguccguaggggagcaaguccucagacauuggagacuaugggaggcauuuagcaugcaagccaacaugaucauccuugucuaugcagugaguuugagggcagccuggguugagacucugucucaaaaacccagacaaccaagaugggacuucucugugucacacggggagguaggggguccuuccuggggaccuccagguagcuuguugcugugagagggaaaagcauuuuugucagcgauguagguuaggugcccaugguccugugagcaacccuaaggaaacucacugggucuaaaaacagauaugaaaguagaacgaggaccguuauaagaagaaggaggauaauggggugagcaugaucaaaacaugcuauuuacauguaugaaaauguaaaauugacauaugugugaaaugagaacuuuauacauuacagacuaaacugugaagguccucaaaacugaaaaagggaggaagaagaggcagaaaggggagaguguccccaggaagugagaggaagagaggggacagugucuccaggaagugagaggaagaaaggggacagugucuccaggaagugagaggaagagaggggagagugucuccaggaaguaagaggaagaaaggggacagugucuccaggaagugagaggaagagaggggacagugucuccaggaagugagaggaagagaggggagagugucuccaggaagugagaggaagagaggggacagugucucuaggaagugagaggaagagaggggacagugucuccaggaagugagaggaagaaaggggacagugucuccaggaagugagaggaaggaaggggagagugucuccaagaagugagaggaagagaggggacagugucuccaggaagugagaggaagagaggggacagugucuccaggaagugagaggaagaaaggggacagugucuccaggaagugagaggaaggaaggggagagugucuccaagaagugagaggaagagaggggacagugucuccaggaagugagaggaagggaggggacagugucuccaggaagugagaggaagagaggggacagugucucuaggaagugagaggaagagaggggacagugucucuaggaaguaagaggaagagaggggacagugucuccaggaagugagaggaaggaaggggacagugucuccaggaagugagaagcagaaaggggagaguguccccaugaagugagaggaagagaggggagaguguccccaugaagugagaggaagagaggggacagugucuccaggaagugagaggaagagaggggagagugucuccaggaagugagaggaagaaaggggagagugucuccaggaagugagaggcagaaaggggagaguguccccaggaagugagaggagagagaguggcacucugagguuacacuggcacacgggacaauguggcucccaugucaagugcuguagggucagauguucucaugcugagagcuggugccuuugacaugcguguggguuagaucacuggucaccuggaccagaaauguuuuagguaguccagagaagaaccccgagaaguggggucucuggaagacagaggagagaggcugucuguggucucuuuagcauuugaaacauugguacagccuugaugcccucauggccauucugggaguagcaagggaaaugagguuaaggcccacuggguguggugcucaaggacccgcacaaggcacuugguaagguccaugcuggcccaggacaaguucacacaaaaucacauucuugggcaacucucacacuuucucagcaaauuccucaccuccucucacuggcggucagaaaggcaauucuggugccaucaggagugugggcccgugguucccaacaccauccucacagcuaaggcugucagugacagagaacagaaugaugggcugaggccaggcacacaggcacaugcuggauugacggcuugauguucagagagggcaggcagaaaagaagugugugagaguuggugggaacaccacaaaguaggcacagcagcuaucaggcaagaaacucaggagagaacaaagccuauaggucaccucuggguguguguguguccuuggccuuuguuuugguccuaaguguagugaugcaaagagaagguggagagcaauuguggcagaauggagagcauaaaaucaaagugugcuugagacgguucgggaggagagagagugucuggauaaagaacccuucugaggagagcuguggagcugacagggagagggaagaacacaucaaggagguauuuacuggugugugugugugugugugugugugugugugugugugugugagcgagcgugcauguguauguagguaccuguacauaugaaugaauguggaagccagagauguugguugucuuuucagauacugucaccugugggaccgugaaaacgaguguaguccccaguugcgcuaaggcuagaagcccuggagaccuugaaggacggugggagcuuugccuacuacacagcuaacagagcugcauggcagauggccacugccucgagcucucugcuucuuuugacugccaacccuagaccaaggucucugugggccaaaaagcuagauccccucuugcacuggcuagcgggcuaccgaaacacagauggagcacagcuacugucucuuuccaucagcaccguggggcaaaccccugacccugggauuaagaguccuaugcuuuuuggguccgcucugccacagggcacggcugcucagauagguguugggcuguagggaagcccuggggcacugcuccggguuugggaaagcacagucugagguaugggacagccagagcuggcuugugaguccccaggccuguaaagagggugguggccaucugguccucaggcucuuggccauccaggugccacuggaugcugaggaagcugagaacaaagugggggcccgagggcuggaucuagcccggggccuuggggagcuccagcuggugccaugggaaagaggccuuggcuggacaguagagggcuugaacuuggcuugguggcagcugugguugggacacagagaggcuuucuacgggagauuagacagaagcuuuguaggcgaaggccaucuccguggcuccccaccgaugguuguguugaaaagaggcaguccaugguuuuaaggcguuuauuguuauggcagaaagugauuguguaaagucguaccccacuucuccgggugggccugagauuaaaugccuuuugcagggaaggaugucuuggaaggaaagcuuaucagcuaagcccuucagccuuuuagguaccucauuagaaugucgaucucuaucuugagccuacguguccuccauguguggaggggcuuacgugacugauggccacaaaucuggggugugggagcugugucuagugacaggggccuugugccugggagcaggcagagcuccuaccgucccuucagggucuccggggcuucuagccuuagcucaaccaggaaccaugcuaccuuucagggucccacagucaccuuacauuuggagacagcuuuuugauaaucauggaguccacuaguucagcuagacuggcuggccagagaacuggagggauccuccugcccgugccaccccuguccuggguuugugagcacgugccacugugugcaccuuuuuauggacucagguccucaaacuugaaccacuuugccaacugagucaucuucccagauauuuauuuauuguaggacggcaaaacuguagcacgugccacacauguuuaugagaaugauccaguagauagaagaauguucauaaauacgagacguccugaggguucaucucgauugucagccugaguagauuuggaagucaccuaggagauacagcaucagguaagucuaggaaagaguuucuaaagagaacuaaccaaggagggaaggccuaugcugcaugugggcagcauccuuccacggacugggguuccaaacugaaugaaaaggaagaagcgaacugaggaccagcauccgucuugcccagcuuccuacugcagaugcaacauggccaccucacacuccugucacugugccuucucagcacgguggauggugcccugcaagcacaagcccagauaaacucuccuauccuuaagccaguucugucagguggucucacagccaugagaaaagccgaaagggacuagcuaaggaaaccaugcccuccagugauccaggucaaggugcagggcauauauggagaaccacagcucuuuuucccagcaagcagaguuaugagaagaaacguccuuggcccacuaggaccccgugauccuggguaggagggggauuauggaaggugcagauauuucucaggucccaaaauuuauuaauucaauaauaaucuugucaaacugggacuagugacacagcccuguagccccuagucuaccuaugcuacugagugaauaaagcuagccucaacacaacuccugucuuaaacuaucuuuaaacaaagggggugggguggugguggagaguacagcucaauggcagugugcucccccugcauggcgaggacuuccuguuugcucuccagcacugcaagacaauaaaacacucuccacaguagugaagcagccuuuucugcaucaagucacaggggcugcugaccaauacgggcuucccuuuagucagguucaccucacugcugagcgguucugcuuuguccugcaaagggcgccugcauggcuccuggcugaccagacucgaacugaguagagucuggugggaauuugaugaccgccuguuccaaaguuggcagguaagugacugacuuagguuguacugucccuugcuaagacggggcuaauaguuucuuauuuccugacccauuuagaguauuaaaguaauaguggaugguucuaguguggaggugcgugccugucauuccagcuuuugggaaguggaggcaggagaacugggaauucaaaguaggccuuagcaguuacguacuaaguuccaggacagccuggguauuggcugguuuugugugccaacuugacacaagccagagucaucagaggaaggagccuucguuggguaaaugccucuaugagauccagcuguaaggcauuuucucauuagugaucaaugaggggagggcccagcgcauugccggggaugccaucuuguggcuugugguccuggguucuauaagaagguaggcuucagaagccuggggaagcaagucagcaagcagcaccccuccaaggcuucugcaucggccccugccuccagguuccagcccugcuugaguuccuguccugacuuccuccaaugauggacugugaucuggaaguguaggacaaguaaacccguuccuucccaacuugcuuuuggucaugguguuuuguugcagcaauagaaacccugacuaaguccacccggcuucauaagacauugcuucaaaaacagcaagggcaaaaaaaauuaaucaggauuggugacacucgagaggcagaggcaggagaaucucugugaaugaguucagccuggucuauacagugaguugugggccagccagggacacacagagggacccugucucaaaauuaaauaaauaaagugggugucugggucucccuucuccugggggaagcagagucaacaggcagguuuggaagagccugugaguacaacagaaauagcagacuuaucuccgggaucagcuucagggagacagaucaacuuuucuuggguuguauaguuuuggggaagguuguaggaauaucgagggugggcaaaggucauuggcugaaggauaaggaacugagacgccucauuagcauggagaggcuuuugggggauuucaggugcuugcugaauggguucugugguggaagaaaggcagcugaaacugugagcuaaucaaggcuacgaaugugacaaaccuuugguagagggugggggcucugaacuccucagacaaggucagagaaggagaaucucugcugguaaagggagucucccauuuugugcugagcucagaaggcuaucuggacaacgguagacuuugaccuuaauuagcaggacaacagguauuaaguacccagugcaacaagggucucaagucuauacucuagagccucaguauuguucccugugcuggugaacaaggucaaacuauuauaaaaaacccaaugauuuaccuguggaugggugagggccuauguaugugcaaaucugugguugggggauauuugaugaacgcagguugucagguuugccuuucacccucugaguuauuccuccagccccaacaaggccacauuguucaccggugagagcaagcucuucucugcuggccccgaacuccugccuugcucuguguccccgcaggucucugauccucucacggcagacacagacucccuuucucaacggcugccuuuucuuugugcuucuucaaugaagcuguuccuccugggcaaaugcagaacugagggaaguucgcucauccacaccuggugccucacuuucaccaucucugcuccaccacuggcucccucuuccucuuuucucuuucuuccucccuccucucuuucuucacauccaugugugugcacagguauguggguguguguggcuguguguaugucugcccugggaacuucuugcucuccaucuugaauauugcagcagggcacuagccucacuauucagugccuagaaggcacugguuaggcuaauguggugggccagcuagcuuuggggucuagcugauuuauauaggcagccauggcuguuuggcuuuuauauggaugcugggaaucucaaugcaaguccucauguuagcccaauuuaacaaguucugccaucucccuagcuacuggguuugguuuuuuguuugaugguuuuguuuuauuuuucagacagggucuuguguagcuuaagcugcccucaagcucgcuguguagccaaagcuagccuugcauucuugauucuccugccuccaccuccccagugcugaauuggccuuccuagcuccccugcucuuaagagcacguggccucgaguagaucucagagugaccaccagguggcgcccgccccucggaggugcugaaagagcucugcggagcuacacguguugugcagugucacaggcgcuagaaaccagcccuugggaaccacgggccagacaugacuggcugacugaugcgcaguuuauguuccgguugcaccuccuuugacuguauucugcagguguguuaggauuguuccuugggggcagggaaguagggaagcagggaugggggccgggggcccgggugaugguggugaugauggugguacaccugccagucuuuuacgagguagcuguuucagcugacaguuaccggaguggggucggauagagggggagaagccacaugcccuuucuuauaagccccucaaccucuccaucagcugccucugucuucucuuggcuugcccuggacgccuccuggaauucaguuggcugguugugccgggaggacagaggccagugugaaacuaacauucaggguccuugauuagaacguuuaaaaaguucgagcuggagagauggcucagggguaagagcauuacuucucuugcacuagaccaaaguucucuucccucaguggauagcuuuauaaccacuguaacuccagcuacaggggaccugacacuuucuucuggauucucucagcaacuacacgugugcagccaccccuacucaacacacaaauagaccuuuuuuaaaaauguauuuuugcauaugagugauuugccuguauguauguauguauguaugugcaccagccacauauauauaguguauacguggcagaucccugcaaaugugagccaccaugugguugccaggaguugaaccugaguccucuggaagaauagcaauugcucuuaacugcugagucaucucuucagcccuaaaacaaaucuuuaaaaaaauguuucggagccaggcagugguggcacacaccuuuaaucccagugcuugggaggcagaagcaggcggauuucugaguuucgaggacagccuggucuacagagugaggacagccagagcuauacagagaagcccugucucgaaaaacaaacaaacaaauaaauaaauguuucagaaucuguagccugauguggugacacaugcuugcauaaaacucuggggaagcuuagcuuacuggggacccccugagugaaccauguggagcugggguugaugcaaaaagcaagaggaacuuauuguuccagugcacuggggucgucccagaccugaaggagaggcagcgaccaccagcagcaguucggccaguuuuuauaugguuuccagggccaaaauagagcaucagcaacuaggcacaauaugauugguggaacagugcacccuuuaaacugauuggucuuuagggaaugaggugacaaggacuucccugucugaaggugagcaggguuagccauguggaaugugccccccacccccguggucugagaaauguuaauuagccuuuuccuuccagaggggcaaguguuucaugacguucccaaaguuucugagcugaccuuuucaccuguaaucccaguacugcggagguagagacaggugaaucuuugccacuuagaggcuacucauucuagccaacuugguguuccccaaaccagugagaaacugucucaaaacaaacaaacaaacaaacaaacaaacaaccacagugaggccuuugagauggcacaggagguaacagggcuugccaccaagccugacagcacgaguucuauuucuagagcccacacaauggaaggaaagaacugacucugacugcugaguauaggugcucacaacaaauaaauguaaagacagaucacagcaaucccaagguggcaaguaacuaagggacuugugagguugacaucugccauccacagcugugcgauugcacacaugccuauguaaaccaacuccuccccccccaacacaccccagaacccaaaaccccacuuuaauccacacacaccuacccaccucccccuagccacucacacuuuugagacuuuccugcuggagaaagccuguuaauagcucaggucacacacccagaaaggccacacacccaggucacagucucugauccuaaaggugcauuugaauuuucgcacaguuuccagggucaucugcuguccccuuggcccucuccaugagcccaucaccaucacuguucccagcucuuuuggcuucuuccugcuucccaagcuuugcuugccaucuuucgggaagaucagagugccugcccuguuaccuggaacguggcaugguagacagagucuguugugggugagccccucuguggcugcugucccuuucccauggguucuggacuucaaauauagaugcuuacaucuauuuaaugcuuacaaggaaagcacuuuaccagcugagcaucuccccagacucucuuuaucuugauuuccccuuuuuugccuuuccagcgccugcucaaacaacagccuagauuaaauccuuuuuauugaaguaacgcaggccauucuugcuuuccuaaccccgauagacuuauggcuaaugcagcccccgaaggcaucaccugagaaccacggugcugcuucucuggggugcuucagggugcccagucucagaauccuugcugguaugcucagccuguuagucucccagguaaaggaaacaguguauaugagcauggaaggaauguuuaauuugagaaagccaguagagaccguuuuucuucuuaccccaaucaaagcugucagagcuaguuagcaucagaaccagucaagugucucccaaaaagcugcuguguguaugugcacagcagcccauccagucaccaaggaaaccacgcaucagugaaaagagcccccaggaaccagcuacaaacucaguugccugacaagucugucauuugcaacugggcccaaguguagaaggaacaauucuccacaacuuccccggcccaacccccugccgucugcagcuucccccauugaaaaucugcucaccccagagagacguguucuggcaggugugaccaacagcaggaagagugcuugcuuauuucccaacaaauaagacaggcugucugcugugcugguccugggacucaaauccuuuggggguggggggauaccaauccaccuucccagguccuagugucuucuggcucccagacaguggucaccgagucugcccaacaucucugggcagugauaaugaggaagcuuguuccauaacuacucuuuacccuucuucccucccuccuucccucccugucucucaugccccuuuccguucuguuucucuucaaaguauugucuuuauuucuauuuuaugagugugugugugugugugagugugugugucugaggaugccagaagaggguccucaggagcuagaauuacaggggguuguagccuguuggacaugggugcugggaagugagcuggggugcuuugccagaacagcaugggcuccuaagugcugagccaucccuccagucaauucugcuuuguuucuuugggauagggucucauguaacccaggcuggccucgaaccugcuauauaaccaagagaggucuuauauucaugauuuuccugccucuaucucccaagugcugagauuacagguaaauaaucucauaucuggcuugaacugguauuuguuacuaucauugcauuaaauauaaauugcaaaauuuuauuaaauuaaauaucauuacaaaaauuuuaaauacuccccccccccagcucauuaaugagucuaaugugacaagaggauucauucauuuguacagucuacaaauauccauugagugcuucuuguuugccaggaaguaguaggcuaaguguugagguuacuagagauaguaauucacugguuguagaugaagucaaggagucauuagagggcaugugggggagagggcaguucuugcgaugaggacucauuggcuguguucuaguuauuuauugcuccuuagcaauccaccccgacacauaaugacuucagguaaucaugguuauuauucucuccaagaauuuucagcuuaggugggaagaggggaggguacagagugacagagucaacugaugggggaacucaaaacauccaagggcuuucuccuugguauguugaguccauuggugguggccuauuaauagggaucuuaggcugaagagucaauugagacaccugcaagcagcuucuuguuuuugucacagcaugguggcugaguuguaggcgugggucuuccaauaaaagagccagauggaagccauagcagcuuuuagucuuagaagucacacaguauuuuauucacgaacucacucaagacacugcaucauugaggggaaaggaacuagaagcuaccuuuugguagaauaaauucaagggaugugaggacauauuuuaaagccuuuugucuaugaucuaaaggagaaggggugugugugugugugugugugugugugugugugugugauaccauuucagggagagaugcuaaauaaagucucugaagguaggcaaugagugauguguuuaaggaagaaaagggcacuaagggugcaauacagcuguugccggaaauauuaaaaaagaccagugaguuccugcacuccugcuggcaacucugcuucggugcguucccaccaucucugccucuagaguagccucaccagcgaccaaucgccaucuacccaacucugguucccuugucucauagcugcccauaccgucucagccauaaucccccugugguugguggucccaccuuccaggaacccaguaaaacaaaacucuagaagcuuauaauuaacaagucagauuuauauaucaauaaauucccaauucucaagaugccuacacaauaauuucggagccaauugauaaugauacaagcugcccaccuagaucagacaaguaauugcaauuauucuaucccgacaugauggucauaacuaccuguggcuauuuaaaaccacaugggaucaggaucuucuuccuguccaucugccuccaucuuggcuucccuucucuuccaagaugcugucaccccaacucuuagcuccgcuucccuuuacucuguccuaacacaggccuccugcugcacuaauaauuuaauguaauuggacagggaaaauccugucauauacagcaagcuaagaggaacaucugagaucauguuagagguagcuggaagcuguuaucagguaguuacaggagccuggauuuuauuuugugcucucucucucucucucucucucucucucucucucucucucucucuguguguguguguguguauguguguguguuggggggaggagaugggauauugcaagauuuaagguuuauauauuuguaucuuucuguuuguauauucauuguauauggcauuuguuuuugcccguguauggaaacuuguuagcgauuguggagcgcuauaugguuagaauguggaggcccaagguugaugucuggaaucauccucccucguggcucuuccaccuuacucacugaggcagagucuuucaacgaaaccagagcucaccaauauggcuugucucauuagucagcuuacucuggggucuccugucucuggaauuacagaugggcugccauaacacaccaggcauuuacauagguucugggguuccaaacuuaggccuccauuccugggcgacaaacauuuaaucccugagccuucucucugcccuccauucguauccugguaggacuguuccagcugcugcccuuagacuugagaugagaccaaaaccccgguaaggacaugaauggagugguucaaaaagaagccggugauggcuuggacaaggauguuggccucagagauaaagaggauggacuggugugaugguuuaaugaaaauggcccccaggggcucauaaggaguggcacaauuagaaggugugaccuugcuggaaaaaguaugucccugggugcagugguuugaauaugcuuggcccuggggaguggcacuaauaggagguguagccuuguuggaggaagugugacacugugggagugggcuuugagacccuccuccuagcuuccuggaagacaaucaaucuuucccuaucagcuuucagaugaagauguagaacucucagcuacuccugcgcccugccuggacacugccuuguugcaggcuugaugacgacagacugaaccucagaaccuauaagccagcccuaaugaaauguuucuggggccagagauauaaaucugggaguuaucaguauagagacagucugcaaagccaagggugaugucaccugaggagaaauggcagugagcaaauccugugaagacagaguucugggaagagagggaagcuuccaaagaggcugaggaagaccgggcgagaaggagggagaccagagcugggaauauuaugggaugaagagagauuuggaaaagaagaguuaagaaagaauuaucuaaaugaugcuuuaggccccucuagaucugaauuucugcaauuccagacauuucucaaguucuucaaauugagauguucuaugacuaaucagccuuugggaaaugaagaaucacugggucucuccaaagacucaaauuugaucuuuagucccuaggggaagaguggcuuuccuguaguuacuggggcaacccuugggaacauuucaggaauccuggcauaucagacauccuagguacacagggacaacuggcagauuguacacuacugguaaaguugggcuuggaacacgggcacguucacuuacuggggcuucuguaagaacauaccacaaacuugguggcuuaaaccauaggacugaguugacucagaguucuaggguuuagacaucugagguggagguguugggagggcuggcugugucugaggacugagggaauggguuccuuuugcacguggucaucaucuugcucuuguagccuuguucaucuucccacgucugucuccacaguugccccuuuuauugagacguugauuauuugcugaacaucuuaauggcuucauuuuaaccuaagcuccccucaaacagcccauuuccaaggaagaucacaugcuaaggaacaaaguuaaguuuguaguaguuacuuuucuguugcugugacuaaacaccaggacuaaagcaacuuauggagaaaagagguuuuaugcuuaugguucuagugaguuagauuccaugaugguggaguggaggcagggccagcgggguagggggcaggagguggagguggaagcaggagcagagaggggcaggcagcaggcauggcggguggagcagcagcugacaaagcagagagagaaaacuagaagaaguggagucuuuaaacucuaaaagcccacagggaguggacacacuuccaccagcaaggccacaccuccuaacugcucaaauagcaacacuggcuaggggucaaguauucaaauguccuagacuauggggacauucaagccaccacauuccacuucuugguccccuagucucuugaucacaacauaaugcaaaugcauuuaauccaacuucacaacuuuuuugaaaagcccaagguccagaucuuuucugagccuuaacuguaacccucuguaagauucaaaauaaaacaaaaaagcaaauuauacacuucugauauaaacuucauucugaauauuuuugggugggggggggggauacaauucaguccacaacugcuugcuuacuguuggcugagaagcuaggcgagaggugagagugcccuccgcagugccgaacguucuggauaguuuuaaauagauaaacauucugaauagauaaacaaccccuuuugaguagaaugagucugcacuucuucccuagaugggaagaccuagguggucuaaguggauuuauuccgagguuccucaaaccgggaagacaauaaaauaaaaacaaaaaacaaaacaaaacaaaaaaccccaaaacucugagauugacgucaccgaaggaacaauaccuugcggacuugacuuccguuagcagccagagcggcuggugcgcagcuccagaggccacgguugcccugguuacucuuuuccgggaucagcugggacacaguggaguugguggguucucaaauuagaagugcaggagccucucuacaggaugcgcacacugcaggagucucugggaucaaauuuguaucccaacggggagcucuacuugcagguuuggcugggaauuaaguuuaugggaaagaauagaaaguucggaagaacaaauuaaguaaguucgugggagacaguucugugcaucgccuggacuuucaaaauggcccacuacaguggguaacgaaccagggagggaaucucauugaauccuaccccagaaagaauuuucuuugcuucucugcaucucagagcaccuuguagcauacuaaugaaucucuugccaucaccacagcgugugugcccucucuucucaauuuauauguuggaaugccaacccucaauugacuauccucggugguaaauuuuauacuucuaggaauuaaggucagaugagggauuuuaugaguagaaccuuguuccuaaaggauuaggacuuauagggcuagcucaaaucuuucccauuucuucugagaaagcacaacaagaaagggggguccucaccugaaccagaucagcuagcgucuugacucugaacucacuggccuuucaaacuauuguugacauuucccaaccucugauauuuugucauaguagcaaaauacacucaugcaguugauuuacauuuucuuuuccccaauuaaaaggcaaagcucuucaucuuaguguccccaaguaccagugugccugacguggugaaucucaccuugcaggugugagugauuaauaagucauugacaggauggagacuuuuaacucacugugaaucggagaguccagacagcuaugaacacacacuuaaucagccugggacacaaauggcguuuccaggacuagagauaauugaaaguggauugggaccaaauacuaccuucagccacagacuacacacaaaagucgucagucagucuggccagaaagggaagcugcuucccugauuuauggcuuuuccuucucucuaauuaggaucagagcuuugccaguccacaucauccuaucucuagaaucuaacacucucagagucaucagagacauagaaagcuuagaggaaccccauugccuaaggccgggugggguaucaggcaacaagcauuugacuuaucucagggaccgcacgggguuacacugccucugcccgggucuaggucucuggaguuuaagaaccgagucuuucagcacagcagacacagauccaucugcagcuuuuucucuaauuaauuacgcuaugggagcugaugcaugaaaccaccaugccaaucuauggaauccugagggcacugggaccaugugugacuggagugcucucauccuucucucugagcucucacauccuuccacugcagauggaccucucugaggaaggcaaguaaguaggagaggguuccuuggagaauguggagucuaaacgcaggaggccaggaugugaaaguucuuggaagcauugaagggcauugagcugggcuagccugaggaaaaccauucuuacugcuagcauguuccucauaguaaccucagggugggggugggggguggggguggggcaugcuuuccuucccacagccagaagcacugaaguuucuacucaaggcugcuguauuaguauuuauggugcgggaaucuggagugcagagagagaaaaugggaacuagagaccagcucaguggcauccuagggaccaauuuuccuaggacuucuaaucccagucaccauuuuuccuucuuuaaaaaaaaucuacccccacaccccguuaucauguagcccaggcuagccucauugcucacuauguagccaaggauaaccuugauuuucucauccuucuaucucaaccuucuuagugcugggauuacaggcaugugccaccauagcuggcuuacgcagagcucuuugaggcuguguaagcacacuuuacccaucaacccacacaccaagccaucuagccugacguuuuuaugugugaccuucaaggcuuugguacgccugcccuugaguuucuaauccuauucaagcuugagcuguucuuuuuuuuuuuuuuuuuuuuuuugguagccucacagcugaaucuuuaauuuuagcaauguguccucugcauaugugaguacucagaauaguuguuucugcauggcuaccagugaaacuuugccuggaguaacaggcauaucaguaauuaaaacaaccucauuucaucaguuuaagaucugaagaaacuaaauuauucugugucacaggaccuauaaaagccaacacaagaggcaguuuucugccgccugggaguggggacucuguccuuguaggguggucaucuguaccugagagcagaggcuacugugauggcucuccccacuucacuuucuacagcccucauuugcacaccagcauguagccucuggucacauguggcaguuuugagaguuuaugucuguagccccaacuucacucccaaauuccagaacuuuguauuaauguucauacccuauggucuugggacccucggaugcacuauacauacaguccccaacacuuucccucuaucagggugauggcucagggggucaagugcuugcuguacaagcauuaggacuucaguuugcaugcacagaaacucacacauaaaagcuacacaucacagugaaaacccagagccccagagcugggaggugcagacagggacaucccauaggcuugucggucagcuagccuagcuaaaccaaggagcuucuucagguuugcugaaacccugucucagaaaguaacauggagagugaucaagggagacacugcauugaccauuacauacauauauauauacaagggggugugaaugcauaugcauauacaaacauauauaccauauacgcuaguuguuuuguuuuguuuuguuuuguuucuuuaucuguacauuuuuucuuauucugucacuuuggagucccagggugcucuuuccaucacuuccuaaggccuacuggugacccuaacaguuuuguguuuccuucccuaauucguucucuggcuaggcugaguucuucacuaccucgaaccuacaagaccgugguguucucuccuaacucagcuccgugcuccccuuugcuccuuccuuaucuuccauagagaucuuucuccgacucaguuguuccccggucuuugucaugccuacaguuauccagauguucucccuaccucucacagugaaguaccuacucuuagcaaaguucucaaggacagccugacuucucagaggguuaaacuucucacuccagaaguggagcuggaagcauguucuuuuuacuaccugauuccuaagauauggcugaauacagguaugugaacaugcuuccuucagaagguagagagagucuagccacaacggaaucugggguuccaucuccaucacugaaaaggaagcuuggggaauuagcaugaacacuaacaguagaaguguagucagagagguguugcuguguucacugaagacuuagaaacagcccaucaucaggagcugguggggacugaugaagguugggcucuguuucagaacaucuaucguucucucuuugaaaauauuuauuuauuuauuuguguguguguguguguguguguguguaugugugugugugugguccaggaaggcuagcaggggauaugagauuccuuggaguuggugguaucagagcuugguaacauccacugugggcccucugauggagcaguaagugcucuuuaccacugagcugucucuucugccagaacuacuucuuuaaggagcuagcuuaguauagccuuaacuccuuaaaaaauauuuuaaaauuuaauuuuaugucuuuggauguuuuaccugcauguauauacguguacuacacaugugccugauguccacagaggucagaagaggguuucagaucccuagcccuggaguuacagucgugggccaccaggugggugcugggaauugaaccuaagucuucuggaagagcaguccguguucuuuacugcagcugaaaagaaguuagaucacugcaggugugccuuugaaggaggauaucgggacccugcccccuccuauuucucucugcuucauggcugcccagauaugaacagacauccucugucauguaccauugacaugaugaacuaucugcugugucucaaagcaacaagacuaagaguccuuugacugaaaccuuugaaacugugacccacaauaaaauuuccuuuuuaaaguugauugccagugaucuuuuaucauaguaaagguagcuugcuguggugguuugaauguguuugccccagggcaaguggcacuauuagaagguguggccuuuauuggaggagauguggccuuuuagaggaagugugccacuguggaguugggacuuugaggucucauacauaugcucaagucuggucagugggaucagagucuccuccuggacaccuuugguucaccauguagaguucucaguuccuuguccagcaccauguuugccugcacacugccaugcuucccaccaugaugauaauggauuugaaccuuugaaacuguaagccaguuccaacuaaauguuugccuuuauaagaguugccuugaucaugguguuucuuuguagcaauaaaacgcuaucuaagauacuaauaguccaccauuuaaaaacagaugcuagucucaaguuuguaccuuacacacggcaguaaagcccuaguucagucuccugucacacccuucuaauuggauuuguguagcauccuuucuggucugacuauuuugaggguggacccucuagagucucuaagguggugguuuaauuaguuuuccuuugaagcauaggguggauagauggauuuuaucucuuauugaguaaggacugugagaucugaaauggagugguuuuuaggaccuugaccuuuggguucaucugacugagggggcucagcagcugaguugcugucaguuuguccuauuuuagauggcccuaugcacuaacuaauugugguuaagauuggcaaaaacucaugggagggcguuuuacccucucggguaucuuuguuuuugauaagagaaucgacucugauccaugagucugggcuauaaauauuaucauuggccauacauggugcuaucugaaggacuuccucccaaaauaaggaggcuuggguuuuuuuuuuuuuuuuuuuuuuuuugucuaucuuuaucccucuguguuuuaguagggcacauauuucccugagcuggggugguuuuuuuuuauaugauggugaguuucacaugguagaaaagaugaaaaacgcuuguccaaugggaauguucccuuggccuauugguccaaaugcuaagccuuucugcagauuuaagaacuggcagccacccuguggcucuuaauuggcugcugcauuaccagguuuucuuuguuuuaaggagaaguuaagagucuuugccaacgccauuggauuuagacagaggccagaggaaccuucggccaacaccagagaguagcucuggccagaaggcuucaguugucccuuuagcuugucuaaauccaugugaucaccuucccggaguauuaguucuguguggucguuuuguucacucuugccccacuuuggucuccagaugugggccuaaguaccagaaguuuuccacggagaccccucuccaagcaaggugggaaggccacagcaagggaagugaguggaggcagggagacagacgaagccucugccaugccuucuggguugcucaguaacucugagccugggucugugaaaagccuacaauccagugaggaaugcagcagaacucaggcacagcucuucgggagagaucucuucccaaguguuacagcucuuggaacaaaagggucagacaaaggaauaguucucacauuccuuuaauucccugcauggcucuccuauacacaguucuggcagugauuuagaguuugacagcaagccccucucauuggcuugggcugagaguuugggggaaaccuuauuugcaugugagagggcuucgugcuguucuuaaguggcugauagccacgccucucugguggggguuguggaggaggguccaggagccaugagagaacuuccaucccauguaagugaauugucacuaccgggucccgggguucaagaucuagccucgacuggaaaccaggcugucuguacauagcccauugccccacauucaagaauaagguuuaggcccaggcccacaucacuccuuucuuuaggcccaggcugcuucaagagucaggcugcuucaugagucaggcauaggcuugcaugucuugcauugggcccaggccucuuuaaauuucagggauagucucaggcccacaucacuucuugcuuuggacacgccucuucaagccucauggauaggcccaggcccucaucacuucuugcauaagggcccaggcccucaucuuuuuugcuuuugguccgguccucuucaauguucaggaauaagccugggcacacaucacuucuuucuuuaggcccaggccucuucaaaguucagggagaggcccaggcccacauaacuucuugcuuuugucccaaggcucuucaaggcucaggcccacaucacuuuuugcuuagugcccaggccucuucaacggucagggauaggaccaggcccacaucacuucuuucuuuaugccagggccucuucaaagcucgguauauacccaggcucuuucacuucuaccuuuugucccgggccucuucaaacgucagggauagucccaggcccacaucacucuuugcuuuuggcccggaccacuucaagggucacaggcccaggcccacaacaaauuugcuuuuggcaaggguguuuucaaggaucaggaauaggcccaggccaauaucacuccuugcuuuuagucucaggucucuucaauguucaggaauaggccugggcacauauuucuuucuuuaggcccgggcugcuucaaggguuaggcguaggcccaggcccucuucaaauuucagggaugggcccaggccucuucauauuucagggauaggcccaggccuacaucacuucuugcuuuuggcccgggugucuucuaggaucagugaugagcaaggccuacaucacuuuuuacuuuuggcccgggccucuucaagggucaggcacaggaacaggcccucuucacuuguuguauuggacccaggccucuuucaauuucaaggauagguccagguacacaucacuuauuucuuuuggcccaggcccucauuuuuuuuuuaguuucuguccgggauucuucaauguucaggaguaguccugggcacauaucacuucuuucuuuaggaccgggccuuuucaagggucaggcauagacccuggcacaugucacuuuuuuucuuuagacccuggcuucuucaaacuucagggauaggcccaggaacccauuacuucuugcuuuaggucugggccucuucaagggucagggauaguccaaugcccacauuacuuauuccuuuugucccaaggcucuucaagggucaggcauaggcccaggcccucuucacuucuuguguugggcacaggccucguuaaauaucacggauaggcccaggcccacaucacuucuuucuuuaggcccaguccucuucaaacuccaggaauaggcccaggcccccaucacuucuugcuuuuguccagggccucuucaaggguuaggguuaggcccaggcccacauuacuucuugcuuuugguccuggcccuuaucuuuuuugccuuugguccgggccucuucaauguucaggaauaggcccgggcacacaucacuucuuucuuuaggcccaggccucuucaaaguucagggagaggcccauucccacauaacuucuuucuuuuggcccaggcuuucaucuuugcuuuuggucaggcccucuucaguguucacgaauaggccugggcacauaucacuacuuucuuuaggccugggccucuucaugggucagugauaggccaaugcccacauuacuuauuccuuuugucccaaggcucuucuaggaucaggcauaggcccagguccucuucacuuuuguuaggcccaggccucuuuaaaugucagggauaggcccaggcccacaucacuucauucuauuggccugugccucuuccagggccagugauuaucaaggccuacaucacuuuuugcuuuuaauccaggccucuuguaaugucagggauaggcccaggcacacuucacuucuucauuuuggccagggccacgucaagggucagggauaggccuaggcccacaucacuucuuuuggccagggccucuucaacguucaggguuaggcccaggcccacaucacuccuugcauuuggccugggccauuucaugggucaagguuaggcccaggcccacaucacuucuugcuuuuggcccaggccuucaucuuuuuuacuuuugguccaggccucuugaauguucaggaauaggccuggggacauaucacuacuuucuuuaggccugggccucuucaagggucaggcauaagcccaggcccucuucacaucuugcauuggucccaggccucuuuaaauuucagggauagacccaggcccacaucacuucuugcuuuuggccuggggucucuucaagggucagggaugggcccaugcccacuucauauuuugccuuuggcccaggccucuucaagggucagggauaggcccaggccaaaaaacaaaaagugaugugccuuuccuucucuucccacuuucccccuuucccccuccccccuuucccagacacuugaagaggcccaggccuaaagcaagaagugaaaggggccugggccuaucccugaaguuuccuuuuuccuuuccuucccuuccccucccccuucccccucccccuuccccccucccccuucccccuucccccuucccccuuuccccuuuucccuuuccccaggccucucaaagguaaguagaugaccaugcccacaucacuucuugcuuuuggcccaggccucuucaaucaagggucagggauaggcccagacccucaucacuucuuucuuuaggcccggaccucuucaagggucugacauaggcccaggcccucuucucguuuugcauuaggcccaggccacuuuaaauuuuaggaauaggcacaggcccacaucacuccuugcuuuuggcccgggaucuucaauguucaggaauaggccugggcacauaucgcuucuuucuuuaggccuagaccucuuuaaguguuggggauaggccaaugcccccaucauuucuuccuuuugucccuuuugucuucaagggucaggcauaggcccaggcccucuucacuucuuguguugagcccaggccucuuuaacugucagggauaggcccaggccuacaucacuucuugcuuuaggcccgggccucuucaaacuuuagggauaggcccagccccccauuacuucuugauuuugacccuggaacucaauuuuuuugcuucuaguccgggccucuucaaugugcaggaguaggcccgggcucauaucacuucuuucuuugggcccgggccucuucaaacuucagggacaggaccaggcacuuuaacuucuuucuuguggcccgggccucuucauaugucagggauaggccuaggcccacaucucuucuucuuuuuggccugggccucuucaagggucaggguuaggcccaggcccucaucuuuuauuuacuuuggccugggccucuuuaauguucagggauaggcccgggaacauaaaacuuuuuucuuuaggccugggccucuucaaacuucagggauaggaucaggcacuuuuaacuucucucuuguggcccgggccucuucauaugucagggauaggccucuucauggaucgggaggauaggccaauacccauaucacuucuuccauuugucccaaggcucuucuagggucaggcauauuacagggauagccccaggcccacaucacuucuugccuuuggcucagucccucauuuuuuugcuuuuugucugggccucuucaaaggucaggcauaggcccagacccucuucauaacuuguauugugcccaggccucuuuaaauuucagggauaggcccaggcccacaucacauuuugcuuuuagccccagccucuucaagggucaggguuagguccaggcccacauuauuuuuuguuuuucagcccggcccucuucaauugucugggauaagcccaggcccucaucaauucuugcuuuuggccugagccucucaaaguuagguauaggcccagcccacauuacuucuuucuuuaugcuaggucucuucaaaggucagggauuugcccaggucaacaucacuucuugcuuuuguuccaggccucuucaagguucagggacaggcccaggcccacaucacuuuuuuugcuuuuggccugggcccucuucuggggcaggguuaggccuaggcccauaucucuauuugguuuggaccugacuuccuuccaggucagauuuucccauugcccacacucuuuuuuuuuuccuguuuguuuggccaggccucuuucuuuucaguccuacuuaucuagguccagaaaaccucacuaucaggguauaugauucuuuuuauguuugaaguacuggauucuuuugaguucaaauuuguccaaagcuucuuuguuuuuagccuugaucuuggucaauauuuuggggaaaaaggagacagauauugauugauauauuuaguauucuucucuggcaucucaaauacacucagaucaucauugaccuauccacuaggaaacaugcucagacuuuacacucauagcuuacguacaguccagguaaaacacauuauacacuauacaauuagaaagauuaauaaaaaaagaucccuguugcauagcuguccaugccugugguagagaguacccaugaacucauguggaaagauuguugcuucuaaguugugagagccacaggagagucucaccaaggccccaugaugcauaacccuccuuccggaggucucaugacuuaauaucacagaaaguuaggggaaacaauagagguuaguccuccaaaugucuugcuaaggcacugaaggcugugcagaucuucacaauuuccuauaugggauggguuuucuuucuauguguuguacauggccaugcucugugaggauauuccucuaguccuugcuauuaccacgucuguccuguccaucaaaagcccucagauacugaacugugccuuagucaccccuuucacaaaaagcccucugucaaguacauguccugaugugagaucaggucuuuacccaaagauuuuccuacauugacuuaccuagaaaggaucucugccaccuucuccuaucauggacucugcugcccucagaacuaggguacacccacaaccaugacagugaccccuucugugaggucacagaggccaagccucacucuuuuuaggaaagcucaaaggguguccaggcacacaggugccuuuuggacugguaucaaauugauugaaauuuuggccucuaaccugucucuucaccaccuuuaaacacaacuuguaguaagauuucccagcaagcagcauuucaggaaguuucccucccuggccucaucaugauagucgaugacuucugagaaugucacuaaagaaacaacugauaugauccuacacacacacacacacacacacacacacacacacacacacacacacauucauucacaaaaacauuaacagccauaaauauaaauauguuaaguagaugaagaagggaugugauaucaaugucuguggccaugcaggaaagggccuuugaguugaaaauaaagauuucuaggaagguucauguuuaaaagaaaacacagagaagguccugggaaagcacuuccuuaugaaccuguguagcauauguucccugaaauaaugacauagggggcaguguaaguaguugaucacuugcgugaguuuugagucuuaaaagcaggcacugacuugacaguuucuuccagaggccucccuuccuggcacguguauggugucuucuuccugagucuauguauagcaugccauucggcaggcacccuuguauuuacugcuguucuggcuuaacagaacuccuguuguguuaaauaaggaacaccucaagaacuucacagagccccugucacugccauucagguccuugcuccugcacuuuccugcaugccuuuauaccugaaggcacauguacucccauauauacacucccagaccaugcacacuaaacauacaauuuaaauauaauuauguauagugugcaggguuagguagagugcuagaauaauauguccuguuuguggggcaaugggcuauacacagacagucuggucuccagucaagcugaggucugaacucugagacccaguggugauaauucaccuacaugggacggaaggaguucucucaugucuccuggaacuauggcuccugucaaaguuaccuuccccucagcccccacaggagaagcaugguuaguagucauauaggcaaugucccaagcuucugaccuucaggcuagacuccuccccaguuaccuagcaacaguaaagauaacagcauaccauaaaaagggcuguuugaccucuccucacucucucacuccucuugcucuuaauccccuuacuauccucucucauuuccucucuuuucgucucucucccucuuacccucuagcucuuaaaccauagacuaucucugcucaucaaggcccacugcacagacucucaccugugugggaaccucucucccucagcccucacucccauaaccccggggcuacagggugucauuccagggcucccgguugggggcugccccuuguccgccccccauugaguggggucaguggcuuagaugccuacccggggcugaguggaaagcgucuggcagcccucccaugucugcuugcccagagcauagguggaacucuggcuggacgugggcuauccucccucccccucuuccccagccucccuuuuaguucccacaccuguugaguaccugcuuucggucaugcuggagacaaccccuggacauacaagacaagauuauuacugugaagaagcaaagucccuucagaagcccagacaguaggacucuguaccaucuccuaccugcccuggacacaaugggcugccauagcugauaguuguccauggcuuagggcacaacagcagagcuucauccugcacuagucuggcgccuggagucuuuccaugugguacaagcugggugugaccauucccuaggcuuauugguguuguuucccugaguacuuguuuggcaaguucuuuagcauguucaugugcauaugcacaaacacacacacacacaccugcuaauacuuacugcaacaguuucuacugcuuuagcacaggcccugcuaaaggucacuucaaggaccacauuaggcuucauacacuuccucacuccuaucucccaguauagcacacugagguuuaggcaggacuucaucauggagaucuguauauauucucccaacauacagcccaacaaaccugcaguuccuuccagaucccagcccaucccugagcucccucacaccaacaccacagccuuuaaccauggcaacaggcuauaugagguaacagagcugaccacaccucucuccagcuucuucccaugugccuagauguaacauggggaacgaccaugcuuucucucuuaacauaaaguaccccgacuuguguaacuacaaguggugagcuguagguguugucucccugaguacuuguuuggcaaggucuuuagcaugcgcauaugcacacacacacacacacacacacacacacacacacacacaccuugcugauacagcaacuguuuauacauauuuguagcaagauauguggcauaauuccauguccuccucaugcacuuucacacauauggagguggaccugcagacaugagcacauacauaagaacauauacaacacaccuacaaagugaaaauauguauuuauauacagaaugagaggggaaggugcugucauggcauuucccgugauacuggcauugauguuugacucaucguggcagcucucugaguacacaugcaaagauuguuacugccagggacugaaaucaccagggaagaucagacaccagugucagggaugcucugccuccuucccuggacaagcuauguaugaugguuaaauggucaaaugugggcauggcaaaagcacuguuccguccuuccuggccuaggcugggggcucaaguccagguccauauauauguguguguguguguguguguguguguguguguguguguguguguguguaucuucuuuccaaggccucuccuccuggugagugagggguucuucuuccuacagucuugaguggccauucccacuacugugagacuucuguuucuagcucuccuuagcucucuugaagaaagucuuagagcugucuucacucagaaacauuuuaaguuccucucccuauuucugccucccccgcuuaagaccccagugaagaagugccuugcacugagugagcuacucacgugaugaauuucagguaguccaucccagaaaacagcccaagccuaggcagacacacgugcucagugugaauccc

SEQ ID NO: 3104 - RNA, 3009 nt, Mus musculus
aagaagcuaaaugugccacccacucgaaauacuagcacuugagugaccagugcauggggauugccuuugguuugagggguaaccugggcuaccaucucaaaacccaggcaaacaagugaauaaacaaacaaaaagugguccuuggaagagaaacuacuggugugugucaccuuggguuuguaaggccucuugcuauggacugagcuucuuguuggcagagucugccgucuccuuuacccuggugucuucugugcccagcccuggcacacuuggucuacuauucagucaguucauggguaaauggaccaagccagugucagauacaccugggaccuguuguuuguugcaacacucccucccuccaggaugaaauaucuaauccagggacuggcgggcucaggcuggguauucccaaugcccaucucuuggcuccuggcaagugcugccaccuggucugucucauuccacgugguugagaguaagaacuggaugaacaggaaggccugugacucacaauggggcaacaggaucuuggaggaguggccugcaugcucccuacucuuccacauucaugagcagucagagcuggagucuuccccaagauggcagggcugccccagcaaagaaccuccucuuccccguuugaggaaagcguuuguucagcagaucuguuauuuuccaucagcugcguuuagaagacuggggaugcagcuaacgcuuucagcgucuucccuggcucaccccuuccuccucgauuagacacuuggucuucccucgaccacagcauggcauacauuugcuguucccugugugcacagccuugguccugcuggaggaguugugagcacuguaauuaaugaggacauggauaccauuugccagcuuuuccaggguggacauaccugugccugccccagguuggggugccuaguggaccaacugaccaccugaggaugugggccuugccagggacuaggcuuguggucuggggaaaugucuccaagccgugguuuccucgucaaagccugaugauaaaacauugccaaaggaauaaugcaaacacaaaugguguguguguguguguguguguguguguauguguguuuagguuuaaaguagggcacccucucucaacuguccucuugaccccuccauucuccugggugcuuugacugugcauagcagguaggcuagggacaaauccuucuguuucuccuacugucuuauacugucuuucuuucuauguagcccaggccggcccugaacuugagcucuuccugucugagcuuccugagugcuaggauuacaaauaugugccauauaaaacaguauugauuauauguaaaauuaauguacauagcauguauguauuuuacauuuucuuguguguguguguaugcaugcuguggugcauacuugggagucaggacaccuuacuuacuauauggguuccucgggucauacucuggccauucggcacgccagcaagcuccuuuauccacuaaagcuaucuuacaagcaugguguauuuuaaauuauuuuuguacuguacuggggaucgaaccuaggacucugagauuggaugccauuguaggccugugccaccagucucagucuuccuaacuuucuaaacugaaguaugauacacauaugaaacuaaauauggucuggauaacaccuccaucuguucaucaucaccagaaucaccccauugucuggcaccccuuccccucccccacccugaaagggcuaucacugucuuuggucuuaggcaagcuucucacuauauauacccaggcuuaccuaaguaaggaugaccuuaaacacugauucuccuccuccuccaacuccuaagugccaggauuccaggcaggcaccacugaaccugggaccgguaugacuuguaucaacaccacagaccuggcuuuuggauucaggcgaguggacucccaggguggguuguucccuccugagccugcuucuuucacugaucaucuugugauacacauuugugucuguguagguaggugguggcugguggcacguucucaugcugugugauacugccucauaucccuuuguuguugaucucaaauaagcaagaccgagccacucacaaaaggcagggccuauccuaacuguccuguaggaggccaggcuggaguugagguuggagauagcugauguaguuuuuucuucaggaggagccuaagugauaagaagucagguaggccuugaacuugaagugguccuucuaggaccgcuggaggaaaauguucuagauguuaauggaaauagccaaggacuggagaguggagugggguggggggcgucggcuguguuucuggcuccuuuccuggcuuugcucugauguccugagauggugcagucacuuauccuguuugaucuccucaagucucugccaggaaggagugcccucagaggauuuggugacuuagguuagcuuuggucaaaggauuucuugaccaaggagguaucagcaggaguugagugcagaacucugagcuucuugacaaucaaggcaaaauggacagagcccuucaggaaucagguuuucaucucacauaccaaaaaauauggugacccuggcagccaaaugcccugacaccagggaucgaguggccgaaggaagaccuguuaaccaugcggcuaauuuaaaaugcuccagcgaucuuuguguuucuuccuucccaagauuucuguuuuguuuugaggagacccgcuagguagccaaggcuggccuugaauuuguaauucuccuggcucagccuccuuggugcugguauucuagaugugaagggcccugccugcuccaggcuuccucuuccguuggcguggcucuggagggauguggacuaauuuaaagguuggaugauaccagcuucccuuuuugguugggguuucuuuucuuuagaguucguccuggcuccaccucuaacucuggaggaagagucaugucaggcuccugucgugggagaaaugaaacug

SEQ ID NO: 3105 - RNA, 2822 nt, Mus musculus
cagcccuccgggccaggaagcgcggaaggaaucgccugggccauggacggggcugugauggaggguccgcuuuuucugcagagucagcgcuucgggaccaagguaguuuguuuguggcgugggggauggcgaaaccccucuggacuagaagugggugaaagaauccagaaagagggaaggggccggaagaaggucggaacggcgcgcgggcaauuguagauccccaagacguucccuuaaaagucucgggcugugcccuccuuggugcggucuugggaugccauuaucuuugggaaaguagcucagccugggaagccccagacucagaucggccuucaugggucucuucuuccuuguggggcgcgugcuaccaccgcgcacucucgagucuuucguucuuucccagagguggaggaaaacuugggcugugcuuuacccagccaguccucacggcguggcgcggcuggaauucuuugaucacaaggggucgagcucuagagggggucgaggcggcucucgccgucuagacugcaagaugauacgccuggcugaaugugugagcguggugccggugacuguggagagucccccugagcccggcgcuguugccuuccgccuggacaccgcacagcgcucgcaccugcuggcggcggacgccguauccagcaccgccugggugcagacuuuaugcagaaccgccuuuccggugagugacugggggugggcaucucugggcuuaagggacacugcgaggauggagcuauuauagaggcacuggacuucuugcaccuacccuagacccaagagaauuauauauaauucuuccauguucccuuuucugcagaaaggcggcugggcuuuggcgcagacggagaaccaaccuaaguuuucugccuuggagaugcuggagaauucgcuguacagccccaccugggaagguagaugucuggcaggaauggaguggguugaagaggugcccuuggggagcuagugauuggagucaaccgagucccuaacuugccccagcgcuccuucuccuucguauguguucuuccaggaucccaguucuggguaaccucgcagaagaccgaggcuucugaacgcugcggcuugcaaggcuccuacauacugaggguggaagcugagaagcugacucuccugacuuugggugcgcagagucaaauccuggagccgcuccuuuucuggcccuacacucuguugcgucgcuauggccgggacaaggugcauggggcugucugggaggaugacccgucagggagggcuaccagguugaguagcuguaggugacaauuccauucucagguggucucuucugugcagauacaguaacuuggucaggccugugacucauuuuuuaugacacgccuaacguguuucccccacccccucagguaauguucuccuuugaagcuggucgccgcugccccucaggcccugggaccuucaccuuccagacuucucagggaaaugacaucuuucaggcaguugaggcugccauccagcagcagaaagcccaaggaaaggugggccaggcacaggauauccucagaacugacucccaugauggggagacagaggggaagacaguucccccuccuguuccccaggacccccugggcagcccuccagcccuauaugcggagccuuuagacuccuugcgaauuccuccaggcccuucucaggacucuguauauucagacccccugggcagcaccccugcuggggcaggggaaggggugcauuccaagaaaccucucuauugggauuuguaugggcaugugcagcagcaguuacugaaaaccaagcugacagacuccaaagaggaccccaucuaugaugaaccugaaggccuggcccccgccccuccccggggccuuuaugaucugccucaggagccucgggaugcaugguggugccaggcucggcugaaggaagagggcuaugagcucccuuacaacccugccaccgaugacuaugcugugccaccuccccggagcccaaagccugcuccugcccccaagccacagggcuugauccuucccgaaucggguaccacucguggcaguggcagcaaaggcuucagcucagauacagcucuguacagccagguccagaaaagugggaccucaggggcuugggacuguggacucucuaaaguagggaaugacagggcgggggucaagucugaggguuccaccugagacaguugcugauaggagguccaauggggugguggcacugaaaaagaaaccguagggugggaggggccagggaccagaggagucaagggaugaccagucccaggaguagaacaaacagggcugagggauaggcccuggggagccccagcagcguuaaggauggcuagcugauggacuaggccuauggaagcggcccacuggucugagugggugcccuuuggggagaccaguguggaucuucauucuuguuuuguucuuugccagauacauauuuaacuuauaagacaaaucucauuaaagccagcuuggguugaaaaggccucugcguaugaaugagcacuauggcuucgugugcugggaggguguggcgggaucaagggaggaaccagaaauacguuggcgaccauggaagaaugaagguccccaagggaaagacgccuacagcguggugauucagagccuggguggccacagccucaccugggcuggucucugucucggugacucugggucacuugucuguuaucuacaugucuuuauucuccucugcugcccuuucaccgagagugagaauuuggcucuguuucaagaccgcuugca

SEQ ID NO: 3106 - RNA, 18788 nt, Mus musculus
aaugaccaagggagccaucgggacaauaguuuucuuugugggaccuuuucucauggcccagcccgggaauuggacuggacuguuguugauacucugucuaguuggggauguggaggaacggcuacgggcuggaaagcuucccguugccacaggggccguccugcugucccgaaaccguuugcaagucaagcacccugaauacggcugccgggccuccaaccugcgggaaaagaaagcuucauugagccgggaggagugggaggggguggcguggcugcagccagcuccacaggggaggggaagaucuagaggagggaacuggccuggccggaauggagggagaaagcggaaugugggagggcucuaggggacgugggagggaccaacgaagaggggagaggaaggggggguccagucuccccuggccgaacacuuuuuuucugagaaguccugaaaguaaucuccaggaccaggacucugcuuccagccucuggaguugugccuagucgaagguaggggaguuacugcuggccagcgggaagaggaguuggggauggagaggaugguggaccaggagaaacgcugauuugggauggagucgggaaagccaaccaacugacaguuuuauuauuggucaaggagcgaaacagaagaguggaaagcugagcaaacuguuggggauggaggcuucagggugcaauuugcaggcccuacgcugaacaccagggcuucggagccaaaugcccccagaacaaagcugucuugucugaguugggggaagcaauggagggccccccuuacuguggaggacuguuuucagccucggauagagaaggccugagcuggggagcuagcccuagcuucugguugcccagugacagaaaaagagguguuccagggagcuuggauaacuccauaccaaacccugcccagcuugaagccuaggucuccuggagucccugacccugcagcauauuugccagcccaugugcuagggaggguggcagaagguucuccuacuccgguuagccucggcccuuccugcaugggcaucugcccccauaggaaacugaagagucuucucauucauagugcugagauuuccagggcugggcucccaggcuccccuugccugugaugccaucugucugucuaacugcaugggucuugcugucauuucuccugugccugcaccuuggcuuuuauucccucuccucaugguuuuugccucucugugucauuccccauuacucugugcuuugguuuuuuugguuugauuaaaaccaucuauccauauucaaugugucucucaccccgugccuuucuguuuuuuccccuucguucccacagucucccuuccugucacauccugucugggucguccucucugugucucuucccaauaucucuguuuacccaacccauccguagacucuccaucucuaacccauacccaccccauggaugaaaguaaauagagaugaugguguuggugguaaugauggccaaaccagggaagguuauggugggacacuaaccacaaguuauaaguuuuauuauuugcaaagggaaaggagagucucccucgcccccaaucuaggucucuagggcugugccuguuuucuuuguguuccuacccucauucagugugugugucucuccuucucugucccuuagugccccccuccuugggccccacccgccaugagagcugucagugugugguauugcugcccauggggacuacugcugcuacacugucugugcagcuucaguguggggucuccgucuccuucuaucagcccagagaagaagguaggaagccaggggcugagguuccggcuggcuggcuuuccuagaaagcccuaugaaggucgaguggagauacagcgagcuggugaauggggcaccaucugugaugaugacuucacgcugcaggcugcccauguccucugccgggagcugggcuucacagaagccacaggguggacccauagugccaaauauggcccuggaacaggugagcgaugcucuggacuagcccggacauuaucuaagugcaguucaaguacauagaaaagaacaaaacaccuuaauggcacaaccaaagggacacgggacaccaagaaugggcagaaucaagcaaacccacagauuauaaaccaucuaacauacuaauuucagggccaugugaccugaagcuagccaguacucuccaggagccuccaguguuccauguguacagugagaagggggcuauguucucuuccacaaagugagacuccauagagcuaugcacaaagacagcccagugcaggggagcccugggugauccaagugcagucgacucagugauaauaugagggcaggugaaugguauccgaauguccccuagccagaacgggucauauacuacagcugacaaaaucgggacccaggucagagcuaaaaccagcaagcaggaacucauguggaacaaguaugacagugcgaggguugaagcacaauucucuggagcugaaagugcucagauuguaugggcucacacugugggugugaugggugggcaccugcuguugaucccccuccccuguucccaguugcuccacugcuucagagaucaagugucacuuuggagauaacagccuuggagaccaacaguagaaaguggagaugcucagaaguacuuuccuacacucaguccuccagagagaaggagggaaggagggaggaagguggagacagacagagagagacagagaggaaaccgcuuucagaaagccacuuucaggaggaauagcuaaagaaaccaaaagcuuggcacagaaacaaacaagcaaagccucacuuagcaauuacaugacgguuggguucaauucaggaaggacagucguggcugaaggguuuucuggguggcaucaaaggacugaaucagaccuagcaggggaaaguuguaaagacccacaaggaccuucugauaguuacguggccuccuggggcugaaagguaaaagcccugugagaauaggugaggugcccugaacacuggcuggaacacauaauuuucgcgagguuccucccaguuuugaguggucagugauagucaauauggcccagaaaguaaaaauaggguuucuguggcaguaggccacguagguauacagaaaaacgccacaggggagacgccagggugaagugaaagacucuaagauucccaagucucagggaaaagucagacucuuaggcaaguuacaucauuuuucggagccccagucuauuuauauaaaguaaucuucuggcagcugcagucugagaaugauuguguauauacuauggcaaagcauuuggcccuaguagggacuuaguuauagcugauagugaaugaauccugauugauauuggugagagcauaaauguugauucucuguuguugguuguuuugguuuuaauucacccuaaucaggucuucagcaucccagaucaccaguaaccuuucaucaaccucacacccucuuuccucucaccccccccaggguccccugucucuuccccaucuuccucucaucaaagaaggauuagccucaaggccgagugaggccaccauuacugucagccauccucaaacacuucuugcucaucucccuuuccacaggccgaaucugguuggacaaucugagcugcagggggacugaaggaagugugacagaaugcgccucucggggcuggggaaacagugacuguacccaugaugaggaugccggggucaucugcaaggaccagcgccuucccgguuucucagacuccaacgucauugaggucugcaguacacacuugugcaugugcacucacgcacgcgcgcgugcacacacacacacacacacacacacacacacacacacggcugccaagugccauaugugauuagaagagauaucauauaaggaucccauaagccuuuauaggauaauguggauuucugggacacuuggaaagugggggggggaguacugcacuguaaaauccaauuuuuuaaaauguguauggguguuuugcagucauauaugucuguguaccccguguaugccuagugaagagaggccagaugagggcacuggaucuuauggaacuggaguuucugaagguugugagcugccauguggguccugggaauugaaccucaggucuucaggaagaguucuagcccucgaauccauucauuucaaguauucacauuaaauuacuaaaccuggcaugcgcucucuaguuucacuccuguucaccugucccucuccucccagguuucugcgcucugccaaugucuuucuuccuccucuuccugagacacuuccauuguaaagguugccucaugcuucaggcagacuuauuauagcuucccucagugccuucggacccugugauuaugucucgaacauagcauauucugccaccgcuacacacugcacucuggggcacauccuccacacaggcagcuuggccuggcauccucagcccugucucaguggucacaccguuggguuuuacagacacaaucagggcuccuucgaggcugcacaguauugcuacugugauucuuuccccugcucuggucccaucucagguggagcaucaguugcaaguggaggaggugcgacuccgaccugcgguggaguggggaaggagaccccugccugugacugagggccugguugaagucaggcuuccugaaggcuggucgcaagugugugacaaaggcuggagugcccacaacagccacguagucugcgguaugcugggcuuccccggagaaaagagagucaacauggccuucuacaggugcgggggcuaaggguguuuucagacuuuggagagguugagaggcacuguaggaagcccgggggguggggggaacgcaaggagacugcugugacguaggcaacugggaaaccaugcgugaccucgaaggcuuuccuacccagaaauugaaacagcuaggcaaggugcagaaugcgcgugcgcgccagugacgucauuggucggcaggcagauuucuggaguccgggcccuggggccuugaaaguucagaguucguggagggugaggcggccuguuagaggcggugccuggggaugucuuugcaaggcugcgcccggggccucagagauugugacuggccagcgccaagucauccuagggaacgcugugcaaaggguggcuuccuucuugggcaucucauuuggugaaugagauaaacagccaguuugaugacuuuucauugagcgcacugcauaagaugugggccggguauuguaaaaaguuccagccuuuaaagaaagucuacacuccuugcaugagauagaaaaccgguucaggccuuaccucuaauauggauaaagcugccuuuugaaccugaauauacucuggguagaacguggugcuaguguaaccaauauuucauucaucuauagugaaauuaugagaggguucuuuuuuuuuuuuuuuuuuuuagccuugcuaaaauccagauaaucaccgcuaucucuaguaauccuccccagaaugcuaucauggguuugaguguaauuuuauuauuccaguaauuucagaucucuaagaauugccauauguuguccuuagcauuuaucugcagaguaugaaaacuuucucuuagccgggcgugguagugcaugccagccuggucuacaaagugaguuccaggacagccagggcuauacagaggaacccugucucaaaaaaaaaaaaaaaacaaacaaaacaaaacaaaaacaaaaaaacaaaaaaaaaccuuuuucuuucuaaaaucaguacauucugugacauccacucauuuccacguuggcuggaauuuucuuuaccguggugcccagauguuccuucagcccuggggaauacaguugagucaccugcagacuggcagcauuuuacaaagcugugagcgaucgugugccuguccuggcauccaucuggggcugagguccuugcauugagcucaggcguugucuuugggaauccacacaccagguuauaaacaguuguaggauugaagcccaagcuuuuccaagaggaguggauggacugaaucaaggucuagagggucucucguccagcauguauuugaugccccaccaugugcggcuucuaucguagacuuuggugauuccacacuaagaacaaacauucuuccccugaggaccaagggacaacaagggacaacaagaaaacaagugagcuuauaaaauggaaggauggcuguguuaucguggcuucuaucagaaccagguucauggcuucuuauucaaagaauugaaagagcacagacaaauagcaaagugggaaaggaaggaauaaauucaaggacaauguggaagugugggacagguaggcugcaagagagcacacagcaggcuaccugagcuagagugcuagaggucaccuggucaccacccuuuuguggguccaggagaaagacuggugguuaagggaugaaccaugggcaguuuucuguuuugauugacaaacuuggcuuauauaagccuuugguuaguguucauaucuuuccccaagagaugucugauuuuaaucaauauguucucccaaucaugcauaggcauaagaugguagauugggcuuuucccuaaaaguacacucagagaauacaguagaccuuacugcacuggcucccgaaccugcccaugcuggauaggcucacuccuccuguuccugaauauucaucaggauguguuugcuccaaaaagggaguuacuaaggguuccugggucagcugugacagagugacuuaauugcuuuguuuagagacaggugugccuguagcaagauggggaggguuggggguacuccaggaugcucagugcuuuguugaaaagggggaugcauagauucaagccaacuagaaccccaguuugcuaagcuguccccaugcuugcgugccucaguagugugcaguaaggauaaggaaguaaaagugcugagggaaagccuuuuugaguagacaucucaugagacaggguuuaaaggcaguggggcacagcuaugcagucguguaguugaggaugaggcauuauaagagacagggguggggagaaggcauucuugucuucaccucagugaggcuggagcugagcgcgcauaggacgugucaggugaccugauccaggagauggaagggaagaguuggugagcuagauccagaagggccacgugggagacauuggccuuacccugugacguaaggaaccauuggggaguuuugagcagaaguugugccuugcuguuuuaauuuuuaucacauuuuuauuucuuuugcgugccacugugaacagagggaggucagaggacggcuugccagaguccguucucuccucugcaggguccagggacugaacucgggguaucagucuuaacggcaaguuccuuucuaugcugagccauuuucuccagccccagaggugguuuuuaguuuugguuuuguuugaaaccacaucuuggauaucccuggcuagcccugaaccccugaucccucugccuccaccucccaaguccgggaauaugggccugcaucagcacacccagcugaggggugacaucuaaucacaucucuagucuuuacuuugacuuguuaauuauuuuaucuuguuaauuaguguguguguguguguguguguguguguguguguguguucgugugcuguguguguacaugacugugcauaugggagaucaaagaauaacuuucaagagucagcgucucccuccacgcuggauuccuggggucaagcucagguucccagguuccagugugagagcuuuucccuacuaagccauuaguugcuuugcucuuuucuucucuuuaaaaaaauauauauaucguggggggguuggggggguugaauggcagagucaauaauaauuauuuuaucuccuaaaggaaaagccagggcaauuuugauaugaauaauauauaagcauucaccacaugggugauaaagccaaacuuuuuaucaaauuacagguguguucaguuuuguguuuauaauuuaaacuuguuuugguguuguagaaugcauggaagcuauagaaauuuagaaggaaaauguauagguauuugaacucuucacugcucuugugcaggaaaagaaacugaggcucugagagcuucagugacuguaagaagacacgucuuuauauaagacacucucccuauguagcagcuuacacuggcaauccccuugucacagcuuugagugcugggacagcaggauccuccaccauagcugguuuuagaggccacucccucauucaugucauuguggcacauacugacugaccuccaugcuaggguggagagcacaaggaugcuaaaugaugauggagguaggcaggcggcagauuacagagccacgagcuguggcuacaaaucugcuagacuuuucuaauaaauguaaugggaaaagacagcaaaguggcuaguugguuuguugguugguugauuuguuuggggagagacagggucucucuacauagcuguccugaaacucacuauauagacuaggcuggucucaaacucaucuaccugccucugccuccuaaauacuaggauuaaaggugugugcuaccaugucaagugacacuaagguguucaaugaagugguauucacccacaagcccagaugacuggagccuaaggcaggaagaucuggaauuauaggcugacuuggagauucagucuuggugggggguggggaacuguucaaugaagauaucugugagaugacaugaucaggcaggcuguggcucuauuuuuuuauauggauuuucauaaaugaaauaauuauggggcuggagagauggcucauugguuaaaaguacuugcuguucuuucagaggacuugaguuuaguucccaguucccucaccaggucucaaacaccugugauuccagcuccaggaauacagugacuuauucuggcuuccagggauacaugcauacacauaugcccuaacacacacacacacacacacacacacacacacacacacacacacacacacaagcaagacaccuacacacauaaacccaaauuuacaaaaacaaaaagcaaaagagccaugccuggugauggcuuguaauuuguaauccuaauaguugggaggcucagacaagaaaauuauaaguuugaggccagccuggacaacacucaggggaagagaguaaauacauuuuaaaauguacauauaaaauccuagugcacauucacacaguauacuacauugaaaugcauggauauucaagagaaauggcaaagcaggaacauggacaaaggaacaauaaccaaggggccaacagggaacuccauaaaccucuuucuaaagaugcagaccagccaggcggugguguugcaugccuuuaauuccagcacugggcaggcagaggcagccaggucucugaguucaaggccagccuggucuacagaguauauccugugacuccaguaugugugguacaaaaguagaagaaucaacacugguucgaggccagccagggcuauguaaucaagccccugucucaacccugcaccccaccacacugcauacucugagaaaggcauacauaguguuggguagggcaaagaguggccacaauuaaagucuucaaaaugaaauggacaaugaggagaaauaggcuugaggaaacaguugaaggaggaaguaaggcaauuuacuucccugcaagcauguuugggagaugagcucagcuugugaaugaccaggccugugggguuggaacgugggcagaaagauuccccagucaaaugugaacgcuaauguccucagauauguucucagucccuggaccagaagucucaggucuagacagugccagggcauuccuuggagagaccacccaagaagcacacacacaaaggggagugaaagagguguugucagccucccugggccugauucaagcugcuucucugaccuccagaucccaauggccccuccucugcccuccccugagguugucuaccuccagagccagcgaugcucauuccucauccgucuugaucuaaucucugaagguccugguacuggggcacuguucugaguccauggcccucacugaggcucgcucgccuguuccugugcuagcagggccaggagggccuugggaguggcugaugccaucacacucuacucuuggaaguucuccauuaggaaucuugucccggauucuggcugcccuggccuuuucugccugguucuacagcaauccugacucgaucuugucuuauccucacagaaaguugaggaagcgagcggccaaagccucagcccgacaccccaagucccuuggaagguaaaggggcaagagcccuggggaccuccugucagccccugaggccucaggagguggauggauggauggggaccuauccauguccaucccaaaacccaagccuguagguuaggaauguaguugaagaauggcuacucccaggggagggugggaagcaggcaugggaauggguuagcuuugaucuuagggaaugggaggagaaagauauguaggaacagcugaguagauacugcagccucagcccuuacaucccucccccucccuacccacacccacaacucccucgguccaggaacaauuccacucucuccuccauugaccuuccaccgaccuccucuccucgcccucaccuggauuuccauaauuggauuugccuuuaguggcacugauuccagugagcaucagggguugcugagugcaugcccucuuuggcauucagcagucuuuaugugcagggagaucaauugcccuccccauacugggaacaaaggguccuucuaaaaacagagugcuucacuuuccccaggccauaugcucaaugacugccucuuccaacaucuuucucccuuuugcagaacaaucaacaaguuuaaagucaaacacaagccccgagugggcagagggccaagcaagagguaaaugagguugggacuggaagcagggcaggcaggagcaggggcagggguagggcucugaccaggaacgcaugcagggcaggccuguuggacugauggagcuggugacagguggauuggcagcggugacaaacaucuuccagauccuuccagaaacgggaaguaaggcacuguguucugagucucuggggacuguguuagucacaggacuuugugcuugcccaugugcuugucuuccuucugugaacuccaguaggccauccagcacuccguccuguacugccuuuccccggagugcccgagagaucgguguucucauccugacuuauccgaugagugcuuccaaguucuuuuuguuuguuuguuuguuuuugguuuuuuucgagacaguuagcugucuguguagcuuuggcuguccuagaacucacucuguagaccaggcuagccucaaacucagauauccgccugccucugccuccaaagugcugggauuaaaggcauacgccaccgcgcccggcucuauuuuuuuuuuuuuuuaaguaaauacuaccaggggcuggugagauggccuauggaucccacuugggaucaaugguuaagaguauggauuucggccaggcagugguggcacaugccuuuaaucccagcacuuggaaggcagaagcaggcagauuucugaguucgaggcuaaccuggucuacagagugaguuccaggacagccaaagcuacacagagaaacucugucucaaagaaaaaaaaaauguggacugcucuuccaggggaccugaguucaauucccaguaccugcauuaggcaacucuacucaacugauacucugacacauacauaugcacauuauuaaaguuuuuuuuuaaguaaacauuaccaguuuaccugguguggaagguagccuauagaacuuuuccaggaacaacuuaagaaucacaggccccaccuggcugucuguuaggcauccaguugcauauuuuuuuuuuccugggcuuccucagaauucaagggaauaagagauucuaacccuagcuggacgugguggcgaacgccuuuaaucccagcacucgggaggcagaggcaggcagauuucugaguaugaggccagccuggucuacaaagugaguuccaggacagccagggcuauacagagaaacccugucuugaaaaaaaaagagagagagagauucuaacccuucuguccaacuugucuuuaaaaggcaggcagcaccacugaaaccucccugauaacuugugauugaggauaggagaaaguagcucuuccauuguccccucuucccucagcaagcucaccucacaagugggcuucugucccuggcagcugucgaagagcucagaauuugaugagugcaaguucuugcaauccucuuuggcuuaggucaucuuuacccaacacgaaucucucugaccccagcaugcacugcuccuuuuuuguugguuauaaggagaggauaagggagauuuggaaguuagaugucuuuuccugugaugcccugacuuugauuuucagccaaagaagacacugaaaguaccugaucucuuugguuuccaggauccgucuacccugggcuuccaaaugauuucuuucuguaaagucuccagccuccuuugccuggugugugugugugugugugugugugugugugugcgugcgcgcgcgcgcguuugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccugagugcugggauuaaaagcaugcaccaaccaccacugcccaguccuuugccuguuuuguuuauaaauaccgucucuucugucuuccuagcuucaaauuguuacauucccucuuucucuaauaucagggauagggcaccagacugcaaugaaccagccugguggaccacuccacacacaccaggucucugcuuugccugucucccugaguccacccaaccuuucugggaagagaguucucccuucccaccaccuagcugcaagcucuuguucugugguaucuacaacucccccucuucucucaugcaucucuaguguuucccaguuugguccuauuuucugcucagcuggcugugggacauugcucaguugaaaucgcacaagcaugacuaccucauuaaaacaucuguguuugccauuaggacagccauagccaccuucccucuuuagccauguaguccuuccaacuuuugucugucuugaguuugucuucauuccagagagccgucaccaguucuucuagccuauucuugcuauagcuguaauaguaugacagagcuucuaacauggaagcgacucuggccucugagaagccauuuucaugcagacuuccucgguacucugcauccuagcucaucuucauucggcguguucagucacagcauaauagaagggucugcuuacugacuguuugggccaguuuugugccagccccuccuucagagccaugucuucuggcuuccuguuagaucuauauggcugccuuuggucucuucaugaccuaaauagccucagccugccuuuaggucauuaagaauaagguugcagcagugugguggugguaccugccuuuaaucccagcacuccagaagaagguggaggcaggcagagcucugugaauucaaggucagccugcucuauggacaggccagccaaugcuacagagaaauccugucccaaaauuaaaaaaaaaaaaaaaaaaaaaaaaaaguacaagacuguuaucaaaccuggccacccuucccuuaggguucuauuugcaagucuccaaaggaccccgacugggcagcgcucuuucauacuacacacuagccgguccugucuuccuacaaggaaaacacagaaggggaagaaagggauaaguggccaugagagguuggggguugucagggaagugaauuggcagauggcuguggggcgggggcgggggagguaagaacucacucucacagcacuucaccucacuccuguccccauaggaugcuggcccagaagaagcaacacuccuuuggucugcacaguguggcaugugugggcacagaagcccaccucucccuuugcucucuagaguucuaucgugccaaugacaccaccaggugcucugggggaaacccugcaguggugagcugugugcugggcccucuuuaugccaccuuuacuggucagaagaagcagcaacacucuaagccucaaggggagguauguaagacaaguuuucauucagcaguacuggggauuugaaccucaggcuucacacacacacacacacacacacacacacacacacacggcaaacuuaccuuucaguuacacacucccacccaagacaguaaaugugaccuuucuccacccagggugggaauucccuagcccggucucuaguuaauaagcaagccuugaccuuugaagacaaggaaccuuccaguggcugugccauagaucugaugccacccacuaucauaaaaaccucauucagcucuccggacuacuuaaaccaacaaucucccuggucuucccaaaucaauguuuccacucaucucuuugggcauggcaugucucucuucuacaggcucgugugcgucuaaaggguggugcccaccagggagaaggcagaguggaaguccugaaggcuggcacauggggaacagucugugaccgaaagugggaccugcaggcagccaguguggugugucgagaacugggcuuuggcacugcccgagaggcccugaguggugcccgcauggggcagggugagggaagaggauguucacacuucuaggggugcauuccuugggaagguauggaguccucugggcaauggucuaguuccaaccuccccagccuugacuuucgacuguaggcaugggugccauccacuugagugaaguucggugcucuggccaggagcccucccuuuggagaugcccguccaagaacaucacagcugaggacuguucccacagccaggaugcggguguccggugcaaccuccccuacacugggguggagaccaaggucauucagacauucuacuuuaggucuuucuacucaggcccggacaucccucagcucccacacagcccugccaucugugagcccuuucucugucccugcucccugcuccagacugccauccccaaagaucccccugcaccuccccucuauaccucuacagauccgacucagugggggccgcagccgguaugaagggcgagucgaggugcaaauagggauaccugggcaucuacgcuggggccucaucuguggggaugacuggggaacccuggaggccaugguggccuguaggcaacuuggucuuggcuacgccaaccacggccugcagguaagcagggagaaaagggaacuuuugguugucaccaaagucuguguuuugggcaaggacuguggaaacacaucccuuggcccuggaaacuggaaccuauaaccucacuggaacuccucccuacauccccaggagaccugguacugggacucagggaauguaacugagguggugaugagcggagugcguugcacggggucugagcugucccugaaccagugugcccaucacagcagccacaucaccugcaagaagacgggaacccgcuucacugcgggggucaucuguucugaaagugaguaguaucagcuagagcuaauuggaggggcugugcugugaucugccucgagagaagccagucucccauacggagggagauggaggcgcccucagugguaaccgccacccucucucucacguagcugcuucagaucugcugcugcacucggcacugguacaggaaacugcuuauauugaagaccggcccuugcacauguuguacugugcugcugaagagaacugccuggcuagcucugcccgcucggccaacuggccuuauggccaccggcgucugcuccgauucucuucccagauccacaaccuaggaagagcugacuuuaggcccaaggcugggcgccauuccuggguguggcaugagugucaugggugagagggcagagggggccagagacgaaggcaaggcucagggguguaacaagccuguugggauucagggaagaaucacaaguucccuugucccacaggcauuaccacaguauggacaucuucacucauuaugauauccugacccccaauggcaccaagguggcugagggccacaaagcuaguuucugucuagaagacacugagugucaagagggugaguuggggacagaguggccuuaagcccaagcauggccuugccgcccuucccugacaucuaacacuuccuucagaugucuccaagagguaugagugcgccaacuuuggagagcagggcaucaccgugggauguugggaucucuacaggcaugacauugacugucaguggaucgacaucacagaugugaagccaggaaacuacauucuucaggugccuagcaucugccugagcuuucagaugcugggguuuggggugagugaugaggacaccugugaccugucggagugcugcugggucacaccagcuuucuuccucacucacaggucguuaucaacccaaauuuugagguagcagaaagugacuucaccaacaaugcaaugaaguguaacugcaaauacgacgggcaucgcaucugggugcacaacugccacaucgguagguaacagaugagaugggugaaugcagggcaggagggaaaggcuuccaugcugucacugcccaugaugggugugugcucuugccucugugcagggacagccccucacagugccugucuauucugcaggugaugccuucagcgaagaagccaacaggagguuugagcgcuacccuggccagacuaguaaccagaucgucuaaaaugcuaccacccucucuguaaaccaccacuggcccccaauggcaggggucugaggcugccauuaccucaggagcuuaccacaagaaccccugaugucagcaggcgcccuacacucaaccaccugugcacuacaggcaacaaacugucaaacagaaguuggugccuccuuuacggggucagcugucauuaccuuuggccaacaagcauggagaaucagccaacagccccagcaacagacagaacacaccacaaagaacugccccacacaggauggcagcagcucauucucuugaauaggggaggucaagagggucagcucccaucgcucuccguucuccuaaggaccgcguuaccucuagccauuuggugggggagaagauccaacccccacuuuugacuguaacauguugcuagguauaauuuuauuuuauauaaaauguguucuucggagcccaggacugaugcagcgguuagagggacuugcccuccgcagguucacugacuccuccucuacccacaugcacucagaaccuaggcuaggaaagcaaggaggagaucagggcaagagcuucacacucuugccgguccagucauucauucugugaccucgggggucacauauaaggucagugucucugauccgcgccggauccgcacugccagcugugauuggguucgaacagcuucauaaacaucuucagcauuuugugccaauuucuccccaauggccaagaucacaucaccaggccgcagaccagcccuguggaggauggacggggcaaggagagaauagacagagaaguucaaggauacauccacccaucccaucccacccaacccccccccccagagcacgcuccccaucaccugugugcgggggagcccaggauaacuuuaugaaugaggacaccaugcugaacaucagggaagcuuggcucacggagcuguaguucaauaaggaugcugaaagggcacagacacuauuagcuccacacaggcccucucccaucuuaauaguucaccuucugccuucuagagcuuaggaagugggauauacacauaaaagauagcuaauuucgaaagauacaugguguugaucaacuucacuucugucauccugaaggguuagaacuuaagcugagccuagaaggguggguccuaccaccuuacgaaauaagguauugagacauagaaguggaaaaugaaaguaguuccgaagaaacggcaagcugucuggaaggauaacgagaugggugggaaugggcgggaaugggccuccagugcuaggucaauguuggcuuuacaucacagcaauagcaggauguacucaaucuacugaaagauccagaugcagugggaugagaaaguuaugagagggaacagugcuugugacagaagacaacagcuuaucuuaggaaaaaacagacaugagagaaaacccaagaaaaggauaggguguguguaugguguguguguagggguguguguguguauguauguauagguguauauauauauacauauauauagauauauguauauaucaccacacuaacauacauauauauguauauguauauaucaccacacuaacauaccugggagucagggucagcaucaucacuccaauguagcggcgcugggacccacugguuccaaaccaggaaucuguaauaaaagaggacaaauga

SEQ ID NO: 3107 - RNA, 18788 nt, Mus musculus
ucauuuguccucuuuuauuacagauuccugguuuggaaccagugggucccagcgccgcuacauuggagugaugaugcugacccugacucccagguauguuaguguggugauauauacauauacauauauauguauguuaguguggugauauauacauauaucuauauauauguauauauauauacaccuauacauacauacacacacacaccccuacacacacaccauacacacacccuauccuuuucuuggguuuucucucaugucuguuuuuuccuaagauaagcuguugucuucugucacaagcacuguucccucucauaacuuucucaucccacugcaucuggaucuuucaguagauugaguacauccugcuauugcugugauguaaagccaacauugaccuagcacuggaggcccauucccgcccauucccacccaucucguuauccuuccagacagcuugccguuucuucggaacuacuuucauuuuccacuucuaugucucaauaccuuauuucguaaggugguaggacccacccuucuaggcucagcuuaaguucuaacccuucaggaugacagaagugaaguugaucaacaccauguaucuuucgaaauuagcuaucuuuuauguguauaucccacuuccuaagcucuagaaggcagaaggugaacuauuaagaugggagagggccuguguggagcuaauagugucugugcccuuucagcauccuuauugaacuacagcuccgugagccaagcuucccugauguucagcaugguguccucauucauaaaguuauccugggcucccccgcacacaggugauggggagcgugcucuggggggggggguugggugggaugggauggguggauguauccuugaacuucucugucuauucucuccuugccccguccauccuccacagggcuggucugcggccuggugaugugaucuuggccauuggggagaaauuggcacaaaaugcugaagauguuuaugaagcuguucgaacccaaucacagcuggcagugcggauccggcgcggaucagagacacugaccuuauaugugacccccgaggucacagaaugaaugacuggaccggcaagagugugaagcucuugcccugaucuccuccuugcuuuccuagccuagguucugagugcauguggguagaggaggagucagugaaccugcggagggcaagucccucuaaccgcugcaucaguccugggcuccgaagaacacauuuuauauaaaauaaaauuauaccuagcaacauguuacagucaaaaguggggguuggaucuucucccccaccaaauggcuagagguaacgcgguccuuaggagaacggagagcgaugggagcugacccucuugaccuccccuauucaagagaaugagcugcugccauccuguguggggcaguucuuugugguguguucugucuguugcuggggcuguuggcugauucuccaugcuuguuggccaaagguaaugacagcugaccccguaaaggaggcaccaacuucuguuugacaguuuguugccuguagugcacaggugguugaguguagggcgccugcugacaucagggguucuugugguaagcuccugagguaauggcagccucagaccccugccauugggggccaguggugguuuacagagagggugguagcauuuuagacgaucugguuacuagucuggccaggguagcgcucaaaccuccuguuggcuucuucgcugaaggcaucaccugcagaauagacaggcacugugaggggcugucccugcacagaggcaagagcacacacccaucaugggcagugacagcauggaagccuuucccuccugcccugcauucacccaucucaucuguuaccuaccgauguggcaguugugcacccagaugcgaugcccgucguauuugcaguuacacuucauugcauuguuggugaagucacuuucugcuaccucaaaauuuggguugauaacgaccugugagugaggaagaaagcuggugugacccagcagcacuccgacaggucacagguguccucaucacucaccccaaaccccagcaucugaaagcucaggcagaugcuaggcaccugaagaauguaguuuccuggcuucacaucugugaugucgauccacugacagucaaugucaugccuguagagaucccaacaucccacggugaugcccugcucuccaaaguuggcgcacucauaccucuuggagacaucugaaggaaguguuagaugucagggaagggcggcaaggccaugcuugggcuuaaggccacucuguccccaacucacccucuugacacucagugucuucuagacagaaacuagcuuuguggcccucagccaccuuggugccauugggggucaggauaucauaaugagugaagauguccauacugugguaaugccugugggacaagggaacuugugauucuucccugaaucccaacaggcuuguuacaccccugagccuugccuucgucucuggcccccucugcccucucacccaugacacucaugccacacccaggaauggcgcccagccuugggccuaaagucagcucuuccuagguuguggaucugggaagagaaucggagcagacgccgguggccauaaggccaguuggccgagcgggcagagcuagccaggcaguucucuucagcagcacaguacaacaugugcaagggccggucuucaauauaagcaguuuccuguaccagugccgagugcagcagcagaucugaagcagcuacgugagagagaggguggcgguuaccacugagggcgccuccaucucccuccguaugggagacuggcuucucucgaggcagaucacagcacagccccuccaauuagcucuagcugauacuacucacuuucagaacagaugacccccgcagugaagcggguucccgucuucuugcaggugauguggcugcugugaugggcacacugguucagggacagcucagaccccgugcaacgcacuccgcucaucaccaccucaguuacauucccugagucccaguaccaggucuccuggggauguagggaggaguuccagugagguuauagguuccaguuuccagggccaagggauguguuuccacaguccuugcccaaaacacagacuuuggugacaaccaaaaguucccuuuucucccugcuuaccugcaggccgugguuggcguagccaagaccaaguugccuacaggccaccauggccuccaggguuccccagucauccccacagaugaggccccagcguagaugcccagguaucccuauuugcaccucgacucgcccuucauaccggcugcggcccccacugagucggaucuguagagguauagaggggaggugcagggggaucuuuggggauggcagucuggagcagggagcagggacagagaaagggcucacagauggcagggcugugugggagcugagggauguccgggccugaguagaaagaccuaaaguagaaugucugaaugaccuuggucuccaccccaguguaggggagguugcaccggacacccgcauccuggcugugggaacaguccucagcugugauguucuuggacgggcaucuccaaagggagggcuccuggccagagcaccgaacuucacucaaguggauggcacccaugccuacagucgaaagucaaggcuggggagguuggaacuagaccauugcccagaggacuccauaccuucccaaggaaugcaccccuagaagugugaacauccucuucccucacccugccccaugcgggcaccacucagggccucucgggcagugccaaagcccaguucucgacacaccacacuggcugccugcaggucccacuuucggucacagacuguuccccaugugccagccuucaggacuuccacucugccuucucccuggugggcaccacccuuuagacgcacacgagccuguagaagagagacaugccaugcccaaagagaugaguggaaacauugauuugggaagaccagggagauuguugguuuaaguaguccggagagcugaaugagguuuuuaugauaguggguggcaucagaucuauggcacagccacuggaagguuccuugucuucaaaggucaaggcuugcuuauuaacuagagaccgggcuagggaauucccacccuggguggagaaaggucacauuuacugucuugggugggaguguguaacugaaagguaaguuugccgugugugugugugugugugugugugugugugugugugaagccugagguucaaauccccaguacugcugaaugaaaacuugucuuacauaccuccccuugaggcuuagaguguugcugcuucuucugaccaguaaagguggcauaaagagggcccagcacacagcucaccacugcaggguuucccccagagcaccugguggugucauuggcacgauagaacucuagagagcaaagggagaggugggcuucugugcccacacaugccacacugugcagaccaaaggaguguugcuucuucugggccagcauccuauggggacaggagugaggugaagugcugugagagugaguucuuaccucccccgcccccgccccacagccaucugccaauucacuucccugacaacccccaaccucucauggccacuuaucccuuucuuccccuucuguguuuuccuuguaggaagacaggaccggcuaguguguaguaugaaagagcgcugcccagucgggguccuuuggagacuugcaaauagaacccuaagggaaggguggccagguuugauaacagucuuguacuuuuuuuuuuuuuuuuuuuuuuuuuuaauuuugggacaggauuucucuguagcauuggcuggccuguccauagagcaggcugaccuugaauucacagagcucugccugccuccaccuucuucuggagugcugggauuaaaggcagguaccaccaccacacugcugcaaccuuauucuuaaugaccuaaaggcaggcugaggcuauuuaggucaugaagagaccaaaggcagccauauagaucuaacaggaagccagaagacauggcucugaaggaggggcuggcacaaaacuggcccaaacagucaguaagcagacccuucuauuaugcugugacugaacacgccgaaugaagaugagcuaggaugcagaguaccgaggaagucugcaugaaaauggcuucucagaggccagagucgcuuccauguuagaagcucugucauacuauuacagcuauagcaagaauaggcuagaagaacuggugacggcucucuggaaugaagacaaacucaagacagacaaaaguuggaaggacuacauggcuaaagagggaagguggcuauggcuguccuaauggcaaacacagauguuuuaaugagguagucaugcuugugcgauuucaacugagcaaugucccacagccagcugagcagaaaauaggaccaaacugggaaacacuagagaugcaugagagaagagggggaguuguagauaccacagaacaagagcuugcagcuagguggugggaagggagaacucucuucccagaaagguuggguggacucagggagacaggcaaagcagagaccugguguguguggagugguccaccaggcugguucauugcagucuggugcccuaucccugauauuagagaaagagggaauguaacaauuugaagcuaggaagacagaagagacgguauuuauaaacaaaacaggcaaaggacugggcaguggugguuggugcaugcuuuuaaucccagcacucaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcaaacgcgcgcgcgcgcacgcacacacacacacacacacacacacacacacaccaggcaaaggaggcuggagacuuuacagaaagaaaucauuuggaagcccaggguagacggauccuggaaaccaaagagaucagguacuuucagugucuucuuuggcugaaaaucaaagucagggcaucacaggaaaagacaucuaacuuccaaaucucccuuauccucuccuuauaaccaacaaaaaaggagcagugcaugcuggggucagagagauucguguuggguaaagaugaccuaagccaaagaggauugcaagaacuugcacucaucaaauucugagcucuucgacagcugccagggacagaagcccacuugugaggugagcuugcugagggaagaggggacaauggaagagcuacuuucuccuauccucaaucacaaguuaucagggagguuucaguggugcugccugccuuuuaaagacaaguuggacagaaggguuagaaucucucucucucuuuuuuuuucaagacaggguuucucuguauagcccuggcuguccuggaacucacuuuguagaccaggcuggccucauacucagaaaucugccugccucugccucccgagugcugggauuaaaggcguucgccaccacguccagcuaggguuagaaucucuuauucccuugaauucugaggaagcccaggaaaaaaaaaauaugcaacuggaugccuaacagacagccagguggggccugugauucuuaaguuguuccuggaaaaguucuauaggcuaccuuccacaccagguaaacugguaauguuuacuuaaaaaaaaacuuuaauaaugugcauauguaugugucagaguaucaguugaguagaguugccuaaugcagguacugggaauugaacucagguccccuggaagagcaguccacauuuuuuuuuucuuugagacagaguuucucuguguagcuuuggcuguccuggaacucacucuguagaccagguuagccucgaacucagaaaucugccugcuucugccuuccaagugcugggauuaaaggcaugugccaccacugccuggccgaaauccauacucuuaaccauugaucccaagugggauccauaggccaucucaccagccccugguaguauuuacuuaaaaaaaaaaaaaaauagagccgggcgcgguggcguaugccuuuaaucccagcacuuuggaggcagaggcaggcggauaucugaguuugaggcuagccuggucuacagagugaguucuaggacagccaaagcuacacagacagcuaacugucucgaaaaaaaccaaaaacaaacaaacaaacaaaaagaacuuggaagcacucaucggauaagucaggaugagaacaccgaucucucgggcacuccggggaaaggcaguacaggacggagugcuggauggccuacuggaguucacagaaggaagacaagcacaugggcaagcacaaaguccugugacuaacacaguccccagagacucagaacacagugccuuacuucccguuucuggaaggaucuggaagauguuugucaccgcugccaauccaccugucaccagcuccaucaguccaacaggccugcccugcaugcguuccuggucagagcccuaccccugccccugcuccugccugcccugcuuccagucccaaccucauuuaccucuugcuuggcccucugcccacucggggcuuguguuugacuuuaaacuuguugauuguucugcaaaagggagaaagauguuggaagaggcagucauugagcauauggccuggggaaagugaagcacucuguuuuuagaaggacccuuuguucccaguauggggagggcaauugaucucccugcacauaaagacugcugaaugccaaagagggcaugcacucagcaaccccugaugcucacuggaaucagugccacuaaaggcaaauccaauuauggaaauccaggugagggcgaggagaggaggucgguggaaggucaauggaggagagaguggaauuguuccuggaccgagggaguuguggguguggguagggagggggagggauguaagggcugaggcugcaguaucuacucagcuguuccuacauaucuuucuccucccauucccuaagaucaaagcuaacccauucccaugccugcuucccacccuccccugggaguagccauucuucaacuacauuccuaaccuacaggcuuggguuuugggauggacauggauagguccccauccauccauccaccuccugaggccucaggggcugacaggagguccccagggcucuugccccuuuaccuuccaagggacuuggggugucgggcugaggcuuuggccgcucgcuuccucaacuuucugugaggauaagacaagaucgagucaggauugcuguagaaccaggcagaaaaggccagggcagccagaauccgggacaagauuccuaauggagaacuuccaagaguagagugugauggcaucagccacucccaaggcccuccuggcccugcuagcacaggaacaggcgagcgagccucagugagggccauggacucagaacagugccccaguaccaggaccuucagagauuagaucaagacggaugaggaaugagcaucgcuggcucuggagguagacaaccucaggggagggcagaggaggggccauugggaucuggaggucagagaagcagcuugaaucaggcccagggaggcugacaacaccucuuucacuccccuuugugugugugcuucuuggguggucucuccaaggaaugcccuggcacugucuagaccugagacuucugguccagggacugagaacauaucugaggacauuagcguucacauuugacuggggaaucuuucugcccacguuccaaccccacaggccuggucauucacaagcugagcucaucucccaaacaugcuugcagggaaguaaauugccuuacuuccuccuucaacuguuuccucaagccuauuucuccucauuguccauuucauuuugaagacuuuaauuguggccacucuuugcccuacccaacacuauguaugccuuucucagaguaugcagugugguggggugcaggguugagacaggggcuugauuacauagcccuggcuggccucgaaccaguguugauucuucuacuuuuguaccacacauacuggagucacaggauauacucuguagaccaggcuggccuugaacucagagaccuggcugccucugccugcccagugcuggaauuaaaggcaugcaacaccaccgccuggcuggucugcaucuuuagaaagagguuuauggaguucccuguuggccccuugguuauuguuccuuuguccauguuccugcuuugccauuucucuugaauauccaugcauuucaauguaguauacugugugaaugugcacuaggauuuuauauguacauuuuaaaauguauuuacucucuuccccugaguguuguccaggcuggccucaaacuuauaauuuucuugucugagccucccaacuauuaggauuacaaauuacaagccaucaccaggcauggcucuuuugcuuuuuguuuuuguaaauuuggguuuauguguguaggugucuugcuuguguguguguguguguguguguguguguguguguguguguguguguguguuagggcauauguguaugcauguaucccuggaagccagaauaagucacuguauuccuggagcuggaaucacagguguuugagaccuggugagggaacugggaacuaaacucaaguccucugaaagaacagcaaguacuuuuaaccaaugagccaucucuccagccccauaauuauuucauuuaugaaaauccauauaaaaaaauagagccacagccugccugaucaugucaucucacagauaucuucauugaacaguuccccaccccccaccaagacugaaucuccaagucagccuauaauuccagaucuuccugccuuaggcuccagucaucugggcuugugggugaauaccacuucauugaacaccuuagugucacuugacaugguagcacacaccuuuaauccuaguauuuaggaggcagaggcagguagaugaguuugagaccagccuagucuauauagugaguuucaggacagcuauguagagagacccugucucuccccaaacaaaucaaccaaccaacaaaccaacuagccacuuugcugucuuuucccauuacauuuauuagaaaagucuagcagauuuguagccacagcucguggcucuguaaucugccgccugccuaccuccaucaucauuuagcauccuugugcucuccacccuagcauggaggucagucaguaugugccacaaugacaugaaugagggaguggccucuaaaaccagcuaugguggaggauccugcugucccagcacucaaagcugugacaaggggauugccaguguaagcugcuacauagggagagugucuuauauaaagacgugucuucuuacagucacugaagcucucagagccucaguuucuuuuccugcacaagagcagugaagaguucaaauaccuauacauuuuccuucuaaauuucuauagcuuccaugcauucuacaacaccaaaacaaguuuaaauuauaaacacaaaacugaacacaccuguaauuugauaaaaaguuuggcuuuaucacccauguggugaaugcuuauauauuauucauaucaaaauugcccuggcuuuuccuuuaggagauaaaauaauuauuauugacucugccauucaacccccccaacccccccacgauauauauauuuuuuuaaagagaagaaaagagcaaagcaacuaauggcuuaguagggaaaagcucucacacuggaaccugggaaccugagcuugaccccaggaauccagcguggagggagacgcugacucuugaaaguuauucuuugaucucccauaugcacagucauguacacacacagcacacgaacacacacacacacacacacacacacacacacacacacuaauuaacaagauaaaauaauuaacaagucaaaguaaagacuagagaugugauuagaugucaccccucagcugggugugcugaugcaggcccauauucccggacuugggagguggaggcagagggaucagggguucagggcuagccagggauauccaagaugugguuucaaacaaaaccaaaacuaaaaaccaccucuggggcuggagaaaauggcucagcauagaaaggaacuugccguuaagacugauaccccgaguucagucccuggacccugcagaggagagaacggacucuggcaagccguccucugaccucccucuguucacaguggcacgcaaaagaaauaaaaaugugauaaaaauuaaaacagcaaggcacaacuucugcucaaaacuccccaaugguuccuuacgucacaggguaaggccaaugucucccacguggcccuucuggaucuagcucaccaacucuucccuuccaucuccuggaucaggucaccugacacguccuaugcgcgcucagcuccagccucacugaggugaagacaagaaugccuucuccccaccccugucucuuauaaugccucauccucaacuacacgacugcauagcugugccccacugccuuuaaacccugucucaugagaugucuacucaaaaaggcuuucccucagcacuuuuacuuccuuauccuuacugcacacuacugaggcacgcaagcauggggacagcuuagcaaacugggguucuaguuggcuugaaucuaugcaucccccuuuucaacaaagcacugagcauccuggaguacccccaacccuccccaucuugcuacaggcacaccugucucuaaacaaagcaauuaagucacucugucacagcugacccaggaacccuuaguaacucccuuuuuggagcaaacacauccugaugaauauucaggaacaggaggagugagccuauccagcaugggcagguucgggagccagugcaguaaggucuacuguauucucugaguguacuuuuagggaaaagcccaaucuaccaucuuaugccuaugcaugauugggagaacauauugauuaaaaucagacaucucuuggggaaagauaugaacacuaaccaaaggcuuauauaagccaaguuugucaaucaaaacagaaaacugcccaugguucaucccuuaaccaccagucuuucuccuggacccacaaaaggguggugaccaggugaccucuagcacucuagcucagguagccugcugugugcucucuugcagccuaccugucccacacuuccacauuguccuugaauuuauuccuuccuuucccacuuugcuauuugucugugcucuuucaauucuuugaauaagaagccaugaaccugguucugauagaagccacgauaacacagccauccuuccauuuuauaagcucacuuguuuucuuguugucccuuguugucccuugguccucaggggaagaauguuuguucuuaguguggaaucaccaaagucuacgauagaagccgcacaugguggggcaucaaauacaugcuggacgagagacccucuagaccuugauucaguccauccacuccucuuggaaaagcuugggcuucaauccuacaacuguuuauaaccugguguguggauucccaaagacaacgccugagcucaaugcaaggaccucagccccagauggaugccaggacaggcacacgaucgcucacagcuuuguaaaaugcugccagucugcaggugacucaacuguauuccccagggcugaaggaacaucugggcaccacgguaaagaaaauuccagccaacguggaaaugaguggaugucacagaauguacugauuuuagaaagaaaaagguuuuuuuuuguuuuuuuguuuuuguuuuguuuuguuuguuuuuuuuuuuuuuuugagacaggguuccucuguauagcccuggcuguccuggaacucacuuuguagaccaggcuggcaugcacuaccacgcccggcuaagagaaaguuuucauacucugcagauaaaugcuaaggacaacauauggcaauucuuagagaucugaaauuacuggaauaauaaaauuacacucaaacccaugauagcauucuggggaggauuacuagagauagcggugauuaucuggauuuuagcaaggcuaaaaaaaaaaaaaaaaaaaagaacccucucauaauuucacuauagaugaaugaaauauugguuacacuagcaccacguucuacccagaguauauucagguucaaaaggcagcuuuauccauauuagagguaaggccugaaccgguuuucuaucucaugcaaggaguguagacuuucuuuaaaggcuggaacuuuuuacaauacccggcccacaucuuaugcagugcgcucaaugaaaagucaucaaacuggcuguuuaucucauucaccaaaugagaugcccaagaaggaagccacccuuugcacagcguucccuaggaugacuuggcgcuggccagucacaaucucugaggccccgggcgcagccuugcaaagacauccccaggcaccgccucuaacaggccgccucacccuccacgaacucugaacuuucaaggccccagggcccggacuccagaaaucugccugccgaccaaugacgucacuggcgcgcacgcgcauucugcaccuugccuagcuguuucaauuucuggguaggaaagccuucgaggucacgcaugguuucccaguugccuacgucacagcagucuccuugcguuccccccaccccccgggcuuccuacagugccucucaaccucuccaaagucugaaaacacccuuagcccccgcaccuguagaaggccauguugacucucuuuucuccggggaagcccagcauaccgcagacuacguggcuguugugggcacuccagccuuugucacacacuugcgaccagccuucaggaagccugacuucaaccaggcccucagucacaggcaggggucuccuuccccacuccaccgcaggucggagucgcaccuccuccacuugcaacugaugcuccaccugagaugggaccagagcaggggaaagaaucacaguagcaauacugugcagccucgaaggagcccugauugugucuguaaaacccaacggugugaccacugagacagggcugaggaugccaggccaagcugccuguguggaggaugugccccagagugcaguguguagcgguggcagaauaugcuauguucgagacauaaucacaggguccgaaggcacugagggaagcuauaauaagucugccugaagcaugaggcaaccuuuacaauggaagugucucaggaagaggaggaagaaagacauuggcagagcgcagaaaccugggaggagagggacaggugaacaggagugaaacuagagagcgcaugccagguuuaguaauuuaaugugaauacuugaaaugaauggauucgagggcuagaacucuuccugaagaccugagguucaauucccaggacccacauggcagcucacaaccuucagaaacuccaguuccauaagauccagugcccucaucuggccucucuucacuaggcauacacgggguacacagacauauaugacugcaaaacacccauacacauuuuaaaaaauuggauuuuacagugcaguacucccccccccacuuuccaagugucccagaaauccacauuauccuauaaaggcuuaugggauccuuauaugauaucucuucuaaucacauauggcacuuggcagccgugugugugugugugugugugugugugugugugugugcacgcgcgcgugcgugagugcacaugcacaaguguguacugcagaccucaaugacguuggagucugagaaaccgggaaggcgcugguccuugcagaugaccccggcauccucaucauggguacagucacuguuuccccagccccgagaggcgcauucugucacacuuccuucagucccccugcagcucagauuguccaaccagauucggccuguggaaagggagaugagcaagaaguguuugaggauggcugacaguaaugguggccucacucggccuugaggcuaauccuucuuugaugagaggaagauggggaagagacaggggacccuggggggggugagaggaaagagggugugagguugaugaaagguuacuggugaucugggaugcugaagaccugauuagggugaauuaaaaccaaaacaaccaacaacagagaaucaacauuuaugcucucaccaauaucaaucaggauucauucacuaucagcuauaacuaagucccuacuagggccaaaugcuuugccauaguauauacacaaucauucucagacugcagcugccagaagauuacuuuauauaaauagacuggggcuccgaaaaaugauguaacuugccuaagagucugacuuuucccugagacuugggaaucuuagagucuuucacuucacccuggcgucuccccuguggcguuuuucuguauaccuacguggccuacugccacagaaacccuauuuuuacuuucugggccauauugacuaucacugaccacucaaaacugggaggaaccucgcgaaaauuauguguuccagccaguguucagggcaccucaccuauucucacagggcuuuuaccuuucagccccaggaggccacguaacuaucagaagguccuugugggucuuuacaacuuuccccugcuaggucugauucaguccuuugaugccacccagaaaacccuucagccacgacuguccuuccugaauugaacccaaccgucauguaauugcuaagugaggcuuugcuuguuuguuucugugccaagcuuuugguuucuuuagcuauuccuccugaaaguggcuuucugaaagcgguuuccucucugucucucucugucugucuccaccuuccucccuccuucccuccuucucucuggaggacugaguguaggaaaguacuucugagcaucuccacuuucuacuguuggucuccaaggcuguuaucuccaaagugacacuugaucucugaagcaguggagcaacugggaacaggggagggggaucaacagcaggugcccacccaucacacccacagugugagcccauacaaucugagcacuuucagcuccagagaauugugcuucaacccucgcacugucauacuuguuccacaugaguuccugcuugcugguuuuagcucugaccugggucccgauuuugucagcuguaguauaugacccguucuggcuaggggacauucggauaccauucaccugcccucauauuaucacugagucgacugcacuuggaucacccagggcuccccugcacugggcugucuuugugcauagcucuauggagucucacuuuguggaagagaacauagcccccuucucacuguacacauggaacacuggaggcuccuggagaguacuggcuagcuucaggucacauggcccugaaauuaguauguuagaugguuuauaaucuguggguuugcuugauucugcccauucuuggugucccgugucccuuugguugugccauuaagguguuuuguucuuuucuauguacuugaacugcacuuagauaauguccgggcuaguccagagcaucgcucaccuguuccagggccauauuuggcacuauggguccacccuguggcuucugugaagcccagcucccggcagaggacaugggcagccugcagcgugaagucaucaucacagauggugccccauucaccagcucgcuguaucuccacucgaccuucauagggcuuucuaggaaagccagccagccggaaccucagccccuggcuuccuaccuucuucucugggcugauagaaggagacggagaccccacacugaagcugcacagacaguguagcagcaguaguccccaugggcagcaauaccacacacugacagcucucauggcggguggggcccaaggaggggggcacuaagggacagagaaggagagacacacacacugaaugaggguaggaacacaaagaaaacaggcacagcccuagagaccuagauugggggcgagggagacucuccuuucccuuugcaaauaauaaaacuuauaacuugugguuagugucccaccauaaccuucccugguuuggccaucauuaccaccaacaccaucaucucuauuuacuuucauccaugggguggguauggguuagagauggagagucuacggauggguuggguaaacagagauauugggaagagacacagagaggacgacccagacaggaugugacaggaagggagacugugggaacgaaggggaaaaaacagaaaggcacggggugagagacacauugaauauggauagaugguuuuaaucaaaccaaaaaaaccaaagcacagaguaauggggaaugacacagagaggcaaaaaccaugaggagagggaauaaaagccaaggugcaggcacaggagaaaugacagcaagacccaugcaguuagacagacagauggcaucacaggcaaggggagccugggagcccagcccuggaaaucucagcacuaugaaugagaagacucuucaguuuccuaugggggcagaugcccaugcaggaagggccgaggcuaaccggaguaggagaaccuucugccacccucccuagcacaugggcuggcaaauaugcugcagggucagggacuccaggagaccuaggcuucaagcugggcaggguuugguauggaguuauccaagcucccuggaacaccucuuuuucugucacugggcaaccagaagcuagggcuagcuccccagcucaggccuucucuauccgaggcugaaaacaguccuccacaguaaggggggcccuccauugcuucccccaacucagacaagacagcuuuguucugggggcauuuggcuccgaagcccugguguucagcguagggccugcaaauugcacccugaagccuccauccccaacaguuugcucagcuuuccacucuucuguuucgcuccuugaccaauaauaaaacugucaguugguuggcuuucccgacuccaucccaaaucagcguuucuccugguccaccauccucuccauccccaacuccucuucccgcuggccagcaguaacuccccuaccuucgacuaggcacaacuccagaggcuggaagcagaguccugguccuggagauuacuuucaggacuucucagaaaaaaaguguucggccaggggagacuggacccccccuuccucuccccucuucguuggucccucccacguccccuagagcccucccacauuccgcuuucucccuccauuccggccaggccaguucccuccucuagaucuuccccuccccuguggagcuggcugcagccacgccacccccucccacuccucccggcucaaugaagcuuucuuuucccgcagguuggaggcccggcagccguauucagggugcuugacuugcaaacgguuucgggacagcaggacggccccuguggcaacgggaagcuuuccagcccguagccguuccuccacauccccaacuagacagaguaucaacaacaguccaguccaauucccgggcugggccaugagaaaaggucccacaaagaaaacuauugucccgauggcucccuuggucauu

SEQ ID NO: 3108 - RNA, 4010 nt, Mus musculus
cuuuugacuguaacauguugcuagguauaauuuuauuuuauauaaaauguguucuucggagcccaggacugaugcagcgguuagagggacuugcccuccgcagguucacugacuccuccucuacccacaugcacucagaaccuaggcuaggaaagcaaggaggagaucagggcaagagcuucacacucuugccgguccagucauucauucugugaccucgggggucacauauaaggucagugucucugauccgcgccggauccgcacugccagcugugauuggguucgaacagcuucauaaacaucuucagcauuuugugccaauuucuccccaauggccaagaucacaucaccaggccgcagaccagcccuguggaggauggacggggcaaggagagaauagacagagaaguucaaggauacauccacccaucccaucccacccaacccccccccccagagcacgcuccccaucaccugugugcgggggagcccaggauaacuuuaugaaugaggacaccaugcugaacaucagggaagcuuggcucacggagcuguaguucaauaaggaugcugaaagggcacagacacuauuagcuccacacaggcccucucccaucuuaauaguucaccuucugccuucuagagcuuaggaagugggauauacacauaaaagauagcuaauuucgaaagauacaugguguugaucaacuucacuucugucauccugaaggguuagaacuuaagcugagccuagaaggguggguccuaccaccuuacgaaauaagguauugagacauagaaguggaaaaugaaaguaguuccgaagaaacggcaagcugucuggaaggauaacgagaugggugggaaugggcgggaaugggccuccagugcuaggucaauguuggcuuuacaucacagcaauagcaggauguacucaaucuacugaaagauccagaugcagugggaugagaaaguuaugagagggaacagugcuugugacagaagacaacagcuuaucuuaggaaaaaacagacaugagagaaaacccaagaaaaggauaggguguguguaugguguguguguagggguguguguguguauguauguauagguguauauauauauacauauauauagauauauguauauaucaccacacuaacauacauauauauguauauguauauaucaccacacuaacauaccugggagucagggucagcaucaucacuccaauguagcggcgcugggacccacugguuccaaaccaggaaucuguaauaaaagaggacaaaugaaccgccccccagcuacauucuuucccuuacuuucuaccagcacaccccucuauaccaagccccagugaaugcccuccccuaagucccauccuccauuuuaaaggaaccccuuucccuguaagacaggcucacuuuucuuuuccccgcgaugcagaaacucccuaaggcgaucagaagggauggcaaaggagauuccagcugucaccuucaugguguucacuccaaucaccuccccauccugcagggacacagcccccuguccccuagcccacacagauggcagaggaugggggcaccugaacaagaguagcaaggauuuggggacagaagucugucugucugucugucugucuguauaccaggagaggaacaagagacuagagacuuagcuaaaauucccuaaaucagaggaaaacccacacuucccacacuaaccuggggcauggauucuuagaagaacacggacacucaccagguuaaccaggggaccaccagaauuuccaaacugugagauaaaaugaaagaaaacaucaaaaagaucuggaaucccaugcucugggaauucuaagaccgaggacauaaacaggguguagggaaauuuuucaaauuccauuccuagcacaugaacuagagaggcugccuuuugcagcccaaccucugauacaggcccagucaccaccacgugucaguuggugcucauacccaacagcuguucuccccaauuccaaccuuagcaccuaauuucccucauaucaggacgcacaucaauagcugcaucggucugaauguauuccacguuguuuugagggagucccaggucccuggcugggcgcugagcagagcugacaauaccagaugugaucguguucugcagugcaaaggggcuucccauggcaacaacaaacuccccuugccggacaucagcagagcggccgaggggcagugugggaagaggcuccuuaagggaaacaaggccagcaaaacuggucauuuuaagaagggagcaagagaacagcugccaucagaucuggccuacuccauccccaccuugguuugaauccucaguguggcaaugucugcuacgggauccacagcugugaccauggccucauaaguauccccgcuaggcagccucacucguacucggcgccgaucagccaccacgugggcguugguaacgaugagcccaucugaagccacuacgaauccugauccguuugagauggggacuucacggccggagaaagggugccugggauggggaaaguacccauuacacugcagcuuccaccucauccugcucccuugccuucacuaacggcaguucaacaccuccuggucaacuucaccauuaccggucuaggaucucgauauagaccacagcaggggcugucuucuccaccacaucugcgaugaaauuguacuggcuccggggagaaguggguggcggagcaggaacagcagccagcaccguggaaagaccccgaccccaaccccacaacagcagcaccacugcaccuccugcgcccaccgccaccgccagccauucgcgccgacggcuuccagggcuccugcgggccuccuggucacuggagccugaaguccccacauucaaucgugcccagagauccgggguccuagacgucagaucugcccgugaugcaaggaaccccucaggcaccugggccgggagacugggggucccauaagucauccagaucugagagucaggaguuccugacgucagcagagcccggaggucaggagcuaacaggggaggcuuccuccagaagaugccccccaaagcccgccaugcccgaaggcuccaguuugcaccccgccccgcuuucagcgcagccaucagcuccgccucgacucuccucgcccgcccuacucagaggcgguccucuagaacccggcaagcggucuaggagaagcagggcacgacgguagcuguucagcgcaugccgggaaacguagucccgucaggacgcgcuccucuccagcauacgcacacgcucacacacaaacacacacacauacacacacauuccccggggccgcgaggcaugcugggaacgcuagcccuuccggggcgccuccgggccucagguucuggcgucucggcggaugcccaaagacuccgccuucccaggggcccccgcggcccugcgaagauggcggcgacagcggccccgcucuccugaagcggcugcgauggaaccucccccagcuccggggccggagcggcucuuugacucgcaccgguaagcgcugcggagggaagagaccggucagcgcguccugucagcuucggcgccugaucgcgucgccucucgccacaggcucccgagugacggcuuccugcugcucgcgcuacugcucuacgcgccggucggccucugccuccugguccugcgacucuuccucgggcuccacgucuuccuggucagcugcgcucugcccgacagcguccuccgcaggugcggaccgcggcgcccgggggagcaucggggcugggcugggcucuggaccgcacggucaccgccgccuguguccccagguucgugguacgaaccaugugugcgguccuggggcucguggcccggcaggaggacuccggacuccgcgaucaccgcgucaggguccuuauuuccaaccacguaacaccuuuugaccacaacauagucaaccuccucaccaccugua

SEQ ID NO: 3109 - RNA, 4010 nt, Mus musculus
uacagguggugaggagguugacuauguuguggucaaaagguguuacgugguuggaaauaaggacccugacgcggugaucgcggaguccggaguccuccugccgggccacgagccccaggaccgcacacaugguucguaccacgaaccuggggacacaggcggcggugaccgugcgguccagagcccagcccagccccgaugcucccccgggcgccgcgguccgcaccugcggaggacgcugucgggcagagcgcagcugaccaggaagacguggagcccgaggaagagucgcaggaccaggaggcagaggccgaccggcgcguagagcaguagcgcgagcagcaggaagccgucacucgggagccuguggcgagaggcgacgcgaucaggcgccgaagcugacaggacgcgcugaccggucucuucccuccgcagcgcuuaccggugcgagucaaagagccgcuccggccccggagcugggggagguuccaucgcagccgcuucaggagagcggggccgcugucgccgccaucuucgcagggccgcgggggccccugggaaggcggagucuuugggcauccgccgagacgccagaaccugaggcccggaggcgccccggaagggcuagcguucccagcaugccucgcggccccggggaauguguguguauguguguguguuugugugugagcgugugcguaugcuggagaggagcgcguccugacgggacuacguuucccggcaugcgcugaacagcuaccgucgugcccugcuucuccuagaccgcuugccggguucuagaggaccgccucugaguagggcgggcgaggagagucgaggcggagcugauggcugcgcugaaagcggggcggggugcaaacuggagccuucgggcauggcgggcuuuggggggcaucuucuggaggaagccuccccuguuagcuccugaccuccgggcucugcugacgucaggaacuccugacucucagaucuggaugacuuaugggacccccagucucccggcccaggugccugagggguuccuugcaucacgggcagaucugacgucuaggaccccggaucucugggcacgauugaauguggggacuucaggcuccagugaccaggaggcccgcaggagcccuggaagccgucggcgcgaauggcuggcgguggcggugggcgcaggaggugcaguggugcugcuguugugggguuggggucggggucuuuccacggugcuggcugcuguuccugcuccgccacccacuucuccccggagccaguacaauuucaucgcagaugugguggagaagacagccccugcuguggucuauaucgagauccuagaccgguaauggugaaguugaccaggagguguugaacugccguuagugaaggcaagggagcaggaugagguggaagcugcaguguaauggguacuuuccccaucccaggcacccuuucuccggccgugaaguccccaucucaaacggaucaggauucguaguggcuucagaugggcucaucguuaccaacgcccacgugguggcugaucggcgccgaguacgagugaggcugccuagcggggauacuuaugaggccauggucacagcuguggaucccguagcagacauugccacacugaggauucaaaccaagguggggauggaguaggccagaucugauggcagcuguucucuugcucccuucuuaaaaugaccaguuuugcuggccuuguuucccuuaaggagccucuucccacacugccccucggccgcucugcugauguccggcaaggggaguuuguuguugccaugggaagccccuuugcacugcagaacacgaucacaucugguauugucagcucugcucagcgcccagccagggaccugggacucccucaaaacaacguggaauacauucagaccgaugcagcuauugaugugcguccugauaugagggaaauuaggugcuaagguuggaauuggggagaacagcuguuggguaugagcaccaacugacacgugguggugacugggccuguaucagagguugggcugcaaaaggcagccucucuaguucaugugcuaggaauggaauuugaaaaauuucccuacacccuguuuauguccucggucuuagaauucccagagcaugggauuccagaucuuuuugauguuuucuuucauuuuaucucacaguuuggaaauucuggugguccccugguuaaccuggugaguguccguguucuucuaagaauccaugccccagguuagugugggaaguguggguuuuccucugauuuagggaauuuuagcuaagucucuagucucuuguuccucuccugguauacagacagacagacagacagacagacuucuguccccaaauccuugcuacucuuguucaggugcccccauccucugccaucugugugggcuaggggacagggggcugugucccugcaggauggggaggugauuggagugaacaccaugaaggugacagcuggaaucuccuuugccaucccuucugaucgccuuagggaguuucugcaucgcggggaaaagaaaagugagccugucuuacagggaaagggguuccuuuaaaauggaggaugggacuuaggggagggcauucacuggggcuugguauagaggggugugcugguagaaaguaagggaaagaauguagcuggggggcgguucauuuguccucuuuuauuacagauuccugguuuggaaccagugggucccagcgccgcuacauuggagugaugaugcugacccugacucccagguauguuaguguggugauauauacauauacauauauauguauguuaguguggugauauauacauauaucuauauauauguauauauauauacaccuauacauacauacacacacacaccccuacacacacaccauacacacacccuauccuuuucuuggguuuucucucaugucuguuuuuuccuaagauaagcuguugucuucugucacaagcacuguucccucucauaacuuucucaucccacugcaucuggaucuuucaguagauugaguacauccugcuauugcugugauguaaagccaacauugaccuagcacuggaggcccauucccgcccauucccacccaucucguuauccuuccagacagcuugccguuucuucggaacuacuuucauuuuccacuucuaugucucaauaccuuauuucguaaggugguaggacccacccuucuaggcucagcuuaaguucuaacccuucaggaugacagaagugaaguugaucaacaccauguaucuuucgaaauuagcuaucuuuuauguguauaucccacuuccuaagcucuagaaggcagaaggugaacuauuaagaugggagagggccuguguggagcuaauagugucugugcccuuucagcauccuuauugaacuacagcuccgugagccaagcuucccugauguucagcaugguguccucauucauaaaguuauccugggcucccccgcacacaggugauggggagcgugcucuggggggggggguugggugggaugggauggguggauguauccuugaacuucucugucuauucucuccuugccccguccauccuccacagggcuggucugcggccuggugaugugaucuuggccauuggggagaaauuggcacaaaaugcugaagauguuuaugaagcuguucgaacccaaucacagcuggcagugcggauccggcgcggaucagagacacugaccuuauaugugacccccgaggucacagaaugaaugacuggaccggcaagagugugaagcucuugcccugaucuccuccuugcuuuccuagccuagguucugagugcauguggguagaggaggagucagugaaccugcggagggcaagucccucuaaccgcugcaucaguccugggcuccgaagaacacauuuuauauaaaauaaaauuauaccuagcaacauguuacagucaaaag

SEQ ID NO: 3110 - RNA, 3343 nt, Mus musculus
cgguccucuagaacccggcaagcggucuaggagaagcagggcacgacgguagcuguucagcgcaugccgggaaacguagucccgucaggacgcgcuccucuccagcauacgcacacgcucacacacaaacacacacacauacacacacauuccccggggccgcgaggcaugcugggaacgcuagcccuuccggggcgccuccgggccucagguucuggcgucucggcggaugcccaaagacuccgccuucccaggggcccccgcggcccugcgaagauggcggcgacagcggccccgcucuccugaagcggcugcgauggaaccucccccagcuccggggccggagcggcucuuugacucgcaccgguaagcgcugcggagggaagagaccggucagcgcguccugucagcuucggcgccugaucgcgucgccucucgccacaggcucccgagugacggcuuccugcugcucgcgcuacugcucuacgcgccggucggccucugccuccugguccugcgacucuuccucgggcuccacgucuuccuggucagcugcgcucugcccgacagcguccuccgcaggugcggaccgcggcgcccgggggagcaucggggcugggcugggcucuggaccgcacggucaccgccgccuguguccccagguucgugguacgaaccaugugugcgguccuggggcucguggcccggcaggaggacuccggacuccgcgaucaccgcgucaggguccuuauuuccaaccacguaacaccuuuugaccacaacauagucaaccuccucaccaccuguagcaccgugaguggggggcgaggccgagagcgccaccggguggcuccccaggcccaagcucaaggcuccccuuuacccauugggauucucuuggggaacaccgagccuuucccccagccccuuaaucgccaccucacgugucacccuuuuccucuuucuuucugucuuuuccuuucucuuucucuuuuugacauuuccuuccauucuucuugcuuuuucuccccguucucagccucuacucaauaguccccccagcuuuguguguuggucucggggcuucauggagauggauaggcggguggaguugguggagucacucaagaaauucugugcuuccacgaggcuuccgcccacaccuuugcugcucuuccccgaggaagaggccaccaauggccgagaagggcugcugcguuucagguggguaagcgcaggcaucuggcuccaguugagugggugcccuaguuccuuuccugucugcccacuuuuagcccugcccucgaaauucuuaauuccucaguugucugcuuauggaguuggacaguuuacuaguuuaagucagauauaagugguuggcugggcuaggcugaacucccauacuacucgcucucucucccucucucuuaguucguggccauuuucuauucaggacgugguacaaccucuuacccugcaaguucagagaccccuggucucuguggugagugcaugcuggacagggacuacucuggggucuggaagggaaguuucccaccuguggcccuggcuuagaccucacuucaugcccuccccucagacggugucagaugccuccugggucucagaacugcuguggucccuuuuuguuccuuucacgguguaucaaguaagguacuaacuguccuccguuuuugguggcugggaagguguucaccucaagggcauggaaguagugaccacuauccugucugccugugguuuguuaaugucgaaguucuaacagaagcaacacuuaucuucaucucccuacucuccccaccacuguuccaagauaaauggggaagggccauacccuuagccccugucgacuuaacagggcagggcucugguuuuuguagguggcuucaucccauucgucgacagcuaggggaagagagugaggaguuugcgcuccguguacaacaggugguagugaacaggggugugguggaagugggggggucccucccuccuggggagaaggggaagaagaccugacgaggcuacagcuauaaccuuccaauucucccuagcugguggccaaagaauugggccagauagggacacggcucacuccagcagacaaagcagaacacaugaagcgacaaagacaccccagauuacgcccccagucaggugugugaucugggcacaaagaugcuugcugcgcuuggugguuuugcuucccuccuuacgcgugucugccucucucaguaauccacucaccucauuuuuuuuucuuuuaaacagugcagucuucuuuuccuucuccucccagcccuucuucugaugugcagcugaccacucucgcucacagagucaaggagguucugccccaugugccauugaaugucauccagagagaccuggguaugggaaaggguagcaucacagaauggcagacacaggaaaaugggucucaacagagaagggguacagggaguggacacucugccccucucuucccagccaggacuggguguguagacuugaccaucacaaaccugcucgagggggcuguggcuuucaugccugaagaugucacugagggaucucaguccccgccugcacccucugccccaaaggugagaccuggaguagucaaggccaagacuuaagggcaggucugggcagucucugcucccucucccugacuucucgccuugauguugagacccuagcacagugccucucuugcaaaguaggcauucgauggguguauaaugaugaugacuucgcaagcccucugacauugugaucaccucaguuccccagcucgggccuggcgaccccucagcccacagcccuaacguuugccaagucuuccugggcccgucaggagagccugcaggagcgcaagcaggcacuguaugaauaugcaagaaggugagaggguuagaggacaauaugugagaaagaacaaguuggagaaaggccugaugaagcugaugugacaaagccuauacacucucucccccaugucccacaggagauucagagagagacaggcccaggaggcugaaugagcccaaaggaacaggaugguacccagagccgcaggacggagacugggggcagcccucacccagcuaacaacaggccggaugagugggugguaaaaagggagggauggggcucccccaaucucacauuaaauucaggguuuucacucaaggucucuguugccucuuuggguuucaaaagccccuugagcagguuucuuuuccuggguugaagacuacaauaugggugagaauggucaaaauggaacugugaaauuacacuaaacugaagacaaaac

SEQ ID NO: 3111 - RNA, 1979 nt, Mus musculus
ucgggaugcgagucccagagcggacucccgggaggggcgggcacacgcgcggcugcgcccugugcacagggauguugcugucccgggggccccggcgcauggccguggccagccccgcgggccccugaagccucugcccugagcgcgccgccgccgggcucccgcagccgucagaaacaccuuuuccagucauccaaccucucaggcuuggacccauggagcccgcgguguuggcugcgcaccaccuuccgcaccacgaacccaucagcuucggcaucgaucagauccugagcggucccgaacccccggggggcggucugggucccggucagucgggccagagccacggagaaagugcggcguuuuccaguggauuccacggagccucgggcuaugcuccagccggcucgcuggccuccuugccuagaggcucgggagugggccccggcggcgugauccgcguccccgcgcaccgcccgcugcccgugccgccacccucgggugcggcccccgccgugcccggacccucugguuuggguggcgccgggggccuagcgggacucaccuuccccuggauggacagcggccgccgcuuugcaaaggacaggcucacgggugagauugcccuaccccucgguguccuucccccgcgaccccauuucuuugcuucuccauuuucugcuccaaccccauugcccgguuaucucuccccucuguucauccgcguggacccuccccgaccccacaguucucggucccacagcagagaggcaguaaggagagagcugcugucgucgggugcaugcaccccugccucugcagucccaccgugccuacggcgaggaggggcagggugaaguuugggaggaccccgauucuuccuaagcccuuucuugaugaggcuucugugguugggggaggaaccccgauaaggacuagggacucucuucucagucucaccucggacuacccccaaacauugcccugcucuuccgucccguagcugcgcucucgcccuucucugggacacgucgcauaggccaucccuaccaaaaccggacccccccgaagcgcaagaagccgcgcaccuccuuuucccgcucgcaggugcuggagcuggagcgccgcuucuugcgccagaaguaccuggccuccgcagagagggcggcgcuggccaaggcccugcgcaugacggacgcgcaggucaagaccugguuccagaaccgacgcaccaaguggcggugaggcgcggggcgcgggcgggccgaguggcgggguaggaccgggacgcccgcugaccccggcucuccgcucgcccaggcgccagaccgcggaggagcgcgaggccgagcggcaccgcgcuggucgccugcugcugcaccugcagcaagacgcgcugccccggccgcugcggccaccgcugccaccggacccgcuuugccugcacaacucgucgcucuucgcgcugcagaaucugcagcccugggcggaagacaacaagguggcuucgguguccgggcucgccucgguggugugaccgacaccugcccgacgagcgccaacguggccgggugccguaccgccagcgaagagugaggagcagaaggcccgcggcccgcggccguccucugaggcucuuuggucaucaguggccccuggcccacacucugacuccgcccuucaagguuuuguuuuguuuuguuuaaaaaaaaaaaccccgcugagauguggguugcaagagcaaccugcaggauuguggaugaagcagggacccugcaaggcugcgacuuugcccugagugggcucagagcucagguccugcugggaagggaccacagagcugguguaaaggcagauaucaaaggacagcgggggagggguaauggaagaggcgcuggcaguagagaauguggccuacugugacagggaccucgucccucaucuguaaaacaauaacuaaggauuccuucuagccucag

SEQ ID NO: 3112 - RNA, 3061 nt, Mus musculus
agcagggagagaguggggaguaagagcucccgguuccccggggggucucucccucuccaccccgcccagggcacccucucccagacuucgcgagcccggaaaaaacucccgcggcgcagacgggagaaggcccgcggcugggacgcagcuccgcaacgcggacgccgcagcggagcaggacugcacuguauagagaggaccccgggucggaggcgaggucgggucccaggacucccacacuccggagcuguagcggcgggcgauagcccggcuucggggucccagggcacacaggcucucuuagcacaagcuaccgaaguugauccagagguugugugcgcgccguuggaaggacgcccgugggagcgugcaccgcagagacccugcuucacucaaccccccuccauaacgaccaccgauuguugggggggcagcgggcucaggugagcacacggggagcuaaagagggggcgagggcggggugugccggaaaacuagccaauccggagaaugugaggcccucguugcuaggagacaagucccgccccgcaggcgguaccggaaguggcgggcugggaucagccuuuaagauggcgucuccucaggggggccagauugcgaucgcgaugaggcuucggaaccagcuccagucaguguacaagauggacccacuacggaacgaggugcaggggcagcgggaugacugcugggguccguuagcugugugaacccaaacgaaggagaggacggguggcggcgggaugggcgcccagugcgcuugcgcagccacggggugcgcgauacgcacgcgcgauucuggccgaguugccaaacgcuggacuuggacgcuugcgcguugugucuccgacagcgucuggucucccgagggaaaaaagagagucaggcggguccgcgaaaagagagcacccgcugugcgcggagcccucugcugggcgaagggggagcucacucccccgucucuucucgggggccagacgacccaguccaauaacaaacugcucuguugcugggaauugcagaaggugagauggggugggcuugcaagaccaguggggagugacugaggguguguccacaggaggagguccgggugaagaucaaagaccugaaugaacacaucguuugcugccugugcgcgggcuacuucguggaugccaccaccaucacagagugucuccacaccugugagugucccggauccugucucuccucuuccaagcuggcugccagccucugugcugccugucccaugugucggguucccaagggaccugagcaucuucguuucuccucuuacagucugcaaaaguuguaucgugaaguaccugcaaaccagcaaguacugccccaugugcaacaucaagauccacgagacgcagccguugcucaaucucaaacuggaucgggucaugcaggacauaguguauaagcuagugccaggcuugcaagacagugaguggccaccuuauauuuguggggccuccugacucuaaugcuggguggcaccuugacguuuuguucccaacaguuuuguugggaaucaaaaaaauacaaagauaaagaggucaacagccaaaacaaagagaauuaauauggcugcccuucaccccuccuuaggugaagagaaacggauucgggaauucuaucagucccgaggcuuagacagagucucccagcccaguggugaagguauguccuuggugcucauuugggggaggggggcaauuaaagcccucagagcaucucuuuugccugguuuugcucucuggggagaagaggguauggaaccuguaccagccuccucaauaucuacuuuuccucagagccagcccugagcaaccuuggccuccccuucagcaguuuugaccacucuaaagcccacuauuaucgauaugaugaacagcugagccuaugccuggagcggcugaggugaggggcaggucagagguugcgugaagugauacuacuggugacccagaugcuaagggacuuggggggaagggugagggagugucugcuccccugaagaaagugugcuguggugcuugugcuagguaggagacaagaaaaguggaacccucuaacuuguaucuguuuccauccaguucuggcaaagacaagaauaaaaauguccuucaggugagagggguugaggggagggccccuuugaaggagccguuucucccagcaacccuucccucagacaccugugcccuccccuccuucucuguuccuagaacaaguauguucgguguucugugagagcugagguccgccaucuccgaaggguucugugucaccgacuaaugcuaaauccacagcauguaaguaagcccaucauguuacggggaaaacaagggacugaaaggggagggcaugucuggcuugccagcuuguaccuggaagaaagcucaggccggaagaucacuucaaguucagggcuagccuaggcuauauagugaauuccaggcuagucuggacuccagaguaagacuuuguuuacaggagcaaaaaagguuugagagcggucugcucagauagcuuagucaaguauuugccuuucaaguaccaggaucagaguucaguucccagaccuaaaaacaaacaaagaaaacccuagcauaguagugcaaacuuguaaucgcagcaguggagccgcacagaggaagagacggacagagucuagggacaagucucuguccagcacuacuucccugcccaucucccucuuagguacagcuccuuuuugacaaugagguucucccagaucacaugacaaugaaacagcuauggcugucccgcugguucggcaagguaagccgggugcacagugggcugaggggccagcaggugcugagagcccacucacuccuucuuucccuuuucuccuuagccaucuccuuugcuucuccaauacagugugaaagagaagaggagguaggggccaggcuugcuuccacccccuucccaccccuccccagauauuuaugugaaauuaacuguggcuuuauuuuuugaaauaaaugcuuuuaaaaagcac

SEQ ID NO: 3113 - RNA, 1881 nt, Mus musculus
cuugcagcagcagaguggcggcuuuauucuuuaacgaguaagaaaaguaggaguguggaguaagagacagaacagagcuaaauggguguuuacccuccacccgggaacccagacaaggccucuagcaggggguccagggcccuaaaauccagggcugggcagcagcuucacuuucaaucguccaccuguaucuccucaucugauaaguugggcucagaaucgggcccugaagggccagggucagggcuugaagugcugucuggcagugcuggguaacacaggacuccaggggacaacccgcauagggaggccacguccgcgcgcaucuccuccacaucccgcuugagcuuggcgcgacgguucuggaaccaagugaccacuugcgcauuagccaggcccagucgcgcagcaaguccgucgcgcucugacggugccaaguacuucuggaagacgaaucgccgcuccagcuccagcaccugcugugcagugaacgcuguccgagacuugcggcgucuccggacaccagcgccaggccccggcggcgccuccggggcggcucugccugccaggaugagacggaaaugucagucucggcuuuggaggaggcugaggucuggauggaaaaacuuagggucgcggggcuuaagcagguagagggagcggggugggccagcaucacgaucccuauacaccgggucagaacccggauucgaagugcagcaggccugugggaaugcugacgacagagagaugagauuacuccagcggguagagggugagugggacugaccagagaucugguacgagagucaagaccguuuggagaaggucucugacgccguuuggagcuccaggcugugcgugguaguaaguuagaggccaaauugaggucgggugacccaucuggccaaauaaaguccuuaacaccagcucucuuuccgggagcccaaagggaaggaaggcaggcggaaggcgguuccugugcccaauagugcugcaaaggaucuucuacagggcucaagaagugacuggggcuggggcuggggcuggggcuggggcuggggcuggggcuggggcuggggcuggggcuggggcuggggcuggggcuggggcuggggcuagguagcuggggcuagguagcugggaggaauuuucugccuuguccuagcccugccucagucuuuucuugccagcagcucaagcguuuuuucucuuccacagccuuucuuggucaugauuaccccgcauacagcgaacguaccagcagccgagcgggucccuggauucgcuccagccuggcgguaccccucagccccugccacccccuggagcaauugcagucucagaacuaacucaggagaccugccgagcccugucaaaugcaacuccugacacuugggcagaaggcaggggguggguaaaaaugaccagccagggccagacaaaacuuugugaccaaggacgagagagugaagcgggggguggagggagagacagauauagacagggacagacagacagauccgcgcgcgcgcgcgcacacacacacacacacacacacacacacacacacacacacacacacacacacaguucaaguccgcuacuuggcuggcguguaccuucagaaggcugugguguagcccgcggggaauggcccaggaaaguuuuacuugcuagcuccuccagcgcacacaguggugacgcgggaucagggccggccucgggaagcugcggugcagaaggugcuucggggaccaugcucggaccuaggaugucugcgauacuaaaggguguccggcgcugauguacagaguucauggcaagcgggauuguagcgaucccgccuucugcugcgcuuggcuucacaaccuccuaggc

SEQ ID NO: 3114 - RNA, 8426 nt, Mus musculus
agaguaaguggguggccaucuuuguuaggggcagaggucguggcuacggagccccaguaagaccacgagacuuccggcuagcuggugaguccuggcgcccacgggcguggagugcgacgggaagcggggaggcggcgagcguuagguucguuugggacucgccgugcaaauggcacgggcguccagcucuaguggcccuuugccuccacucgcuaacguacccucgucgugggcgcagcccgugggcgcuggggaggagcgggacgaggggaggcguggagggcuagggcuacuggcugcggugagcgucccgugcccggacuucagcagacagccgugggcucccgcgucugcaagcggcccgaugcccuucgcucuucagcggcuccgggccacauugcuucgucugcaccgcgagcgagagcagcuccugcgggcccgggacugcgcccgccaccugcaggcggucgugcggcugcuccgcuccggcuccucggccgguucccucucccugcagcaguugcacggcgauuuacagcugugcccaucucguggggcggcucugcgccucggcuucccgggcuccagggagacgcuucuccugacucgcccugucgggcuagcugcccagcacuuggaggcugccaucgagaugcagcuucguucacugggccggacacccgcuagccugggccugacaucccagcuagccgaacuguugcuggcccuucccuucuaccacacucugcagggacauucccugaacuucguccccggggccgcgcgcccauuccccgcggcccgugugcuccagcuccuggcugcagagcgggguugucagguggcagauaagcuggcugaagcccguggcggaucgggcuugcaggagcagcuccgucggcagugcgagcaagagcgagagcugcugcccgggcugcugggccugguagggggcguggcuagcaccgacagcagcggacugaggcuugggggaccuggagcccuguggagccaguauuggaccuugcugugggcagccugugcuaaguguuuggaccuacgcgugggacccugggaggacccuagagcaauggcacaagagcugagucaggcacugugucaagguaagcgagggguccgagcuggcauuuggagguuguggugagggugucuuuuucccuuuacccucucucaacuccagccugucagcaagcgcagggccuugaaugaaugaacuuccccgaguuuaaaguauagcguuuaggguuucccaaggccacgcagcuucccauagcagucuuuauuuagguuuuaguccacacuggccugggacgcuggucucagccuccugccuccggagagccaccaugccugacuugaguggagucggcaggggcugucaccagggauuuguuuccaggcuuccuucauuucucccaucagcaccccugccucaggagugugagaaggagcuguugucucugugucacagccuguuucaccagucugucaucugcagcugggaccaagguaaggagaaaaggacauuggggugacccaaggauccuguugcgcacccccucagacuauauuuugucaugccaggguucugccaggccuuaggaucagcccuggguggucagagcagcccugcgucacugucuccuaccucugagcugcugcagcggcuuuuuccuccccucuuggauagccuucgacagcccaggccagaacuuaggcuguguccgccugcaggugagacaggagguguggaaugggagggcagggggcggggcaguuguuaucuuuugccuguccucuguucugaagcuggccuucuccuggaggugaccuaugaacccuaggguacuguccuuccccucccagguccuacgccugucgcucuggggcucuguacccugcagaccaccuugcucugguuugugggcagagcucagcagcaccuggcagcgugggaccccgguuccuucuugcuccugcuccagaaggaucugccugugaguggcccagagcugggagggagcagccucccucaguggccugagcugagcccucccucucuguuucugcccacagccucuucugucugcgguggaggcgcuguccagccuggccuccgaagcagcgcucacucuggagguggagcagcagcugggccuagagauccacaauuugacugaaaagaugcaggugagugcagagaccugagaguggcagcguaagugugugccuagagaacagggcuggggaccuugcgaucuccaaucuccuuagucucugcuaaaguuuucucuguuggcuucuuguucuuuacuauggaaaaaaauucaaauauggucauaauaguaaucaacucauggucaguuaugauucauacucccuugcuacucccuaauaguguuagccaaugacaucauuguuuagacuuauuucauuagcgacugcauaauuaugucuuuuacuuuuccuaguaguguuuaauucauuauucucuuuaaaagugacauuuguauauauuauuguauauauauacauauacuauauauauacauacacacacauauacacacacuauauauauaguauguguauguauacauauacauacauuugcuugccucugcuucuugaaucugagauuaguggcauaugcccuugcaucuggcuugcuuuauaguuuuacuaaaguagcacaugucuauauuuaaagggugaaaugcaagcuggggcuguagcuaagcaacaagcacugcugaucaugcaucaucgaacuuuucuuugauuccaaucacgagugggaaggggagcagaaggaggcagcaagaugauucguuaguuauaggugcuuaaugccaagucugacaaccccagacccauaugggguaaagauagaacuaaugacggcaaguugucucugcugcauaugugagcaugccagcacauacacacacacacacacacacacacacacacugcauaugugagcaugccagcacacacacacacacacugcauaugugagcaugccagcacacacacacacacacacacacacacgagagagagagagagagagagagagagaaugaaguuaaaaguauuuuuaagcccucuaauggggagaucagcagaacagcuccacuccccucuggguuggcuguuucuucucgcccuuucucuggauuaugucagggccucauguaugccagguaagauccgugacaccaagcuaugucccccaugauuuucuucuagguuuauggacagagcuauuacuucugucuuuaucugucccauuuugcacaccacugcuuccuguugcaaaauauaagguuauguuuguguucuccugguguguuugcagggcucaaguuggcccuguccuccuggugugucugcagagcucagguuggcccuguccuggugugucugcagagcucagguuggcccuguccuggugugucugcagagcucagguuggcccuguccuccuggugugucugcagagcucagguuggcccuguccuccuggugugucugcagagcucagguuggcccucugcuccuaguguggaugcagagcucagguuggcccuguccuccuggugugucugcagagcucagguuggcccucugcuccugguaugucugcagagcucagguuggcccucugcuccuggugugucugcagagcucagguuggcccucugcuccuaguguggaugcagagcucagguuggcccucugcuccuggugugucugcagagcucagguuggcccuguccuccuggugugucugcagagcucagguuggccuucugcuccuaguguggaugcagagcucagguuggcccuguccuccuggugugucugcagagcucagguuggcccucugcuccuggugugucugcagagcucagguuggcccucugcuccuggugugucugcagagcucagguuggccccugccccuuugcucugcuucucugcuuaccaagcaucuuaacugcugugaacucccaccuuuggucuccugaaucugagacuucuaguccagcaacuguuugggauuucuuccauucuuacuguuuucucuuuaacaucaugcccuagcguagccuccuaaugagaagagcuucacauagaugguuauggaagcccagaggaggaccaguaccugaggcuuaacugcuggcugggcagccucugaguagcagaagcaggcuccccagacagccuuccuggggaacaaaagcucauaugcucucuuugugaguccaguccucccucccucccucuccccuccuguuuguauucaggacugugugugucaggaaaugguguggagcuuggcagaguagccaguuagcauuacauuguuggaggcagggccaggggugcuaguguauaccuuuaaucccaguacugaggaggcugaaacaggauuugaguuugaggccagccuggacuacauggaaauuucaaggcuaguuugggcuagacagaugggaguggggaaauucugugcuggagagaagggagaacagaggcacacacaugucugaugugccagggacccagugguuucuuccucucccccaugccgcagaaccucccuuuccuuagguuccggggaucauauauccacgucuuuuuccauuuucuuuuguuuuuuauucccccauccuuuuccuuucuugacucuaauguaagagucagcucaagcuggccucauggaacuugucauccuccugcuucagcauucccagcccuggggucacaggcaugugccacuaugcucaggucacagaacuucugccaaaugccccauuuuuuuagauucuccaaaaaucuaaagccgggcgugguggcgcacgccuuuaaucccagcacuugggaggcagaggcaggcagauuucugaguuugaggccagccuggucuacaaagugaguuccaggacaaccagggcuauacagagaaaccuugucuggaaaaaacaaaaaaacaaacaaacaaaaaaaucuaaacaacacaaccuuguuaucaccaucuucuucccaccccauuuuuuaaaaaaagauuuauauaugcaaguacacuguagcagucuucagacacaucagaagagggcaucggauuucauuacagaugguuaugacccaccaugugguuucuaggaauugaacucaagacucuagaggagcauucauucagucacugagccaucucuccauccccuggccauugagcuucuaauacucugauucuacuuuccaaaugcugggagucuagccgcaugcccaacacgccugacuugucaugugccuuugauuacuaaggaaaccucuaauccuagguacugugcaugguuuagguccagaccuccuuagaaaaugcccaugcucccacagugaggcaucaggguuuuacagaugcccacacugagaccucagagagagaaacaccauucccagucuaauagacuagcccuucuuacuuucuuccuccccauacagcuccugcccaaagaaucacugggucuguuuguccaagaaugccauaaacaagccacacaaggcuucaagcuccacaugccgaggggucgauacuggagacuucgauuguguccugguaauuuuucuuucuuccuggugcuggaaaugaaacacaagauuucacacaagcuagacgagcaagccuugcugagugagcuacaacccccagcccacugucuugguaaucucucacuuccaccuuucuccuucggguuccugguauaaaugguccaagcccuccccaguuguggcuccacaccacugucaacaucuuuguccuuacccuuugugcccuuccuucccucuggagcccacuggacuucugcagucucuccaucugucuuuucucuugucucacuccagaaccucccagugacccuagugaguacgcucggauaguggucuacucuguguuggagccuguguugcaaggacuucagggauugccaccugaagcccaagccccugcccucggccaggcacugacagccacacugggcgccuggcuugaccacauccucacccaugggauccgguucagguaugaaggaaagaugcuaguggcagaggaagaaugccaaacagggaaaauggagaccauuugggcagagcagucuggggaggcagaagugucugguggccacauuguaccuggacaucuagccugcagggggcgcugcagcucaagcaagacuucggaguggucagggagguucuggaacaagagcaguggggccugucgcaggagcuucgccagacucugcucucacucagcaucuuccagcagcuagauggggcccugcugugucuccugcagcaaccccugcccaagaauccaguccacagaagaccuccccguugcugugaguuaucaccacuccucaaccccaggcuuuucuaagcccuuccaggggugcuuucgaacacccacacccaaucucaccauugcuuuggcgucagcauuccccaccaaccugccguccacuccugccuucccaggucucuguuaugagguccagaccacugaacugcccaccagcagccucaacagccuggaaaacuuggcacccccucuucgucuuggagucuccccugcccagaacacucaccugcuaagcacccuggggggaggaggacgaggaggagggggagggggaggaccaggaccuaguccugaggcuuaccuggugggaaaccagcaagccuggcuugcccugaggcugcaccaacacccacguuggcaccugccuuuuuuuucuugccugaggacaaguccugaacccuaaguugacuaggaccagggguugcagaucaugccccagacaaggaacuguaugcuagagaagcuuaaaccugggugcuugauaaaacauguucauaaacuagaguccagaauugaacccccagaucauccuaggaucugcaauccagaguaauaggcaaacuacagccugaaaucuggaugucggaaacaaugaagacaucuuggagcuaaaacuagaaggggucuacagggcuagcgcucaggagacaggcaaaccuugcuuucucucgaaucccaggagcaaagcgaaaacugauucaugaggaaacacagacaaagcagacauuucuacacguggagggcagucuuaccccuuccccgucucuguuucuagucauuaggcuguagggccuggacauuuaagccuuggcuguugcuacaggggcagggcuugccuucugcuggguggacaguccccgcagugacauccuuuccaaggaaggagccaggaugugggguggugcugaccuagaucucgcaggcaggaccccgagggagagggcugaaggacguuuuccugcgaaggggauuuugcacauucacugcuuaugcuguguggcacagaacacugcuaauggcugaaguauucgcggguggccccggaggucagccgcgcgaaguaccgcggagccgccggaagcgguccguuccaauaaaccgauccccagugcuacuccuuccgggguggagguaaccauggcggcggcuuuggcucggcucggacuacggccggucaagcugguucgaguucaguucugcccguuugagaagaacguggaguccacgagguacggguucuggggaggugggaggcguccguguuccccacgcgugcgcgcgcacccucgucccggcucccuggucccccggacgcgcucacgcugcccuccggccgcaggaccuuccuccagacggugagcagcgagaaaguccgcgccaccaaccucaacugcucugugaucgccgacgugaggcacgacggcucugagcccugcguggacguguuguucgguaaaccugguagggacgcgggugggcgagggcagaucgccgccauagcccugcauagucagggucccuaacucaucgguuugcaucucccccaggagauggguaucggcugauuaugcgcggugcccaccucaccacucaggaaauguuaagugccuuggccucccacauccgggacaggaacgccgcggcagcaucugcaccgggcgcagacaaggucgccccggguacgaguacccgccgcugauauggcagaagaguccaacaaccaaauguuagcuugaaucuaaagacagugaguggucugagaagaccugggcuuuaaucacucaaaaugcugcauggagcucaugauacggagcaagaacacuaacaacagggcuucuggggcaagauaaguaaguuuggguggugaagggccccgacaaauuggaauuuuucuuucucaguguuuaacuuuauuuggaucugucaaccaaguacauuuuaauuaaauauuuauugccaaaugaau

SEQ ID NO: 3115 - RNA, 2498 nt, Mus musculus
ucuaaacaacacaaccuuguuaucaccaucuucuucccaccccauuuuuuaaaaaaagauuuauauaugcaaguacacuguagcagucuucagacacaucagaagagggcaucggauuucauuacagaugguuaugacccaccaugugguuucuaggaauugaacucaagacucuagaggagcauucauucagucacugagccaucucuccauccccuggccauugagcuucuaauacucugauucuacuuuccaaaugcugggagucuagccgcaugcccaacacgccugacuugucaugugccuuugauuacuaaggaaaccucuaauccuagguacugugcaugguuuagguccagaccuccuuagaaaaugcccaugcucccacagugaggcaucaggguuuuacagaugcccacacugagaccucagagagagaaacaccauucccagucuaauagacuagcccuucuuacuuucuuccuccccauacagcuccugcccaaagaaucacugggucuguuuguccaagaaugccauaaacaagccacacaaggcuucaagcuccacaugccgaggggucgauacuggagacuucgauuguguccugguaauuuuucuuucuuccuggugcuggaaaugaaacacaagauuucacacaagcuagacgagcaagccuugcugagugagcuacaacccccagcccacugucuugguaaucucucacuuccaccuuucuccuucggguuccugguauaaaugguccaagcccuccccaguuguggcuccacaccacugucaacaucuuuguccuuacccuuugugcccuuccuucccucuggagcccacuggacuucugcagucucuccaucugucuuuucucuugucucacuccagaaccucccagugacccuagugaguacgcucggauaguggucuacucuguguuggagccuguguugcaaggacuucagggauugccaccugaagcccaagccccugcccucggccaggcacugacagccacacugggcgccuggcuugaccacauccucacccaugggauccgguucagguaugaaggaaagaugcuaguggcagaggaagaaugccaaacagggaaaauggagaccauuugggcagagcagucuggggaggcagaagugucugguggccacauuguaccuggacaucuagccugcagggggcgcugcagcucaagcaagacuucggaguggucagggagguucuggaacaagagcaguggggccugucgcaggagcuucgccagacucugcucucacucagcaucuuccagcagcuagauggggcccugcugugucuccugcagcaaccccugcccaagaauccaguccacagaagaccuccccguugcugugaguuaucaccacuccucaaccccaggcuuuucuaagcccuuccaggggugcuuucgaacacccacacccaaucucaccauugcuuuggcgucagcauuccccaccaaccugccguccacuccugccuucccaggucucuguuaugagguccagaccacugaacugcccaccagcagccucaacagccuggaaaacuuggcacccccucuucgucuuggagucuccccugcccagaacacucaccugcuaagcacccuggggggaggaggacgaggaggagggggagggggaggaccaggaccuaguccugaggcuuaccuggugggaaaccagcaagccuggcuugcccugaggcugcaccaacacccacguuggcaccugccuuuuuuuucuugccugaggacaaguccugaacccuaaguugacuaggaccagggguugcagaucaugccccagacaaggaacuguaugcuagagaagcuuaaaccugggugcuugauaaaacauguucauaaacuagaguccagaauugaacccccagaucauccuaggaucugcaauccagaguaauaggcaaacuacagccugaaaucuggaugucggaaacaaugaagacaucuuggagcuaaaacuagaaggggucuacagggcuagcgcucaggagacaggcaaaccuugcuuucucucgaaucccaggagcaaagcgaaaacugauucaugaggaaacacagacaaagcagacauuucuacacguggagggcagucuuaccccuuccccgucucuguuucuagucauuaggcuguagggccuggacauuuaagccuuggcuguugcuacaggggcagggcuugccuucugcuggguggacaguccccgcagugacauccuuuccaaggaaggagccaggaugugggguggugcugaccuagaucucgcaggcaggaccccgagggagagggcugaaggacguuuuccugcgaaggggauuuugcacauucacugcuuaugcuguguggcacagaacacugcuaauggcugaaguauucgcggguggccccggaggucagccgcgcgaaguaccgcggagccgccggaag

SEQ ID NO: 3116 - RNA, 2498 nt, Mus musculus
cuuccggcggcuccgcgguacuucgcgcggcugaccuccggggccacccgcgaauacuucagccauuagcaguguucugugccacacagcauaagcagugaaugugcaaaauccccuucgcaggaaaacguccuucagcccucucccucgggguccugccugcgagaucuaggucagcaccaccccacauccuggcuccuuccuuggaaaggaugucacugcggggacuguccacccagcagaaggcaagcccugccccuguagcaacagccaaggcuuaaauguccaggcccuacagccuaaugacuagaaacagagacggggaagggguaagacugcccuccacguguagaaaugucugcuuugucuguguuuccucaugaaucaguuuucgcuuugcuccugggauucgagagaaagcaagguuugccugucuccugagcgcuagcccuguagaccccuucuaguuuuagcuccaagaugucuucauuguuuccgacauccagauuucaggcuguaguuugccuauuacucuggauugcagauccuaggaugaucuggggguucaauucuggacucuaguuuaugaacauguuuuaucaagcacccagguuuaagcuucucuagcauacaguuccuugucuggggcaugaucugcaaccccugguccuagucaacuuaggguucaggacuuguccucaggcaagaaaaaaaaggcaggugccaacguggguguuggugcagccucagggcaagccaggcuugcugguuucccaccagguaagccucaggacuagguccugguccucccccucccccuccuccucguccuccuccccccagggugcuuagcaggugaguguucugggcaggggagacuccaagacgaagagggggugccaaguuuuccaggcuguugaggcugcuggugggcaguucaguggucuggaccucauaacagagaccugggaaggcaggaguggacggcagguugguggggaaugcugacgccaaagcaauggugagauuggguguggguguucgaaagcaccccuggaagggcuuagaaaagccugggguugaggaguggugauaacucacagcaacggggaggucuucuguggacuggauucuugggcagggguugcugcaggagacacagcagggccccaucuagcugcuggaagaugcugagugagagcagagucuggcgaagcuccugcgacaggccccacugcucuuguuccagaaccucccugaccacuccgaagucuugcuugagcugcagcgcccccugcaggcuagauguccagguacaauguggccaccagacacuucugccuccccagacugcucugcccaaauggucuccauuuucccuguuuggcauucuuccucugccacuagcaucuuuccuucauaccugaaccggaucccaugggugaggauguggucaagccaggcgcccaguguggcugucagugccuggccgagggcaggggcuugggcuucagguggcaaucccugaaguccuugcaacacaggcuccaacacagaguagaccacuauccgagcguacucacuagggucacugggagguucuggagugagacaagagaaaagacagauggagagacugcagaaguccagugggcuccagagggaaggaagggcacaaaggguaaggacaaagauguugacagugguguggagccacaacuggggagggcuuggaccauuuauaccaggaacccgaaggagaaagguggaagugagagauuaccaagacagugggcuggggguuguagcucacucagcaaggcuugcucgucuagcuugugugaaaucuuguguuucauuuccagcaccaggaagaaagaaaaauuaccaggacacaaucgaagucuccaguaucgaccccucggcauguggagcuugaagccuuguguggcuuguuuauggcauucuuggacaaacagacccagugauucuuugggcaggagcuguauggggaggaagaaaguaagaagggcuagucuauuagacugggaaugguguuucucucucugaggucucagugugggcaucuguaaaacccugaugccucacugugggagcaugggcauuuucuaaggaggucuggaccuaaaccaugcacaguaccuaggauuagagguuuccuuaguaaucaaaggcacaugacaagucaggcguguugggcaugcggcuagacucccagcauuuggaaaguagaaucagaguauuagaagcucaauggccaggggauggagagauggcucagugacugaaugaaugcuccucuagagucuugaguucaauuccuagaaaccacauggugggucauaaccaucuguaaugaaauccgaugcccucuucugaugugucugaagacugcuacaguguacuugcauauauaaaucuuuuuuuaaaaaauggggugggaagaagauggugauaacaagguuguguuguuuaga

SEQ ID NO: 3117 - RNA, 3409 nt, Mus musculus
uggggcggggcgcucggggaggcgcgcggcgaaggcucgguccgcugaccgcacgguggcagccggggagcgugcaggcugcccgcauggcccggggcgagaggcgacggcgcgcugcggccgcagagggggcgcggccgcuggagagggcgcgggcggcgggccggcgggauggcagggcugguggggcgcggggcucggcgagcggcgcggcccuggccguggugguguuggcgcuggccuucggccugucggggcgcugggugcuggcguggcuccgugugcgccgcgcgcucacacugcaccccgcgccgucugcgcugccgccggacuccuccaguccugccguggccccggaacucuucuggggcaccuaccgcccacacgucuauuucggcaugaagacucgcagccccaaaccacugcucacagguaacccuggggcgggugaguggggaggacccagcagucuucgaagacuuaagacagccucuguugacugacguggccauucugcuucccaggacugaugugggcacagcaaggcgccaccccggggaccccuccuaagcucaggcacacgugugaacagggagacggcgugggucccuauggcugggaguuccacgauggccgcaccuucggucggcagcauauccacgauggggccuuaaggcucaccacugaguucgucaagaggccugggggucagcacggaggggauuggagcuggagagugaccguagagccucaggucagggcaucaggaucgucuuugcacagcccagacuuccccacccuucccuuucagcagcaaaugcaguaugaaauggagguugacagccgggacaccagccuggcugaccaugucugccaucuccuuguuuguaaaguagauaucacagugacgccuaacuuaaaagauugacugaaacaaucuacguauaauucuaaagccucugucauuuccaggaggaauccuguucagggcccuuuggcucagcccacuggguggaucuaccuacccucagucuuggcagauguauguuugccacaguucuuguaaucccugcugagacugggucucaaaaagauguuuuucugaugcuuuuguguguuccuuggucacccaggccucagguacaccuuccuucccuuuggugucccuguucuucuacguggugacagaugggcaagagguccuacuaccagagaucggagccaaaggacaguugaaguccaucagugggcacaccagugaacuuggugacuuccgccucacacuucugccgccaaccaguccaggagacacugucccuaagcauggcagguaacuggaggauuggugcagggugguacaggggugcuugggagauugacuuagccugguuucuaugacucccuccuccccuucccaccagugggacuggagaggcaucccuuucaugaauaacacuccuuauuugucuucuugccuucaagcuacaaugucuucugguccuccaacccggggcugccacagcucacagauaugguaaagagccgccuaaacagcugguuucagcaccggcccccaggagccucuccugaccgcuaccucggcuugccuggaucucugaagugggaggagagaggcccuagugggcaagggcaauucuugauccagcaggugacacugaaagccccuuucucuguggaguuuguguuugaaucuggcagugcggcaacaggaggaaaccaagccucugggcggcugguaggcagccaacugacccaggcccuggagagccaugcugcagccuucaaggaacgguuugagaagaccuuccagcuaaaggagaagggcuugagucccgaggaacaggcuuugggucagguugcccucaguggccuucuuggugggauugguuacuucuauggacaggguuuaguguugccagacacuagcauggaagggucugaacagaaaauggacccugcccuguuuccaccugucccucuuuucucuggggugccuucuaggucauucuucccacgaggcuuccucugggaugaaggcuuucaccagcuagugguccagcgaugggauccccaccucacccgggaggcccuaggacacuggcuggggcugcucaaugcugacggcuggauugggcgagagcagauucugggggaugaggccagagcccgagugcccccagaauuccuagugcaacgggcagcccaugccaaccccccaacccugcuccugccagucguacacaugcuagaaggccaugacccugaugauuuggccuuucuccgcaaggcuuucccccgccugcaugccugguucucuuggcuccaucaaagucaggcagggccagugccacuauccuaccgcuggcggggcagggaccuagcuuugccuacccuacuuaaccccaagacgcugcccucaggccuggaugacuacccuagggccucgcauccuuccacagcagagcggcaccuggaccugcgcugcuggguggcacugggugcccgggugcugucccagcuugcagaacagcuuggggagacugaagcugcugcagagcugggcccauuggcugccucucuagaagaaccuggaagucuugaugagcugcacugggcuccugagcugggggucuuugcugacuuugggaaccacacaaaagcaguacagcucaagucgaggcccccacaggggcugguuagggugguaggcaggccuccaccucgauuacaguauguggaugcccugggcuaugucucucuuuuuccuuugcuacuacagcugcuggaccccagcucaccccgcuuaggaccccugcuagacguucuagcugauagucgccaucucuggagcccuuuuggguugcgcucucuuucagccucuagccucuuuuauaaacagcguaacacugagcacgauccacccuacuggcgaggugccguguggcugaauauuaacuaccuagcuuugggggcacuacaucacuaugggcauguggaggguccucacaagguucaggcugccaaacucuaccaugaacugcgggccaauguagugagaaacguccgccagcaauaccaggcuaccggauuucugugggagcaguacagugaccaggaugggcggggcaugggcugccgccccuuccaaggauggaccagucuugucuuacugaucauggcugaagaguacuaaugggacagaaggaaagcuaggccauuugugucacuuggaauaugcagacaagggcuuggguuucuggucucauuguuucagaucuuuguaagcucaucucaggugucuccuuauugucaucccauauagcucuggggugaaugugaacucaaagagucuauuuuucuaaauaaacuggaaaagaaccuaacugac

SEQ ID NO: 3118 - RNA, 3409 nt, Mus musculus
gucaguuagguucuuuuccaguuuauuuagaaaaauagacucuuugaguucacauucaccccagagcuauaugggaugacaauaaggagacaccugagaugagcuuacaaagaucugaaacaaugagaccagaaacccaagcccuugucugcauauuccaagugacacaaauggccuagcuuuccuucugucccauuaguacucuucagccaugaucaguaagacaagacugguccauccuuggaaggggcggcagcccaugccccgcccauccuggucacuguacugcucccacagaaauccgguagccugguauugcuggcggacguuucucacuacauuggcccgcaguucaugguagaguuuggcagccugaaccuugugaggacccuccacaugcccauagugauguagugcccccaaagcuagguaguuaauauucagccacacggcaccucgccaguaggguggaucgugcucaguguuacgcuguuuauaaaagaggcuagaggcugaaagagagcgcaacccaaaagggcuccagagauggcgacuaucagcuagaacgucuagcagggguccuaagcggggugagcugggguccagcagcuguaguagcaaaggaaaaagagagacauagcccagggcauccacauacuguaaucgagguggaggccugccuaccacccuaaccagccccugugggggccucgacuugagcuguacugcuuuugugugguucccaaagucagcaaagacccccagcucaggagcccagugcagcucaucaagacuuccagguucuucuagagaggcagccaaugggcccagcucugcagcagcuucagucuccccaagcuguucugcaagcugggacagcacccgggcacccagugccacccagcagcgcagguccaggugccgcucugcuguggaaggaugcgaggcccuaggguagucauccaggccugagggcagcgucuugggguuaaguaggguaggcaaagcuaggucccugccccgccagcgguaggauaguggcacuggcccugccugacuuugauggagccaagagaaccaggcaugcaggcgggggaaagccuugcggagaaaggccaaaucaucagggucauggccuucuagcauguguacgacuggcaggagcaggguugggggguuggcaugggcugcccguugcacuaggaauucugggggcacucgggcucuggccucaucccccagaaucugcucucgcccaauccagccgucagcauugagcagccccagccaguguccuagggccucccgggugagguggggaucccaucgcuggaccacuagcuggugaaagccuucaucccagaggaagccucgugggaagaaugaccuagaaggcaccccagagaaaagagggacagguggaaacagggcaggguccauuuucuguucagacccuuccaugcuagugucuggcaacacuaaacccuguccauagaaguaaccaaucccaccaagaaggccacugagggcaaccugacccaaagccuguuccucgggacucaagcccuucuccuuuagcuggaaggucuucucaaaccguuccuugaaggcugcagcauggcucuccagggccugggucaguuggcugccuaccagccgcccagaggcuugguuuccuccuguugccgcacugccagauucaaacacaaacuccacagagaaaggggcuuucagugucaccugcuggaucaagaauugcccuugcccacuagggccucucuccucccacuucagagauccaggcaagccgagguagcggucaggagaggcuccugggggccggugcugaaaccagcuguuuaggcggcucuuuaccauaucugugagcuguggcagccccggguuggaggaccagaagacauuguagcuugaaggcaagaagacaaauaaggaguguuauucaugaaagggaugccucuccagucccacuggugggaaggggaggagggagucauagaaaccaggcuaagucaaucucccaagcaccccuguaccacccugcaccaauccuccaguuaccugccaugcuuagggacagugucuccuggacugguuggcggcagaagugugaggcggaagucaccaaguucacuggugugcccacugauggacuucaacuguccuuuggcuccgaucucugguaguaggaccucuugcccaucugucaccacguagaagaacagggacaccaaagggaaggaagguguaccugaggccugggugaccaaggaacacacaaaagcaucagaaaaacaucuuuuugagacccagucucagcagggauuacaagaacuguggcaaacauacaucugccaagacugaggguagguagauccacccagugggcugagccaaagggcccugaacaggauuccuccuggaaaugacagaggcuuuagaauuauacguagauuguuucagucaaucuuuuaaguuaggcgucacugugauaucuacuuuacaaacaaggagauggcagacauggucagccaggcuggugucccggcugucaaccuccauuucauacugcauuugcugcugaaagggaaggguggggaagucugggcugugcaaagacgauccugaugcccugaccugaggcucuacggucacucuccagcuccaauccccuccgugcugacccccaggccucuugacgaacucaguggugagccuuaaggccccaucguggauaugcugccgaccgaaggugcggccaucguggaacucccagccauagggacccacgccgucucccuguucacacgugugccugagcuuaggagggguccccgggguggcgccuugcugugcccacaucaguccugggaagcagaauggccacgucagucaacagaggcugucuuaagucuucgaagacugcuggguccuccccacucacccgccccaggguuaccugugagcagugguuuggggcugcgagucuucaugccgaaauagacgugugggcgguaggugccccagaagaguuccggggccacggcaggacuggaggaguccggcggcagcgcagacggcgcggggugcagugugagcgcgcggcgcacacggagccacgccagcacccagcgccccgacaggccgaaggccagcgccaacaccaccacggccagggccgcgccgcucgccgagccccgcgccccaccagcccugccaucccgccggcccgccgcccgcgcccucuccagcggccgcgcccccucugcggccgcagcgcgccgucgccucucgccccgggccaugcgggcagccugcacgcuccccggcugccaccgugcggucagcggaccgagccuucgccgcgcgccuccccgagcgccccgcccca

SEQ ID NO: 3119 - RNA, 2534 nt, Mus musculus
ucuuguugucugggagagcggcacaggcgccgcugcggauugggcaaaaggagaaaccugugaccgguuccuauuggcugaucuguuaguuagcgauucugauuggcuggacugagcaacuguguccucuggaggugcucuccccggccgggagcuccggccgcggagugaugguggcaccgguggcgaugggccgggcagggaccauggaaguggcggcagagguggcaggggcggggcagcuggcgguggaggaggcuguggucuucaggggucuguagguggaggcauggcucgggccagcagcaggaacagcagcgaagaggccugggggucacuucaggcgccgcaacagcagguaucccagcagcucuaaaagcuuaucucacuacagccauuuauuucucuuuccccuuuccugucacuuccuguccggggugggggaggagcucauggagccaaagguacucugaaguuccugaacaugaccauucuacucuuugucuagacuuauuacguagaugcaguugacuuuaccugcacccucuuagaccccaucucaugguugcaaugcaagccugcaguggcucuccaguuaccagaggcguagugaaacccccagggagguucccucugucuugcagcaguuauuugugauguuuuucucugugccuauugucacagcagaguccggcagcaucuucucuugagggagcaauuuggagacgagcuggaacccagacucgcgcccuggauaccauccuuuaucauccacagcaaucccaucugguugggagcacugcucugggucucacacugugccuccucuaccccagggagcuugagacccagggguggaaaaaaaaaaccaucuugggggugugggaggcagaccuuuggggugggagauguugaaagcuuuuuagcuuuggaaauggccuuaaauuccuacccauugucacacuauguuuuguuucuuuuaaaacauuagccuacaaaaaaccacccuuggggccaggcuucugugagaaaaguauuggguuuaaagaacugauaucacuuucucuguauuuacacuuuacuuucucacuaguuucuggcauuuuaaaucuuccauacugauagcccuacauauagacccuccuuuuagcaucccaugccauccuuccaagcuaggucggcucgugggugggacuguaugugcgugcaggagguggggguggacagggccuuggguagaagccccugguucuuagugccuccuugccuccagcuucgagagcugugcccaggagugaauacccagcccuaccucugugagacuggucauugcuguggggagacuggcugcugcaccuacuacuaugaacucuggugugagucuucaaagggauccaucucagguuccaugcccauccucccuuggauuucugaacucagcuaccaaagacccuucucugcuuagggcuggagucuggggugguggucugaguugugcccucuuugccuccugcaggguucuggcugcuuuggacuguccucauccucuuuagcugcuguugugccuuccgccaccgaagggcuaaacucaggcugcaacagcaacagcggcagcgugaaaucaacuuguuggcuuaccauggggcaugccacggggcuggcccuguuccaaccgguucacugcuugaccuucgugagugaccugaagcucuuggaugcagaaccaguagccccuuccaagccaggacccucaaccaccccacacuuccacuggcagacauuucagagcacucuuguagcucagguccuucagucauccaugcuguucucucuccugcaggccuccucagcgccuucaaacccccagccuacgaggaugugguucaccacccaggcacaccgccaccuccuuacacugugggcccaggcuacccuuggacuacuuccagugaaugcacccgcugcucuuccgaauccagcugcucugcccacuuggaggggacaaauguagaagguguuuccucccagcagagugcucucccucaccaggagggugagcccagggcaggauugagcccaguucacauacccccuuccugccgcuaucgucgccuaacuggugacucggguauugagcucugcccuuguccugacuccagugaaggugagccacucaaggaagcgagggcuagugccucccagccagaucuggaagaccauuccccuugugcacugcccccagauucugugucccaaguuccucccauggggcuggcuucuaguuguggggacaucccauaaguaguuucaagagggaaacuggguauuacuuggccaccaggauucagcccugguuucaacugcaguccuccaugugggaccguccccacccuccuagaacacgccugaaagggcuggagcccugaagaggggcagcaccgaggacugugcuaucuuuacucacucccaagacauacacaggagccuuuaaucucauuaaagagacaugaaccagcugcuugugauucugggua

SEQ ID NO: 3120 - RNA, 3669 nt, Mus musculus
cugaggcacuguacgaaauuuaauagggugggggagacagcaggaauguggcgugggagaggucuuagguggccaggaguggggaccccgggcccucgggcccucccagccguagcugcagguugaugcgguagcacuguaggcugcaaagggccuggccggugcgggagcaggcauaacgacgcgggugggggcagccggggacagagcaucguggagcggggcccgauggggcaggccgcugugccaccgccgugggugugggaacgccgggaggaaaagacaagguggagcccugugccccgcugcaguagcgcaccaugggugcaggggccggggcagcagcccguccuccgcgccgcucgccccgcgccgccccgcgcccuccacgcccgcuaggagcggccgucuuggugaggcgcucaauugucugauuuuugugcuccucggcccuccucgccgccugcagccgccgcuuccgugcacgcuccucacgcuucagcagcaucucuucggugagggcaggggcagggcagcccccacccacuggcagaggcagagucggggacggcuggcuccgcgccuucuggaggagggcucgcuggggaaagagacagaggaugucugagaaccaaauggcgagguuuuuggggucacccaccccuauuuucguuuguuuuuguuucgaggcggucucacuauauaacuuuggcugcccuguaagucacuauguagaccaggccagccuggagcucacacucuugccucuguucccuaggugcugggaucaaaugcuugugccacuguccccaucuuuagggacccuuaauaccacacuucucuucccaggguuccugccucucacucagguccaaaggaggaaacaaaaguaugguacccugccugccccuuguguagguuuuuguuguugcuguuauuuuaaauaguaucucaggaaaaaacaucaacuuggauuuggcucaaaccaaaaagaauuacccuggauuccuuuuuucucccacuaaguagcuacuuccgucauacauccaggcuucagugcagguuucucuauuccuuuuacuacuuucuucuggacucgggccaucaccagcucucccaguuuccacaccccauaccccucucccaguuuauugauugauugugucaggcuaucuauauguauuuuuagaugccucggaauuuguaaccauccuccugucucucaagcucuggggcacaggucugcgccacgacagccuacacuucagcagcuuccuaaggaaauuccuuaccccuacuaagcuucacagcacauaauugccaaaguaauuaagccagcuaugucacuugucaguauauaucccccugggugaccuggccacacucuccuucugggucucugugccccugggcucuaugucagcuggccucucugucugagaagcuccccugguacuggaaaugucaucucuucaaaggcauucuagacuggaaagacuacucagcggcgaggagcaccggcccuuggggaggacucucauucaguucccugcaccuacauggcagcucucaacugucuguaaaucuaguuccaggaguucugaugaccaauggccuccaugggcaacgggcacacacucauccacauaaaguaaauacgauuuaucuuuaaaaaacaaaagaaaacaaugagcuaguccccacaacuacccuaauguuucugucuuggcaauuucuacuucagcauuccuauuuucuguaggauuuuuuuuuuuuuuuaagguuuauuuauaugaucacacuguagcccucuucagacacaccagaagagagcaucagaucccauuacagaugguugugagccaccaugugguugcuggguguugaacucaggaccucuggaagaacagucaguguucuuaaccauugggccaucucaccagcccuauuuucuggaguuuuaaaaaguuacuuaggagcucuguguguguguguguguguguguguguguggcaguacacaccuuuaacuccagcacuuaggggcaaaggcaagcauaucccagucagggcuuaaauacuaagaucccaauucaaaaaggaaagucauuuaccuucugucagcaugcacuugaauauccacccaccuuccuuuccuguuccucucacugccuaagaaacaacaagcucuccauauguuugucgagugaauacagauggaacuaacuuaccugucucgcuguaagcagccgcucauugaucuccuucuugaggucuccguugucauccagcucucccuucuccagggcgucuaaccaucucuguuccuccucuuccuccuggcccuccagauccccuggcaggucccgaaguggggagggggacagauuacugucuucaucugggugggaaaguugaaggaaagugcaaacauuaauuuaucgaaguugguccuaguacacugaaaauucucagaccccacccucuuccuuuugcugguuagaaaugagcaacccagcuuugccaccucuacggucuucucacccagccaggcgcgguacugcuccagagguacgccuuccauagguuccucuucauuauccaccaccaucaggggagacggugagcgaggccccucaggaaucacagugaaaguggggacacugcagaguagaaacacuacucuaaagugaacaagcggcuggcucucuccuacuuuggagcuacaaacagcuuuuccgaccugcugggauucuugcugccuuaacuuggacccagcccaccugcuacugaauuuucccgaguuaaauacuugaucucaccucuuggugcccaggaccuguccacccagcuugauuuuaaguuuaaguuggggcuuggcaggagucugcagcgucgguccggccuccucuuccugaugaugcuuuuucuuguguuucuuuuuauguuucuuguguuuuuucuuguguacuccguggccgugggcaccugccaggcucagcuccagcguuuccccugcggaaggagagccugucugaggggaucggccaaaaaguggcagggggaagaucugacuaaccuaacaauucaacugagucccacucuucccacguuauuagcuguuaccauaacaacagccccgccucgcuccuucccaccuguggcgggcagacccggcuccaccggcuccacggaguuacagcgacuccuuuuucaagaucacucgaguuagauccacccgcgcuuaccuggcucgggggccuccauagccccagaugugcucccgcgccgccacagcuugcucaugggguccugcaaagggagaggacuggaaacugucgggacacaagccgacaugccuuuuccgccccgcggaagaacggaauccagcaaaauaaccggcuacuuccggcgccuggcaaccauguuugugcgugguacgccuuacagccaaaaauauuccgauaagaaacagggucccuuccaaacaaaaguuccggcauugcuaggcaccuuacuggcgcaccagacuuaaaaaggauuacgaguucgaggccaggcuuaaugccaucuuguucucaaaacgaaaguucaaagccucuaggaggcuggaaaagccaccaaaaaagguaagguuuuccccuaacuuggguucccuguauuagauucc

SEQ ID NO: 3121 - RNA, 3669 nt, Mus musculus
ggaaucuaauacagggaacccaaguuaggggaaaaccuuaccuuuuuugguggcuuuuccagccuccuagaggcuuugaacuuucguuuugagaacaagauggcauuaagccuggccucgaacucguaauccuuuuuaagucuggugcgccaguaaggugccuagcaaugccggaacuuuuguuuggaagggacccuguuucuuaucggaauauuuuuggcuguaaggcguaccacgcacaaacaugguugccaggcgccggaaguagccgguuauuuugcuggauuccguucuuccgcggggcggaaaaggcaugucggcuugugucccgacaguuuccaguccucucccuuugcaggaccccaugagcaagcuguggcggcgcgggagcacaucuggggcuauggaggcccccgagccagguaagcgcggguggaucuaacucgagugaucuugaaaaaggagucgcuguaacuccguggagccgguggagccgggucugcccgccacaggugggaaggagcgaggcggggcuguuguuaugguaacagcuaauaacgugggaagagugggacucaguugaauuguuagguuagucagaucuucccccugccacuuuuuggccgauccccucagacaggcucuccuuccgcaggggaaacgcuggagcugagccuggcaggugcccacggccacggaguacacaagaaaaaacacaagaaacauaaaaagaaacacaagaaaaagcaucaucaggaagaggaggccggaccgacgcugcagacuccugccaagccccaacuuaaacuuaaaaucaagcuggguggacagguccugggcaccaagaggugagaucaaguauuuaacucgggaaaauucaguagcaggugggcuggguccaaguuaaggcagcaagaaucccagcaggucggaaaagcuguuuguagcuccaaaguaggagagagccagccgcuuguucacuuuagaguaguguuucuacucugcaguguccccacuuucacugugauuccugaggggccucgcucaccgucuccccugauggugguggauaaugaagaggaaccuauggaaggcguaccucuggagcaguaccgcgccuggcugggugagaagaccguagagguggcaaagcuggguugcucauuucuaaccagcaaaaggaagaggguggggucugagaauuuucaguguacuaggaccaacuucgauaaauuaauguuugcacuuuccuucaacuuucccacccagaugaagacaguaaucugucccccuccccacuucgggaccugccaggggaucuggagggccaggaggaagaggaggaacagagaugguuagacgcccuggagaagggagagcuggaugacaacggagaccucaagaaggagaucaaugagcggcugcuuacagcgagacagguaaguuaguuccaucuguauucacucgacaaacauauggagagcuuguuguuucuuaggcagugagaggaacaggaaaggaagguggguggauauucaagugcaugcugacagaagguaaaugacuuuccuuuuugaauugggaucuuaguauuuaagcccugacugggauaugcuugccuuugccccuaagugcuggaguuaaagguguguacugccacacacacacacacacacacacacacacagagcuccuaaguaacuuuuuaaaacuccagaaaauagggcuggugagauggcccaaugguuaagaacacugacuguucuuccagagguccugaguucaacacccagcaaccacaugguggcucacaaccaucuguaaugggaucugaugcucucuucuggugugucugaagagggcuacagugugaucauauaaauaaaccuuaaaaaaaaaaaaaaauccuacagaaaauaggaaugcugaaguagaaauugccaagacagaaacauuaggguaguuguggggacuagcucauuguuuucuuuuguuuuuuaaagauaaaucguauuuacuuuauguggaugagugugugcccguugcccauggaggccauuggucaucagaacuccuggaacuagauuuacagacaguugagagcugccauguaggugcagggaacugaaugagaguccuccccaagggccggugcuccucgccgcugaguagucuuuccagucuagaaugccuuugaagagaugacauuuccaguaccaggggagcuucucagacagagaggccagcugacauagagcccaggggcacagagacccagaaggagaguguggccaggucacccagggggauauauacugacaagugacauagcuggcuuaauuacuuuggcaauuaugugcugugaagcuuaguagggguaaggaauuuccuuaggaagcugcugaaguguaggcugucguggcgcagaccugugccccagagcuugagagacaggaggaugguuacaaauuccgaggcaucuaaaaauacauauagauagccugacacaaucaaucaauaaacugggagagggguaugggguguggaaacugggagagcuggugauggcccgaguccagaagaaaguaguaaaaggaauagagaaaccugcacugaagccuggauguaugacggaaguagcuacuuagugggagaaaaaaggaauccaggguaauucuuuuugguuugagccaaauccaaguugauguuuuuuccugagauacuauuuaaaauaacagcaacaacaaaaaccuacacaaggggcaggcaggguaccauacuuuuguuuccuccuuuggaccugagugagaggcaggaacccugggaagagaagugugguauuaagggucccuaaagauggggacaguggcacaagcauuugaucccagcaccuagggaacagaggcaagagugugagcuccaggcuggccuggucuacauagugacuuacagggcagccaaaguuauauagugagaccgccucgaaacaaaaacaaacgaaaauaggggugggugaccccaaaaaccucgccauuugguucucagacauccucugucucuuuccccagcgagcccuccuccagaaggcgcggagccagccguccccgacucugccucugccagugggugggggcugcccugccccugcccucaccgaagagaugcugcugaagcgugaggagcgugcacggaagcggcggcugcaggcggcgaggagggccgaggagcacaaaaaucagacaauugagcgccucaccaagacggccgcuccuagcgggcguggagggcgcggggcggcgcggggcgagcggcgcggaggacgggcugcugccccggccccugcacccauggugcgcuacugcagcggggcacagggcuccaccuugucuuuuccucccggcguucccacacccacggcgguggcacagcggccugccccaucgggccccgcuccacgaugcucuguccccggcugcccccacccgcgucguuaugccugcucccgcaccggccaggcccuuugcagccuacagugcuaccgcaucaaccugcagcuacggcugggagggcccgagggcccgggguccccacuccuggccaccuaagaccucucccacgccacauuccugcugucucccccacccuauuaaauuucguacagugccucag

SEQ ID NO: 3122 - RNA, 1865 nt, Mus musculus
acacucuugccucuguucccuaggugcugggaucaaaugcuugugccacuguccccaucuuuagggacccuuaauaccacacuucucuucccaggguuccugccucucacucagguccaaaggaggaaacaaaaguaugguacccugccugccccuuguguagguuuuuguuguugcuguuauuuuaaauaguaucucaggaaaaaacaucaacuuggauuuggcucaaaccaaaaagaauuacccuggauuccuuuuuucucccacuaaguagcuacuuccgucauacauccaggcuucagugcagguuucucuauuccuuuuacuacuuucuucuggacucgggccaucaccagcucucccaguuuccacaccccauaccccucucccaguuuauugauugauugugucaggcuaucuauauguauuuuuagaugccucggaauuuguaaccauccuccugucucucaagcucuggggcacaggucugcgccacgacagccuacacuucagcagcuuccuaaggaaauuccuuaccccuacuaagcuucacagcacauaauugccaaaguaauuaagccagcuaugucacuugucaguauauaucccccugggugaccuggccacacucuccuucugggucucugugccccugggcucuaugucagcuggccucucugucugagaagcuccccugguacuggaaaugucaucucuucaaaggcauucuagacuggaaagacuacucagcggcgaggagcaccggcccuuggggaggacucucauucaguucccugcaccuacauggcagcucucaacugucuguaaaucuaguuccaggaguucugaugaccaauggccuccaugggcaacgggcacacacucauccacauaaaguaaauacgauuuaucuuuaaaaaacaaaagaaaacaaugagcuaguccccacaacuacccuaauguuucugucuuggcaauuucuacuucagcauuccuauuuucuguaggauuuuuuuuuuuuuuuaagguuuauuuauaugaucacacuguagcccucuucagacacaccagaagagagcaucagaucccauuacagaugguugugagccaccaugugguugcuggguguugaacucaggaccucuggaagaacagucaguguucuuaaccauugggccaucucaccagcccuauuuucuggaguuuuaaaaaguuacuuaggagcucuguguguguguguguguguguguguguguggcaguacacaccuuuaacuccagcacuuaggggcaaaggcaagcauaucccagucagggcuuaaauacuaagaucccaauucaaaaaggaaagucauuuaccuucugucagcaugcacuugaauauccacccaccuuccuuuccuguuccucucacugccuaagaaacaacaagcucuccauauguuugucgagugaauacagauggaacuaacuuaccugucucgcuguaagcagccgcucauugaucuccuucuugaggucuccguugucauccagcucucccuucuccagggcgucuaaccaucucuguuccuccucuuccuccuggcccuccagauccccuggcaggucccgaaguggggagggggacagauuacugucuucaucugggugggaaaguugaaggaaagugcaaacauuaauuuaucgaaguugguccuaguacacugaaaauucucagaccccacccucuuccuuuugcugguuagaaaugagcaacccagcuuugccaccucuacggucuucucacccagccaggcgcgguacugcuccagagguacgccuuccauagguuccucuucauuauccaccaccaucaggggagac

SEQ ID NO: 3123 - RNA, 1865 nt, Mus musculus
gucuccccugauggugguggauaaugaagaggaaccuauggaaggcguaccucuggagcaguaccgcgccuggcugggugagaagaccguagagguggcaaagcuggguugcucauuucuaaccagcaaaaggaagaggguggggucugagaauuuucaguguacuaggaccaacuucgauaaauuaauguuugcacuuuccuucaacuuucccacccagaugaagacaguaaucugucccccuccccacuucgggaccugccaggggaucuggagggccaggaggaagaggaggaacagagaugguuagacgcccuggagaagggagagcuggaugacaacggagaccucaagaaggagaucaaugagcggcugcuuacagcgagacagguaaguuaguuccaucuguauucacucgacaaacauauggagagcuuguuguuucuuaggcagugagaggaacaggaaaggaagguggguggauauucaagugcaugcugacagaagguaaaugacuuuccuuuuugaauugggaucuuaguauuuaagcccugacugggauaugcuugccuuugccccuaagugcuggaguuaaagguguguacugccacacacacacacacacacacacacacacagagcuccuaaguaacuuuuuaaaacuccagaaaauagggcuggugagauggcccaaugguuaagaacacugacuguucuuccagagguccugaguucaacacccagcaaccacaugguggcucacaaccaucuguaaugggaucugaugcucucuucuggugugucugaagagggcuacagugugaucauauaaauaaaccuuaaaaaaaaaaaaaaauccuacagaaaauaggaaugcugaaguagaaauugccaagacagaaacauuaggguaguuguggggacuagcucauuguuuucuuuuguuuuuuaaagauaaaucguauuuacuuuauguggaugagugugugcccguugcccauggaggccauuggucaucagaacuccuggaacuagauuuacagacaguugagagcugccauguaggugcagggaacugaaugagaguccuccccaagggccggugcuccucgccgcugaguagucuuuccagucuagaaugccuuugaagagaugacauuuccaguaccaggggagcuucucagacagagaggccagcugacauagagcccaggggcacagagacccagaaggagaguguggccaggucacccagggggauauauacugacaagugacauagcuggcuuaauuacuuuggcaauuaugugcugugaagcuuaguagggguaaggaauuuccuuaggaagcugcugaaguguaggcugucguggcgcagaccugugccccagagcuugagagacaggaggaugguuacaaauuccgaggcaucuaaaaauacauauagauagccugacacaaucaaucaauaaacugggagagggguaugggguguggaaacugggagagcuggugauggcccgaguccagaagaaaguaguaaaaggaauagagaaaccugcacugaagccuggauguaugacggaaguagcuacuuagugggagaaaaaaggaauccaggguaauucuuuuugguuugagccaaauccaaguugauguuuuuuccugagauacuauuuaaaauaacagcaacaacaaaaaccuacacaaggggcaggcaggguaccauacuuuuguuuccuccuuuggaccugagugagaggcaggaacccugggaagagaagugugguauuaagggucccuaaagauggggacaguggcacaagcauuugaucccagcaccuagggaacagaggcaagagugu

SEQ ID NO: 3124 - RNA, 17118 nt, Mus musculus
ugaaugggagagagaagcauucaacuguagaagugagacuugggcggucccaagucaagcuagaaccagaaagugcagugugacuaccgguguuuuccgagcuccaggacaccaguuugacagguagggaggggggugcugcagaggaggggauuuggggacccgccccaagugcuggugagcuaauccagccgaaaggauggaagcucucaggcacugcuggagugcuuuagggugccucuggcaaugaaacugucgacccaaacuggcuuggcacccgaguacgggccgggacuuuagcggggguggaagaggagggugccgcgcccugcccagcccaggugucgucuccgggggcgggguuugggaaccgggcagcugggggagauucccggcuguacugguaggagggcggccgucgagggaccggagcccaagcccgcgagagacugaucccaggagcguacugggcaaggggcugccagcauguucucucgaaaccaucggagucggaucacaguggccaggggcuccgcccuggagauggaguucaaacgcggccgcuuccgacuuaguuucuucagcgagucgccggaggugagaggccgcgucccugccuuccccucccagcucuggcagguagcccuggccaccccgacuccugggcgcgccaggaucugggucuauucuagcucaaguuguugacuuggaaauccagguguggacagggugcggguccaucugaucuguauaagccaugccuugccugguugagguaauuugccucugccuuaaaaagucccgauuagcguccacacgagaggcucuaaauucccuaacugugccuaaacccaggucccucuaguauccugggccaaggacauugggcagccaggcauccuccaauacuugaaauuuuguuuugguucccagccgguucccagcuaccaguagcaucccacacucugugcggacccccuaggccaaccuccguugucuccacaguucuguaacuugucugaaguccucccaaugcccuguuacuccuggagggcaacaugucucucucucucucucucucucucucucucucucucucucucucuguguguguguguguguguguguggucacacccaacuuuccaccucccuucucgggccuaagaagagucucuagccucuagccugagucaccacaccaccacuaccaccacuaccaccacuaccaccacuaccaccacuaccagcagcagcagcagcagcagcagcagaguaucccugucagcacguucugagcccuaugcuuaaaucucuaaacuggagaggcacuggaggcacauggcuaagucagaaaugagaggggcuuggccaccccaaagagacuuauguccccaaggucaucuucccacaugcucaaggaggucccaguuuaaagucuguaucccucacuggcccgggaaggguuaagcguggugguucuuccagcagugcaccccccucccgccugggauuccaggccuggcuuuugcccuuuccuucuaggcugcccagaacaaaggcucuuuucacgcccgugucccgcagucccaagcuuucucugagucagaagagaguggaggguuuugucauccucccgccccagcaacuuagacccaaggaacccgcgcguggccagcgucggggagucaggggcgagguuggggaccuggaggagggcucguguuccugagccuugcaaggauaugccaggccuugggagccauagcugaggagucggggcggagcugcugggccaggccugccgccggguugagugugacuccacggucccggaguaggggggugggggacagcccugcagcuggcugggacccggggcugguuuccugucuggaagggaaggggccccgagaggggaucagggccagcagcagccaggcacaccccugacuuucucccucucucucuccucccuucugcuggaaaagcgagguaauugugagcccaggguggggcgugcuggaugggggccggcauuggaaggggugacccugggagcugggcugcauuacagacucaccccuuugucccauucccugggcucaagucgccucauguccucacuucugucgcuaacuuuucucaaacuaagccagaacucccucggucgguucugaucucccgucaagccucaggauuccguagaaucagcaggaggcgucccuucccugcccccuuccagcugugccugccccucacugcccucgcagcacgcacauucucgaucggccaggccagagaugugggcgggagcgggggaggggccaaaaugggaaugaaagggccuuuuucuuccacagcugggagaacagcugccaccaacuccaggcuggacacucugugcccagagcccccucugcagcuggccucuccucccaggaaccccugcucauucuuaccucacuuucuuuccuccucugcuuggcuccuaccaaggccuuggaacagcgcuaggagagaaacuuuugucacagaagccaaaggggucuaacaggacugcagagggacagggacagacucugcauucugucccagagcuggacaccucucucgagcccggggagcagugggaggaggaacugugggacaacguggugccuaccuggccucucuccgggcagcaagggaaggggcuuuaggggacacagagaugcaggacagauugcgcauccuggaggaccucaauaugcucuacauccggcagauggcacucagccuggagguaaugccccgaccccuggacaacgugcuuccugugcugucucagccuuaguggggcuaaugagggaggggggcagggcccgguagggcccgcccacagcugggauaggugguuuuguauacaauguguugaauacguuuggggaucaaagcccacuucucugaccagaaugaacauuaugaagggcuaaggauguggcucccaugguagagcgccugccuguuugacacggacaaaguucuggguuugacucucagcagccugggcacugcaugaacugcguugcaggggcaaaugcauguaauucuggcacuuggaaaguagaagcaagagugaguuccaggccaaccugggcuaaacaacaacaauaaaaccacauguugacagcaggggcuuggcuguuaugaauagguguagauguuuguucugaggacagagguucauuuuugagacagaaugaagagauuucaguaugaaggggguuuguagaagaugaacucggaagagaagugaggagguggugugccacggugcagaugugaggucagaggucaacuuccaagagaggcugggacacuauucguacauuuauucuuuuucuuuuuaauuucccuucccuccuuucucuccuuuuuucuaaucgucuuuagacaggaucacauuuuguaguccaucuggcuauugaagucacuauguggucuaggcugguguggagcucauggcaguccuccugccuuagccuucugagugcugggauuacagaucggagccauuaugcccuacuuguucauuuuuuucucucuuuugguuuucuuguugcuuuuauuacguguguguguguguguguguguguguguguguguaucagaggauaacuuuuggcguuugggggauuuuguucuuuccuuccaucaugugggcucugggauugaacccagguccuugggguugaaggccaucccccuuuaccugcugauccaucucacuggccuggugcuuuuucaauuuuuuuuuuccucuuaagacaggcucucugaagucacuaugugguugaggaugaccuuggacuccugaccgaccuaccaccacuucccaagagcuggguaucgcaggcaacuguuuuagacuaaauagcccccauaccugucucauucuaugugcugggcuccuuucuaagccauaggaauccaucuggagaaggcgggaaaugcccuuucuugcgagggaacagaugguaacugugugaguggugccacuuaaggaaaauauuauaaaaacggggugcaauagcaauccagcagauggcaauguuagauggucuggaagggccugggguccugaagccugcaggaaggcuuuccagaaaguagccaugguuaaccuggaaauggcucugucggccaggcuagcuuugaacucauagcgguccagguccaucugcccgucucuuuagcgcuggaaggaaaggugccugccacuaggcugccuuccaccuucaguuuuaagauguugauuguugugaaggaucagcuuggagguggugagggcuggaggagaaaggucggcugggucaagacguuuucccaguggauggccacauauuaccauaggggaaugaaucugggguguagauuacggaguucauggaagggaggagagauuccaagugauggugggagauguggcaggcuggcuaauggguuagacaugacaagugaagcagccagaaacuccagaacaguugaguccaggcguguggcgcagccccuggucuguggcccuucgcuggguggaggaagugacugucuggacuuuaaugggacaggggcagggaugcagaguguaucaggaaggguaacuugaugcacacaggcugccuguccagccccugccccaucucuggaucaauggaugauguuagccagauacagccuaagccaguuauagccacaggauccuuccuggcacggccuuggcgugcauuucaagcgugcauuucacacggugccaacggugccagccagaagaagggaaccacccgugucugccugcagaggcaccaggaggauacacuucaguuugcuugucuauuuuguagaaaggugccaaguggaccccuugggguuucugacauugccuaguuuucuugugcuggugcacaaaagagaacccauuuaccgggugaggcuuggcgugauggcacauuccuauaaccccagcacccaggaggcugaagauggagcauugugagcucaaggguuauagaaggagacuaucccaaauggggggaaaaaaaaaaaaaaaaaaaaaaaaaaaaaaaaaaaaaccaacaacaacaaaaaaacuaagaaaaauacucaaaaccuccuuucuguccgucuggccuucauuucuccugcuacuccuuguauaauuuguauuguaauuacuuuuaguuaauuaaggcaguggggagccagucaaauuuucaguuucucuacccacauccggcugccagaugcugcuuccauccacagaguuggucaggguaugucagguuuaaauccugcauccugcacaccccugcccggcauacacuguccugcauccugcacaccccugcccggcauacacuguccugcauccugcacaccccugcccggcauacacuguccugucaguuuucuccaugggaggccugcccagcaucugggacagaagaaggaauugguuuuacuuuaauuaacuuuccuucaagcacaggcugagaauucuguacaaccuccucuuccuccuccuccuccuccuccuccuccuccuccuccuccuccuccucuuccuccuccuccuccuccucccagguucauccuguccucagaaacacagacccauugacauuucaggaaauggcaggaaaguuaguucuggaggguaaacccaggaaggcuuuuuggaagaggcauccuaagcugcacauucaaaaggagugagagugaaagcuuauuuuuauuuaauuaaaaaauauguuaugugguggugguggugauggugguaguggugguggcgguggugggguugguggcaguggcuguggagaugauguauggccccaagcaaguguggaggucggaggacaguuugggagaaucgauucccauggugggguucagggacugagcugagguccucaggcuuggcagcaaacagcuuuacccagugagacaucuugccuguccaccuguuuuguuguaauaacuuuucacguagcccaggcuguggagcugaggguggcacugaacuucugucucaagugcuagcauuacuucgagucaauggggugcugaggagggaacugaaccgcauccccagagcaaggcuugaaugugugcccggcccagguagaguuuagcuucuucuuauuaaauccucacagaauguugugaagaaagccaacuacucccaggucaacgacugaagccccagagacaaaaggcuccuccagcuugucaagucccuagaccaggauuugaacuuagcugugggaauucugaagggaacagaaggccaugggaagcagagcaggaagucaggggcagcgugggggaggggugggucaucaugggagacugugacucauccucugucaucccuggagaucugacccaggucugaggaugcucaguguuggcaucuuucccauccuaggggaaugggguccauuuggggagggcggguuggggcgguuguuguggugaggaagccagugccuacuccugugcuaauggguguggagagagaugcaaagcccaagaaccuaguuuuccaccucaaaagguggggggagcccuuuccccagcccauucuugggggcuggauggccuagagaggauuaggaagcacuuaaggaaggcagcuaguucccccaagggccaguucuccuggcccugcuggaucuagcaagcucacuucuuaccacacccugccucugguaagggucaccuuggaaagagaagcccgcuuaggagaggccucuggggcggcccaggcucucccugcagccgcgucccuccgcgacagggucccggugguagagaugcaggcaucgcagcgcccgcagggaccgcccgcgccuggcgcccuuggcgccucucgcggcaauugggagcugaugucacgggcgcccacgggcacagcggacgcaggcggugcgguagcgccgacgcucgggguucuucaauccccacgcgaucccccggccacgcuggccccccggguuucugcgaccugugaccccucgcuaacugcaggcgcaauggacaaggcuagggaaggaucggugagugcuuggccccaagggggcuagcuaaccaggagcgagcaugaggucgcauccuugaucaaauucaucugggacuacugaacaggaacugguugcagaguuggggcggaguaggcaagcagcugaccuaacaaugacaggucauuggugcguacaaagcauggcugggaguagaaaguaguuugggagggcauccugguggagaggguuuuggguaaaaggcacaugguacuggagagauuuguuauaaagucugaccuagcacaggaccccccccccccaccuccacaccccacccuacacacaaaaaaaggguaggaaaagguggcaggcuggaccagguuuuggugagaaggaaaucaagcugucaguacgauuggacaccagagacagagcagagcagagcauaggaaggaaagccagugugacagagaggacagguuuguguagucaccgcucuucucuuccaacugcgugcccccacuugccuggcuuccugcaccgauguuuugcaccuccgcucuggagccuccucccugucaccucagcagaagccagcagaggcuguugccugugguuuuuaugccagacgaggcacuaauggaguagccauccaucucugcuuguucaucucccagcugcggcuucaguauggagccucgcucggucagcacccuccagcgcuccacugugaacaggccggucuucaaagcagccuccuugauaaagccuguguagggacaugcccugccaugcacugaacacucugcaccaagcaucaagcuugacucucccgggaagucuuuccacacuaggaugccauggcuuuuuucacccuauuuuguuuuuguuuuuguuuuuguuuuuccgagacaggguuucucuguauagcccuggcuguccuggaacucacuuuguagaccaggcuggccuugaacucagaaauccacuaucucggccucccaagugcugggauuaaaggugugcgccaccaccacccagcuuucacccuguuuugugugucuguaugucugccuguguguaugcuugcuaugagugugcauagaccagagguucacuuuauguaucuuccucuaucaaucuccacuuguuuguugagguggggggaggggcugccucuaccucucacucaguguuaggauuaugggcauguguuaccauacccagacuauccuuuaauacguguguguguguguguguguguguguguguguuucuguauguggaguggguacaugccacacacagcacaguguggaggucagaggaggagaauuugugggggugauugucuccuccaccauguagaacccagagcucaguucuacagcuccagguuugguagcaguggccuuuauccacugagccaucucauugcccuucccccuucucuuuugagacaaggcucucucacugaaccuggggcaagguuuuggcuagacugauuggccaccugggaucucugccuguuucugcucuccagcacugggguuagagaccagcgacgugucaugccuggcuuucacauggguacuggggauuugaacucagggccucuugcuugcauaguaggcacuuuaccuacugagcugucuccccagcucuucauccccauuuuacaaauugggaaaccaaggcugauggaaguggagugaaaugccccaugcguuuaggagcugccuguaaguugcagggggugggguggggugcuuccuggaggaguuuggagacuugagauggccuguuuuggaagcgaaucaugugggaggugcuggagugaaaaucugaucuaguaugauggaccucagaaacaguccuuggaggaaggaacuguaaauaagcuggauauguagcucaggcuagcuuggaacucauagcaauuccccugccucagcuuuuugagugcugggauaaugggcacgcaucacccugcuugacugccuagagcuguuuauguuuucuuuuacuguuuugagacaaggucucauauagcucagguucgccccaaauucacuauguugcugggagugaccuugaacaucuugguucuccugccuacgccaugucugguuuaugcauugcuggggaaccaaacccagagccucaugcaugcccaggccccaguccaaugcuaauugccuuuuaagcuccaggaugagugacuaccccuguaucaucucucagagucucuucccugcccuuucaugccuguccagacccucaaaccuggaccaaugacuuuuccugagcucugaucucucccacacucagggagcuauuugagguguguggaggguucugugcugcaugggugguaugcaccuugacugagcccacauuccugaccucugugaccacaaucacacaaauguguaaauauacauacauaugcacaugcaaauauauggcauauauacuauacaugcaugugcauauguaucacauauauaaaacaaaugguaaguguauguauuguuuuugagagagucccauguaucccugccuugccucuaauuugccaaguaucugauggccuuaaaaguccugccuuuaccucccaagugcuggauuacagauguguaccaccgugccuaacuugacgugugauguuuugcuuucuauucuugugcuauauuuucuggacagucauaucucaacaugccuaccucgguggucuuuugcacuauuucagcucagauaugacucacuguacugcugucuuauugacaggcuuuuaguuuggguguuuaaacaaagcccggggcuggagagaugacucagugaugaacaauaacugcugcucucccagagaacccacauucaguuccuggcacuccugugagauggcuuguagcucuagcuccagggaaucugaugccuucuucuggccucugugggcacugcucucauaugugauacacagacacacaaauaaaacagugccaagugcaggacucugugcauguggcuuggcaguuaggugugugauuguaucuguaggcuaaacacuuggguauuggauaguuagaucaaaggauauaugaauuuauagcuuuuguagauuucuccaaauugugaugaaagagguagacagaauucauauucuucaccauaaaauacaugggacuaucuuauuuugcaaagcuuuucugguuugucuugggcaauggcgggugagacaacaggcuugcugaaacguuuugcugaaacauuaguugucgcguguugugcccugucacacccugcccacaccuccccagcuugggacuggguuggggaggggagaugccucagcauguucccugaucaccauuuccuuuuucccccuuccaugauucugcucaggacacagagcugcagaggaaacuagaucaugagauccggaugagggauggggccugcaagcugcuggcagccugcucccagcgagagcaggcucuggaagccaccaagagccugcuggugugcaacagccguauucucagcuacaugggugagcugcagcggcgaaaggaggcccaggugcuggagaagacaggcaggcggugagcaugggaggcgaggugucugagggagggagggagggagggagggaggcuuuauuugugguuaaaagugauaaaaagcaugugugucuguguggaguguuuggagcucgggccaaccggaaggggacaaccuucucacacaccucuguccuggccaugaaagacaccuugguguuuuacugaggugguggugaucauccagaacggcugggacuggacucagggaagccauuauauauccaauagaagcuggccgucugggccacauguaaugcaaagcugccgauuugucuaggccugcccuugaccuccuaugucuggcugguugauuucuggaaaaccaauuuucucagggcuaguucaccaaauggucaauuugucgaauggccaauuuaccacaaauugauaauagcuuguuguaccuggaguucaccaucagaggcaugaguugggaaagugcauaauuaaaaaucacuuaaagagcucagccucaguaugugauccacacugcaccgaugcugcccugcgcuccggcagucugucuguccggucagcagugagacagccggagucaaguaaaaauguuagagagaaaauacuugguaaacugaucacucugaagacuggccaguugugguaaacgagucaucuggagaacugcuugccucucugaggcuacauaaaaagagggucccagucccucaccagcauggaguagccgagggagagguugcuaggggcucacuaggaagccuacaggagaaaauuaauuucucuggugcuucauuuaacaagaggccaagcaggcaggaggcagcucucucagggagccaugggcagaggggccacacagcccucagucagcagcuaaacauacacuguucaugcuagguuguguagucacaccauagacgauaaaagcugggcaugguggcuuaugccuguaaucccagugugugggaggcugaggcagcagcaugugcugaguuugaggccagccugagcugcccagugagaccaaccugugguggggccaacccuuccaagcccacaguuuaaugguggugguaaagacuugaaagggaaucucuggugaugccacagggggucuggguggugaggaacaaugcugggagggggaggggcccaggcauguaugcuauaccuguguguugacauugcucaaauguuccuaagaccagaaaccgcugagccuuguccauagcucuccuccaguccuuggcccugccaugccagccaggcuagggaucaggggccucuuagagcccuugggaggcagagcaaaggggaggaguauguggagacaaggccaggacucugugauuuacccacagaccuucggacagugugcagccugcucagcacuccccuugccguggccgggucugcaucucugguaagcacacagcugccccagcugccagcgugccucacugcaccacaccacacccccuccggccugcuucuaaccccucuuccuuccccucugccccuuagaccuccggaucccacucauguggaaggauacagaguauuucaagaacaaaggcgguaagcaucacaaacugggacaaacucaagaguguucccgagguggaggcacuugugggaagucuuaaggucauuuuucccccuuucuuucuuuuucuucuucucucuuucuuuccucccagaccugcaccgcugggcuguguuccugcugcugcagauuggggaacagauucaggacacagagaugguccugguagacaggacccucacagacaucuccuuucagaauaaugugcuuuugugagugccucgcugcuguggcucccuucuucuccagcuccuggggugcggggugggggugaagguggagagggagaugacucaugggcuuccccuguggaguuguccuucuuugccccauguccuccugagccuccacucucccacaccugugucacagugcugaggcagagccugacuuugaacugcggcuggagcuguauggggccuguguggaagaggagggagcccuggcuggugcucccaagaggcuugccaccaaacucaguagcucccugggccguuccucggggaagagagucagggcaucgcuggacagugcuggggccuccgggaacagucccguccuguuaccuaccccagcugugggguaagagccucuccuaccugcugccuuccugcagcuccccacuggugaccacgucacgcugaaugagcaggcauucuggcuaacccuagaguuaggccuaaguuagucuacaagccugacaguggggagccagggagagccagguuuuggggaucuuaccuguuuggcagccagaaaaacaucuuauaggacuggggauguagcucaguuauuaaaaugcuugccagccggguggugguggugcacgccuuuaaucccaccacucgggaggcagaggcaggcggauuucugaguucgaggccagccuggacuacaaagugaguuccaggauagccagggcuauacagagaaacccugucuccaaaaacaaaaacaaaacaaaaaacuaaagugcuugucuagaaaacacgaagccuugggugggguggugcaccuguuauuacaucucuugggagguggaggcagaagaaucauauguucaaagacauccacugcugcauggugaguuuauggccagcauggugcacauaaaacccugucucagaacaccaaaagcagggauggagaaaagggcuccauagauaaagcacuuacugagcaagcaugggggcuggaguucugaucccccagacugaggcccagggccuacuugggaggagagacaggugaccccuaggguaagcuggcuagcucgacuccuugaauuggcaagcucugaguucagugagagacccugccuucauaaguaauuaaagaggacacccuguguccuucuggccucuacauauauaugcacaugugugccaccccuauagaaucaugccaagagcagacauggaugcauaaaccaccaugcucugagcuggggcaugcucuguggcaaagcccacagccagucaccuaggagcuagagaaagcugccccauuuacggacugaggaacaccuacucucauggaacugccacaauuucacugagauaauguauaggauguauaagggaagguccagacgccuagcaggaggucaggaaaacaggaggcaagcuaguuuccaugguaguuuucuuggcaguggaacaacccagcgucagcccugcagcgccuuccugccacacaugccacuccacugaugucccuucucccuccagagguccucgauuccaccucuuggcccacaccacucuuacccuagaagaagugcaagauggauuccguacacaugaccucacgcucaccagucaugguaugugugugugugucuguccaucuuucagggacacuggcacugguaggagggcuuguggggucguccccuucucacuucccauccucaccugguacuuccuccucccccagaggagaacccugccuggcuaccccuuuauggcagcguguguugccgccuggcagcucagccucucugcaugauccagcccacugcaaguggugcccuuagggugcaggugagggguccuacaggaguggagggggcauggacauagauggacaaccuaaagaucuagacaugggagggacaaagugggaugggaagacagcagggugaguauugggugcauggggucagugggggacugggaggaaggugcccgguuggggaggcaauauuccccagaaaacaccaaguugucuacgcagcaagccggggagcugcagaaugggacacugguacauggaguccugaaaggcacaaaccucuuuuguuacuggagaucugaggaugcagacacugggcaagaaccacuguucacuaucgucaucaacaaggugacuagucccuccggggugaggccaccuggugccugggcucaggcaccucucucucaagacuccggaggguugggcccaggcuucagagacaagagaaaggcagacucuguuccuaagagcacuaagcccaccacagggccugggauacagagguaccuccucccuacaccucccuacccccaaacaaugaugcuacaacaggcaacccgcucccucagcauccccagcauccccagcauccccagcauccccagcaucccucagcauccccagccccuuccaaaccccagaggccucuuucuugggucaagcaguuucuccuccaguucucucugcuuccaguuugugcugcuaguaacuugcuguuugucucuacaaagguauaaacgggcugcucuccuccccagcccuagucuugcuuuucuaugugucuguuuugcucugucuagugcuggggucaaaucgagagacucguguuuuaagcaagugcccuaccccagcacugccccucagaccccgccuguguuuuggauguacugggcgggcaacucggaccugggccuugcuguucaugccccucugcaccuucccugcccugcucugucccccuuuccugucucuacuugcuccuucuuuccugccucagcacaggcucccauccccaccaugcuugcugccccacccucacaccagaguuagcaggaggcaaaugaaggccccagcggaagucccaaagguacugcuaggccagucuagcugggaugauggucagaggugaaggcagugccuugcuguccccugcaggagacuaggguccgggcaggugaguuggagcaggccccagaguggccuuucacccucagcaucagcaacaaguauggggaugaugaggugacaaacacccuccagcuggagagcagagaagcccugcagaacuggauggaggcgcuuuggcagcucuucuuugacaugaguaagggaaagagcugggcagaacuucugggagagcaggggugggggguggggcagaugugacagaagcagacaacuccugcaugggucugguccuccucuccucuccccuccccuccucuccccuccucuucucuccccuccuccuccccuccucgcaggccaguggaggcacuguugugaugaagucaugaagaucgaaacuccugcgccccggaaaccaccccaagcccuggccaagcagggguccuuauaccacgagauggguaagugagaggagggucagcuggaggcugauggaaagugggguuggagaccucaagggauccugguuaacagaaccagagagaaagcacaucaugggguccagggcccacucagcccuacuguguuccccauuccucuccacuucuuaaaagcacacccaaccagaguucaaaacaaacccuaaagagcagagucguuuccugccugcgucuguccuaauccuuccuuuucuguuucccuccaugcauguggacuccugucuccucuucugaacucacuugcccggcacugcuuucucuccucuguucuugguuucuuuauccacuucugcuacccccuccccccauaacgucacagucuuaucagaaccuguggccuccggaggucccugugaggggcugcuccugcagaauaaugccaucucagcagagauucgggccuugcuuucuuccuauuacagugacaggugacagucagggcugagcaggccagggcuugagcucugacuagcccccuccccuugcccccucccugcugccacagccauugagccgcuagacgacaucgcagcugugacagacauccuggcccagcgggagggcacaaggcuggagccauccccacccuggcuagcaauguuuacagaccagccugccuugccuagcuccugcucgccugccucaguggccccagucccaaccuggaugcaaccccugcccuggggaagaccccgaaccuuuucccuggaugcugccccugcagaccacucccuugggccuucucgcucgguugcaccccuucccccgcagagaucccccaaauccagagguuucuacagcaaaagccagcucggcccauggcuccaguccccagugugagaggaaccagcaacaggaucuggccaagaaagaaaaugacccaaggacaacugggcucuagguccagcacuguggggcaccaguuggccagccugggcuccucuuccuccacuggacuaggacggaaggcuggggagggguaauggaaaccccucuuaaguuguggcuaucaugguacagagggggaccauuccuggagcuggcuaggauuccccuaagcgcuuccugggagaaaacuggaacaacucugcccuaucugccugcacuaaccagccuccagggcggcaacggagaguggagaggaaagcaccuccccccgugaucccaauaucaaccauuaaaguuauuuaacagcucgau

SEQ ID NO: 3125 - RNA, 2760 nt, Mus musculus
guuccugcggcaauucguuuauuuuugagcaagguccauuucccaguguggaggcucaggacccagaguggggcacaggcuugguggggagcagccaggcuuugggggucucguuccuuaucuguuucauaaucaccugaggcuuggacacaccugucuggauggguugcugcucaggcgccuggggggugccuucuucagccuccuuccggaugacagcaggauugagcagcuccuggguuccccgguuccacauacucacaccaggaaccagcuucaugguuucugaaauaaccaugggcuuccaaagcacuugggacguagccucgaggaccuggggcgccgcuaggggccauccagaguccuccuccaaaggugucaccuccacagguuccugacccuguggaggcacgcgaguccgacccgcccacagcucucccagcugcuccgccucccgcucccagccacuuggccacuuagcuaggggccauaguuuggggguaggggugcuggcgacgucgggagggauuggguuucuagggaggaagcggaacccggggcugaggaauggcacguuugacccgaaggacggugagguuugggccaaguuuaaacuaggauccgggcccaaagcacggaauguagcacaacgcuggagagggaaccuugggcuagagacaugggguuuggagggagcacgcgagcuaagggcuugggacucgcaugcugagguugcggucccagcuuggcuccugcgcgggcgcccgcgauauauuuccaaagggugcacuucgaggucugggaucaggaccucggccacggggcgcacccaguggcggggcagccgcgaggaauccaugcgcaacgugguggucuugugcuuuggccgcucucccaagacuucaggcuccuggaacgcggagggcucugccggggugagugcaccgaggugggacuccgacccuaucgggcugcuguggagcuggcccuugcucugcaagcucagccgguccccugccgcgucuggcuggggcaugcagagguaaagauccucgagcgacaggugugagccgaaggaugauuccuucucagaggccugaagacggacuacuuggggcugcuucagagaagacugggggcuguagacgcgcucgccuuccgccguagaucguaaagacuccuucgagggcacagccaacauauggcuucccucuuggccgugggguacuuccaaggcauccccgggcucagcuuccucaaacgccuccaagguggccgugggucucggggugacuuugggcucggcagaagguucugaagguugugucggcuuuugggacucuuugucccacgaugaaccuaaaaggaacugguccggguucccagguuccuggggaaacacacaaggguaaugaguuguuggaaauggagggaaaggaccucacuucgugguccugagcggcuccagaggaggcuucugucgggaagaggcucagggcuugggcuuacuucguuguggaacugcuccucuacacaaacgggcgccggugugugcagaacaggcacggagcccugggcccaggaauccguagugcaugccaggggcuccucauccucuccccacgugggguccucagccacugcagauucucccucaucucgggccaggaagcgccacucagugaucugcagcauggccucucgggccuggcuaauggugaauggaacgcacuguggaagcgagggagggucucagccuugccaggagaggcaggguagaagauaggucuggaagacccagaucuaggcccaccugcugggucagauagacuuugaaggcacacuccauaacucgagucauaaggucagccaagaugucacccacuacguccucgcccuccuccagggacauaaacgcaauccauucugccucauugagucucccaggcacgauguccaccugcggcaccggcuggguggguggccgggcuuuuucugccuuggaucgggucaccccacgaucucgcgccugccucugugggaacgaaaugggcacucaggacaggaaaucaagggggugggacggaugggcuaagggcuagaaagacucuccagguguuuucuaagaaagaaaagggaccaggacaaggaaccuucaagucugugaugcgccggaugaacacucuguagguauaucacucaauuuaauacuuguaacagccuucuaagcccucuuuaaugacaaggaaacugacaccugacagaagguagcccucacuaaucauguucaucucagcucugcucuuuugccuuacugcaguguccaaguucuugagaguuccaagaauucaccgggauuuagucuccucugcuuuuguuucauuuugcuuugaacaaucuuguuauguugcucuggcuggcccagaacuuacuauguagaguaccucaaacuugcagcaauucuccugccucugacucucagauucuaggauuacaggaauggaacagcacacaaaaaccucuccguuuuuguuauuuguugccuuuuguggguguguauauuuugaccuggagagugaacugaggacaaugccuacucacuaggcuaaaucccuucaccucuuuuuuacucccuccagacaggguuucuaucuguagccuuggcugucuugaaacucgauguguagaccaggcuggccucaaacuugagcuccaccugccuccacuuccccaaagaugagauuaaaggccuguaccaua

SEQ ID NO: 3126 - RNA, 34204 nt, Mus musculus
cggggcggggcggggcagcaaguccggagcggcgggcggcggcggggccgaucggggcgcggagcccugacagcagguacgcgggcggcgaccccgccgacugucugcugagcugccccgaagcucucgcggagcuggcggggacucgggguuaggacuuggugggcucgaaggguggguggcacccgggcgggcggccgggcaggccuggggccccgcugagcgcuucucccaggcuugcccacucuccuucagauuugcgaggggccccugcuuacugugacaccguagugagcgcaggcuuucugugggcacguguuuaggaauuuguguuaaacgaagacaaaaauuaauccuagaggguucagacguggagggucuggaaaugcguuugaugugugaguacgccuuguccugggguccaacuaggcuuacaaaacgauccuuguguagucgucuuguacacacaccucucguaacugagcaggacgacagcuaaagcacacagaugcgaaauugcuguuuucaaagaggcaggucuuuagacugaaauccauuuacagcagcgcagagagcugcaagcggcugcuggccccuuguuacccugguguacuuaaaagguacugagaauggaagaacugugucagaaauuggcguccuuagccuacugugcugucaaagccugucuucuuguacuguauuuaaacagauaaggauaaccuaaaaaauaggaaaauauguaugaguguagggaccagaaaugucaggccccugcagcuggaguuagagccaguuguaguucuaguaacugaagucagguccucuguaagaacaguaggugcucuuaaccacugaaccagcucuucagcuccauaacuuuauuauguaaaaggugcuuugcauucauauauauauuugaaaguucagguuuucucagcagacuauuucagaacuuuuaguaugcuggauauauuucucaagagucucuagggcauguguauguguguguauguauguguguauguauguguguguguguguguguguauauauguauguauauauauauauauaugcauaaucucccccaaauagacagggagauacuggauuuuuguuuguuuguuugcuugcuugcuugcuugcuugaguuuuggucgugucuacuuaacgucuggugcuguuuuuggaaaugaaguucccgagguagaaacccaccauuguaaaggggcagugugugccagugguuuuuacuuuaauggagguauguguuuaauagagucugguggaaauauagcucuuaucuagucugcauuuguaacagguucucaggugaugcuguucaggggcaagaucuuagcugacaggcacauuuugcuaccugcuauguagaacaaacuacugcucuggguuaguuacuuuauccagcccuuaaaccaggaguuaggaccagaagaccucucagccuccucucaucucagugcugggcuucuaaccgcagccaccuuugcuguagcugaccuccauaugugauacucuugucaguuuggcaaauuuugcaaucaggcuugaacaguucuaauaauggggaaauaacugaauaugccccccccccccccgagauagaggcuggccucaaacucccuguguagccacaacuggccuucagugccugcuucuccugaacaccccaguugcuaggauucuuaguguaagccucccuguggcaucuguccuugucuaggcuaucucuuagaguuaaaccaaggaaaagcugacuuuccagguguggguaacacucaacuugggugcuguuuuuguuuuuugagacaguguuuuucuguguaguccuggcuguccuggaacucacucuguagaccaggcagccuugaacuuagagauccgacucccaagugcugggauuaaaaaugggagcuaccaggagugagccugguuuuguaguauucaacuuuaaugccaacacuugggaggcagagguaagugaaucucugugaguucgaguacauccuggucuccagagugaguuccaggacagcuugggcuacauggacagacugucucaaaacacaaacaaacaaaaaaaguuaacucuuaccaggugagguggcauauaccuuuaaucccagcacucgggaggcagaagcaggcagaucucugugaguuugagguuagcuuacucuacauauugaacuccaggacagccauggcuacuuaaacaagaauaaaacugaaaguuggcuuuuaagccaugcuugugauaccuguuuauaagccuagccccugagagguaaauacaggaagauuucuuugaguuuggggacagucugggcuacuuagugaguuucaagcuagccccagcuacagaggcccugccucaaaaaacacugagggaagcugaggaggacauugccucuuccagcaucagaugacagauauucccagcguuuuucuucaaaccgaaucaaugcuuaauucuuucaucacauuuaagaagauucguucuuaaaucugucucuguuuguacguaguggagcauuagcuagacguugaagggugggcgugguguguaagacuauagaaagcacugggaacagccuugguggggcagaggagacugcacacaccgaaccggggacuguuagacgaucgcggugaaggugguggauggacagugaagagagcagcgcuugagaaguauucaccuuacugugcugucaaaaguggucagaagugagggaggagaggccaggaguuugcaugcaaaccgauaauuuagaccgacgauuagaacaguaacgccuggcuuuauguuuaacuguguagaucacagagcuuuuuugggcaugaucucacuugauguaauuuccuguaaggugggacaagcaacagauggagaagcaccaaaaagaagaaaugaguugcucuaaucuucaaagcuauggaauggcagauaggaagaauggagaaaggaaggguguguggguagugacugaggccuggcuggacgugagggugcagaggagaagacacugaacggaaggagucagaggggcugggagaauugcaagagcguccacagcugccucuggguucugugcagccccagcagugguuguggcugccuggagguggagguuagcaaagaucggaguugucguggucugcuaagaggcuagggaguuauggaggggauggcagaugucugcgaaucaggggagauggaaacuggguucucaguguccuccgucacccaguacagcaguuaguucugggagccaguggucuaucaauccagugaucuuuguuaaucggagugugugaccaggacaagguaagagacugccugacgcaaaugugucuuagggaccuugccaucuugggauucuggcuuuggcuuauugauaauuuuuuuuugguauugaguggcauuaguugaggugugcauccucaccuuuucucugcuuuucugcagcagagagcggggcuuuggugcccuuagagccuuuugaagaacauuccuucucagaagaucugcauuuuacuuagagccugucuggucugugguuccuuuaccauggaagcauaugaguuuaggugcuuaucugaaagagcuucaugcacugcucugugugugugugugugugugugugugugguauguauguacaaguguacuuccccccacccugugguguuuguuuuuuaaagaauuauugaauguaugugaguacacuguagcuaucuuuagacacaccagaagagggcaucagaucccauuacagaugguugugaacucaggaccucuggaagagcagucauugcucuuaacuagccaucucuccagccuguuuguuuuuuguuuuuugguaugugugaauguggugugauaucugcacauaugugucugagugugugucccugugcacaucccuggaggucaaagaaggaagcuuucucuaacacucuauuccuuuguuuguuuuguuuguuuguuugagacagagucucacuaugggccucuugaagcagccagcaaacaccgacaauacugucuucucccucacagugcugagcuugcuaguggguacucgagccugaacuuaggccuuugcgguugcacauugcugucuuaaccucugagucagcucuccagcucugcuuuuaugggcuggcccugaucuuaugcccggagcccggcuggcacaauaacuuuugacuauuaugucccucucugggcaaggcacugugcucagugcuuagacacuuugggguccuccuccucuuagggggagguuggacagaagaugguaggcaguauuuucaguaaaguguggugcuguaacaaaacuuuguccaaggugucuauacaagggcagaaaggaaauaacaggcucuccagggagaagcuggggaauuucaggaaggagaugacuauugaccuaaguagugauggaugaagagugggguccaggugacacucuuuuuuuauuugcagggcaaagggcuugaaguagauccaagcagccagaaggggagagcuuuggcaugcaucaaaggagggguuauuguuguucacagugaaguuaauaaaaaaaauuuauuauauauauucucucucucucugugugagagagagagagagagauugcuuguaugagcugguucuuucuaccauguuaauccugggaaucaaacucaaguuguuagauuugguggcauuuaccuauugagccaccucccuggcccgcacaagaagucuuuaagcagggauaacaugacuguguuuugggaagcuggccguggaaggaagcugaaggaguagagucugagcucaggauauugggagacuuaaaaagaauguaauggggagacuuaccguaacagaaguguuuuaaggcugaagugaaauuaggccaacaggauggagaggacacgugaaucggagagaggcuguggcggcagaauuaaccaaauaagaagggguuguuaacaguggcucaguuaucuaacuuagguagacuguggcaugcuggggcauguugaaccuuaguggucugugauguccagcagcccgguacaaaugugggucugaguuucagaagcgucccugcugaggguugguagaagaagguaguugguaaaggggggauggauucuuccugccacacuuacagaaggcaggggcagacagaggagugagggauuguugugcgugugagcaaggcugcccaggaaguggggaagaagaacauuccgagggcgagagggagcccccuucuucauuugcuucaggauagacacacuggaugagcuugacaaguacaucuggggguuggggaacaagaugccaugguuaccaugcuuucacucugaaaaugggacuaacuccagcggagcaguguggagaugcagggcuugauggcacuaagggcuacaaacucacaguuuggcagacaauggaaggauagauucuguggacacgguaaggacuagaaauaguuguuccuagaauugaagaggccagggcagguuuuuguggggauguguaagaaccagcagaggguacuacugaaaugaagguccucagaagaggaggugaggugcagaggaauggaggagggauggauucaggaggaaagaggcagcggugugugcaaagggauucuuaccuaagaaguucaguugccuuucucugcaagauuguuggcugagggguagguggccagugugagcuccaucaggacaggugcuuagauauggugagagaagcuagaugcaguugaucagaguaaggagagagagccuuagacaagccccaggaguguggaggagccugucugagcuggaguccaaugcuuauaggcuucuucaucuucaucauaaugauaguggcuuccuuuuaaugagugcuuuguucaguuuuaagugcugucagacucugucugugugugugugugagagagagagagagagaggagggggggacaggugucauuauguagcauggaacuuacuauaugguccaugccagcuuugaacugccaagcccuucuaugguuugcacaacaguccugucagagcauauugcugcuuuauugaaaggaaaguugaggcauacugggcuuugauaggcuuagcguucauguuugaugaguaucugcagaaaugggagucauuaucccaaggcaucagagaagggagagauuuaguggugguggugguggugguggggugucugucgcugccacagaggaauuccaaacugcuagagcgauuucccagcaucuugucuagaaagcuaagugacugguggcugcuugucagauaucacagggugagacagucaccugagacaguaaccaagagacgagaccuugcucucauccccaucccauacucccauacucccguguguguguguguguguggguguggguguggguguggguggcgggggucuuagcucaccuugaguguucccacuuggugcugugggugagaucugcaggcagagccugccccuggugagcagagagguagaugcauggauagaggagaaacaaacucaccucuuuuuuuugcugcagccacuggagcaucucuguguccuuccuuugggguugcuauggauacgccuuugccuuugcaugaugguuugaggagauugauuuccguuaugaucuggugaugacauggguuuuaaaaaggaaaggauggcaugaucugcuucagaggcuggcuggugagccguccaagcggcagaggcacagcugagguggcugagccuuuguuggcugccuuggcuuuugcugaaguugugaaauggugcaucuaccucaguagagcgcagucucagugcucucugccugcuggguccuagugccaggaccucacugguugauuccugggacauugcuaaacuggaagcugcuuagaaacuagacaagugggacucugucggugagagggcugcugcucuucaguguuaggcugcagagguuccuuuaucaggacaagugaagggguacuauguagcugcagccuuccuuucuggaucuuagagguggauguggaaaucccuggauacuuguuagagugagggggacuuugggaguggggagagcuccauucagauugggagugugaugcagacauuucuggggguaauaaucuggacaggugaagacaguccauuuaggaugcucucucaucucuguaaggucaguaagacagguauuggaguagggccaggaccaaaagaagcuccgugcaugacauauugcuggguuuccuggagcuuccagucagcuucccccagagggagcagaccuuucucuguugggcuuugggaggcaugcgugcacauuugcucuucuuugcuggugcuuucagagacacuuuggcccuguugucagacugcccacguuucagaccagccccugcuggagagcaaaaugugggguuagcccaggauuaaaguuuggaaacaggagcuuggaaaggcaucuaaguaugagggauacugaggucaaggucgaaacgacagaaggagugagcaacguggcuuuucauccucaccugcucuucuuaccucgccuccaguuugccuguguccguguucuggaaguucucuaagacuugcuuaguuaccagauacugaguacaucuuccacuauucuagauagcuuagcauauguaauauuguugaggaaaauggguuagaaauccagggacuguuuuucuguuaaggggaugugaagaguccugugggacacugucagggucccaguaaugcuuuggcaagagcacgcgccuguagcuaggcuugugacagacuuagaggcucaggaucacucauggauggagguaauacagucuuauuugacuaaucauagugccucugugugugugugugugugugugugugugugucuguguguguacuccaaagguugacaccagacugucuccuugguugcccagcaagcuccagaucugccugccuccaccucuagcacuguuuuacagaugugcacggccaugcccagguuuuaguggguucugggggucugagcucacguucucaugcuuauauacugagugcuaacuacugagccaucucccagaccccuugucuuauuuuuguugacaauauuauaaacuuuucuugauaggauugggccugggaccugggacugucacaugcuaggcaaguguucuagugaaccugcacuguuuaaaauauuuuauuuuggaauaaauaguauauuuacacauaaguauaagaaauaacauugaaaaacuggccugguaggucagguuuguaguccuaacuacuugagagauugagguaggaagauuaugaguucaaggccugccugggcaacuuuuugagauuuuuguuucaaaaugaauaguacaagaccuggaagaugguucuguugguaacugcuuggcaugcaagaauagcuaccuagaugggauccccaggacccaugcaaaagaacaaggcacaugagugcacaccuguaauccagguacuggagaggagagacaggaggauuccugggacugcuggcuaguucuucuaacuagaauuggcaaccucgagguucagugggaguuuggagaguaacugagaaagaaaccugauauugaccucuugucuccacauuccucuaaaacugcccacaaauaaauaaaaauuuuuaaaagggcuaaguguguacagugcuugccuaacaugcacaugagguugacaguucaguuugcagcaacacacacacacaugcauguacacacacuccugcuuaaaauaauagcgauuacacauauaaacccuuacuaaguuccuuccccagcccugugcuaacaacugugaagcuguggcacagggucuuagggaggacagagccguuguucagugacugaauggcucaucacagauuccucauguuggcuuucauaguccugccuucuuucuccuuauuccuuaccuacuggcaagcaccaaucucacagggguccacaugggaacagaugacaaaacacauuuuagugugcgcagguaaaucugccccaggaaaggcccaaaggacaucuccaguuucccuuucucuagucucuuaacauuuggauucucauucuuuucucuguuuuuuuuuaaaugcuuuuguguaugcacaaugugugugugugugugugugugugugugugugugagugagagagagagagagagagagagagagagagcgcauacucauacauuucugugugucaguacaggcacacaccugccacaguacacuuauggagaucagaggaaagcuugugcuguugguccuugcuuuacaccuuguuugagacggggucuuuugaggauucugccucucaacucauagggcugggacugcagcuccauguccucacacauguguggcaggcacgucacccacugaauacucucuauagccuccauccuaauauugauauucauaccuaaaaacuugccagcuuauuuauucaugugauaauuauauuugugcgugauauucuauaaauauuuacuauauaugugugugugugugcguguguguuuguguguguauguauguguguguguguguaugugugugugcgugugugcgugugugcguguguguguguguguguguguguguacauggugggaguaugugugucugaggaagccagaagagucagcucuccuggagcuggaauuacaggugguugugagccuuccaggguuuuggaaccaacucagguccucauugauagcugcaaacauucuuagccacagagccaccugucuggccccucauuugcuaacuuuuaccuucauuuauugcagcuuuggaguuucugcugugagcaggucaucacugauguguggauacacauauaggcaccuauacccggcugggcacaguuugugucaggcauuguuacagauccuuuuaggggucaggcguugauguuaugaguuggucucuguguacugcaagguguaguaaggcuugcucucuagcugcuggcugcuuuuccuuauucuuuguaacauucaugagagauagagaacgcacgccuuuuuuguguggauuguguuacugugguucaauaagguaagcaucuugcccagagucaugcaggcgaggaaaugcgagaacagagcuguggcguccagggcugaauguggggcccaugcaugccagccugcugccuuuccuggcaucacaucugucacggccuccucggaucccuuuggcucuggcucuggcucuggcucugucccccucucugucucugcuuccaccucccuucucacccugcagcauacgcuuugcuguaauccugccuuuccuugcagguugcuccuguguccacucuacccugcauguuugaucuuccuaaagcagucucacuaugccaucccacagcucaggagcaaggccuacugacuguuaucacuggauucaguccgucugucccugcccgaugcuaaacucccugcccacccuucucacuuccucuugcaccucaguguuuguuuauuaaggaccugacucccugcacugaaagguugugggcuuuccugcagaaggcuuuaggauuugacagaagaacccaagcagauaccuuagaucccugucugucagguguucauaacuuacagggcuucuguguagccccaaaccaaacagaaagcucuguaagucgaagcccaguucaccuuucuccugugcccuauuuacucucuauacagcuuguguaucucuaguauccugccagguagcucuucuuuggaacuuuguaguuuucauacuccuaaaugugcuuucucuuccucaagucuuacaguauugaguagaugugucagacauucccauucgguagaauaaacagcucucaaggaggaguguauauucaugugcaaugugcucagagcacagggaggcugcucuuacaucuguguuaucacuguugcccugcuggaccuagaacucaaaauccuccucccgauuucugaaugcugggauugcagguguuuugaaaguaguucaguuuagagccuggcccuggaagccuggagauaggugugggacagugagggacugugggacguaucaggaguucuggagcagcuguguacucaccuggguaacccgagggaaagugggucucugggccccagccuccuugucugggccaucccuggccugccucuggguuauugugauauaacccagugugguggugaugguguucauagcuaguuuuuauuuacaguacagaugcuguucuaaaugcucuuauuuaagcagguguguguguguguucauuuauuggcaaauuuaaagauuuguuuucccuuuuuguuugucuguuuguuuugagucaggaucucucucucucucucucucucucucucccucucucucucucucucucucucuguuuauuuauuauauguaaguacacaguagcugucuucagaugcuccagaagagaucaucagaccccauuacaauggcugugacccaccaugugguugcugggguuugaacucaggaccuuuggaagagcggucggugcucuuuguuuugcauuguguauggcugugucucuaugugaacauauacacagugugcauacauagggaggucggaggagucagauccccagagccaccugaugugggugcugggaaccaaacucagguccucagacauaggagcuggacauguacuuaacagcuuagccaucucucuaguccuuauuuuuauuuuuaaaaaggauuuauuuuaaaguaaguguguguguguguguguguguguguguacacacauaaauagagguuccugcagcagucagaggcaucucaucuugagcuggaguuacaaguaguugugaguggcacagcauggcugcagguaaccaugguaacagaguaaacucagguccuuugcaagaagagcaagaccuuuuagccacugagccaucucuccaaccccuguccuaaauauuuuauuuuuuaaguuuuauuuuaugguguauggguguuuugccugcauguaugucuguguagcauguguguaccaugcccuuggaguuuagaaaaggguaauagauccccuaggacuggaauuaaaggcacuugugaaccucuauguaggugcugggaugaaccuaugguuuuuuuuuuuuuuuuuuaaaugguuuuuucgagacaggguuucucuguauagcucuggcuguccuggaacucacuuuguagaccaggcuggccucgaacucagaaauccgccugccucugcuucccaagugcugggauuaaaggugugugccaccaugccuggcaaaucuauguuuucugcaaaagcaaccaguguucuuaauugcugagccaucucucuagcccccguuucuguucuacccacugagcaaucugccgagcccuaacgugauguuuugaaauguguucuguaggcacucugaguggguuuaguacgauugucugggcugggguggauaugaaggcagagcaaccuggacacugcgggggaagcagaggugggguccugaugguucugggcagaaguaaggcacagagacuguuuugguugagagguuaaucuagcauauaaagggacuggcuucauuaugguguucuuccaggugggcaucaccuaacagaacugcuuuguggcauuauccuguguuaggcaagugugcagaguggcagaaauugcagucuugucagugaaggaagacaaguguauucagggacuagguccacauuacagccaggggauccagugguuagaccccaggcccuuugcuuaagggguaagaccuuaggcauugaccugugaauaauaaaugagguagcauguggaaaccuuugacuagaauaaguaguuucauuaaauuaacaccaucuguuuuaaaauuaugaagguaauauaacauaacuaaggaagcuugugaaguacacaacuauaaaaaauaaguuggcuuguugagucugauguuagaagacaaggccaaggguaaaagagaugaggaccuggguaaaguggacuugggccaaggggacagugaggugcuuagcuuuugaaaacuaccuuuaauaaucccauugaaugugauaucuuggggaucagagccugccugacacaggcagaggagggagugacuguggggaccucugcuguugcagggguggggagcuggguacucauggcuuucucugggugagcaggcuucuagcucugccccuccuguuuaucuggcccaguguaagacagagaucgagacccucgucguguggaguccagacaucuuucugguagggugacacagaaaagcagcagaagggacuagaaggccugugaaagcaguuugaugaagugcugaucauuuugaaguggcacuugaugcuuggggaccugcugaagccucacucacugggacugggggcagugauagugagggguacagguggggaagaagugucaccuccagaacccugccugcacucuggugcugaggauuucuugccuacccaucccuggguucgugugaaggaggggagcacuaggacccagaggccagcaugcuuccugacagucuagagcagcacuagcgcagagugagacucaucagcuggcaagcggggcucagugucucuggguucaggaauccuugggcaguagaagggacuuacuccucagccccaucacugcuccugccccuccagagggaggaccauggacggagggagguccguggcuaacggcuucugagccguccguccaugcaggcccaucacccugaccccuccugccuagguuucugccuuuucucugucuuuggcuagcugggggaggggguagaguccgggugagcaacauggcccagagcaggaggcacauguccagucggguaaguggccccagucaauaugggauggcccugggagggcugcuggaccaggccgggugccuguggacaucacuugugugggggcuggggaggcaggcuggcucucagcugagguacucacacacugggcuucugaggagccuucagagcgcugacaggggcaggcuggacaagguaccccacccacccacccaguuggguccuaacuggggcccaacuagacuugaccucugacuccagcuggcucugaggccagggauuucugagggguccagucugucuuugacuggccugggggucagaaggccuagcugugaggcucuuuucagaugcccugcuaucugccucugcucucuccucugugagguuagauuugcauccacuguuagagccaccugacuccgagaggcguguugggaggugugggagggucuuuucugaguuuguguccagccuugauaucauuggcaguuuccuuuauugucaggcccaugagcucuucauugucccugguauaguuugagguccccacaucccuaggagcucuguccuuaccuuacugguggggcuuugugaagagaggggcuagggaaugacagcugggaaggguuugacuucccaggcucuggcagggcuccuuucugaagcuaacugugguguguguguguguguuugggggguaucaggaaagaccccucccccgagccuuuagguccacgggggucacauuuucuugccuuauuuauuugcuacaaucucucugguucauggaacagcuauugcuaaaaauggcuuaggugugauuuucuuccaaaucguggucugaucugggaccuaauuucauguguucugucaucacggguauguaagaaucuggguaugacccaaggacagcguuuuguuuguaccuuugccaacccagaugaacuacugggcaggguuugaggacaguaaagggcuaacuugagguauuuuguuuauuuguuugugcucuucauuuuaugacaccguggccugcaggguuugggggagagcagacaauaggacaugggcccugaggagggugcuggugaaugugcuguagucaacagucuagcagugccagguagauauggagauggacugacagcaaucauaucagcaaggcauggugguggcuguggcccuggaaagaggugcaguucugucuuucugagaagucuagguggacgugcugaugcgugccagugagcccagcauucagggggcugggguaggagggcugcaaguuucagaccagccuagggugguacugagauucuguuucaaagaacagugacaaaaauuuuaaaaggcucgugugcacgcacacacacacacacacucaggaagaggaggaagaggaggaggaagaagaggaaggagaggaaggaggaagagaagaagaggaggaggaggaggaggaggaguggaggaggguggaggagcuggagaaaggcauuugguuugagucccagggagaccgaggacaguggagagagccaccacugagcugcuaacuuucucagcucugguuccugggacaggguuguggggagccuggucugaauugaguuguuugcuuguucuuacauccuuuccuuggggacaguacacccuagaagcagcuauauggugauauucaaagaucuaucaguaaauccuaauuuguuauacaauuuaaauauaaauucuuuuuuaaaaauuucaguagauucuagagaauuuuagagucuuuuuuuucuuuuaaagauuguuauugcugagcugugguggcacacaccuuuaauaccagcacuugggaggcagagacaggcagaucuccaaauuugaggucagccuagucuacagagugaauuucaagacagccagggcuacacagugaaacccugucucuaaaaaacaaacaauaaaaaauggauugcuuauuguucauuuuugugacauuuuuuuuucuagaguuucuucuuacuguaggccaggcuggccucgagcucaccggguaguccaggcuggccucaagcucaugguaauccugucucagcuccccaagugcuggaaucccaugugugagcuagcaaaacaagcuuuuuaaacauuucuuuuuauuuauuuauuuauuuauuuauuauauguaagcacacuguagcugucuucagacacuccaagaagagagcaucagauuuuguuacggaugguuguaagccaccaugugguugcuaggauuugaacucaagaccuucggaagagcagucggcacucuuaaccgcugagccaucucaccagaccccuaaacauuucuugaaacaaggucucauuauguugcccaggcuguuccuuuaacuuaccuuauauagccaagguuggccucaaacucauggcucgccuccugauucaaccacccggguguugaaguccuggacauaugcucuaccuggcuuuggggaaguucugaacaugucacugauguuuuccagaggggaguuuguagucucacuuuguccugagaauggaguuuaaaggcgugacuugugguuucuagguccaggacgcuguccugagccucugacugaccauguuggcauaugucuuucuuccagacgccgaguggcagcaggaugaguacggaggcaagcgcccggccccugcggguuggcucccgcguggaggugauugggaagggccaccgaggcacuguggccuauguuggagccacacucuuugccacuggcaaaugggugggcgugauucuggaugaagcaaaaggcaaaaaugauggcacuguccagggaaggaaguauuucacaugugaugaaggccacggcaucuuuguacgccagucccagguaacugauggugcgagccugggugcacauuuggcgucuguguguguguguguguguguguguguguguguguguguguguguguuugugugagugcaugcucacuuuuguacaaacaucuguugcuugugcugcuaguguguccuuuuuccuaagucggaugaaggcugugguugggagaaaggcaagaucaagccuguucuguccccagcuugcucgggagcucaggagggacccaugguauaggcauucuugaucugacugcauuggguauguucuuuggccucagauccaaguauuugaagauggagcagauacuacuuccccagagacuccugauucuucugcuucaaagguccucaagagagguacuaguuacacccuggcauugccacuucacauccagguuucccacccuucuaauaacagggugucugcucucuuucuuucugucuuucccaucccacucagaggguucuucccccuuccccucuguauaaauguauuuguuguuguuugcuuucuacagagggagccgaugcagcugcaaagaccagcaaacuggugagcgguuuggcacuguaagggaggagcacagagcgggagggaggaaggcccaggcugggcaggaggaagcaguagaugggucuggauugaguuaggcuuguagucgccuaaccuccccaagaagggcaucucuggguaugaguuguaaccuuagggccagaauaaaggugguaggagaaguguuggagucuagauguuuagggucggguaggauugaguuacauguguagacagcuuccuaucuucugguauccaaagaugccaaggcgggaggguguucgggcaggguaaggugggguguggagggagaagcagcucuuuuguucacaaguauuguaagaugcaugcagauggcccuuuccagcucgcuuugccucuucugcagagggcuggaagguaggccucuaacuuuucugggccaggagguaaauauuccuagaagcuguuccucaggggacccuucuuugcccagggcucgaugcuuuaccuaacuucccuugcguguauucaccugagcugauguuaacacuuaugcacaggauguaugucaggccagacagucuguucucuaacucugaccuuuccugcuccucacgcagcggggacugaagccuaagaaggugguguguuuacuguuugugucugggccgaugggugggcugugagccccucccacucucuugcaugccccccaccccaacugcuacaugcauguguguguaaccauggggcugaaauggccagaggaaauggcaguuugucuucuggaucaccuugaggaaaacgaggccaucagguucagggaccaagccaaagcagcacucauuagagacaguuuucagugcucuagaccccuaguuagaaacugcaggcacuugacagcaaucacagcugcagcagguuugcagcgcuuucccagguagccaggcuuggcguggagggagggcauccuggaggacuagagcugagaagugugguagaaugguuguguaaggaagggccagagcagugccugccugccugccugcuguugagucaguacugccguaggugcccaccuugcucugcccaguggcuuucacugcuccccucgacaagugugugucugccuggacacacucccuuucaggaucuugcccguuccacucccucuuuccacagacuuuucuuuaggucuuuugagagggucucacuuuguagcucaggcuagucuggaauucacuauguagagcaggcuaaccuagacccuguggcagucuuccugccucaccuucuuagugcagggauuacagaugggcaccaucaugcccagcuccucaccaggggcuuuuaaacacuuagauugcugccaugacuuccucacaccagccuugccuugggccuccccacaaguucuuucugcccugcauguuccugucugagccgugugugcaguacugugagcccuuuguugccagccugucucgggccuuccugauguugcauggggaacuucuggauugggacugugggagggggaaagaaaaccgccuuucagcucugugcgggcauugaaaagacuuggaagucuuaccauggcagaaaccauaugcuaggacuuguuuuugauccuggguccuggguccagguaggaaugggauucuaaggcagauggugcugcagagggagcugggcacauuccagacacaugaggacuggcuucaucccuugaguacugcauugugguuggugcuccaguuucaccucagauacagaagagcaugggcugcagugugagcugggagaguccuggcugcaggcugacaugacccugguggcagucuaagcaaugcccauguccuagugaagugugacagccuggccucaacugcuugugcuaagaaguguucccugcucucuccagucuugcccccuggugguucaguccaagcaaaucauuuagccagaacagcuagguccagagcaaaacccagaguauguguauuuaugugugaguguuuugcgugcauguauguuaguguacuauaucugaacugugccuguggagaccagaggaggugauggaucccucugggacuggaguuacaagaugguugugagucaccaagugggugcuuggaauugaaacaguccugcauaaaagcagccaaggcucuuaaccucugggccauuagcuccccaaaaccaguguuuugagagagagucaggggagaacguagaugucucaaaaaauaccuacucuuucuagaaagccauuuagacauagacuuucaucucuccagcuuggagaggugagggaagagcccaacacugauauuauagcgguugcuggugccgauggcaugucccaagguucccuaaucacuguguguucuucggagcuggagcggugcucugauuguguuccugauaagaaaccuaaggguuucaccagugugugcaagagaaguggacuugaucggcuuuucaggggccagaguauaacuaugagauagauugauggagccggcaggcccucugucccuguccacaaauucccugggccauuucugcaguggucccuggcccagcuuuuuggagcagcgucuuggagguagaggagaagaggagcgcgauggugaugggacagagaggaaggacagcuuugcacaggacuuaguaccauccggagaaggcggagccauccgguucugggugguugcuaggugaccuagggcugguagcuccacccccauggagcugaggagggugggugcaugacgucagguggagcugcugcugcugcggccacugagacagccaucagcuuaaagcugacgacccgggccaggcaaggcuccggagccugcuggagcucgcaaucgcccgcugaccugcugugcaccugccacggccugugucgcugcagccgccuuugccuguccggaagcuaaggcugcauuguugggauuugaugcacuaaucuccugucuccgccgccuuucccucccucccuucgucugucuuuccucccuguguuugucugcccuccucuguaccucccucucuuuccucuccuugcuuucugugguuuucugcaaugaugagacaggcaccgacagcccgaaagguacucuugcuugcucugguccugcugcuggguugccagggcaauggaagcaggcugcuggggugggggugggggcugauugacuucaucagucuaccuggcagggggaggaggguaaggaugaaggggaggggguagggagaggugugugucacuacugugccccacccuggacauuuauguuccuugaucuacuugcuuugacucugauugagucuguaccaggucauuuacucaguggccucacaggcgugggcuucaggcaaucccuacugcagucaggguugggaggguuuacugggguccagccugaggcagcuagccagcugccucagugcacgaagcaggccuacuuaccaaccuuugcuggacugacuuaugcuuguucucccagcauccugcuuccccagagucugugcuagggaguuuacugggacaggauguggacccuagaauaguuuuugauccacagcuguggugaauuagucuugagcagagaguggagguuggccaucuuggacucagugucugcagaaaacagagcucaagcugaaucuugacuugcuagagagucaggcacaggcagcaagccucugggaguuggagcuaauugccccucagccacuccuggguggcuuggggaagagugguuccuaaggguugcugcccacccccacuccuccagcugggaggguuacuuugcugagcugugggcuuuuacuaaugcaguauucauaguacugacaccugagcccucugccuuagggagggagccugcugcaaggccuggaccugaaggaggcugagggaggggaucaacccuguucuuucuuaguggucugagcgccacuuucugggugucugcacuccugucagugggccggguccuaggguguccucucuagagucuagcacuugaaggaacaggcugacuugggaaaguccuugggagagguggauggguggggccccuagccuagaguggcagagauuguucacagaaggaugcucucuggaggccuucuugccagcugcugccuuuggucuccuguggcucagccuagggaccagacuugugggagcugaaggggccuggggaagugaagccuccaaggguuagguagacaugagaggggaacagggcagcgggagaugcgagccuggagcagguauaggccauccccuugggaggcagugggacagggguggugggcuagccuugucuauugcugcuucugcucucauugcuaccucuguccuccugccaugacccucucuuuccugacuccuacucuucuggcuccuguugccuguccagaccacaacucgacggcccaaggugagaacaagcaggucucuguaagccacugcugagugcacagauaguucaggcaugugcauguaugugggcaugcaugcuagcaaaugaauguugguugcaguauaccagggagaagaggaggagcuugaggcugguaacuggacuccuggggaagugauuucuaauucuuuuuuuuuuuuuaauguguaugaguguugccugcauggauguuugucauaugugugcccucagaggccaagagaaggugucagauauuuugccaugugaguucugggaaugaaaccugguuccucuggaagagcggccagugcucuucugaggcgucucuccaggccggacaguuucuaaugcuuaagaggccaucuuagccaguagauuggguguggaagagcagugagggaguuacggcuaaucaagacaggcuuugaucagcuuggaagggugagauuauaagaagugagugcucugaugucugcaggggcaaggguuaggggggcauuuguggguagucugggguucaacaucacaggggcagcacugucuaccccaggguuuguggcuuccugaaagcuggccaccccccaugcccccaccucaccccucccagcuugaacaggggccuggauacuguuacuuaguuagagcuuuguccuggaggaggagguaagggguuggcucuggcucuacuuaccuugcuuggaggguagucuguacggguuuccaucuuagcccaguauccuauaagauccguuggcauagaccuaaggagugaagacuggggaggcuuacugggagagcaagccugacuccacccuuucggccccgcccgcccucuuuccgaacuggacaauugagaacagucucuaaucuguucugugcuucugggcaugacauugaggcacuucugucugcugggggagucaggcauacacccagcgugaugggaaugggagcaguaagaaguugcuagagugaucacaagugggccacagaggggaguccuggggagugagagccaguuuugaagguuagagcagaguggggaggaauguggacacagugccaagggaggaaccuuguaaucuuaugucucccauucucucuucuuuucucgacuguccuuugucacugcuacuuuucgacucugucauugucccccccacccccaccauugugcuuuuauauacccucucugucuuucucuccucugccuccuuccccugcucccccucucccucccacacucccggauucuguuuucucuguggccuccucacgccucucaccagccuacucgcccagccagcacugggguggcugggcccaguagcucccuuggccccucuggcucagcgucagccggggaacuaagcagcagugagcccagcaccccagcucagacuccgcuggcagcacccaucauccccacaccggcccucaccucuccuggagcagcacccccacuuccaucucccucuaagguaagaacagaguccaggcaccucugcacccugccuagaguuagggaagaccuaggacuggaaucagaaagagugagguuucccuguccuucccguccuuccguacccucuccgucgcaucucgugcccgccgcgguuuccucucagauguuccuguaccacuugcucuugguucuuggucuagggaaaugcuuuuauacagucuuaucuuugcuucagcucaguuuuguuaggguggggcaggagcugugcacaaaccgugggaccuccucuuggcaggaagaggaagggcugagggcucagguacgggaccuggaggagaagcuggagacccugcgccuaaaacgcucagaagacaaagcaaagcugaaagagcuggagaagcacaagauccagcuggagcaggugcaggaauggaagagcaaaaugcaggagcagcaggcagaccugcagcggcgccucaaggaggcucggaaggugagccucaggugacgcugcgccucgggugaagcuggggagguagaaggacccaaaugaggggacugggaacuaggcugggauauagggugucugggaagaaagggcagugugggagucgcucugcgccugcuccaugcacuucuaaccuccaggaagccaaggaggcgcuagaggcaaaggaacgcuacauggaggagauggccgacacagccgacgcuaucgagauggccacucuggacaaggagauggcugaagagcgcgcugagucucugcagcaagagguggaggcacugaaggaacggguagacgagcucaccacagaccuggagauucucaaggcugaaaucgaagagaaagguaaggggccagcuggcagguaagaggaagguaaggagaaagcuggcggggcagcuggugcagugggcccggcguggacacauuguugcucuuacaggcucugauggggccgcaucaagcuaccagcucaagcagcuggaggagcagaaugcccgccugaaggaugcccuggugagguaggcuugccgcugucccuuuccugcugccuccagugccagggcacucacuaccuugugacagaccgaccgacacaugcuuucugucaucucugucuucucuuugaccccuuccguugcuccuuccacuucugcguaggaugcgagaccucucuuccucagagaagcaggagcacgugaagcugcagaaacucauggaaaagaaaaaccaggagcuggaggucgugcggcagcagcgcgagcgucuucaggaggagcugagccaggcugagagcaccaucgaugagcucaaagagcaggugugagcacgcagcccucaccuacccggguggcgaggcgcuuccgcuggccccuccugcugcugggcccucacacggcagcacuuugcccugucccuuccccuuggcacagguggacgccgcucugggagccgaggagaugguggagaugcugaccgaccggaaccugaaucuagaggagaaagugcgggaguuacgggagacugugggggacuugguaagaagagagcagacccccgacuucucacccugauggagacuguuuggaaggggucuucugagagcuugacaucacgcccuguccuuugagcagggacugugguaaggggaccagcuggcccugccaugcugaccuccugugugcucuuccccacucugugccauccaggaagccaugaacgagaugaacgaugagcugcaggagaacgcacgggagacggagcuggaacuccgagagcagcuggacauggcgggcgcccgagugagggaagcgcagaagcgaguggaagccgcccaggagacagucgccgacuaccagcagaccaucaagaaguaccgccaguugacugcccaccuacaggugccugccuccauccuggucucucucugcucaagguaacccugggguucccaggaccaacugugcuucacugucuacucucaggaugucaaucgggagcugacaaaccagcaggaagcgucuguagagaggcagcagcagccgccgccagagacuuuugauuucaaaaucaaguuugcugagaccaaggcucaugccaaggucggaaaaaugggcaccuugaagucagggguguuaguccaggggaggagggguagcugugggcuagcuuggggugggcuucuggcccuagggugcuuugggugguaauuguggaagaauccugaccugggcuuacccuacagacaaggggccuggugguucugcagcuuugcacccgacugaagcccuucuccguccuugcaggccauugagauggaguugagacagauggaaguugcccaggccaaccggcacaugucccugcugacagccuuuaugccugacagcuuccuucggccagguggagaccacgacuguguccuggugcugcugcucaugccccgacucauuugcaagguauggccagucagucaagaaauucagugugcugugagccaagguauugaugacgagaggggaaggcagcaggcacaggcugcccacacagcuuacaguuuacaagguagccuagguacucucacucuguaggggcucagugaacacagagccagccgccacguuccggagcucuguaucuguauuccaccaacugcagagcagaaauguuugcaggaaaccuugugcaugugcaguuuuucucucccuguucucuaagccaucuagcauagucuugcugucacuuagcuugucuuagguaucaucaguagcccagaggugauuuaacguguacaggccuguacgcauagguuacacgcagcuccugagcauuucacacgaggcacuccaacaucgccugucaguguuuauagaagucuaaaaccagucccccagguaggaaaagcuguccagggaggacaagaaguccuggcaguugcagacuacuucagcugagggauagagguuccuaaaggagaaacauugaagcuagaguaggaucgccuugggugcuaaaggauacgugcuggggaaucuaggcaguuacgacccugcucugcugugagccuccugcccgacugagagccgugucugcucugcguucauccccuccacauggucguucagcuauguccuggguuccugguccuguggucuuuguccucuauucccagucccaggacccugcucuucuuccugcaggcagagcucauccggaagcaggcccaggagaaguuugaccugagcgagaacuguucggagcggcccgggcugcggggagcugccggggagcagcugagcuuugcugcuggacugguguacucgcugagucugcugcaggccacgcugcaccgcuaugagcaguaaggcaccacguccccucccuugcacccugggcuggggcuccaggauucgcuggggcugagguaacugccuggagaccgugcccucacagagcucuuuuucugguccucagugcccucucucagugcaguguggacguguauaagaaggucggcagccuguaccccgagaugagcgcccacgagcgcuccuuagauuuccucauugagcugcugcacaaggaucagcuggaugagacugucaacguggagccccucaccaaggccaucaaguauuaccaggucuggggccaagguucagggcggggggugggggggggguggcagggcaacaggggauacguaccugucguguggccguguggccguguggccuugguuggcuuucugagaccaguuugcucugguuuuguuuuuauuguuguuugcgguugguuuguuguuguuggaggggcaugguaugauuuuuucaguuuuguucuuuagagaccgggucucauggaacccaggcuggccuuaaacuuucuguguagcugaagauaaccuugaacucgugauccuccugccuugucccaagugucgagauaauaggucuaagccaucaugccuggauaaaaaaaaaguugugugugcaguguaugugagugugcguguauguauguguguguauuguguggcacaguguacauguaagggucagaguacaacgugagccaguugacucuuucuuuccauccuaugggucuugagguuugaacuugggaucaagugucuuuaccgcugagcuaucauuggccgcuuuuauaagacggcaucuuacuguagcuagcucaggcuggccuuaaacuccugaugcucuugucuuagccuccccagcgacaggauuauggaccugcaccaccagucccagugcuuguuugucugaugugaacuugacaugugaugucacugccuagagcuuuuggaaaguuuuguaccucugaagaccacagcguccaggacucagacucuaguuugggaagagggcagucccccagcccuugcccuucauagacugaaggcugccucuguguuguuccuccucagcaucuguacagcauccaccucgcugaacaacccgaggacuccaccaugcagcuggcugaccacaucaaggugacgugucuagaugagugacuaagugucuguagagaugagggaaggaaaucagacugagaggucugugagagcagaggacccaugcgcaugugacagucacaggagguggggacccuggggaugaggaugggugaacgagcucucaugaggagcuaagaccucacguuucuuucccuguaguucacccagagugcccuggacugcaugggcguggagguggggcggcugcgugccuucuugcaggugagggcacaucuggaccucaggaguucuuccuuaucccuucuccuuuccuucccccagugcuaauggcugcgugucuguuccccucuccuguguagggugggcaggaggcaacagauauugcccuucuucuccgagaccuggaaacaucauguagugacacccgucaguucugcaagaagauccgaaggcggaugccggggacggaugcuccugggaucccagcagcgcuggccuuuggcucacagguuuagggcggagacugugaggggaggaagcugagcagaaauggggguaggggggacgccuagcacauuaagauccggaucuggcggggggauugaauuaggaagcuaggaacuaugauggcggacaaggaugggcucuugaccccaaccuaucacacagguauccgacacacuccuggacugcaggaagcacuugacgugggugguagcuguucugcaggagguggcagcugcagccgcccagcuuauugcccccuuggcagagaacgaggggcugccuguggcugcacuggaggagcuggccuucaaagcaagcgagcagguugaccuggaaccuugggcuguggggucuggggaggcaguagcucuugucagcuuuucauaccugcucuuggcuguugcagaucuacgggagccccuccagcagccccuaugagugucuacgccagucaugcaccauccucaucagcacgaugaacaagcuggccacagccaugcaagaaggcgaguaugacgcagagcgacccccgagcaagguagguggagguuucuggggacccaguggccuguagggguucaacuugcagagcagcccugcuuguggagaguggggaggcuggagggaggggcauucugccuagaaaccagggugauuuuccugugacuggagcagucucuuucccccgccuccaacccucugacccacugugucuuuuagccuccuccgguugaacuucgggcugcagcccugcgugcagagaucacagaugcugaaggucuggguuugaagcuugaggaucgagagacaguuaucaaggaguuaaagaagucacucaagauuaagguguggaggacuggagagauggaucagugguuaagagcaauagcugcucuucagaggacccugguuugauucccaacacccacgugguagcucaugaccaucuauaauucuaguccuaggggacccaaugcccucuccuggccuuugagggcaccaggaacacauaugguacacauacauacauacauacaugcagacgaaacuacacauaacaugaguuaauuaaaacaguuaagguaaaggcugucuaguguggugggacuuggcggugucgaguacugggugugaggaugaaggaacgugcaaucugaggaaggagguaggaccugcaacuaggggccauccgggagggagcuccacccccacagccuaacccgguccuguggcucuggggaugacggugacguucaggaacugaagugucccccauccagggagaggagcugagugaggccaacgugcggcucagccuccuggagaagaaguuggacagcgcugccaaggaugcagacgagcgaaucgagaaaguucagacacggcuggacgagacucagacccugcugcggaagaaggagaagugagcaucauccuggggcccugaguccucuccccuucccuccuccccugcagugagcaccguccuggauccugagucuccuccucuccccuccuccucugcagcugucuguugcgagugacuccuuuugccugccuuggaguguggcuauccacucuuucuuuccuacccuucucugcuccuccugugucucagguugccucugaggccugcccucaggacgugccugaacccaugcucucuuccacagagacuuugaggagacaauggacgcacuccaggcugacaucgaccagcuggaggcagagaaggcagagcucaagcagcgccugaacagccaguccaagcgcacaaucgaggggcuccggggccccccuccgucaggcaucgcuacccuggucucuggcaucgcugguggugaguacaguggcuagguggcaguggcccagaggauacugacuuggcuggccucucuucuggccucaguuugacuucaggugccuguacccuagguguucagccuggaacaugcuugccccaguuuuacgcugccuguuugagcaggguuuuguuuuccacgacgaugcguucacagaccuuuguguaaaguagcacgccaucaagacugugccaguaaagucagaagaacggcugaguuaggcucugccauccugccuuucucucucagccguauucaggaaagguccagccacacugcuggagugccagccucgugugagugaagccagugucugauggcccucagugugugugcuccacuucuguucugaccucuucuuagguucuuaaugaggucagagagccguauguggaguguugugccuuccaggcugguucccagcuccugcugccucucgguucccacugcucuaguuguuucugccccccgcccuguccccuuucaacaugugcuuaacauuuucacuccagagaacagucuccuagccccacagcuaaaccaccagggcucuggucguuccucaucucaccugaggacuugcccuuaucagaggccuugucauagauucgacuugauucaggacggcgaccaagugccugugugacaguguacucccacagcacagacagcuccacaugcuuugaggggaaucucuugauucaccauuuugugcuguuuuaguaaggcucuuaaacaaauucugcuucuggauuagugaaacaccccaucaaacaagggaggcgcuuaccucagagcaggguauccugaggagcaaggcaguacuugccccuucuugccaggcucuccagccggagcauucggugcagagauacacgcagccucuggagugguucccaugccuuuccuggagaugaaacgggaggcaggagcagccucaccccgugcuuccuguguucacugacucugucauucucucagagugugcugggccucacggccucacccacuguugcucuccuucacaugucugcucaaccccccaaagucagaggugggguuuugggaaguuuugguggugaggagaagggucuucugcguguugugcccagagucccucugcuuuguccaguguccccucauugucuaaucgcucucucucuuuucugcucccuccugggcucuccagaggaaccacagcgagguagagaccugccccagcuaggguuuaccaaagcuacugggcacugggacuggggacagcaucccaaguggaggugggggaggggagggagaagugaagagcccaguuuuuaacccugcgcucccaaggcugaugacauugcacaugcuguucacagggggcgcuccugggcaggcuccgggcgccuugccaggcccggggcuggugaaggacuccccacugcugcuucagcagaucucugcuaugaggcuacacaucucucagcuccagcaugagaacagcauccucagaguaaggcacucauggggauguggggccugagcucggagcaugccugcccagugauggucggucauugaaggucauugaaggucaccggggccucuuaaccgcucccucuguucccucccaccuccugacagggagcccagaugaaggcguccuuggcagcucugcccccucugcauguugcaaagcuuucccucccaccccaugagggccccggugguaaccuaguggcuggggcacuguaccgcaagaccagccagcuccuggagaaacuaaaccagcugaguacccacacccacgugguggauaucacucggagcagcccagguaugugcucugcgucugagaagauggucacugccauccuguccccagggcuucuccuagcagagucuacuggcuucagaaugcaguuuccuugauucuugugcacagucucucccugcucucucuuuccugucucucucuccucucuuuuuccuuucuuucuucugauauugggcguugagcugagggccucaagccugcaaggcuuuuuacuuuaaaaaauuuuuuuguuuuguuaaaauuguuugagacaggguuucucuguguggcccuggcugcccuggaacuugcucuguagcccaggccauccucaaacugcucgccucugccucccugagugcugggaucaagggugugcaccacuauaccuggcaauuuuauuuauuuuuuaauguuuuguuuuguuuuguuuucgagacaaggucucaguaaguugcccaggugggccuugaacuugugauucuccucucucagucucucaguggcugggguucuaggccucuccaccagagccaguucacucuuucucucugaagugcccgugguaugugggucuaguaccgacacuucugaccaugcaguucagcugcucggguggaccucaguguccucagcaucucucccucuucacagcugccaagagcccgucagcucagcuuauggaacaaguggcucagcucaagucccugagugacaccauugagaagcucaaggucagucccaugccacccuccccacacugagcgcccccggaucgcccuuggggagacaggcccucggaucgcccuugggggagccaggcaccuguggguuggucucuggaccugcuccgugcucuguggcacacuggagugcagugggagggaagggggauccuugcuuagaagccgauugauaaauucagucaacagugugugaccgucgucaucuuuaggccagugagccaccagugcuggcugaccaagcagcucugugggaugucuggcugcagugucugucaagugaaauaauucaaggacaaaauauuugccaguggcuuccuagaagccauagacaccaaguuagguccuaaagaaugaaggcguauacaggaaggacagaugcuggacggggucguguguagugaaagaaagccauguuccucuggagcuaguguugcgggaaguucagguguugagcuaccacccggauccccuaagugagcccugccuccccuuccucccuccccuuccuccccaggaugagguccucaaggagacagugacucagcgcccuggagccacugugcccaccgacuuugccacuuucccuucaucugccuuccucaggguaaggaggagcagccugggagauggcggcgccaugcugggugcuccuguggccucuccccuuccucuugggguugaagaggccccuggagucucaggcccagcagccucacccugcuuuaccuggcagggccaagucuuacuugcacagaaccaaaagugcuuccagcccuuagagacugggcuauucuagcaaauagguaucaccugcccugacccucacaccaggagggacucggucaccuuguuggacuccccuuguucccauuugggaaguguuaccguggugucagacgugaagccucaguuucccacacaguacaguacucagggacccucagugccuauaaucaagugagcccuuaacccgagguccucuuguucuucccaacacaaggccaaggaagagcagcaagaugacacagucuacaugggcaaagugaccuuuucaugcgcggcaggccuaggacagcgacaccgccuggugcugacccaggagcagcugcaccagcuucacagucgccucaucuccuaagcacuccuucccugccuucccuguggucccacugcgcagggcacagccaccucagccacucccaggcuggaccacacgcuaaccuccugagugguucagcugcgucuggucuggucaggguccugcugcuuccguaaccuggguuugccuguccaccccuggccucuuccguauuugcuguuaucugcucccucuuuccugaggggccucagggcauuggagggggccgacaccccuccacuaaagauugagugaggucucccugacugaggacuucaccccuugauuaaagcaacuugugcuucacugcu

SEQ ID NO: 3127 - RNA, 20220 nt, Mus musculus
auuucagaaacgcauuccacacccgacagaugagcuuuauuuaaaaacaaacaaaaaacccaacugcaagaaaacccuuuaauaagaaaauccgacuaagucuuauauuaacccaagcuccuggauagcuuacaggaaagccaacgggguacgugaaagacgugcaggcagcugcugacaguucuuugguggcacgagcugcccucgugauuaucacgcacaaguuuuguuuuguuuuucaaaaacaaauaggccucaaagcacccgccaaagaaaacagacacacaacucucuuaacagucugaaacuuaaaaguuuaaaugugcugcaaaagccaaacgugauaauacacacaucauuuauaaaaugagcuuuuucgauucuagaaaauuaaaauagauaggacaagcucacaggaggauaacagcaaguggggagacucuaacccuucccugacgacccgccacagggggacagcuaggcccagccagcugagcucuccucagggcaaucggagcacuccuggcugcacucccgagagaguaagggagugccguugaaacccugugcugcuuucucuuccuuucccuucauuuccucuacuaagguuuccuuugguuugaaaguugaacucaaaggcuugggaccuaagaugagucaucaacuuguauuggaauagcacuugggaaaugagagccuaaaacggcagaccuuuuuuuuuuuuugaugaaguucagcauccacucucggugugaggacgucuccugugcaucaccaggucaaaggcaggacaacugaugggcauccuggugagguucuguagagccaugcgcgcacacagccacccguuuaagcuuucaauaaauacaaacauuuuaaaccauuucgacagaauaaauuaaaaacacugcauuccucuuggccugcuuagccucucgggcuggcucagagugcugcuaguugguggcgacuccgcgcuguuuggacuugaacacuuccagcuccucuggucuuagcacuuucuuugcggcaauaaugguguucuucaugagcauggccacggucaugggacccacaccaccagggacgggagugauauaaccagcuuucuucuugacuccugcauagaaacaagauaggcaagcuguuacagaugcucguggcaaagaucacaugguacuuuaccaugucauaacaaaaauacucaagaaagagcaauaagaaauguaagggccaucauuagcuucaaaauggguaggaaagagcuagagaaaugguucaacagguaggagcacuggcugcucuugcagaggaaguggguugggcgcccggcaccagcaugguggcucauaaccaucuuugacuccaguugcagggcaccugacacucuucugaccucugugggccccaggcacacacacggugcacaagcaaauacacgcaggcaaaacauccagacacgcuaaacaaaucuuuaauuuuuuucuuuuaaauagcauuuacagaccagggcauagaucagugguaaagcacuggcugaacaaacaagggccugaguucaagucucagaacccgugucaaaaaggcaggugugguggcgcaugccugcaaucccugugccgggaagcagagaaacagaugcccggggcuugcuagucagucagcaagcuccaggugaauacuccaagucaugaacugaagagaccuaggacacacacagugacacauguacacacauaaaacacaccaacagcugggcaacagcugggcagugguggcgcaugccuuuaaucccagcacuugggaggcagaggcagguggauuucugaguuugaggucagccuggucuacagagugagucccaggacagccagggauacacagagaaacccugucuugaaaaacaaaacaaaacacccagaaaacaaaaaacaaaaacaaccuaccaacauacauauacaacacacaugcaugacauacacccacaacauauacauuagcacacacauacacaucacacaugcacacucauaaguaacauauacacagacacagauauuaggacacacaugacacacagacaccacauacacacauaaugcauacaaaucgcaggcuggcgagauggcucagcagguaagagcacuuauugcucuucugaagguccugaguucaaaucccagcaaccacaugguggcucacaaccaucuguacaacaacaguguacucauauacauaaaauaaauaaauaaucuuaaaaaaaaacauacacaacauacaauacacagacaccacacacacauaacacauauacaacacacagacagcacauauacauauaauacacacacaaaacagacacauaacaaauagacacagacccacauaccacauacaacacagacacguaacacaaauauacacacccacacaacacacauacaauuucuuuaaaaaaaaaaaaaucccauguauagccaugaggcgugguggugccucuuggaagaagguagagaacaauccuggaaggcccucagugucaaucucaggccuccacacacaugcgcccacacacacaugcccccaaacaugcccccacagacauauguacccacacacaugcaaacucaagcacauacuauuacacacacaccacacauuuuuuaaaaaaguguuuuaacaauguuaccaaaauuauucuuauuacuuaaaagauauaaaaaaagggaggcagaggaauauggauuucugugaguucaaggccagccuggucgacacagccaaaguuaccuacugagaccuugucucagagagagagagagagacagagagagagagagacagagagagagagacagagacagagacagagagaggaaaugaaaggaaggaaagaagaaaagaaagggcuggagagauggcucagcaguuaagagcacugacuguucuuccagagguccugaguucaaaucccagcaaccacaugguggcucacaaccuucuguaaugggaucugacgcccucuucuggugugucucaagacagcgacaguguacucacauacaugaaguaaauaaauacauuaaaaagaaagaaaggaaggaaggaaggaaggaaggaaggaaggaagaaaggaagaaagaaagaaagaaagaaagaaagaaagaaagaaagagagagagaaagaaaagcaaucuguccuaauguccaugaaagguauuauuuacaaauuacacuaaauaccuucaaaauccacaucuccaaccaauuugggcuuugcagugacaggaucuugaacucuguuuauucccacaucgaugaccgcugcuccuuccuugaucaugucagcugugaucagauuuggaaugccuagugacagagagcaaugaucagcgggacacugaaggcaacauacuucaucucuggauuuucauuuauuguagauuuauugauuuuacguauagaaauguuuugccugaauauauaugcaccuugugccugcagggggcauuauagucauaggacauuaaagacaugguaccuggaggagcaccaguaacuaaggaaccauuuaaacgcacauggaaauacucugcggguaggaguacccuccuccuccagucugcaauggggcgacagguacaagaaucccaacugcaacuccagcucagagacucacugggaggggauggcagcugggcgggugagaguucagacaacgcauauguguacaucuacauauaagucuagagaugcacuguagagcucuuaccagcggcagauauuacaaugucugcaaggaucgugugcuucuucagcugcucuuugggaguguaucgaugagauauugugacuguggcaucaccugagaggcaaaaacagaugccuugagucccaaauccaggcugggauggagguagguuucagcugcucacagcacugcagaaacccaacaccuuuggaaaauuauggacuugcauugucucuuagagccaauacucaggacagagaaaagggccgggugugugugugugugugugugugugugugugugugguaugugugugugaacaugcuuaucaaacauuccugccagccugagucugaccccggaacucacacauaguaauaacugaaaugaaaauuuaaacacaauuaccacuugguguagugucuggcgcugcucucagcuggaccuccuuggggucacuuauaaucacauuuaaucuauuuccuaugucauggacuuuaaagaguuuuaccuuuucuaagaaaacaucacuagaauuacucaggugaguuuucucaauaaugccaaaagguaccuggaaauacagcuuuccuuuggucccagaaacucauuauuacuguaauuccgugcaauucuugacuuagcuuucccuuagaugaauuaacagaccaugacaugacucgccggucuggucaguuaacuccucugcaggagccacuguuucuuuuccucccaaaugacacagaguaggacaccaacucugaguaagaaagcucguugggacugucuaagccauauaagccauaacugacaauuucuaauugccuacaagcaagcuuuauucaaaacucggaucuaucagagacuaguuccaggauccuugguggcauugagugcagguuauuucugaguguucacaggggucacaggauggcuuuugagaguuaucacaggaaagggaacuuccucacccccgggccguucgugagcuccaucugugugcagcaacauugcaaucggcauuccaacguuuuuugaccugccagccacuaccacauucuucccuaagguuggaaugccugcaaagauaaauaacaauaaauacacacacacacacacuccaaaugacacagcacagauucaacuuugaauaaguacaaucaaagccacaucugaaaaugucuuguugccuaccaccacgcuuuacacagaacuuuaauuuguucauaacacgaaucauucagauauauagauuugcauuaaaagaucugcucugucuuagaauguguaucagaggaaggcagaugaccugggucacaaauccaaucguuaaacuaucagccaguuauggcugggacugccucagcaauggggcgacaggcguucuggaaacugcaaaaugucccauggauccuugcugucaccguuguuaaaccuaccauuuccuucuccaaggccuguagaauggagcagagcuguccuaugcaacagcuaggugagccccgcugggugggaucccacacuuugcgguuuuggggguuucugccaguucuaaguauagguugacuaucccuuaccugaaguacgugagaccaggaacguccccauacugagacgguugagauuugggaauaucugcauagcuucuauuugguuaacauuucaaaacuaacagugcugaaaggcuuucagauuuucagaccgggaaugcccaaccuacacuacguucauaauacugaaacagaaaugcaauuuaaacacacaccuaccuguucgcuuaauuaucucccacacgccccaugggguugcuggcagcauagaguacugguccaagcacauucgccccacguuaaugacaugaaagccaucaacauccuugucaggagaaacggcauugcagaccuuccucucaucaaugugcucuaaaacagaaaucaagaccacgcccuaaaguccggguggugccgcagaggcugcccggccccagugugucaggcuugcuguggagaucuacucucucugacuuguugcugugaugcacguaagcagaagucaaauagcacagccaaauaccacaucccuccacucuacuuuauggacaucucuuaucaggcugcgagggauaacucagaucaguuaucccagcacuuggaaggcugaggcaggaggacugcuccuagucugaggccagcccagacugcacagugaaacagugaguacuuuaagcacuucaaacaguaccucuguuuagaaaucauuucuuuuuauuuuuauauuuuauuuuagugugugugugugugugugugugugugugugugugugugauggguguuuugcccccaaaugguaucuuuugaaaaccaacacucaccugggaguggcagcugaacaaggaggccaucuacguucucaucguuguucagcuuccugauugaauucagcagcucuuccucugaaacugaggcugguuucacaauugucucacuguugauuccuauuguaagaaaggucagggcuuaaaacaacaccaagggacacugcuccaaaccacaggggaugaauaaagacuaaguucuucucugggggaaaaaaaagaacaccaaagcacuuaauaaacaccuguaguguguaaccaccacgcaagcuaagugacugcccaggguguaacuacugcccaggguguaacuacugcccauggcguaaggcuuacaggcucacagauggcauacuccaggacacuagcucagggcuccuccugcacuguucugugcuuauucaaugaccucauauugaaacagggagccugagccucagauaaaacaccagccagagagcuggagaaacggcucgguauccuugcugaggauggacuuugaucucaaguaccacgugaaagguacaacggcuugagcggugagaccauagcauucccagcuccuguuggccagccagucuccagguucagugagagacccugacucaaaaaauaagucaagaguaaacacacacacauacacccgccagcaugcacuuaauaaauaaacauaauuaguguaauaaacauuacaaguuuuaaaaaaaaaccaguaucucugucuugaguguucaagcaucaugggaaaguuugagcagcaggaugaggaggccucugugaugugguuaaacagaggucugaaggauaugacugacuucugagaaauggcuucugaguucuucacugauuggcuuuaucaucacggggcugaagcggcucaggccuuggcggacgggagaucugugucuguccuugaggcauugcagauuaccauaugacagaggucuagaaacagcuggcugagaugugccugugucugcucguaugacagucaguggucugagcaccuggugucuucccuucggauguggcuggguuaagugaccaauccaugagccagcucacuaacccaagacagagaugcuggggcggggcgagggguggggggaagcaaauguaaaauguguucaagguccucgcuaaaaugugaaguccaaaauggaauggagaucacagcccagaagcuacaacaagacaaccuguuugucacugaaagcccucccucuauagggccaauucuucccacaguaaaguuuugacucaguuuuaucagacuagucuuauguguuugaguuuucuguuuuuauuguugcuguagaggguuuuuuguuuuguuuuguuuuguauuuuagauuuuuugagacaaggucuuauauaguccaggaugaccucaaacaugcuauguggccaaggcuggccuugaauuccuggucccccugacuccgacucccacagugcugggauuauggucuggacagucacucagggcucuccucagaaagaggcaugguggcacacaccaggggggcucuggugacaacacuuacccacuucagcugcugcccugguuuuguugagaacauaggagugacuggcgggauugucaccaaccagaaugacacugagguguggccgcuuguugccugaggccacccacucuuccaccuccugcuguacuucuugcuugaucugcugggccaguuuccuuccagaaaugacaacggcuucauuucugcaggugacacagucacaaaaaaauguagcuuggauauuuguacagaaaaaaaaaaaguuauuaaacaacaaaggcuuacguuuaaauaugagauccaaaggagauauuuuguuuuaaagauuuauuuauuaauuuuaugucuaugaguacacuauggauguuuucagacaccagaaggcaucagaucccauuauagaugguugugagccaccaugugguugcugggaacugaacucaggaccucuggaagaacagucagugcucuuaaccacugagccaucucuccagcccccgaaggagguaauuaagggcggucaccagcucccagugcaggauggucucgguggcugaaaaagcucuucuggagcucacacgcuuccguugcugaccgcugacacuugcccagguaagauuucagaucagggucucuaagcgucaccuccucaucccugccccaaguuuucaguggauauucccucggccccucccuacaggcuaaccagcuucucugaauauuggcauuccacuugaaguuuguguugugccgcugguauuaauaucuggucauuccuagguaguagguauuuucuuuuauguguauggguguuuugccuguauguacgcauauguauaccaugugugugcagugcccgaggagaucagaaucccugggaaaugaagaacaacagacaguuauaaguugccauguggacacuggaaauagaaccuggguccucugcaagaacaagugcucuuaaccaccuagccccucuccagccccagugaacuggguuucauuuugacaguaauguauaauacagcugucucucuucaagcacugguuccgaaaugcgcuuuucaccuauaaagagucagguccuuuacagaaaucaguguaguauuugcauaaucuaagcauauuucccuccaccucuaaaauuaucuuuagauuguuccuaaaccuaacacaaugcaauuccaugggaacaggugcuauaaauaacaaggaauaaaggucuauauauguuuagauugauggagaggacuugacuguauacaaacuacaucauguggcuaguuuaauaaacaccacaguaggcaagucaaacuucaaauugccugccacugcccagucccucuccagaacuguugugauagaaggugugauaguuagcauugucaccuuagccaaaucuagaauccccuggaagaugaaccuuugacaugccagugaggcauugccaucuugacuccuugagagggaaaaaccaauccacuguggauuggcaccauucuguaaccgggauagaaaaaaaaaaaaaaaaauggagacacgggcggugguggggcacaccuuuaguuguaacacucaggagguagaagcaggcagaucucugaggccagccuagucuacauggugaguucuaggacagccaggacuacacaggggauuaucacaacaacaggaaguuaacuaagacuaggguagucuuccucacaagugcucucuggccuauccccuuguccagucacagccgacauaccaagguuuuccuuggcuauauggcuaguccaaagccaaccugaguacgugagauccuggagagggcaucagggaagaaagaagauguauacaugcuaauaaucacacacacacacacacacacacacacacacacacacacagaagaauuuagcuuguacuucauaaaaaguuucuuugggaagcaguaaaugcagagaagacaggagaagcccacuuggacuaaaaaugacaggcugguguuaaggacauuggguucugaagaggccaguguuccagguccuaaucucuuuuuugcuggaagguucaagauguuaugccaauuuacuuuagaaaaaaaaagagagagagaaaaaaaaaaaccaaaacaaacaaaguaacacaaagccaggccacaaugccaagaagauuguucauaauccagcuacaugcuaaccuucuguggcuucccacugcacugaaaaccaggagccauuuccuaggcuccucaucccugugccaagggcugaauuaaguaacuccuuagagggagauaggagacugagcucagacccaaaauuaaaaaaaugaaaguaaauucaacaccugugcacuuaguuuagaugugacaugcuuccacagaugugcgcugggauuuuccacuaaaaugacagacuagaaagaaguccaauaaaggucaaaacuaaaacccaagucagacauauuuauuuuccucuuaaaccaacaguuauugauuuuacagucaauaaguaucaggaaagcuuuucagcucccgaccaaguuauuuugggaaaaguucugcuacuuaauugauggaccggcaacgagaaagacagagagaggaaugaaaccaauaucgacugaacaauagauauuuugccauccccuuuccauaaauuaaucuugguucuucggcuuaccauaaaaacccugcugaaugcagcaaagauggaugauaguaagaaacaagcuguaaguguaaacagcugccaccaaguccauuuacucucccgcccaccgucucccaggcaacaguacucuucccuccagccccggaguuuauguuccugaaacccugggucggcaaggcaggcacugcaauuaucaaaugugcaggacggcgaacacagaucgacuucagagauacgaagcccacacuucucagaaaagcaugcaagaguaaacccggagaaggagcaaagugguccaguuuuuuuggguaaugaauuacaggaucuuuucaguuagcaaagucucugacacgugugguccacagacauauggagccagaacucaggaagaggaaaggaagaacagggaaauaaaagguggaauucaaugugggaggucaggaucugaucuuggaaaacccuuucaaguccugcaaaaccucaggauccagugcaccaacaugcaaggcuccagaaauauuuuuauugccuuccaccuaguauucacaaccccucuaggacucuucuuccuaggcacagaaauuggaguuugaggccaagaaagacccaauaaaucaauuaucccccgaaagaagugcauaaaacuuuucugccuuccucauuaguuugguuuuuuucuuuucccagucaacuuacuuugggggcugagaggccuucauauauuucaacuuuuaaaauuaugaaaaaauauguauacgauuuuuaccauugugacuuuuuuaaaauuaggcuggucucuaacucacucuauagaccaaguuggcuuugaaccgcaguaauccuccugccucacaagcaaucucaccgcgcccggcucuggcaauuuuaaagcguacgguuuaugugguauuaaacacucacagaauggugugaccaccacagugguccacgugcagaucggaagcuccaacacccuagcucccucuaaaacaaugcacccuacucccagcagcccccagcaacuucuggggcauguaucauuuuagguugccaaggcuagaacuggugggcuccagaguggacugcgaagggccaccaucaagcuggggcaucuugcgaaccacacccacccgggaggagggaaguugguacccuuggagcaagccggcucacagauuucaucagacugcagcaacccgggcugccgcuaggguccgggaagggcagaccucuccgcacccaucucugcaguggcagaacaguguccccugccaagcguccgcaucuccacgugcaccccggugccacguugccccgccacaccucuccguugggggcuggccccgaggccgggugaugcuugggaaggauaucuguccacgccgcgcuccgcaaccccacggacucgcuccccgacacacucaccgcacugccgccagguggaagggcuguaggcggggguggcagccgugcguggggcgcaacaaccgcacagccaacgcagacaacaaggaaacugaagccauggcucgcgccggugcccgcgccggagagaagcgcgcgcgcgggccacgaagcuauaccccgggcccacgaaagccccgccucccgcgcgcccauuggccccugagccggcguaggagccaauaggagaucucaguucuacguaagcugguccaggagcagguccugauuggcugaaggagucaagccccugacugaggagaggcagcaguggucccucagcuaggccaacugaaucugggguucauucauucauucaucaaacaaaaaucugaaccagcuacugugugcugagaaccccugaaaggcacuaaaaaaaaauuuuuuuuuaaaaggagaaaucaucauuuggcaaaaucauacuaaaaauugaucuggaaucacccaaggaugucaaaacagcagggugaaaccugaaaaaggagcaagauauuuacuuguaguuuugccauauagaggccaguaagaugacucaacaguuaagauuacuuaccgcucuuacaaauugcccaaguucgauucugauccuucuagugacucaaaaccucuuguaacucccgcuccuccuacaacaccagcucuggaggaucagacacuucuggccucuaagggcacccccaggcacacgucauacacacacacacacacacacacacacacacacacacacacacacacacgcaugcacacagacacuuucuggccuccaaagcccccccccccccaccauggacacaugcaauguacauauaaauuaaaacgaagcuuuuauaaaaaguuaaccaggagcuuuuacauguaccuuuguguguguguguguguguguguguguguguguguguguauacauauauauauauauucauguguauacguauacugaaaagaacagcagguucucuuaauugcugagucuucucucuagcccucuacucuuaaaaaaaaucaaguuaacauuaccauucaugggacaaacauuuuguggccuugcuaugaggcauuuaccaaaauauuucacuugauaauucuaaacaaaucugaaauuuuaauguagugacuuucuuaaaccaggaggacuccacuagugguuagucuuccauggauuuagagucaccuccugggagacagcacuucugggugugucugugagaggugcaacuaaagaggaaauguccacccaucccauggacuggggacugaggaucaguaaaauggaggaaaggaggaagccugccugugcuccccccucucuguuucccagugcagagaugugagccagcagccucagucuccugcugccacagcugggagcugcucuuugucccccacaauggguuguguauccccaaaccgcccauaguacaacugugucuucccuuagguucccuugucagguaagggucagguaauuugguuuuguguacauuuaugcauauauauauauauauauuauguauauauauucauucauguguauauguaugugcacacguauggagguaaaaggucaacaugggguugaccuuccucaaucacucaccaccuaauuuuuugcguguguauguguaugagugugguacauccacaggagcacauggaggccacaauaggccaucagguacccuacucugcuuauucucuugacacaggguaugucacugaaucugaagcuaggcagaucaaccuccagugacccuccugucucugccuccagcgcuuaaggacuauaggcacagguacaaccauauuuuuuauguggguguuggggauuugaacucagauccucaugcuugugcggcuggaacuucauuacucacugagucaucucuccagucccuagguuucucuucuuuccuuccuucauuucuucuuuccuugcaguacugaggauaaaacccagagcuccucacaggucauucuagacaagcgcucuaccacugaguucucaaucucucugucucugucaaucuuugucucugucucugucucugucugucugucugucugucugucugucucucucucucuauauauauauauauauauauacauaaauauauacacacauauacauauauauacacacacauauacauauauacacacauauacauacacacacacacauauauacauacacacacacacauauauacacacauauguacacacacaccagguucuagccucagucugcugaaucugggauuacaggcaugcuccaccacaccuggcuuccuaguguuguuuuuaaugugcuuaauaaaaagacuugcuucaaaaaaaaaaaagaauaaaaaaaugaaaaacaaaaacaaaaaaaaagacuugcuuccauguuuccuagaauacuauauuuaaaugucauuugcuuuacaaaagugcuucuuagccaguuuuuauuuuauuuacucuuuccccuugccccugcucuucuuucuuggcauguguauucauauguguaugugauguggguaaguacguguguggaagccagaaguuaauauugguauuuuucuuugucccucuucccucuauucauugaggcaagacuucugauugaaccuaggguugccaguuuggcuaguccaguuagccagguaguccugagucuuccuugucuccaccuccagagcgcugaggcugcagacagagccucacaccagccuggcuuuuacaaggguggcagggauccaaacuaaaguccuuaugcuugcacacuggguguuuuacccaccaagccaucucaccaguaccucaccucugugcuggcuaagcuugucaacuugacacaagcuagaguuguauaaaaggugagaagcucaguugagaaaaugucuccauaaggucccacuauaggacauuuucuuggugauuuaaccgauuguggguggugccaucccugggcuggugguucuggguacuauaagaaagaaggcugagcaagccaggggaagcaagccaguaagcagcaucccuccguggcuucugcaucagcuccugccugacuucuucuugaacagugauucagaaauguaagccgaauaaauccuguccucucuugcuuuggucauguguuucaacacagcaauuguaaccuuaacuaagacacucucuccuuuugauaaguaagauuauaaaaugacucuggagauugccuugggugauuuauuuuuuaccuaauaaaguaaaaacagaagauacuaagguuacacagggaguuagaaugugucauuugcugucaauuggguuucuggugaaauuccaagaaaaccacagguuuauugcugggaagggagaauggccuuaaacaaacgguacuuguucuggaauucuucaaccuuagcugguaagaggcuucaaccauacuccuagggugcccuuccucuucgaugucccccuaauacucccuguauuuccuggcugcucagaaccuguagaaugguuuccaaaauagaucuuaguuuguuucaucuaccuaacuccucacagaucuaaguugcuaacaauuccaccuccaauaacuuuauuuaaugugaaaaauggggaguguguguguguguguguguguguguguguguacaugugugucauggugcauguucagaggucagaggacaauauucaggagucuguucucuccuuccaccaugggagcucugagguuugaacucaguugucauggcucccuggacuuuugaguuuuuguauuuuuuuaauggggucuugguauguagcuguuuuuccaccucagccuuucuacacugaggcuacagcugugcgcgucuccucaccuagaucugcuucccuuuuuuaaagaguaagcaggagcugaagaggugguguaguccgcagcuccugugaaagcuugaacaucagaguucggaaccccaacagccauggagaggccggggcugggaaguggaccccggaggagcuuggagcucucaggccaguuaaccuagucuaaucacugagcucugguguaaugaaacccugucucauaacuuuaggugguugaagacuggagagacagcucagcaguuaaaaguuugcaguagcaaaccaggcagugguggggcacaccucuagucccagcaucugggaggcagaggcagguggacaucuacaaguuuugaggccagccuggucuacagaacuaguuccaggacagccagcgccacacagagaaacccugucucaacaaaacaaaacaaaacaaaacaaaacaaaacaaacaaacaaaaaacaaaacaaaaggagugcauacugcucuugcugaggacuggaauucagguucuauuuagcacccacaugagcagcucacaacugcccggaggaagggacuucagcucaaggggcauccaaccccuagagccucugcaggcaccuaacuccugcacguacauaauuuaaaauaauaagauaaaaucacacacacacacacacacacacacacacacacacacacacacacagcauuaggcuucaaaaagcacuuugguauuugccuuccuauaaggaggccagguuuuuggauggcugguuucauuuuccuucacuuucccccuggcuuauuccagccucaucaggcuggccuuuuucuuuuuuucaguucuccuuucaguagcaacauagaaaaccccugcuugcuucaaagcuguugcaugugggcuuggcucugagcagugcccaucacccacauccugcacuggacuaucucaacuucugagggcuuagcuucauugacacuuacauuuuccaguuuuuguucugcuuuguuuguuuguuuguaugauuguucguuuuuaagauagggccuuaauaauguagcucuugcugugccugcuucuucaauacugggguaaaaguuguguguguuaucaugccuagccugguucugguuuuauauguacacacacacacacaugcacacacgcacacacacauauauauauguacauauauauauauauauauguauauacauacacacacacauauauauauauauuuggguaugucaucacguguaucuggaagucagaggauagcuuguaggagucauuucucuccuuccacuuggguccuggagaucaauugcaggcuguuaagcuuggcaguaaaugucagaaauuugccugucacucucuuuuguuuuguuuuguuuuugagacaggguuucucuauguagcccuggcuauccuggaacucacucuauagaccaggauggccucaaacucagaaauccaccugccucugccucccaagugcugggauuaaaggcaugugccaccacugcucggcugcaugccacucuuacacaaggcccagacuaaaucucuguaauguuccaauucuaguguaugugcugccaaagugaguauucagucuauuuguuaucucuccugucaaucucccaaugaucuucaucaguuuugugcuuuuccucaucauagugccaugguuugaaauuacugagggcucagggaguaucucaaccaggaagugcuugccuaacaugcaugaagcccugggcucuguucccaucuuugcauaaaaccuugcaggccugaaguccuaacacuugagagguguaggcaggaggaucagaaauucaaggacauccucagguaccuacuaagcccguguuaugggguuuuuuuuuuuuuuuuuuuuuuuuuuugagauagaaucucauuauauaaccugcuggccuuaaacucacagagaucugcuugucucucugccuccaagugcugagauuaaaagcaugagccacucugcccgugcuuuacacggcaaacuagagaucagcccagguuacaggagaucugccuaaaggaaagacacaccuacauaccuaccuuguguaacccacuguaagccccagaaggaaagaggccuuguuuugucuauagcucugaccagggacuuuaagucauuuucagaauaaaacuuccauaugccaggagcagguuuuuguuucugacacacugagauuucucuuucacaguccucaaccugagacacggaacaggaacagcucagagcuucuaaugucuuucuucccucaccugugagggggauccgcugucugggaaaggcaggaccugaaguguccgcagcaaggggaagaggcucugugugcgagaagguagggacaagcuggaguucugcagaugaggguguaggaugcuuacacagaauaaaaagucacgguggccaauuuugccuaaggaagcucaaaaggggaacugaaggaagauugggggugggggaggggagcagcccagaagaggggggaacaagaaggcccucugagcugccgcuuaccuucuguuucccacaucugcuauaaccagaucguaugacgcuaucucuugauccugcugagccagagugagcaaagcaccccaguguguguuuggcugcugucuguucugguggagaccaaauugcccugccccuuacucacugggaaaccuuaucuuugacuccuuagaggauuguauugauauccucuuuaaauauugaccaaagauuuacaccuuaaucccuaaggcuuucucucccuaaagcuggacauauggagaagugucuuuaauaaguuuuuuccucauagauuuaauaauucuacaauuuuaagaaucauuucauuaaaagauggaaaaaagccccaaacaaacaacaaaccuggaguucauuuagucugcuuuuuuuuuuuuuuuuuuuuuuuuuuucugaaacaggguuucucuguguagcccuggcuguccuggaacucacuuuguagaccaggcuggccucgaacucagaaaucugccugucucugccucccgagugcugggauuaaaggcgugcaccaccacacccagcauuuuuuuccuuuuuaaaagaagauuuuuuuuuauuuuauaaguguuuugccagcuuacaugcaugugacaugcauguaugccugaugcccguggaggucagaagagaguguuagaugcucuggaaaugaaguuacagauaguuacagacagugugcaugcuggacccugaacucagguacuauacuauacagguauuaagugcucuuaaucaagccucucacaucauauuuuuauaguuauauacauauauauauauauguguguguauacauauaaugucauauauguauacacacauauacauauauauauauauauacauacacacacauacauacacacacacauauaauuuuugagagucuuucuauguagucauggcuguccuagaacaugcuaugcagaccaagcuggccaugaacucacaaagacccaucugccucuaccucccagugcugggauuaaagaagcuguguaucaucaugcuuguccugacuugauauaaacauaaggacacagacucaaaccuuaauaauauguuauuuaaaaauauacuuaugaaaaaaauaaacaaauaaaaggacaagaggcagaggcaggaagauaucuguuaguucgaggccagccugaucuacaaaacaaguuccaggacagcaggacuacauagagacccugucucaaaaaaccaggaaaacaaacaaacaaaaaaaaccaacaaaaaacaaaaccaaaaacaaacaaacaaaagauucaaaaaauauaucaaggcacauacucuaaaucacauacaaauuuacagaaguuagugaaaaaaaggaaagaaagaaaagaaaaagcuuacugaauaauccugauaaccuaggcugcccccccccccaucaagguagaaaaggagaaccagcuacuacuacauaccacacuaauaaauacaaauguauaaaaggugguuuaaaaaguuaauagaaggaggcaggugguagcucaagccuguaauucccgcaccugggaagcagacgcaggacggucaggaggucagggucauccuuggcgacauaguaaacuuuaaaccagccugggcagccuggaacaccugagauccugucucaaccaaggaacaacacgcaaacaaacaggaacccaaaaguugauaaaauaaaauugaugacauuaaugugacagguggcauucaaaugguuuuaaaccaccggcaaaauacuggaucuuugccacugcgcaucugcaguuucauuuauuuccacagguuuuuuuucuccccccucuuuucuucauucuaccauagugucaccuggugucaacauauccucccacacggaacaugcacauggacauucauagcagcguuacaguguguguguagaaaccucccagguguccaucaacaggcgagguggccagaauagcauuccuuuaggagaagacaucaaguuuuucuaaauagcgaaacagucaccaaguagcgcuggcagacgucccucggcca

SEQ ID NO: 3128 - RNA, 17765 nt, Mus musculus
ggaagaagcccggucucgcgagauccucuugguuccgcauuuuggcucgcggagcugugggaggcagcgcggaggagcccgcggucggugcuuggucgcggcggcuggaacucgguaccaaacccgggccgugaagcuucggcagcccuguagagccgcggaccguccucugccucccggugcccgcggcggcgccgagucugacggggcgggggccacggccccucgggcuagcgaggaugagcuuccucuugugagugggccgggccgggccggggcggggcgggugucggucggcagggccgggccgaggggccaagcggagggcggagcccgaccuagggcugcuccgggccugccgccccgggaucggcuagcgcaggaaaaugugcagugccucggugaccagaccaggcugagaaagaaaggcgcagguucucaguggcuucccacagguuugcauuugggaagagggcauugcuccuuccaaugugacuuuucucuuagcccaggcggggcuugaaccuggacuccuccugccucugcuuucccaaggagccaggauacagccucggccacuaggacaggccuccuuuaaauguggggguuuuguuuugagaaauggucuugcuauguagcccaggcuggccucgagcccucuuagauguugggauuaaaggugggugcuuucaucucggcccacaugugaauuuuuuuuaagguuuuuauuuuuuuugagaacuuaauagaugcguauuuucauuucuaacuccuccagugcccucucaucucccauucaaauucauguucucuuaucuauauucuauauuacgucuauacaacauacauacguaauggauccaguuagugucgucuguauguacuuggguguagagcugacuauuucauuaugagucuauuugagcuugucccugaaaaaccugacucuucuuguggacuguccauagcucuucagccaggugagguaaauggaaguuuuuauuuauaacuuaaaccgauggacaguuuuucccacucuuuggcuauucugaauaacgcugcugugagcagcugguuauagguuuuuggguaugugugugugaugguaucuccugggucuuagugagguuuuugcauguuagccuuugaggcacugccaagccuucuaaagccugcacugcauuuaacaucccauucucauuguauugaguuuucagaauucuucaguucacaccugccugguaauuaccacugauagaucugagggugaaguggaauuuauugauuuacauucucccaaugaccagcaauguuaagcaucguuugugugugugugugugugugugugugugugucugugucuguauuuuguguuuucagacuauuuguggauagaguuuauugagauccuuuuccuauuuuaaaaucagauuguucuuuauuuuguuagcaucuguuaauuguacaaauuaauggguuucacugugacauuuccacguguguauauggugcagugguuguguccgucugacuuuuugguuucaguuguaagaauucuuuauguauuuuggauaugagugucucauuacaucugugacuucuuccauccucagcguuauuuuaacuguuuugauggcaucauuagaagaauguaaguguauuuuucaaagauuuauuuaguuauuuaguuuuuuuuuuuuuuuuuuuuuuuuuuuuuugcuuguuugguuuuuuuuuuuuuuugagauaggguuucacaauguagcucuggcuguccuggagcuaacuauguaaaccaggcugaccucccagagaucugccucgcucucccuccagagugcugggauuaaagauguauaccaguauacccaguuuaggauuuacuuucauuuuaugaguaugaguguuuugcuuguauguauguauguauguauguauaccauguacauccaguacccacggaugccagaagagggcaucaaaucccaugggacuggaguuguggaugguugugagccaccaugugggugcugggagcuguauaccccaguccucugcaagaacagcaaguguucuuaacuacugagccaucucuucagcccuugaagcacaaaccucaauuuaucauaugaagaucuuauugaaucuuaagaaaucauuuaauguuaauuuuccauauucaguuuccuguuauucaguuuccugucuccauguguuccuggggugauccuucuaauguauauaguucuuuauaaaguaugauauuuagucuaguacuuucauaauuuuuuacuuuuuacacuauuuaaaauuuacuuucacagguaagguguaaguccacgagucuguucccuuccccuuuuagauguugucacaauucugauaugucuuauuuuaaugcuuuuucuguuuuguuguuguuugugcuuucuauggguuaccaaaauagacuuugcucuaauuugguucuguaauguguucagcuaugcuuugacuauauauaccacauuaccuauuuuuacugcacagcaucccaugauguggauauacacuccauaucuacgagugcauggaaggaguagauuugcauuguuaagauguugcuauaacaagcacuagaaucuacaguguguccucccccacacgaacugcuugguuaaaugcucugguagauggggauaauagauuguccuaugcaacaacuuguguguugcuccugcacuaacacuuuuaaauuuuuacuuguuuguuucauauauguagaucugugaguguggaguaggcacacacugugugaugcuguguccugauacacagagcaucauagaagagggcauugggggccuccuaucacuuuuugccucuucuuuaaggcaagguaucuuuuugaacuugaaacuccuuuuuuauccccacuaggcuggaagccagcaaguuccagagauccuccuugucuuaguguugugcugcugugaagagacacaagaacagggcaacucuuacaaaggaaaacauuuaauuugggcuugcuuacaguuucagagguuuaguucauuggcaucaugguggggagcauggcagcauaccugcugacauggugcuggagaaguaacugggaguaacugcaggaagagacagacagacugguacugggcuuuugaagccccaaacccagccccaguuacacacuuccuccaacaaguccaucccucguaauccuuacaaauagugccacucccuaaguauuuaaauacaugauccuauggggcuagucuuauucacguagucacauccccaucuccuuccccauuaccacagaaguaauacuucacauuguucauacaacauauaagccucucauuuuuugcauuuaucaaucguuuuuaguugaccauacucauuucuugacaauauucucccuaaguacccuaaagcacuagcauuuccuagagucggauuacagguugucuuuauguugugcagcaagugcucuuaacuagacagucaucuauucagucuaugcucuugcuuuuauagagguguguguguaucugugugucugugucuggagccgagggccuccuuaaugcugggcaaacguuugacacugcugcauucuuuuuugucaucauccccucuuccauuuuggccuuauuuagggaguacuuuuuauugaucagcuuauuuauuccaauauuuauuuauuuguguguguguguguauguaaaaacaauacauguucuuaacugcuuagccaucuuuccagucccuucauagagccguuuauacacuuaaaaugccaguuuucuuucauugcuaaaacuucauaccuuuuuaccuuuaacccaacagcagcagccgcucuucgaaaacauucaaaccaaagaagaauaucccugaagggucccaucaguaugagcucuugaagcaugcagaggcgacucucggaaguggcaaucugaggcaagcuguuauguugccugagggagaggaccucaaugaauggauugcuguuaauaguaaguuuuuuaaaacauucacuuguagauuuauagaguuugcuaaaaucucauuuaaugaauuuucuuuuauagguauaauuauuguauauaacagcuaucuauaaaauacauuuauuuagacuuuacuugucaaaggccuugguuuugugguugaguggagacacuugaagugcugagugcuuucuuggugagaauaucgucaagaaaugaguaaggccaccuaaaaaagugcuugcacgggggagacuuacauguugaacaaugugaaguacuacuuuuuagggaaacccuguuuuugauuuuacucaaauuaucaaguuugggcuggaaaaauaggucagugguuaagaguacaugcucuucuugaagaggacacaguuugucucccagcacccauauggggcagcucacaacugccuguaacucuagcuguagagaauccagcagccucuucugggcucacauggacauacccacacacagauacugacguugaaccaauuuaaacguauccccagcuagcuuacaaauuuauauuuguaagugagacucagacuaugauuauuuggcuuugacaauuacugggggguaaccccuaauuacuuuucuaacugcuggcuuggcuaccuccccagggguauaccccacauacuuucuccuggccucuggcucaugguccuucuccucuggaggcagcuuccuccucucuuccuccucgucuugauucuccaccccaaccagguaacucagaacccacccaccucuccaguaauuggcuauugccaauuuuuauguaaccaauucaaacuaaggacaagguuuguacaacaaaagcuuguaagcuacagaauuuaucauuacaauccacagcaacagaccaaaccucaauagauacaaaucauauaauuuaauuuuuuuuuuuaaauuaaaucucagauuguuauucugaaggcauguguuggccuccugcaguuuuagauuuuuucuuugagguuuaauuguucuaaacuguuuauugaaaccuuuugguuucuggccaucaagaugguucagcugguaaagauacuugcugccaagccugaguucauucccuggaauccacaugauggaagaggggauugacuccuggagauuguguucucucucucucucucucucacacacacacacacacacacacacacacacacaacuuuugguuccagaauuccuguauucccauaaaaauuacugggacggcucagugugcuuguacugcucuuaauagaggacaagaauuuaguucccacccacaucaggagucuauaauuccaacuccuggaggguccaacaucucuagccugaauucaugugcaaaguccacccccuccuaccccccaguaaaauuuggucuuaaaaaacauuacugaacacagcaaagaacuguuuguuuguuuuggguuuuuuuguuuguuuugagacaggguuacuccguguagcccuggauguccuggaacucacucuguuagaccaggcugcccucaaauucacaaagaucugccucugccuccugagugcugagauuaaaggugugugccagcauugccuagcugagaauuuuuuucuuaauccauuuuuaaaaaauauuuauuuauuauauguaaaguacacuguagcuguuccucucucucuggccccgcucacuccggccuucauccauuuuugaagaaacuuggaaagcccuaguuuuuuucagguacucuuucagacaagaucauuagcauuuuggaaaaauguuccaagucuuaauacauuucuuuauaccguccuuccuccucgucgucuggaucuagcagaggcuccuuuggaggauccucccuggcuccuucaguccuuccagauguuaccuuuucucugaccuucuagagcuuacuguuggcaugugggccccaucuucugucuaguauuacucauauuuuaaacucuucuguuacuguagaccccauaugagguacucgauucaguccuuuuugaguggucuucaguaugcuggaggccuccgugcuggcucugaagcagauguuugaaauguacaagacagcuugugccuucuuuuuccuaacaaaugguaguauguuguaguuuagauugguaagcuaugguucuuuuaacuccuuggaucuaaucaaauaauauauuccagugacuuguuagguacaaguagauuagcuccaggguuuuaagucaguuggacaugguaaugugcuccuguaguucuaguugcucgggaggcugagagaggaggauugcaugagcccaguuguucaagacuagccugggcaacauagaccccauuuuuccuuuugcugagaggucuauuugguuugucaugauuuauguaguagucacuugacacgguugucacuuugucucugcagcuguggauuucuucaaucagaucaacauguuguauggaaccauuacagaauucugcacugaggcaagcugcccagucaugucggcaggucccagguauuugucugaccuguuaaauaggcauucagauugcuuucuuuuauuuuauaacuguuaaauacuaaauaauaaagacuuuucuuaucuguuuauucauguagagcuaauucuguuucugaguucuuuuuuucuuuuuuuuuuuuuuuacagauuuauuuauuauuauaucuaaguacacuguagcugucuucagacacaccagaagaaggcauaagaucuuauuaaggaugguugugagccaccaugugguugcugggauuugaacucaagaccuuuagaagagcagucagugcucuuacccacugagccaucucuccagcccuguuucugaguucuuaauuacuagcaguagcucuugcuguuaacuacuuagguauaugaguacucaguauuuaauauuuauauuauaauuauauucuaggagcaaaaguauaaaauuagccgggcgugguggugcacgccuuuaaucccagcacuugggaggcagaggcaggcggauuucugaguucaaggccagccuggccuacagagugaguucuaggacagccagggcuauacagagaaacccugucucaaccaaaaagauaaagauauacauaugauguauuauaucaagcuucuaagggcugacugaagaaaaaaguaagaugcaagguaggaaugcuguuaaaagccgccagggcuauacagagaaacccugucucaaccaaaaagagauauauauagauagguagguagguagguagguagguagguagguagguagauagauagauagauagauagauagauagauagauggauagauggauagagauauagauaugaauaugauguauuauaucaagcuucuaagggcugauagcuagauagauagagauauagauaugaauaugauguauuauaucaagcuucuaagggcugacugaagaaaaaaguaagaugcaagguaggaaugcuguuaaaagccuccauuuuccgagguuuuucgagacagguuucucuguauagcccuggcuguccuggaacucacucuguagacuaggcugcccucgaacucagaaauccgccugccucugccuuccgagugcugggauuaaaggcaugcgccacaacgccuggcccaguuuuuuuuuauggaguuuaauuucuuacaagaauuuuuagguggucuuaaaauauuugcucauuuuuuuuccuggugccuguauaguguuaaggaaagcagcugcacauccuggaguagcaucugccuuaaagaaagauacaggguuaaauaggcugacagucuccugugacuguuuucuaaagguuuaguuuauguauaugaguacacuguccuugucuuccaaccucuggaagagcagucagugcucuuacugcugagccaucucuccagcccccuuccuauaacuucuuaaagucacauaaaauugccauggacagaaugugaaccugcuuugguuacagguuguccacguuaagguuuuaacagcuaucauuaacauuuuguuguucucggcagguaugaauaccacugggcagauggcacuaauauuaaaaagccaauuaaguguucugcaccaaaauauauugacuauuugaugacuuggguucaggaucagcuugaugacgaaacucuuuuuccuucuaagauugguaaguuaaccccguggagcagacuuucuugugagugaugacugcaaucuuuaaaugcgcuauuacuuuacaucagcuuaacagagaaggccgcaucugcaaagaacuugaauccauguauccccccagcuuaccaacuuguuuucuucacaccaguuaguacuuacuuuuuaaucuuuuccaguuugaguacauuggaucuguuuuaaaauaaaaaguauuuuauguauguggugugcgugugccacagcauaugugugcaggucagacaacuucuuagauuugauccuuuuaccuuuacaugguuuuuuaaucuguguuucaagacagggucuuacuaugcagccuuggcuuuccuggcauucacuaugagaccaggcuggccugggauucacaaacaucccccuaacccugccucugccuccccacuggugggaauaaaggugugugucacuguguccagccuuuacaugaguuuugaagaucuaauucgggucauuuggcuuucauggaaagcaccaaacucacugagccaugccacuaaaccugaacuuuuuuuuuuuucccccgagacaggguuucucuguauauagcccuggcugucccggaacucacuuuguagaccaggcuggccucgaacucagaaauccgccugccucugccuccugagugcugggauuaaaggcaugcgccaccacacccggcucuaaacuuuuguuuuaauguccaucuaaaaauacugacaaaggggccagcaugauggcucaguaaguagagguacuuacuaccaagccugguggccugaguuggaucucugagaccuacaugguggauggagguuguccucugaccuccacaugugccuuacagcacgugcauagauacaugucugcucuugcacacacacugaugagaugaaauacuuuuuguuucaucacguguucuguucuguuuauguccuuugucuguuauagguguuuggucuuugucauacaagcuguauguuuucuuccccugggguaccuugaucuuauucauggaguguuuugcaguauacacuucucuuauuuugcucagcuccuuuaagauguggguuguuucauuguugcuuuuuguggugcuagggauugaagccuggccuccugugugcuagguguguguucugcccugagcucuuuuugagcccccgauuacauuuugucagugagaaaguuauuacuucuuuugugguugggcuuagacccagggucccucacaugguugaacuuuaccuucuucuaaguuacaccccaacuucuccauuucuuuuuaaaaauguugugcuaggagaacauuucuguuuugcuacuauguuugguuuugguaugguacugagaagugaagucagccugccugcaguuccugggcucugcguggcuucuucccagauucuuccugcccuccucgguggagucugagcagaggcacugcugggagaaacacaucaaguguuuguacuuaggcuggaguuggggaacaugguggaacauaccugcaaucccaacacuccugaggcugaggcaggaggauugcuggaaguucaaggcuauucuguguuauagagugagaccucauuucaaagaaacaaacaaaacaacaaaacaaaaacccaccagauuugacuuaauaacauuugucuuaguuaggguuuuacugcugugaacagauaccaugaccaaggcaagucuuauaaaaaacaacauuucauuggggcuggcuuacagguucagagguucaguccauuaucaucaaggugggagcauggcaguauccaggcaggcauggcgcaggaggagcugagaguucuaucuaugucuucauccaaaggcugcuaguggaagacugacuuccaggcaacuagcgugaggaucuuauacccacacucacagugacacacucauuccaaccaggucacacauauuccaacgaggccacaccuucagauggugccacucccugguccaaggauaugcaaaccaucacaacauucuucuauuaaaccuuguauuuccuuucucacagacaauuauacguucauucuauuugaguauguucuauuaaauucaguuuagcaaguacuuagauuaaaguuguucacauauuuaccaaguuauuuuuaugagggaagaucucauuuagcucaguuuggcuuugaauucccuguguaacugaguaugaccaauaccccaucuuuccaucucuagcucccucuugcagagguuauaaaaucucaccaccaugcccagcagaauccuccuuucuccucauccucucauacuacuguaaugguucuggguuccuuuacuuuccuccucauuaggcugucaucaguguuguaauguuugcuuuuuuuuugagacaggguuucucuguauagcccuggcugucccggaacucacucuguagaccaggcuggccucuguauagcucuggcuauccuggaacucacuuuguagaccaggcuggccucgaacucagaaauccgccugccucugccuuccgagugcugggauuaaaggcgugcgccaccacgccuggccuuuaacauaucuuuuuaaaaaagauuuauucauucauuuauauauuuauuuaguuauuuauuugagacacaccagaagagugcauaggaucccauuacagaugguugugagccaccaugugauugcugggaauuaaacucaugaccucuggaagagcagucagugcucuuaaccacuaauccaucucuccagcccccuuagcauaucuuaagucauuagcaagaugggaauuuuaaaagaaaagauguuaaaccuguauuuuugcuauuucauauuaaaauucugcucugagaaaccagucauaaacuucaguguaauguuugaaaaguaauuuuaaccaagacuaggaagaguugggaauaccauaaaaauauauaagaugagccgggcgugguggcgcaugccuuuaaucccagcauuugggaggcagaggcagguggauuucugaguuuacagaauuucugagggccagccuggucuacaaagugaguuccaggacagucagggcuauacagagaaacccugucucaaccaaaaagaaauauauauauagauacaagauguauuauaucaagcuucuaagggcugacugaagaaaaaaguaagaugcaagguaggaaugcuguuaaaagccuccauuuuccaagagguucgaggguguuuaauuuaaaguaugaggaacugguuuuugaagcugacuuuuuguucagccugggacucacuguggaguucauggacucucagagauccaccugucucugccuuaaauuaaagacaagcaccacuugcuugccaggcaugugccuucuuaguuuuucuuaauguugguuuauguagcuaguacuggcucgcuggcauucuccugucuauaaaggaguugguucuguuagccaaacuuguacagaguguagccacucgccccauggcuacugcuuggagaguuuucuacuccucccaguuuuucucaagagguauuucuuuuuuucugagaaggaaagaggccccuuucuucuguuucaggaaggaucacucccuuuuuaggauacaggaaaaugaagacuuacuuuccagaguaauguaaaagaugagauauucucuaccuacauagaugaugguaaagacuugauaccacuuaaaugugguaucuguuuaggauacacauuuguuuaggaaguucuccauuccuaaauuuuuuuuccuauuacagaugacaaaagugauaauuuauaaucaaaguguguauucuuguugcauuugaucuuagagagacacucugauauuaaacaaccaacauguucauuugaacugugauccagcagccucuaucccuauacuacuguuguagacaguguggugugugaagaauacuuaguuugggauuucccuugcuuugugaguguguaagcuugugugcuacaguugcuuuggguagcaucaggacuugcugcauucugauuugauaaaagacuuauaggcguguauucgauuacaggugucccuuuucccaaaaacuuuaugucuguggcaaagacuauucugaagcgucucuucaggguuuaugcccauaucuaccaccagcacuuugacuccgugaugcagcugcaggaggaggcucaccucaacaccuccuuuaagcacuuuauuuucuuuguucagguaggugagucauugaucucugggccuuggacuuagaccuugauaacuuaguaaaaauuaucuuauuuaucgauguagaaaguguaacuuuaagcuuuguucuguccccguuuuguccucuucaccacacuguuucauugauucaugaagcaguauagaagggcagugucucugggaugcagagguggcucagcaguuaauaacacauacaguuacugcugaggaccuagguucaguucccagaacccacaucaggaggcucacaguaggccguagggauccagcauccucgucuaguuucugcagacacauguacgcaugugguucacauaaacucaugaaagcucauguauacaacuaaaauagauaacugaaucuuaaaaaaaaaagugggggugggggaggcagcaucccacuggggccuggcugccuagggcuuuccuuggccaucguuggccugugagcacuaacaaaauuagaacuuuaaaauaucaaauaaagguauuuggaaaagagacaaagaauuaacagaccaugaugccacaucucucuuauccuagccagaccuuguuucaaaaaaccagaaaagaaagcuggagagacaaauggcucagcaguaaagagcacuuucugcucuugcagaggacuugaguucauuuucuagcaccugcauuggggagcucacaauuaccuuagcucaagaaauccugauaccuacuucuguucucuucagauacccgaauacguauggcaaauacaugcgccugcaaacacacacacacacacacacagauuaaacuauuuuaaaaagcagggaaaaaaggacuccucuuuagagcuaggcaauucugauguaaauuaucauuuuauaguagagaacacugguagcuuuuuagugauuauuguguauuguggcuuuguguacaguguaaaggcuauaccaacuuaauguuuuucuuuuuccuuuugagacuguauuccuuuuaugugcacaguuauguauguucauguguauguauaaaaguaaaagcugacuucucaugagguagcuguuaucaaaggcuuagugugucauuuucaggucauuucuguauaaacucauauauuuuauuuugguguuuagcacaaugaugagcuacagugccucucaucccccacaguugguuaagaagggagccugaugucccaguauuguaaaagucacgagucauguguuggucuuucuggggcccagacacaccuggugaucuuacgggucaccagauacuguugauacuauagagauuccaggauuuuaggagcugugugucaggaaauggggaggaagaccagcauaugucauaacauauauguauguagguaugugucugugcauguggcuacacauauagauggaagccagaagucagcacugagcaucucccaacacugggcauuacugguucagcuagacuaauggccagcaagcucuagggauccuccugugucuaccuccccagcaccauggucacaguacugugucuggcuuucuugugugacaagcauuuuccuuacuaaggagccuucuccuuagccugcacuuguuuuaaaaaugacuaaaaacaguuauuuuauauaucauaaaggucauuucuuucagauuucagaaagcuagguuuaggaagcucauuucugaaaaguauguaagaguuucaauuuugguucauuauuacauuuuucuuuucuuuuuaggaguuuaaucugauugauaggcgugaguuggcaccacuucaggaauuaauugagaagcuuggaucuaaagacagauaaauguuucuucuagaacacaguuaugcucuccuucuaucuacugcuagcacucucucauugcugucugguauggacuaaaugauacugacuacaagaaaccaggaucaaaagauccauuguguuugcagagaaaauugucccaaagguagguuggccagauagcuucagaacaauccaacgacaacagcuaaauccgaggugcuguguggccacccuguuacugcuaguguccuucuuugucuuagcccaugacuaaccuguaguuuguugcugagcuuuguuuaagaaaaugauuuuucccaugugacagcauaauggacauuaagaauuuucagcagcaacuuacuaguaaguuucuagaacaaaugucuuaacacagaucaguuugcuuuguuuuacaaaucagugguguucuguuucuaaaucccaucguuuagagcuucuguuuuacuuugguucacauuuguauacugauguuuuauacgcaagaguguauguuuuuagcuaggcaugaugguccaugccuguuaccugacaacuguggaggcagaggagagggucucacauuugaagcugguuugagcuacauugugaaacuguugcuaaaaaaaguuuguuuuacaaaauccacaaggcauaaaucacaggcauauguggacugagauaaccaaaguuauuuuaaaugacuuuauuuucuaaacuuguuugggauugucuucaugucuagaugaggagagugcauggcuucugacggugccuugcagguucucauuugagacuccucacucagauuaauuucauauguagcuuggggcagagaucaaaacaacuuucaaagcucugagacacacuuggaccuuaaagccacugugugcauugcuguuuccuugcaggucuugcggggcaguaggaaaaguauucagacuacuugauuauuuccuaaaugauuccauguuuuuauugcaacuugaaacuucuguuucuguauagaaaugcacagacuucauggcaauaaggacgaaggucaaaaaccacagaauagcuugugagggguggggguguugugugugugugacagcaggucuccuugggccugugagagcuggagacccagcaaagagagugaguugauaguaacuuggcuucauucugcgcacaggcugcagugaccucuagagcuucuauccuacuugucuuuguaucaaaacuugaauuuuuccucauccugucaggauaaaagacuccucuacucgggaagugccugcuuuucaugugguccucagaucuagucagcucuggcugccuccucagauguacaugacaucccagggauucuggacacuugcccggcaggcagagcuggaguuaucagcauuguguaucagagcugggacuuacacagugcucauuggccuccuauauggcuuuauaaaaguuagaguugaugagguuuuuguuauuuauuuugauuccacuagacuauacuggaaaguauugcuuagaaacuccaguuuuaauaacucauuuucaguauguucuuaaguauacucagaauuucaaaggaacuguuuugauuuuacuuugccugaaaccacauaucacuguuagaggaauucaaauuggaauacugauuuagaaaaaaaaggacaguuuggaaacagcucacaacccaggaguaugcagagguccagauaucagcuguugugcaaguguaugaccgucaucugcagacaggcuucuagaugacaccaaggaugcaucaccccucagccccagacuccauuuacuuugauuugcuuuagucucugaggaaugaaauucuuucucaaccagggcccagucauuuuuaugaauucugacacccucaaaucaaaggucccucuuuucucugcaugugauucagggauagaaaugcccucuccaugacugagcuccaaauggagaagugcuaagauacggaggaggcagcucacuaauggaauauaaagcaaagucuuguugguggaaaagaaugucuccacuuuuuguggugucccccuccucuauuuuccuucugucuuuuaaaaugagaacagugcuagacucccaagccaaccugccuuaaucagugugcacacauugcacuguugcucaccucugaggcaaaaacccgagaggaggcugucuuucugucuuuggcuagagggucgauuuguaacaucugaagaaaucagucuguccuggguuuaucugccuacucuccugcuccccgcagcuggagucagcuguccugucugauucugcucccugaacuguauugcaguggcuuccaauugccuggagaauucugcuuuagcccuguggugcuugaacuuccaggacuuugaaaaauuuggauauugggggcuggagagauggcacauuguuuaaagaauuggcuguucuuccgaaggaauuagguucaauuccuagcaccuguaugguggcucauaaguguguguaacucaauuccaguggauacaacucccucauacaaacaugcaugcaggacaaacaccaaugcacauuaaguuaaaaaaagagaagaagaagccuuagacaaugacagacuauaaaauauagucuugcuuccuugugguacauuuuuuguguuaacagcuacuagacuguuauucugcugaccgaguaaagugacuuaccagcagccaguuagccagcucuccaugacuuguagcaaacaggcacaguccuggugaugagguuuguacucuuggcuucucucugagccccaagaucauauuagauauagcuucucagacaugaugucauuaccucaagcgcauaaacaaaucaggacuuaaagaguguaggaccuacaaguguguguccugucauggugccagggcuccucugcucucuggcagccauccccaggcaguauggagcccuggacagugccagccugggcaugagcagcugaguaccuuuagcagccauguucuuuccuccugaggucagugagaguucugacaaagaaggacacgguagucuuuugaucuuccugauuuuacauucaguuuugaugcaaggcuuuguugggcuuuggaguacauguggcagcaguaauuuuacugaagcaacugcauugaaauucauugaaaugguuuucuccucagaauguaucaaauaaguauucuguaaagccauuccggauggccagcaugcuaugggcugguuauagaacagcauucuguguuggucugcaucaaaaauaguuugcauaagauagucuugguuaccaucuaaaauaacuuaaaauauuccucacauaaaaaauuuauguuguauuuuuaaaacuuuuagggcuuuaucuauuuuucuaagucguuaacuguacuuuuuaaaaaaguauuuuguaucuacuuuuguaacuucaucagaauaaacuauauugaaagcaaaaaugccuuugaaguguguuaacaugcuuuuguuuaaauauggaaaugagauuuuugauuaaauuuggagaguugucuuugcauau

SEQ ID NO: 3129 - RNA, 26758 nt, Mus musculus
cgucaaaggugcgcuggcgucgcuugaucgcaggcggaagugcucucggcggaagugcccgccuugcucggcuuggguaggauggcugcaggucgguuccuucugcgucgucuccgagcgucuuuccguuccccgcugcggaacgcgcucguggacgcgccacacgccagggccaugcacgacgggggcggcccccgaaggcucugcauugaaggcaacaucgguaagggccagaaaguggcugucgagccuuggccuccgccgaguagguggcugagaggcugggaaaagaaguuggccucagaucugucccacccugcccaccugaccccuucugcugccaccgcccaaccugccggccgguucugcaugucaggccuuucucccacagugcaccgcggguuuugauuuugggagacauugggccccaguacccgcccaccuacucacccacggggacguaauagccugacgcaggcuuuagauagccccagaauuauacugguuuacuggcauguuucauucgcuagaaauagaugcgacagugugccgguucuuuuccuaaaauagcaucaccagauuuagcaaaaauaaaaauaaauguccaguuuacauaguuuaagauaauuuuggugugucacaugcaguauuuggggcauacacuuaaaaaaugagccauuguuuauuuagacuuuuuuuuuuuuuuuuuuuccccugagacaagguuucucuguguagcguugacuguccuggaacccgcucuguagaccaggcuggccuagaacucagaagagauccgccugccccuugccucccuugugcugggauuaaggggauguggcaccaccgccuggcuuagaucaauucuuaacagauuccauuuucacuauuuugcuguacccccauguuaauugcacuacaaauuauuaugacaguguucuauuguuuugaaacagucacuguguagcccuagcuggcuuggaucuugcuauuuagaccaagcugggcucaaacucacagaaaguugccugccugguuaggaaggaucaugcuucuuaaauuuagaaauagauacuuauuauauauuuuguuauaaguaacccaguaucuuaaaaaacaaaaaagcaacauggaaggaaaauggcucaacucacuguugcugaauucugaggguacuuagcucugcacagaugcugauaaugcuaucaggugugggcugcucaagacauucuagcagcaaauaguuucucguuuuauucauucagcaaaucgcccuuugagugucuucucugugcuggcacuguuccuugacccuacggauacagccaugaccagaucaaauaaaaauucugcacuuuaauaggaagugauacauaauaaagcuacagaaauuaauuaagcgggguaaauaaacaguggaugagcuauugaugaguaagaugagagguugagggugguugucugucuuccaaauauaguaauugccaaguaccucacuggugaagggaugcuggaucaauaaccugaacagugugggggagugagcgaggugggcagcugaccaacaguauuccaggcagagcaagucggaaggccuggggauagaaugguguguucagugagcaggagggaacccauuccagccaaaguagagucaccaaggagggcaguggaggaaaugaucagguggaugaaggaggaccggguuguguagaucccaaagacuaucguggguuguuuucuuaauuuuaaauuuuacucucuuauauauuauaucccaacggcaauuuccuccuuccucuccucccagccucucccuccacuacccuccauccauucuugcguuucucaucagaaaaggacaggccucccauggauaacacccugagacaggaagccauucaaugguuugagguguugagagaugaaagcaucucugcucagugcauaggaaguggaagguuucaguuaggaagccauugcaguauaacaagcuaagcuggaccccggugaaaguuagaguuuaagguaggccaggggggccuggugauagaugagguguguguucuggaggaggccgugauaaccucagucaucuuuacuggaacagcuuggaagacuuaguuuggauuguuuucuaauguauauuuguuuacuuaguuacuuaguuauuuuaucaugagaucuugugcaugcuagccaaauguucugccacugaaguccaucccccguccuuuuuggguuuuuugguuuguuuguuuguuuguuuuguuguuuaaguucuacaucugggugugagaaugugugugugagugcagggagaguugcagguguuugugagccacaaauaugggcacugggaaccaagcucaggucuucuggaagagcaggagacacucuuaacugcuaagccaucugcccagcccagaccaugagcuuugcuuuuguucucuucccacaucaaacucuugcuuacagaguccaggcuggccucgaacucccgaugcagcuccaaacuaaccuuuaacauacauccucugccuccaccuccuccauucugggauuaccguugcgcacuaacacacccagcuuagacugucuuaaacggagaagucugggaagaacagacuguguuagugguuucaagaguugguuuuaagcaugauuggguuucaauguggcuaugagauagccaaguagaauagaaguauugaauaagcucguggguaugcgaguggaggaugcauauauguguguguguguguguguguguauacacacauacauauauaugugguauauauauaugugguauuuaaagccagaagacuauauugaaggaaaagacugaggcccuugauguuaaggcuauuuuucuuucugugaaagauugaaacacauuaguagauuuuuuuaaaaaaaaugaucuagucaagagggcaaauuagcuggguaggaguguaguucuaacacucaugaagcagagacaggcagauuucugaguuucaggucagcuauggcuacacagagaaacccugucuuugaaaaaagagcggggagagauagugaccagagagaguuucuggaaucuuuuuacaacuguuauuauauuuauuggcuccgugcaccguggcuccuauacagaguaccagcauucaucucucccugcuuccuucuugggaugcaaagcugccuuacccuccugaugcugggaguuuccaccaagauggacucaaacugagccagaagaaacccucccucccaauugucucaguugucagguacuuugccaccaagacaagaaaacuaagguaguggcagaacacugccuuagggaguuugcagaggaggauggccagaugcuggugagccuguggauacugcuucauccuguuggcaguagguggcugccugagccacuagagaguugacgucagggugugccguaacuagauucgugucuagaaagccacaggcuacaguuaaguguaaacaagugcuuccuaaaguggacacuuucuaugucacauguguugcaguacccauaaugcuuuguuucuagcuuguccaaugggcaaguaaauaaauuggaaaguucuaaaguaaaaaacuaguuuccacagcuguugaaguugaaggaggagagaugacacaggcuugaauggagggagaaagaagggacaguugaaggauagucaggaaucgagauggccaggacucagugacugcuuggagauuagcagaggaggagggugcucagguuuacaguuugcauucugacucaguaagcaggggaugaaaucaaggaagagauauucuggggagguaaaagggauacauuuugucugagagaucugcgagacacauagaggagaucccgaacugacuugacuggguacccaaguacagagagacuuaagaugggaccgaguccaggcauggagcuggugacagguggggguagguaaagccuuggaggugcugcagagcaaccugggagacugcaucugccuuggcucuaguccccaguuacuucccucagcacacacucagauggcagcucccacacugaguuccucauccugugcauccugugugggcuggcagagcuuccuacccaugacuguaugcacuugaguguugcugacauguucaguaccuucccugggucggagccaccagugcucuacucaucucuguguugcccugccuuugugcucaugugacugccagaauccuguccuggcacauuuauguggaaguuagucacuggcacacaggaaagggaauggcuuccgcugugauccugaaaccaggcaguauggcuguaugacugcaguucaaagcuuuucacccacaacugaaaauccaaacaauaaaguaccuagcagcuccuuuaguucuguucaucacuaaguugugucccucacugcuuccugaagcccauuacuuugugacuacaaaccccaguugaagugcagguugccauaugagauagcugucagugggucaucugacuccauuccaguguuucacuuucacggaccuacugugagaaggggaaacaguaaguuccucccaugcuggagucuuggguguaaggcagcacagggcucugcuaaaggcauauugauccuguauuagaaaagugucuuaugcacacuguugugucuuuucucugugccaagcuuuauuuuaaaaaaaugagcaaagaacccugguggggaacaaccuguuucuaauacuggaucuugacuucucuugucucugcaagucacuucauucuuauucccccaguucuauucuuggugccuggcuaggcacccggcauaggaaaggagagaggugcagccugucuucauagagcucgcucccagccugcugcugagagagcaaacgauugcagucuaacaccuggguaaacuagagcagggagggaucaccucugccuagggauggaguggagcuggacagacggcaaggaggcuucagggagugacaguggucaggugaaucaggacagccacagugggggaggggagcgccggcaggcccauucuugcagaaaggcugaguucaccuuaugcucugagcugugaggaaccuuuuuuuuuuucuuucuuacaaauaguuucccaugaaaagaaaggaagaaacuaaacaaacuguauuaaguuucuuucacacuucugacugauuuauugaguuuucucagaaguacuuucaggauuagaaccuuuaugauccugggcuuagucucaagguugcagaaggcccuugagggcagaacucagccugcuucauugcuuuagcuaccgugccucuuaggaggagcuccaagggcuucucugcaugaauggccgcagcagccgaugcacucccucacauaaggacucaguguucuugggaagaauuguuuuaauaugccagguuuauauuugcugccauuaauugacuucaguugaaucuuuuccccucacauuuuccaucuuagugaggaaaagaaaaugcugggcacuuuaauucuaccuuuaaccccagcacucaggaacagagacaggcagauuucuaaguucaaagccagcuuggucuacaggaauaguuccaagacagcagggcuacccagaggaaccacacacaccccaaaaggaaagauaauagaaaaugcccagagguaaucaucauauuuuuaaaauccugugagaugccaguauauuacauuuuagaaaauaugauaucugcagcaguaggucuguuucugucaccaccacauugcaguauaguuagcuauaacaagcaugcaguuuauagaaaaguuugugcaaaggaaaagccauggcuugcaaaggcaaacagcuacaucaggacggcaucuagcuuguggaaugacuguccuaaaguuuaaaaaacucacauguccuaauaauaguccuaauaauaauauacucugagaaaaguucuuuccauauaaucaaacuagaguacaccaacagccaaggcucuaaaggaagauuugaugcaccuugagaggugggaaaccaaagaaagauaacagauauaauaacaggaagaucuaaguuaugcuaaguccaagauuuaaagaaaaaaacuaucugaagggaggcuggcuguagacaugugcauucuugucauuagcaagccucuguggcaguggaaaccaaacucccugugaagccucugagaacacuuuaagacuuuugucuuuaaagauuauguuuuuaauuauguaugugcagguaugucuguguagggcuucaugcaccugcaugcaauacccgcugaggccaggagagggcguccaauucccuggaacuggaaauacagacuguugugagcuguccaguguaggugcuaagaacugaacucagguccucuggaauaguagcuaucacaacacugggaaguuacaccaucucuggauuuuauuuaaauauauaaccuuacauuauugaagugauuauuccacguguguguguguguguguguguguguguguguguguguguguguggugccaguuacagcucaguucucauggcauuuacucaccucuaugugggugagcauccauucaggaaaugcuacccuagaaugaauuacucaggcuauuccagcccuaguaaaaugcauagcgcagcucucagaaccuuccaucacuguuuacugucuuucugugcugacguuggcuucgauuacuaugcuugcuuucuagaauccuuggaauuggugggagcuguacacagaagugauuguuccaguaauuggaacuguagguucccauuguauuuguaagcaccccagguugaguguguaacugguaucauucgaaugcucagaguucugaugcccugagauggacugauacugccuggugccagcuaggaagcuggugccccuaaccugcagacccuuccagcuuccacuuugaaagaugcaagcaggucuaauggucaucagagcacugccuucaucucuuuguuuuauuuauucacuguuugggacagucucacugugaagcugggcuaucuugcagcacgcuguguagcccagccuguuguccaucuuuccauaguucugcucuccucuugaccucccaguugcagagcuuguaggcauagccacaaugccuugccuuuucauaguacuugaauuaguuuccaggaccuggcaagauggcucaguggguaaaggcauuugcugccaaacccaaggacgugaauuuguccccagagauucaaugguguaaggagagacaccacuucuacaaguuguccucuguccucugugucauggcacacggaguaaauaaauacuauuuuaacugcuuaaauaacuuuuuacccuaagcauaagaacugucucucagacuuacugaaccuaaccucuagguauuagccucccaggccauauauuuuaagcugggguauacucagcacaagcagguuugagaguugguaauucaccaaugcaguaggaauuaggagcuaacuagagaagucacugacacguaaggugagaugucggauuugggaaaggaaggacuaagccacuggccuggagcuuugacggaagggaagacauuuacucuccucugugugggaagcgcagaggcagagcaagaugaacaagcacaaaguugguggaggugggacagaaaagcgugacugugcauaacuguccuccugugcucugagaaguggggugcuguaugaugaaggacacagauugcugugugggcuccuggcugggacguggggcuccugagcucucacgcucuuucuugguuccauuugcuuccccgcagaggguagaacucacucgagaaggaacacuucugauaaagaagauggagcuuuagagcuccuccgaaggcauuuucuuucucucuuugaacgagagggucuuaguacauagccuuggcuggcccagaacucaguagaccagguaaccuccaacucagaugccugacucugccuuccucucccaggugcuggggucagaggcacgaaccaccacguucagacuggucucuuuuuggagggaacugaaaugaauguuuuguuuguuacuggguuugguuuucuguccuagcaaagccccauccucgacauagagaaacaguugucauuauagugaugcagcuguaucuagaacaucagagagaauuagcuugcccaguugagagguaucagugucggcaacagcuucacacaagagggccaugugagcaaagccugcaagguugaguuaggagcugacuagguguggagaggguucagagguccaguccauuaucaucaaggcaggaacacggcagugaccaggcaggcauggugcaggaggagcugagaguucuauaucuucauguaaaggcugcuaaugggagacuggcuuccaggcagcuaggacaaggguguuaaagcguacacccacagugacacacuuacuucaucaaggccacaccuccuaauagugccauucccuggcgcaagcacauacaaaccuucccagugucuuacuauguauccaagcuggcuucauauucacugucuagccaccacuggccucaaauucaugaacuucuccagcauucaugagugcugggguugcagagguguagcaguccuuucaggauuuuaagcugugcuucucaugcagugcaggugcaguguggaggagguccugaguguggaggugcaaacauggaaaggacagaccaggaacaguuagaagcacaggcaaaaggccuugaggccucuggaggucugacaacaguggguguuaccauccucuaggucuagaggcugggacgcuccaccuggugggucagauagcauuuauuuggggaauacacugacucugagcugugcaugggauguccagaagggucugcccaccaggagcuuaggacagauggaccagauggaguuguaaauggaaauagaucaucuuagccuugugggcuagguugguuccaccuccuugcuaucaccccgauuaagccacaaauaacuucuugcuguuaugcugauuucacuuuggcccauuuuuacauagcucuuggcacagucuuuaaaagcugaggaggagucagaggaauggguucaauucccagcacccccacgucgccccacgucgacucccagucauccagaacccaggacccgggggucugacacggguggugcgcgggucacaggcacacaggccaagacacucguacacggaguaaaacuaaauagaaagcugagaaggaaucucgucauuucccugccgaaacccaucgcuucugauguaccucugcccgagaggucaaaucugcgagucccuguggcgcugcacggcacugcugucugccuggccgccccaauauucaccacucuucucccgcacucaguacuacagcugccagcugcuucuggggcugcggccauucucgugcuugccucucccuggccuagguccaugcugcuccacguguggguuaucuuucccccacccucagccugacugacugcucagggcuuccuuuggggcuuccucagacauuucuucaaaggagcuuuucccagccccgugagcugcaucugaagcaucccguguuuuccauucucagcacggcaggauuuaucaguaacuccccgugugcuugguuagcgcccgcccuucacccaguccucugaggauaaaauucauucagugcuuuaucacucccauacaccagggcucgacaaucccaaacacaaguuagcccuccauggcuguugguuagguuuguugaaugagugaggcucaaaauugguuuuuccuucaacuuagaauuccugcagucacagccuaagcuuuauagccaccuuuugccuacuuuugaaaguucuguuauauucucaacaguuacuccauacucugggauuguuggcucauuaaaacugcagccuaaauccuaaggucacgucugcucacugugcugugguaacugguuagcuguccaagccuucacccagcccacagugaguuguacagcugccaaguuuugaagcuggaaaagcuggcccuggcucccaugagaugggcggccguggcagaaguuacuggcugccucccucaccuggauuugggaagcaucccaacaugugucauuugcauugcagcugugggcaaauccaccuuugugaaguuacucaugaaaacucacccggaguggcagguggcgacagaaccuauagcagaguggcagaauauucaggcugcuggagcccaaaaaguaaguuuucagcugugggggguaguuggcagacaugcacgcagucuaauuggaguaauuuaauuuacucugaagacaugaaguagcccagcuugucuccuuuuuaaaauaacuucauucuagaaagcaggccacagaggauaugacuuguuuggauauguuuaguuuugauuuuuguggcuucuguaugucugugcaagcgccugccuccugucuuugugguuucccaagcaugcccaaccauccaggcuuugaaaaugaauguugucauuccuacccuuaaguauuuauauuguuguuauugaagcuggcuggcaggagcaauagucaacgaggacaucuuagaugugggaagggaccucacugagcaucuggucacccuuugagucaaugcagagacaacagcucagguuuuuaaggcacaugcucaguaccaggacucuuccaagcuggaccaaccccacaugucucacucauaccucacagcucagccccagugucaggucugcugcuucugccaaggccauaggcuuggcuucaagccugacgacguaagugugaguggggagggcucaguuggacgaaaagcuuagagucgcugaaggaguggcagugugugccgcuggccuggugaacugcagcuaccaggggcauguguugaguggcucuaguccuguuuuagccacuaauuacugguugguucuuccaaguguugaaccauauuggacccugugacuuggacucacugguucagguccuucugccucaagccuuagccuuuuuguguuacagcaacuccuguguacaguugagacugagagccuucucucuucacaucgaguucuucagcaucccucaagguuuccucugggccguuuuccauuuugaagccacucugugugagugaugugcugcucagugcauucuuuuccacacaguuuaccaagagacccgccaggcucuccccggugcucugagugggagagcaccuuagagugggaucuggugccagaguugcugcuccaguccagagugaugcagccugugugaccccaugcuaugugaucagagagauguuuuuccagucaucuguucauaugcuuguauguaugcaauuguauauuuguaaaauuuuccauuagaaacaaauuauaauaucuuuuucugaguaugccagaggcaagcggugacauuuuaaaauaugaucacaaaagcuuugcuacuccaccguaagaguuaugaagcugaguucuccaaaccuuaaccacugaaccaccuuucuagcccucuguuuauuugguuuuuuggagacagagucuuuuguacccuaggcuaucuugagcucuuggucuuccugcuuucacuucccaagcaccaggauugugacaugggccacuacacccuggcuucuuuauguggguucugggaauccacucagguccucacccuuagaaagcagacauuuuaccaauugagccauuuccucggccuuccuuuuguucuucuuuucuuucuuuuuguuggggagaggggugagagaguauggugggguagauaaauaugccacacacacaugcacacacacacacacacacacacacuauagguaaaucucaaggguuaagggaucagagaacagcugucaggagucaguucucuccucccaacauauaggugcuugagauaaacuaaggcugguacuauuggcagcagcuccuggaggcccugguuuuuaugucuccuauaaguagcucaagauuuuaaaaacauccuucuauauuucuuucugcuauaugugaauuuuaaaaguuguaagacucuaacgugugugugguguguguguguggugugugucuguguguguggugugucuguguguguacguguguguguguguguggugugugcguguguaguguguguguguguggugugugcguguguaguguguguaugugugugugguguguauauguguguguguguacguguguguguguguguguguaugguguguggugugugguguguguguguguauguguguagugugugugugguguguguguuugugugugugugagggggggugcuucccugugcacguggauggagagguugucaggugucugguucuuugacucuccaccuuacucuccuaagacagaaccucucaaugagucuggagcuaggcuggaggccaucuccccggugauccucuuguccccuccucgagugcugagguacuagcucgcaugcagccuugcccaacuguuuaccuggggauugaggaucugaacucagguucucauguuugcccaucaaacaguuugauccacuaauccauuuccauugccucuauauuuuuaauuuauuuuuguuguauuuuauauguauuagcauguaugucugcauaccacauccaugccuugugcccacagaggccagaagaggucauuagauccucuggaacugaaguuagugaugguugugaguugccauggggaugcuaggaguaagaccuggcucuacuggaagaacaacaaaugcuguugacugcugagccgccaccucuccagccgcuguccucuuuaaacagucgguugucugauuguccugcggagcucuucgucaucucacuccugaguggauaugcacugcauuguuacugaugcucagccucaucuucucaaacuccuaucacuguguugaugauaaagcacuugauuauauuugaccaguaugacucaauucauauauggaauccuuugcucagacuuuuagacaguaguaguugccucuagcuggaaucgauuagaagaguuuugcaguuuacaugacucaccucuauccuccugcuugcuuugagcacagcuugaaggaggaugcucacuguucucuucuacccuugggccgcacccucugaugucagcgcucaguccucuguuacuccuucucuagagccuagaaggacguccccuacuggagugcccacuuguuaucaacagcgauguucaguuauucuccauaaaucuucuuagcaccccuuucacaugagauaaucauggcugaugcugcuuuucuucuuaaaggcaggcucucauuauguagaccaggcuggucuggaauuugguaacccuggcuggccucaaauucacauggcuccuucugcuucagucuugcaugcguaggauugaagguauguaccagcacaccuggcuaugucagcuuuuuagaagaauauuuuauauguacaguuugaggugagucaucagugauaagaugcugcuguuugcaggacagaaucaauuuaagacuuguaaggaaaaugggaaugucuuaaguuuaguucaguuaucauugaggagguagcccagguucaaauacaugggggacgggagagaauggagcuggggagguagauggcuuagugguuuagcacugggcugcucuuccagaggacccgaauucaauuuccagcacccauauggcucacaacugucuacaaccccaguuccagaagaucuggcacccucacacaggcauacaugcagcaaaauaccaaugcacauaaaaauuaauaaauaaaaaaauacaugggaaaauucguucccucugaauucucaucuggggggucuacucuuucuguuaacugaagacgaauauuaacauuugugaaauuuuuuuuguucuauuccguaugucuuuccuugucauuucccuuguauuuuaauugguauugcucuacauuuguagauuucaauacugcuuuauuuuccauuuuaauucuuaguggcgucuucauuaauuuauuggaauuaaauggggagagacuugcauuuauucguucuuuuucuugauacaguaagaccauaccuguucuuccuucuuuuuccuuucuuucuuucuuccuuuauuuuaaagauguauuuuuauuauuuuaaauuauguguauguggggaggggguauguguacaaacacacacacucacacaaacauagcuacacauauacacacucaauuuuuaaaauauauuuauauauacuauaaaauauauaaaacuauauaugaaauuauauacauauauguauauacauacaugauagauagauagcgaaacugaaaaggaacaaaggucaguaucuaugcugagagaacuauuacccagaauaggagaacagaaaacaaaaacaaauguccgcuggagagauggcucagcgguuaagagcacugacugcucuuccaaagguccugaguucaaaucccagcaaccacaugguggcucacaaccaucuauaacaagaucugaugcccucuucuggggugucugaagacagcuacaguguacuuacauauaauaaauaaauacaucuuuaaaaaagauuaauauguaaaaaaaccauaaauaucuuaauaaguaucucagcaagagccaagauauugccuuacugguagaauaagaacaggcugucaaaaacaaaagaugacagaacaaccuuagguguaggcccucgccuccaucuuguugaagacagucuuguucacugcugcagugggcaccaggcuagcuggcccaggagcuuccaaggagucuccugucuccaucucccaucuugcuguaggacacugagauaauaugccugacugugccuagauuuauauggauucuggggauuugaacuuggcucuuuacauucaagugacaaucacuuagccacugagccaucuccccagcccuuauauuuuauagccacuuauugucucuuuguugacaaguuuggacaaguguuugcauuuucugugaagauugcucaucauuuacuuccaaaguuaaugauacucuuugcuagaaacuccuuucagugcuuuacagcaugaaugacugaacauuugucacaugcuuggccuuauaugcugcucuuaaucauccucauugugaacuccuuaagcacaguuacugcaucuucuucaucuguauaggagagguauuagaaugaagagguuagaggaagccuaguuugagcccuauucucuguuuacuccccagggaaccuuaaacagguaaguuacuuagccucucaguggauuugccccucuguaaaaaugguuuuaauagugcucaccucaggaagcuguuuggaaguuuaaaugacauacaguccaauaaagucugaaguauacuuucuuuuucuccaccccuuacaguaccuagcccauggaguacuucacccacauaggucuccagucagcaacaauugaagggagggaagggagggaggaagggagggagggaggaaggaaggaaggaaggaaggaaggaaggaaggaaggaaggaaggaaggaaggaaggaagguaggaagguagguagguagguacaaagugccuugcuuaaauuuuucuuuugcauugacugagccuagaaaauaaaccugggcccaugaguguccacuacuuguucccacccauacauucagaaucgaugagacuucaaauugcauuucaugauuccuagaauaaagaaggaaccggacuuuguuugaacaaaguaugacccuuccauaaaacacagaagucuguuuaauuuauugguuauuuagacucucaaauaagcaguuguuuucuuucguaucuuccuugaaguuugagaaauaaccacaaauggaauuugaaagucaauauugguauuaagguaggauuugauucagaggagaauuguagguaacugccuacaaacagacuccacgagcccaggacucugugugugugugugugaguucugugagugugugaauucugugugugaauuuugcuuugcucuuuccuguccagugauguggugugucaucucccucugucagauccuuaucacacgaggacgaacagucuucuuccuccuuacauuguuuaaacugagcuggggagucgucucccucuucauguuuucaguggaaggaaguaucuaugguuauuuuucacaucaagcauugaacuuucuugaggaagggcagagggugggguauguugugcacuaauucaccuucuacaaaauucuccuugucuguacucgcccauaggauggcacuuccaaacgucuuggaaacuugcuagaaaugauguaccaggagccagcacgaugguccuacacauuccagacccuuucuuucaugagccgucugaaggugcagcuggagcccaucccagggagacuccugcaggcagagaagucugugcgggucuuugagaggucuguguacagugacagguaagacaccagacacugccagccacagacacugugcucacagacaugugguuuuucuuugcagggucccugaccuuggcucacuagucauuguaaaaugucuguguggcuggcuugugaguguccucucagagcaaaauagacaugcuuuuuuaguuauaggugcuuugcugcuuacuuaaaacagaguuucagcuguagcccuggcuguccuggaacucauugucaaccaggcuggccuuguucucauaggugauccucccaccucugccuucggggaauugggauuuccauaugugccacuaugccuguuguuguuaauaacuacuugggucaagcagggcacuaguggcucaugucuuuaacccuuugugaguucgaggccagccugcccuacagaaugaguuccagggcagccaaagcuacacagagaaacccugucucaaaaaaccauuuaaaaaaaaaaaaucuuaacauuuccuuauaaagaagagggcaguuggucauacuuugugccauuaccccagcaaagcggcuuucuuuaguuaaagggggauauuuucaggcagaaaggauaaccagguacaaauucuaaucucaagagcauuuauacuccuuuaaaaaugcauucaauuuucccuuuugugcccagggcgugaguugcccccaguguggaagggcgaaagugucauucccuccugggcuggguuaguggagguuuacugacugccuccugcacucaggagccaggcucagccccaggccagucccggcuccaugacaaggcuacugcagcaaggacgacauauguacucacaaguguguguauguuucggaggacagugauugcagggaagaagaaauagaagcuuucugauugaauuaacaucaguguggcuuuagaacaaagcucuggauugcuggguccuucagcccuguucugucugcaaucccgcaacccccucucuuuacccccaccuucugcccaccaccagcagcuauggagaaacaggggaagugccuaccucaggagagguaaaggccccuuuuauaggcuuagucauuuuucuuuguaagauguaacuuucaucuucaguugucuguggagaaguuggcagcacuuuccaauucuugucgccuucagugagcuuuagcuaaaacauucuagucugggcaaguucacuuuuggaguuugcaaauuagcuucuuuguggccucagagaaacaguucagaaggcuuagagcugucgacuacugaguggcaaucaccguccugagcaucucacaaguagaucucagucgugucugccauguguugagaggcagguaucuucccaaggcaacauggccuguggaagcugcaacgaggaucagacucuacagagucauuuuacaaaagccacucucuuaaaagagacacagcuuugcaguuugcacuucccugagccagucacacagcaguuugguuuucaugguuuucagaaguggccaguugcugaccauugccuuagaccuggaguucauuauugcagauauaaauguguuuuguaucaagcuuuaacagcagaauugacccuuuuaaagccaugguuuauacaguucugaucucucaauuuaccagaucuuccuuuucuuguggaaguaagcaaagaaggaaguuaguuugauauucagcauuagcccucuuugauuugauuggaagcucagcagaggaagcuagguuccuguaugcuccggagaggagguugcucuccugguccuacugaagucagcuccagagcugacacccuugcuuuucagcaacaaagcagcauggcucagcagccgaagacucggcagucucacucugaagugcaguauggaaggguggcuuuagccuacguuuacuuggguuuugcuuggaaucuugcuguaguaaugaggaaaucucaaaggcucagguuuccaugcacaugccaugugucuuggccagcuucccuuucuacagucccucuccuuguaguggguugcuccguguguaggcccuagcacggccuguguaggugcuguuucucauuacaggacugagcaggaugggagcuguagacugggaauucagauuuccagggcuggaaagacaguccagcagcuaagagcauuugcuucucuucuagaggagccaaaguucauuccccacacccacaucaaauggcucacagcugccuguaagucuagcccagugaauccaaugucuucuucuggucuccacaagcaccaacuuguacuuacacaaacccacccagaaacauacacgcacacauaaauaauaaaaauacaguuuuuaaacuuugaauugauucuuugugaguuucacaucgugcaucucagcccaccuaucuccccgucccauaguaucugcccuccaaacuugcaaccuccccucccaaaagaaaauaaacucacaaacaaaaaaauaaacaaaacaaagcauaaaaaacaucguggaagcuguacugugccauaguguaucccacaauguaccucucuguccauacgucuucauuguaaguguucauggcagugagucugguuggagguuucuggcugcuaucauaccaucaauauuggauccucacugggguuccuccuaguuauccuguugcugcccugugucauggcgacccugcagccuuggaucugcaggacuggcccuuucaugcacuccaacagauaauggggugggccaacucagaucccagaaucuggucauaggugguagcugagcaggucagccugcuggcucuuccauaucugcacuuccagggugagcucuccagcccugcuccagcuaggccacccaauacugccaucagcaggaggcaggguuagcucuccugucaugcccccacccacacccccagagccagcuccacugugcugcccagucgggcucggggcccauucucccaggugcugcagcuggcgaggggcugggacagcugagcagcucacacccauaggccagcuccacuguguuggucaggcaaggugcagggcuaacucuccugcucucaugaccuugaggccagcucucucgaugacuacagguggcaagggggaagggggcagguggaaauaggguuggggggcgauauuuuuuaaaucagguuauuuuuaauggcuaauaagagcuagaaugguuaagugguuuggauaagcaugaaacaagccaguuacugauuuuucugcuuuucucccacuccugacuuucuuccuccaccccaaccucccacucaacaauuccaaccagguauaucuuugcaaagaaucuauuugaaaauggcucccucagugacaucgaguggcacaucuaucaggacuggcacuccuuucuccugcaggaguucgcaaaccggcuuuuguuacacggcuucaucuaucuccaggcuucaccccagguaacucugagccuaaaaucuucuauaggugaugguggcaucugccuuaaucccagaaugagggaggcagaucuuggugaguucgaggccagccuggucugcggauugagcuccaggacauccagggcuacacagagaaacccugucucugucucucucucucucucucucucucucucucucucucucucucucaaaaauaacacuuagugucuauauuguuuggaguuuuguucuguuuuaucuaaagaacuucaggaaacacaagagaugcguccugcaaacuucugguuucuuggaaguuaguuuccagcccucagccagcagagagaguagaaauacacccguacuccagcauugaguacccgccucccagggaccugcugcagcuauaucuguggcagugugcucaaacaguagccugcguguggaagugacccgcuggggaagaaccaacuguuguuuuuacagcuccaggucugcagcaccugccacaggcacuguuuccuuccugugucgggucaucugaggcuucaguggaaccuaugaggaaggaaggaaggaaggaaggaaggaaggaaggaaggaaggaaggaaggaaggaaggaagguuuccucucucauccuaaauuguugcccacaguuugguccuugagaagucccucaggcaggcaaacuguagaagugcucucuggcucugauucuguaacuugaacuugggagccaguuuagcccacaggaugauuucaugacaggggaucucuggagacagcauuggcccuuggcuccuacugacugguagugaccuuggcuagacccuagaaaaggggucuuugucuguaaaguagaucuccuaaaagacuugggcaggauucccagucgaggcaaagcauguuuugagagauacugcugucaacuuuugagagacacuuugcaaguauggucagaugccaaguacgcccauuguugcagaaaacaagccagcugucggcaggcuggggcugagcuuguggacagaagggagccugggggcaugcuaagcaaagucugagaacaagugagagaguuccucucaugucacguugcaugggccccauagagaggaucaggaggaaggggcagccagaagagggacuucugagugcagcugggacuggauuugugucuucuugccuuuuucaccuuuuuuaaagguuuuuuugagacauggucucacaguguagcucuggcuguucuggaacucacucuguagacaagacuagccucagaugcacagacucacagacucugccugccucugccucccagcugcuagggugaagggugugcuccaccauacuuggcuguauguaugcaugcaugcguguguguguguguguauguauguauguauguauguauguauguauguauguauuucuuccuccucuuccuucuucuucuccuuuuuagauucauuuauuuauuuuauguauauaaguacacuguagccccagaagagggcaaucagaucccguuacagaugguuguuagccacuguauguuugcugggaauugaacucaggaccucugaaagcagucggugcucuuaacuuagagccaucucucuaacaccacauuuuuuuuucuaauaugacauuuacuccuccuuuucuagcaacuccucuucaucugugugugugagugugugucugugugugaguguguguguguaugugugugugugugagagagagagggagagggagagagguggggagagagagucagaggacgguuuaacuucauuucucucauucugcccuuccauggaucucagggauggaacuuaagucaccagcccuucuuugccaguacggguugccugcugagccaucuugccaagcccaucaugccuuugugguauggagaggaccugaauuauaauacagacguuagaucacaucagggaguaagagagucuagauaaaguuucggguccaaauaaaauugaaguagauauccgcaagacuuaagagcugagaagacucuucugugagcugaagugguuuggccagcugaggcacauugacagacuccaauggccuuucuugcuaaggaggaauagaggcgcaucguaaaggcugaugacuuuacagguagaaaauagucccugaauggaaaagaggagccugcuccaacagaggauggcagggugugagggaggcagguuucuaggggagaggaguucucuccagcugugaggugcuauggauaggacaggggagacaagacugaguuagaggcgacuuagauuucccuugggauuccugagauggcugcacuuagaggagcagggguugaaggcuguggcugggagaaggaagaguguugaccuacucuguucugagagagacagaacaggguggguugucucagggccagggcagcauugcugggaggagcagaggagccagugagcugaggccuucccgggaguaaauagagcugcuuggcuuuuugguucugugguuggacccagaccuugggauccauaaagcaagcaagucccccuuaccuucauucuuaauauccauucaaggccuguauaaaguggcagggugguguaguaauaaugaacgucauugggagcuggauugucccuuagaagaaaccaauuaaaguauuucaucucguaaugagacauuuuaggacugaauugagauuuuagcgcuguuuggaugguguuagauaaaggaacccaggaaggccaaaggaugaacaggacacauauucaagccaggacccagcacagcacagacuccugccagaugcuggcuuuaggaucugugagacgggcuccaggccccugucuauguguccuccccuuaaagucaaggaagcugggaaucacaauaguaauaauuggaggagaaauggcugggcuuguguuccccuaacccuuagagucaagaagagagcgcguggcuggccaugugacucaggauacccaucccugugugggacagugccaauuggacagagugugcagggucugugugggaacaagugucaccugagcuugagacuagagggcacagugagcagagccuucagcagucacagcguggcacgucaggaagcuuggacguagggucccugcacuucuccccacacuggcuucccaucacagucuaguguguacucccaugugcacuggaaugacguggagccacgauaaaacugucccaugaauuuuaaaaucauucauuauaaucaugucaguaaaauuagaauuaugccaaauauucaaaauaggauuuugccuagacuguagagggaagaaaaguuugcucaguuuagcaaauucauaauaaaaagggaaaugcugauuuuaauagauccaggcugguaucaaugguugucuguagucacugggugauaauuaugaauagcuuuuaccagaauuguucuguccuuguauguauuugaaaacaugauuguauuauguuuuuuaaaauauucauuuauucuaauccagaagauauuuuucucucagaggaaaaauuaaguaccuuagcugaagcugcuugcuagugggaauguagcaugggugaccucugaggaggcagcugggcaguuguaggaagagcucauuccuuuugcccuguuaauccuggugcuuagaguugaguccguagauacgcuggcacacagacagacugcccuguuacgugcaucacuguuuguaauagccaagcacuggagaugaccgagugcuuauuaggggaccuggcugaguguacuguacuguaaaacagaauacuuacucuacagcacuguacugguuggcuuucuuuguugcugccuuuuuguggcaaggucuuaaaacucauagcccagcuggccuggaacucacuagaagcauucagguuucagcuacccugugcuagauuucuaggugugaaccgugcugagaacggugaagcacuguuaagugagaagagcaagccuaagaacagagugugccgugggauagugucucuccguucucaggagauggugucaggaacgcaugugugcauaaacugcugaaagcucagucacguguggugcugugagugaggagaacagaguagccagaggcaggaggguacaggaaacacgggucacagagcuccaggucagccuggagcacaccuagaacuacccccaaaauaaagucaaagacaauaaaacucggcaggcaggcaggcggguuggggagggaaggugcuaaagagaauuuguuugcauaguuucauuuccuuaagggaaagaugggacaugggggaggguggaguccuaagucagcggguuaaucugcccacacucugaggacaguugacauugacuaaugaaguauuugaccaggcagaaagaggaacaagggcaauucaggcaaaacaaacauuuggagcagagguuuugaagugugaaggggcuuggcuugucccacaggaaggaggccaaaucuggccaaagccaugagcaagggagggacuaaggaaguugaggacaaguacuguggccuuaugugcuguggcaaggaaucacaguucucaggggcagagacccucagaccugcagguggaggcagagugaagcucugcaaaggggcagggagaggggccuucaugucaagacucagguuucauuugauucauuucauuugacuuaugcagauguuucaucuacuccagagugagugcuugaucuagagauguuucaaauugcuuaccacuuuauaaguagaguggcucucacaagccaggcacagugacacaugcauauaaucccaccaccuggacagcugaggcaggaggauagcaaguucauaacuucuugaagucuuugguuaugccuguagcugguaagcagccuguggagcaaauauuuuaagcaggggcacaagaaccauagaaggcuggagugaagggcaaacuggaaaggcagaaugacuuuggcaauccuagaugugccuuaccucagagcagucucaguuaccugcggguggguggaggauggagaaaaagcagcccaccaaaacugcuugccccacacaugacuaugacagaugacugacucuuaggcccaugcucucuucgugcacuucuucaccuccaggagaaagaaagcagcaggcucuugaaguguccagaugaaaagcaugaacgccaaggcagaggugagaggacagggccagcuagagagauuagaaucuccuggauucuugaugugcucgggaggaagacaaagaaggguaguuucaggcucccagugcggcuggcuggguggauggaguuugcuacuaaccaucugaagcuacuccgaggaagggcagucugaggcagaaguggacaacauggugccagugcccugagcaaggcaagaagcagcaggugcagucaugggccaugguaccaaagaggacauccagacauuuuguggguugcuuggcccuguaagacugaaauguaagagucgggggauugucuuuuagguuuguauggagagacucuaccagagggauagagaagaagaaaagggcauugagcuggccuaucuucaacagcuacauagucagcacgaagacugguuuauuaacaagacuaccaaguaaguguguaacagacagaccagagccuccaccaccgugcugagcacagccguagcucccagcggaacugcaaggaugcgggacgugcccagcaucucucccuccuuuccuuccuuccuuucuuuucucucgauugugccuuguggugaaugcuugucauaauuggcucaggauggaagacugaaguuguuuagaaaaauguccauuuugauugacauuuuuaguguccuccaucaggcuuggguugcucacaucagugcuuuaaaugcugacuucaguagcagucuaagacuagugagcagucuacucagccuuccacucugcaggcagcuucagucuugagacucgggcugggugugaggaaggugaguggcguugccugagcucccucucgcugccccaggcuccacuucgaagcucugcagcacgugccagugcuggugcuggaugucacugaagacuucucugaaaaugccgccaggcaggaagagcucaugggacaggugagcacagccuaggcucguccugguucccagugcagagcucuggucuucccggccucugugucaggccuuguugcuuugugcuucaaauugcauuucacacuccaaaacccugagcucauaggcaaaucccagauacaaugcccagcucuaaagugcacugcauuaggaaguaucagucaguuaggugacucuuagcaugcgcaggccagcugacuuccuccuguaagguguuccaaaaugggggacaaggaacauguggguucuguucccagcugccacuuccugcugucugacccugggcagcuaauguuuucucaccucauaaaugcucaugggacugcagucacauacacuaaggggaguacugagacggcagcauacaguaggucuucuuuuccugcaggugaacaccuuuaugaggaacuuguaagcaauaaggacacguggcuguggucuggacucugacuuucucagaugcugacugcucuccauccuguuaugcacaucccuuuggccccucaugcacccccacaccugggugugugcugucuuuguacugccauuguuuuuguuuuuuuaaucucaagcaccuugaaauaaagcugacuuugcuauuuuucuaaucca

SEQ ID NO: 3130 - RNA, 6934 nt, Mus musculus
cguccucugggcggggacagcacggcggcggccgcucagugucgcgggagccggaccgcgcaggcccgucccggcggcccggggggcgccaugugguucauguacgugcugagcuggcugucgcuguucauccagguggcauucaucacucuggccgucggugagagcgcugacccgggccgcgcgcgccccgaugccccgagccgccaaccgcugcugcucuuugcagcugggcgcugacgaccccgagcugguccuacuggaccucugcggaaccuuccgguggggaugcuugguucccgagacgcauccuugcucuuggagcccugagcucccuacucagccuguccccuccagcugggacagggggaaggccccugucugucucacccggcugugugcuaguguacagcacccggccuguaaacuaaguguucugcagguguugauugacgagugaaguuuaagguucccggaacagagguuaacuuuaugcugugcggucaaauccaauauuucuacaguugucuuggcaaaguucuaucuacuugugcagaugagaaggacaucccaggggugcuuuggcuuguucccgacuuccuggagucugaggaggguuggugggggacuacaggaugagcaggcuggugggagugucccuggcugaucucuuccuguuugucccccucccucugggacccccuucuccuacccagcggcuggacuguacuaccuugcagagcugauagaagaguacacgguggccaccagccgaaucaucaaauacaugaucuggguaaguggccgcuuuucccuggaguagucacccagggcuuguuugcccuacaucagaaacaggaaguggggacuguuugagcuggggcuguuuuggugcugagaacccaggaucugagggugucccacuugcuucccugcccugcagucugcacuccuggguccagaucaccccuggcccuccagccucagguggcauaguuucacaaccuacugccauuccuuaaggugacagugcagauauuucauugauagguauucauggcuucgcuuuccugugucugucucacaguguccacggucucuaacaccagguccccaaucccagcccaggcuuagaacuuauagggacaauaaggacaguuuguaacgcuuaguuagcuauugcccucucuccacucagugucauuuguccuaagggagaauguccagcccuuucucuucccucauggagguuucuuuuccugaagacuuggucccugucccuguuagagaggcugugaggaagacugaggugcgggggggggggggggggaggauaccuuuggacagaaaaguucaccuuucagucgccuaaagucugcagcuacuuucacucucaacguagccugggguuguaguuugugguaaagacagggcuacagccagcucauuggcucagucugugggugugguugggauagcaauuagaccuuucaucaccgacaaccgaagccuuucucagacugccugcuggauucaucacugaguuacguaauugauucaguagaucaugcuuagcauucaaggaagcuaugaaaugggacauggggguacaggcaugcaugcggccuucgguuagauccucagcuccagcuccaaaaacagugcuaacaguaaaaacgagagcaggcaaagugagugugcgcucugucacacguuggguauguguuugguggagugcuguauaaaauguuuuuuuuuucuuacuuuggaucacugucuaaaauguuuuagaaguggccuucagagagaccaccuuuuugaaagcugagugugguuucugugaaccgagaaaaccaaagugcauuuguaacagcgcugugcagagcaggcagggacugacugucccggaggccuaaagguccccugagccagcgccucugccuguuuuaguucuccacagcagugcugaucggccucuacgucuuugagcguuuccccaccagcaugauuggcgugggccuuuucaccaaccucgucuacuuuggccuucuccagaccuuccccuucaucaugcugacgucaccuaacuucauccugucaugcggugagagggggcaagcagggaggacuugaugugacuagaugugggcacucugucccagacacugaccugauacuggggaggggagcaccugagcagcggcugagguccuacaggaggccacacugcugcucguuccugaggacccuagagccugucccugccuaguccucaugaggggaagggcuccagccaugaggaccuugccaaagagucaaguuagaaggaggguuugggaaagaagagaagcacacuauuuccugucccuggaaagucacuucucaucccggagugacucuguuagacccaguugauucaugcgguggucacagaugcacacagauguuugugagaaagguuuuagcaagugguuggccacaggcacuguuguuuugccuugcuguagacugggucgagauggcaggugguguggggugugcuuuagaguuagguuucugagucuaggagaaaucugaauguuaucuguagaaggguagauugugaguguuuggggcaugucgaugucagguauaauuuuaaccucagaaccuguuuagugggaguuuguucaguaccaagcgcccuguaggucucccagugagcagcucuggccaccagaaggcuccucuggcuuccuaggucacucccuucuccugcccuuuggaugccugggaaaguuuuucugagguaccuugucggcaccaggugccaucuaugucuuagcgucccuuagccuugugcaagacauggcagagugcugucuucaugguaaagggcagaaacgagacauguaguugugacauagguauggggacacaguguuucuggugccugcccuucauucugcuguggaggcacgucgggcuuugaaccucugagcagcuguccccuuacuugcucuuugucaugaacgugugcacacuagggaagaguguaugggaucauagcacagcaggauagguuggugugucuuuccccauccuagcuuucuaaggaacccugagaguaccuggucucuaucugaggccuucucccugcugugcaguaugaagcacauuccacugagguguguguucugccuacucaugaucucgucuccaaccuggcucuugggagagcaguggccugaucauggguuauuuguaacacaaagcaaaccuuguuuuuauaacaugccggaauguuccagucuaccuucugauucuguugcugcugcuguccgcagugaggaaguuggagcugagcaccuguccuuaacagauggggacuggggucuaggcagugcccuuggcccagagccaugcuguggguugguguagagucaagacugagaccuggggcuccaguuuuggggccuucuggauuuggugagcacacugugaccggacucuccauccccacagggcuagugguggugaaucauuaccuggcauuucaguuuuuugcggaagaguauuauccuuucucugagguaagauguacccagugucuagcacauaggcgugguggcagggauggggguguaaagggacuuacaugauccucuuugugacuguagcugugauccaaaaccgacuccauucaggaacuguguguuuuauuuuuuuguauaugaguacacuguagcugucuucagacacaccagaagagggcaucggaucccauuacagaugguugugagccaccaugugguugcugggacucuuaacucaggaccucuggaagagcagucagugcucuuaacugcugagccaccucuccggcuccuguuuuuuguuuuuguuuucuuuuuuuaagcaaauaaguauaaugauuuuggaaggcagggcgucugaagaacagagggaucccuuuggcaaggugagaggacacuccucuucccccagugugcccuuugcgugccucaguagagucaucuucaagccuagaagggucaccaggcuggccugugugaaccggaccucacaaggacccaccccuagcuccagccccaucagaaccuccccaugauuccucccacuugaagcccccaagcacagugucccuuggggagggacucccccagcagucugugucagagaguccugcuuccugagugcagggauagggugggccuuugggggcacccuggggcucucucuucucagucucuccugucaccagguccuggccuacuucacauucugccuguggauaaucccguuugcuuucuucgugucacuuucggcuggggagaauguccugcccuccaccaugcagccaggcggugaggaagggcgucuuagguuaggcgggggggacuggugucagcccugugagaaaacacuagggcuuugggugaugagaacucugcacacauguacacaugcaugcgcacgcacgcucaucucccugccuguguuuccacagaugacguggucuccaauuacuucaccaaaggcaagcgaggcaagcgcuuaggcauccugguugucuucuccuucaucaaagaggccauccuacccagucggcagaagauauacugacccuuuggggagggcauguggggggcaagaccaagagagccaggccccugggacucugggcuaaucgugccugggagccuggaaggugucuucugccagcccaggucucccuccccucuguucugaagccucguuccccacccuccucaggaggcuugaaugcugccaggggcaccagagaggguagcagagccugcuaugcuaggaggcuauguccccagcccucccuuccccagaguugggucugguuggauggggcaggcagggaagcugguaugaagcuggggaacugacagcaaguucucaggcaggugaccguagggaggagcugaggguuggcacuuccaggaaaagugcauuuugcuguugaaauguggguccuguccaaugcugauucccuuucgaauaaagauucuagguggcacuguuugccuuaauaccccaggaguucaucuucuucucugccugcuaaccuucugccuagacuaggcuagccugcucuagggacucuucuggcucuugcccuucuggagggauucucauggcccuaagugggaagggaacagggaugagaaugagugggcaaaggcaguuuuucugaggcuucuccuccucuccgugucuccuuccccagacugugauaguccagggugggggagggguagaaagucuguagcuggguuagagauguagaccaucuacaauacccuauuuaugucuuccuuugagaaaaaggagagauuucuugguaaauucuauaucaggcucggugaaaaaaaaaaaaaaaaaaaaacauuggcuucuaggcagccuaggcugcugcucagagcacacaggccacacucaccugcgcuuccggcuccuggagggaugugagcucugucuucuaagaaggugagccucaucccgggcacagaccagcaucuguugaccuugcacuccaacuacauacagugccuugcaggggcucagcaguauauggaaugaagguccccucccugucgcugaaucucguaccucacagugagucuggcaggugcccagauggacaaggcauggggaagacugcaguuccucagcaucuucuuaugcauccuucaucucauuggcucuugcauuucuguugcaucuuggcccgcuagucucugaauuuguuuugcagcuacaggugagauugccagaccuguuuucugccacucgaguggaugaagguauaggacagggacggcugccuaccagugggcucaggcuggccccacuugcucugcucuccacuucuuuaucuuuguucauccugccuacugcucagacaggggcuuucccaagcgaacccaggucaacucaucacaggucaccggcugggucuuggggucgcuggcacagcugauggccugcuuccuggcucacguuucugagcacugguguggcuguugucccuucacaguuucuguuauagaggcuucuuucuuacccugugcacacaggggcuucuuuacugucuuguggaucuccucaggaagcccagcugugcugguagcuuaagggaugcuguggaggaagucagagccaaucuucagucccagcuacuuccuagcucaagcacaguucugcugccuucugggcacagagaccauuugagcuuagugucugcucuguuuaccugcucuuugcagugccucgucccuggucucaugauggcucaggagccaggcagaauauugcuuucucuuucugccuaagucuaucugaucuauucuugguaucucuguauuugagccacccuacugucaucucucaccuccuuuuguuuugacaguuuccuauguuucucuauccucucaccagcuggguuucuuuuugaaaugcaugguuggccaaaucuuuucaggcccccaacucuccccagcucuccacuggccucaggauaaaguccagacuccuuagaaugguguaugagguuccugggucccuacuggcuucaccacuugacaugggcucugggccccagccuccuauacacagagaccauggcucuagcugcuuugauacucuuccuuccacuuugguaauuugccacuuuucuucuuagauuuuauuucuuccaaggagcuuuguccccucuccucuccuaaccccagcugccacacagaugucuaggcucacuggccugcgguauggucugucuccccacuagacuggaagcuccuugagggcagggaaagcccuuggguuuuuguauuaucaacuaccugauuuuggcgccuggcccauggaaagcacucaauaaauguuuuguuuaaagagugag

SEQ ID NO: 3131 - RNA, 1796 nt, Mus musculus
ugucugaggaccagggcgggagccaacguccagaccaccccacccuggcucaugagcgcacacucuaccuugugcugaguacgcugagcaggucucagugaggccccaggcugcugucagcugagguuugugcggcggugaggauagagcccaggguuucaugugugucaggcuagcgcucuacaagugaucugaguccaacucuguucuuucuggacuguaucucgucuguauaacccagacuggcauggaaugcaaugcuggcucagcaugcuaaaaacuggcacucacagaccauauuucaccuucuggccaccaccugcucaacucuaaacugugcaguggaacuggaggaagagaggaagauaccguuagguccuguagaagagugacuccugcguguuuccucaggcuccagguuguuccagcccuacuuaagaggcagcuucaauagccaggaggacugucugcugcucuugacauuucuuugagacuucagauggagucuccuuggggcuagcaugucucuguccaaccucggaccucugagccugccuccuguggagaaaucuugaacugggauccucuuucccugucagauaauuggguccgguuguguuuugauguaaacaguugggaaggugggcacacagagccucauauaucccaaacucaccucagacucuggcugaggaugaccuuaaacuccugauucuccugccccaccucccaagugcuaggauguuuugguguaggcuugcuuucuaagguuccagagugaaugaauucuuuaccuccuuucuuaccuaugugacucaguaaagcaccaaauaauucaagaauagaaauaacauuauugccugauagagaaacuagagggaagugagacauuaccauucacaguacuucagagcuggaaaaugcuuccuccaacaacaucuuuagaaucaaagauaauuccauaggauucugauugaauggaaguuuuggcaagagugugauguugugggugaauucugauggaaaaguucccuuuagcacugguguaaugagucuugggauccauuugugacagcgcugaugugcuuuuguucuguuguuugaaucuuuuuguaaugagauugcaagucaccaggacuggcccuacacuccugaggugucugaggcuguccuugaaucccagucuuucugucuccacccccuaaaugcucggaugaaaggaccacacugcccuccuggcuuugcauuacuuguuuagaaaggaauacagagagaaaguuugguuuaaagacaagauugacuucugaauuugggugagaauuacuguaaucgcugccaguucuccccuucacaaugaagaugagaaaccucagggccaagacauggcucagaggguaauagcaccugcugcucuugcaaaggacuggagguguguucccaggaccuacaucagggcucacaaacccugucacugcagccccaggggauucaacucuguuuucuggccuccuugggcacucuccacuaauacgugcacauaucauuuaaaauuaaacauaaaaaagauuucgaacuccuaaagauccgaucagauagaggucauguggcccaggcucaucucaaccucccuauguagacaagaagaauuuugaacuucauauccuucugccucaacuucccaagugcuagaauuacagguaaucaccaccaugccugacuuauguaauacugguaacugaucccaggguuuuguauacuguagacaaccuaucuaccaacugaacuacauccccaac

SEQ ID NO: 3132 - RNA, 600 nt, Mus musculus
uauuaacaguaagauccaggguuaguuuuuguagccucggcuagcccuucggccucuggcgcgcucaaacuuccgacccuuggaacagacauaggguuuaugguauggcugugugggguuccuggggccuugccaaaaugucgguacaccucucggcccuuccgaagaccagacagaagcacagugucccggcccuugggagacuccagggccagcuggucaaaggugaggaucuuacccacagccuugaggaugcgacuccgggcccccguugcucacccgcagugcacacaccuucagcuuucugugaccguccccacaaccacagcagucuuguucucccggccaggaagcuucaucuuucguaucaugcgggacagggacagagguggcccguugguucggcucaugaacaaccucuucagcacaaccugauugaagguggaguugguccaucuggccagaaaccuguaaagcuugacaagcagccgcagguagauguccuggcucuugggcuccuugggccgaaccuuucgguccuuguuguggcgaaugucaacacccaugauggcgccuccugcucggccagguccggaaagg

SEQ ID NO: 3133 - RNA, 120013 nt, Mus musculus
cagaagcgaauugaggugagggaggagcucagagcugugcaggucggcgaugcccggggcuggcguucccgcagcggcaucgagccccaaguccggggccuccgggucgucgcaggugucggacucccugaggcggugagcgcuucccuuguccgcggugccccuggucgccugcucuggggcuucagggggcgggccuccaggucccccgugacugucagucacucccuggcugcugcgcucguugagcucugggcgagugggagguggcugggugucaguuaaaggcgcgggacgcuugggcuugggcccuuggcgacaccagccccuauguugcacaggcucuuggccgcagaggcggccacagucccugaccacucuggaccggcuuagcgcgaagcccuugguucugcgaaggagcacacacgacagagaccccugagaggacagguggagggguagccgcgcagcgucggugcagcgaaauggcugagaugagcgcugcucugaaaagcuugcucuuuuucaaaaaugacacuugcauaacuugcuguggcucauccuaaaauaguuuuugaugucaagacuguagacguucgaaugcaagaccgacacaguccccuaucaaagaguaacuuucgggcugucuuauuugauuaguaagaggcuucugucaucagaaguugggggaggggcugcuguggucgcucagggcgcuuaccuagcgugcaaagcucccugaguuucauccucagcucuucaaaacaaaaaacaaaagcaaaaaccaaacaaacaaaaaacccgccauacauacugaagaaugggaaaaaccaaaagagccuugcuauauuuguucuuccuuuugugugauuucaucuuagagguuuggauucugaaagugcuuaauagcgcacccccacccccuccuuagcagagggaaagugggcgguaccuggcaguuggaguggucaacccacaacugagcauaggaggcagcagcccagcuaaucagggcagcgacuggcgugucccacgagucacaagggacacuguuugcaugcaggcacugggggcacuaaguggaagcguuagccccacgcguucacccuucuggcuggaaucuccuuugguuuucuggagggagcugcccggaaucuccaacuggcuugcaauacccuucugcuuacucuguguguguguguguguguguguguguguguguguguguguguguguguguucuugagaauggagagaaugacaggcauuguggagaaacgcuuugguguuaugucauccuucuuggugccagcuuuuugagucacauucuugugacauuguuuuagucugccuugcccuuucucaaaaggagugguggcacuaggugguuuuuauuguuguuuuuuuguuugguuugguuaguuguguguguguaugugugcugcaacuuaaucagaagucuucaaagaaugacaguauugggcugggcagugguggcgcaugccuguaaucccagcauuugggaggcagaggcagguggauuucugaguucgaggccagccuggucuacagaguaaauuccaggacagccagggcuacacagagaaacccugucucaaaaaaccaaaaaaaagaagaagaagaaaagaaaaaagaaaaaaagaaugacaguauuacaugcuuuuaaaaugagugaauguaucagagauuguucuuacuggggucggggggcuagaauguacaaacacuaauuuuauucgguaaguaggaaccguaaguacuuugaaugcacuuugucaaacccagcauugcuccagggaacuugcuuggacuuuggugugcuuuaaaugagaauggcuucccuagccccauguguuugcaugcuuagucccaaauuggugaacuguuuaggaaggauuaggagguguggucuucuuggaggggcuguggucuugcuggaagaggugcgucacugggagugagcuuuaagguuucaaaagugcacacaaggcccagccucuuuaucucugccugcuguuugccaaucagaauguaaagcucucagcugcugcuccagcaccaugccuguuugcuucccacccugacaguggccuaacuauaaaacuguuagcaagcccacaaugcucucuuuaaguugucuuggucauggugucucuucacagcaauagaacaauaacuaagacacccucuaauuuauauuuucuguuaauuuugcuuugccauaggcuuaaagauuaugucuugcuguucguacuugucaagauuauuuuagugucuuucaauuuaaauuuaaguauauuuuuaaaagggagguuauaaaauguaguguuccuuaauguuguucugggaauggaaaagcuuaauaaugcuuuauggcaagagaauaauuuaaagaacauaagacuggagagauggcucagaaauucagaguacuuguugcuuuggggaaaaacuuggcuuuggugccuggcaucuacauuguggcucacaaccauucauaacuucaaucucugggacccgaugcucucuuuuggccucugcacuuaccagacaggcacauguugcacauauacacacucaggcaaaacauucauacauauaaaauaaauaaauuuaaauagauuaaaaaaauuuuuuuuagucugguauggagguacaacauaccuuuaaucccagcaugugggagacagagacaggaagagcucugaguucaagaccggucuggucuacagagcuaguuccaggacagccagagauacugucucaaaaaaaaaaaaaaaaaugaaaccaaaaugucaaaugcuuuuuaggcagugguggugcaugccuuuaaucccagcauucaggaagcagaugcaggcaaagcucuguaaauucaaggauacucuggucauuuauucauauauauauuuacauacacacacacacacacacacacacacacacacacauauauauauauacauacacacacguguguguguaugguguuauaauaauaauuguucaaucucuaacacccacauggacagcccaaaacugucuguaacuccaguuccaaugcaucugauauccucacaccaauguacauaguguuuauauauauauauaaguugacuauuuuuuaaauaugcacuauguaugauuuguagaaugguagaauaugcaguaucucauccaaaauaacauuaaaugucaggauaaucauuugagugcaacauuugcacuuuuguuuacuaaauaguaauuuugagcucauauuuuugguaauguaucauuaaagaaauauugcaaaaauacaaaacaaaaaaacccaaaaagugccuaguuguucuaguuuccuuacucuucuuaugauaaauacucugaccaaaaauaacucgggaggagaggguuuguuuggcuuacucuuccaggucguagucucucacugaaggaagucagagcaggagcucgaggcaagaaccaugaggaaccaugagugcugucaaagccucaugcauaguuagccuuuacccagaaugcagaccgccugccuggggaugauaccacccucaguuagcuggguucucucacgucaaucaggauaauccuccagagacauguccacugaccagucugaucuagacaguuucucaguugaggcucucuugucagaagacuguaaagcugugucaaggugagaaagaaggcuaacuagggcacuaaugcauucgccucuccauuuugaaggaucaucaucacuauuauuacaguugcuucagcuugcuuucacccacagcuacaugcucagcuuucaauuuuggaaugcuaauaguaugggauaugccauuuucggugugaguggguggagagcccccacagguuguauucagguuuuagauuuucuccacugaaguguuaguaccaccggagggucagggcuuggugaaaugggaagcuuauuagcuugccuguuacuaugcagguaaauaugguuagcuuuaaagccaaaugagacugcuucucuuaguuaccuugccauuguucucugaguuccuccucuaaugguuuaaugacaucaaauagaccagacaaugcagggcucugucagucucauuuuuuaaaagucugcuucuucaugucucucaucuuuacauucucaucugcucuuucaagacaaauaucuuuaaagaggcaggaaaauagauuugcacacuagagcaucaggaaggaaaccaucagagccccgggacauaaaaccuggaaucauaauggaauugugaaugaaaggacuagaaaauaaaguugccaggguuugaggcacagcauaauucuccgucuuucuuuuuuaugauuuaguggguuuuguuuuauguguaugaguguuuuaucugcauuuauauaaaugcaccuuaugugugcaguguccguacuagccagaaagggugucagaucuccuggaacuggaguuacagaacacugugagcugccaauugaugcggguagcgcuguucuucuucuguagggacagcgaauguucuuuauuguauuuuauguacguuugugugaggauguuggaucucguggaacaagaguuacagagaguugugagcugccaugugggugcugagaauugaacccuggguacucuagaagagcagucagugcucuuaaccgcugagccaucucuccaaccccauaaauauuuuuaacuacucuccagcccgaguucugggcuguuucugucaucuuucauggucuaauuccuuugcugcuugcucuggcucaaagauuuauuaauuauuauacauaaguacacucuagcugacuucugaaacaccagaagagggcaucagaucucauuaccagugguugugagccaccaugugguuucugggauuugaacucaggaccuuuggaagagcagucugcacucuuacccgcugaaccaucucaccaacccaacauuccauuuucuuagaggagaagcuuccaguuugcuuccaguucucugaguucaggauaaaauauugggaguaaguccacugaagggaauaugguaggagucccuaugacuaucuuggcguucagacucauaagaggacuugugggacucuaauacacuccuguucuuagcuaggauguuuaacaguaaaaggaugaggagaaaauguggcaaaagaaaaagguucauaggaugaacccuucaaaaaaaauuuuuuuaaaggcacagcugggugguggcaggggguagcacucagaagcagaggcaggcggauuucugaguucgaggccagccuggucuacagagugaguuccaggacagccagggcuacacagagaaacccugucucuguguagaaaaaagaaaaaagaaaaaaaaaaaagaaagaaagaaaagaaaagaaaagaaaacagaaaaaagaaaaagaaagaagaaaaugguucccagagugaaaaucauggcuuuaacuuuauucuuaaaaugguaggauuuaagaacaaauuccaaagcaggcucccugauuguacaugucauaaaaaugaaccagcauucucaauaacacugugugagugcauucuguauuauacauuucauguaacccuacaagugaagguaccaacaguaaauccguuaucacugaagcaugucacaguuacuucucuguuacugugauaacauaacaugacaaaaguaccugaagguugagagagcuucuggcuuauaauuccagggggauacagccccucauggcaggaaggcauuggugggaccauggcagcaggaacagaaagccagcuauaucguaugcacacucaggaagcagaaaaauagcaggaaguaggaucaaacuauaaaaccucagauccucuccucuguaauguacuuucuccagcaagccucugccuucuaaagguuuuguaaucuucccaaacaguaccaacaacuggugacccaguguucaaacauacaaacccauaugggacauuucuuacucaagcccacaauagagcaucaggauucuacagauauuuuuugaaacugucucauaauuaaaaaaaaaaauaauaauaaccuggcaaaacuuuuaucuuuguuugaaaaaguaucuguguuaacaguucuuuucucauauaaaacuugaguuaaaaaaaugaagugugugugugugugugugugugugugugugugugggggcaugcacaacaacugagguuucucuccuucacuuuguuugaggcaggaucucucuucuacuguuguacuguguuccucaagcuaucuagacuucaggcucuggcuucuucuguugcugacucccacuuuccucuaagaaugcuggcacucuagaugcauugcauacugggaucaaauucagguaguugggccuaaguagcaauugcuuucacccacugagccaguaguuacuuggcagaaacucuauuaaaaaaacaaaucuugcugggcguguaaucccagcacucuuuaaucccagcacucuggaggcagagucaggcggauuucugaguucgaggccagccuggucuacaaagugaguuccaggacagccaggacuauacagagaaacccugucucgaaaaacaaaacaaaacaaaacaaaacaaaacaaaacaaaacaaaacaaaaccaaacccaaaucuuaguucauauagugcugcauucaguauuauacacugcauguaacucuacaggaggucauauugacaucuuggcacaagggaaauuauauuaaguuuuagguuuuaggucaaggauauuaggagcuaugagaaaaauggaguaaguauuccugauuucuguuuugguuuuuuugagaaggaucuuacgguguacuccuggcuggccugaaauucacagcccaggcuauauauuauauuauauuauaccuuuuauaauaggcgacccucuugccacagacuccacagugcugggauuauaggaaugagccuggcuuuuaauuuuuuuucaauuccagauuuaggaacucugguaauaaaugcuugguucucugacaugccugaaccaucggucaugaucucagaccuuuggguuuucuuuuuuuuuggggugcagcgaacuuuauugaugguauucaagagaguagggagggcucccuaggccccuccuguuauuaugggggucugggauggaaauugugagggagaugcucaguguugggggccgaguuggaauagggccucucucuugcucaguguccuugcuggggugggugguccaggguuucuuacuccuuggaggccauguaggccaugagguccaccacccuguugcuguagccguauucauugucauaccaggaaaugagcuugacaaaguugucauugagagcaaugccagccccggcaucgaagguggaagagugggaguugcuguugaagucgcaggagacaaccugguccucaguguagcccaagaugcccuucagugggcccucagaugccugcuucaccaccuucuugaugucaucauacuuggcagguuucuccaggcggcacgucagauccacgacggacacauuggggguaggaacacggaaggccaugccagugagcuucccguucagcucugggaugaccuugcccacagccuuggcagcaccaguggaugcagggaugauguucugggcagccccacgaccaucacgccacagcuuuccagaggggccauccacagucuucuggguggcagugauggcauggacuguggucaugagcccuuccacaaugccaaaguugucauggaugaccuuggccaggggggcuaagcaguugguggugcaggaugcauugcugacaaucuugagugaguugucauauuucucgugguucacacccaucacaaacaugggggcaucggcagaaggggcggagaugaugacccuuuuggcuccacccuucaagugggccccggccuucuccaugguggugaagacaccaguagacuccacgacauacucagcaccggccucaccccauuugauguuaguggggucucgcuccuggaagauggugaugggcuucccguugaugacaagcuucccauucucggccuugacugugccguugaauuugccaugaguggagucauacuggaacauguagaccauguaguugaggucaaugaaggggucguugauggcaacaaucuccacuuugccacugcagauggcagcccuggugaccaggcgcccaauacggccaaauccguucacaccgaccuucaccauuuugucuacgggacgaggcuggcacugcacaagaagaugcggcugucucuggaacagggaggagcagagagccuggguuuucuuuuaucuuggucauuucagucauacaguuuacuguugucgcuccuauagagguuuuuauauuaugacucucaucauugguggaaggcagagcagaaucuuaacuauauucuuggguaagaugucuuaguuuucuuucuauugcugugacaaaacuccaugaccagaacaauuuggagaggaaaggauuuauuuggcuuauggguagcagcccaucaucaggggaagucaaggaacucaaggcagaaacuuggaggcagaaacccaaggcagacacuacgaaggagcagacacuacggaggagcagacaguauggaggagcagacacuacggaggagcagacaguauggaggagcagacaguauggaggagcagacacuacggaggagcagacacugcagaggagccgacacuacggaggagcacuguuuaguagcuuuuucugaacggcuaggucagccugcuuucuguuuuaccccaggacuaccugcccagggaugacacugcccaggguguacuggcccuuucacaggaaacaucaaucaugaaaagcuccacagcaaagcucccugcaggccaauaugauggggaaguuucucagcugauguuuccucuucuuagauuguucuagcuugugucaaguugacaaaagcacacaaacaaauaagcaaacaaacaaaaacccaaaacaauacaaaaaacccuaaccaguguagacaucuaugaauauaugaugauugcaucuuuaaauuacuauuacuacauuucugccauuuuuauucuuguuuuuuuuuuuguuguugguuuuuuguuuuuguuuucgagacaggguuucucuguauaguccuggcuguccuggaacucacuuuguagaccaggcuggccucgaacucugccucccgagugcugggauuaaaggcgugugccaccacgcccggcugccauuuuuauucuuaucugaacaguaagcaucuauuuucuuguggugaauuguuucaugguagcaguuuuaguaaaugaacuugagaaaugucuaauugucuugacauuuuacauauuuaucagucugguaccauaaaccaugggauccccuuucauccaaucccuguuaaaauccaguguuggcuaugcagguggcaugggccuuuagucccacuugggaggcagaggcaagcagaucccuaugaguuugggcaagccaggucuacauagcagguugcagucaaccaugucuacauaguagcacccugucucaaauaucaguaacaaacaaacaaaaaucuaaugauaguuugauagaaguaggaauaaaaacccaucuaaaaaauucauauggaaucauaagggauccugcacaguuaaaaugauuguuaaaaacaaagccaaaggauuugcacuuguugauuucaaaacuuucuacaaaguuauaguaauuaaaauugugaaguuagcauaggaauagacauaaauaaaacucuugugaauugcugguggacuauaaacuucuuauaaacuucuugccuuccuuaaagcugcggcaagcuggguguggaacacacaccuggggggccagaugucaagaggcagaggcagaaggauagcaaguucaaagccagccuagacuaaaauuuaccaagacugucucuaaaacaaaauuggaguuaaaugcauuuuuuaaaaaagaaaauaugguuacuaaaaaaaaaacaaaaacuaagcauagggucgccacaggaccuagcaguuccacuucuagugagacccuguccucagugaauagaaaaagaggagcgauggaaguuagaucacaccuacccagagaaggaucaaaugugaacaaagaaaaggccauauauauuuuuugauuaauucacuuuauaucccaaucauaaucccacccccccaccccugccuucccagucccacccucacaaaucccuccucccauuacccccuucucuugggugcugcccuuuccuggguuauuaagucacaauaagacuaagcacauccuuucucacagaggccauccacggcagcccaguuaggggaaugggauccagugacaggcaacagagucagagauaaccccucucaaguuguuaggggacucaaaugaaggccaagcuauuuaucugcuacaaauguguagggcuuaggucuagccccugcacgcucuucggguggugguucagucucugggaggcccgauggacccagguuaguugacucuguaggucuucuuauggugugcuugacccauccggcuccuucaauccuauccccgacucauccacgagacucccagaacuccugaugcuugacuaugggucucugcaucuguucccaucagcugcuggaugaagccuuucaggagacaguuaugcuaggcuccugucugcaugucuaugacaagacaacacacagagagcaauugagaaggcagagccguagcugcauuugagucagggaaaggguagcacugccagggagagggagacaaggcucagacuugucugacaggcugcagacaucugucuuagaaccagaaugucaauacugcagcaccaaaaugaguguuauuaaaaaaauaauaauaauacagugaggacuuguaccucagcugaucccuucauggcuaaacacacccuaggaagauauuucuugaagcucuacacaagugagacaagacaauugcguuaguagaagauucaagaaucuacaauagagcaauaaaugaguguguucaauagcagaguaguuuauagaaauaauaaaagaacauugaaaauguaaccacaggaugggugguggcggcguaugccuuuaauucuagcaccaggaaggcaaagccagacauaucccuguaaguuucaggcuagccugaucuacagaucgaauuccaggagagccaggagcuacacagagaaaccaugucuugaaaauccaaaaagaaaagaaauaaaagaaggaaggaaagaaggaaggaaggaaggaaggaaggaaggaaggaaggaagaaaagaaggaaggaaggaaaacagacaaauagauauaaccauauaacauaacagagaugaauaacuggucagugcugagaaucaguaauguugagugcucagccuuaaaugagacauuuguaacaacuccaccaagacucaagaaacauuguggaagagugggagagaagaaaguaagggccagacaaggggugggagcugugcuguaaaauguuguccuuggaugugacauggccacagcauucaugaacucacugaagcuuugguuaucugcacaagaucaagccaacaaaaucagccaacagccauuccaucaggaagcacuauuugggcucagugggucacaaagggaaaaaagagaagaaggcaggagggugacgucuagugcugcuuagugggaguggaaggagggaguuugugguaaacaaaaugcauuguuugaaauacucagcuuuccaagaauaaauaaaagauacucuacuaaaaaauauguacaugagaggaaagggaauggagaaauguaacuaaaauagaauguaaaaaauaaacaaaauaaaacaagaaaaaauguguaugugguguuguauuccuguaaucucaacacucaggaggcugaggcagguauaucccuuaucacuucaaagccagguugguuuauauacaacaaguuccaggcuauccagggcuacacuauacacacacacacacacacacacacacacacacacacacacacacacacguguguguuauauguauguguauguucauguguuauacguguguuugugcauguguuacacacugauggaucuucagggguuagagcgguggauuugucuucaagagagugagcugcaguuguagaggauccuagugcauuucccagcaagugacucacaacugcauauagccucaguucccauggauguguuauccucuucuggccuuauacacacacacacacacacacacacacacacacacacacacacaccccucuaaucuuuaaaaaaaaaaacugucuucagauaguaacagaaaagucacgcaggucuccucuaaggagccuggaguagccagucuugcccuagucugucugucugucuuucuuucuuucuuucuuucuuucuuucuuucuuucuuucuuucuucuuuuuagauuuuauuuauaugaguacacuggcgcugucuuuagacaccccagaagagggcaucagaucccauugcagauaguugugagccaccaugugguugcuuggaauugaacucaggaccuuuagaagagcagucagugcucuuaaccacugagccaucucuccagacaccuaguauuucaauaauagacggauguguucaguuuugucacuuugcuuuuuaaaaugaugcagauaaauucacaugccaauagaaagugaucaaaauuauaaaaagcagauaaaacaucagucuuacaauuaaucagcuuugaccuuuucccuagauucugaaaugaguuuucaguucaauacuacaacaaagcaccacaagguggcgacagaacucuaaaauacuuuuuuaaaggcgccuuggaaaagaucugaugcugcccugaugaaaguaaaaguuuuaagaauaucccuuucagaauuuauggauuaaguccuaacgcuuguucuggccaguuuuugcaaggcauuacccuugcuuagauaaauaacacugcaguaaauaaauaaagagcaauauugcugagugaauucgaugucugucucuugggguucuagcagaaauccguacuaccuccgaagcucuuuguucucucugucucuguugugaccucuagcccccgaccccuaccaacaaauugucauaauauagggcuagagaauggcucggcaguucaggaugcuuacugcuccugcagaauuugguucucagcacuuacacagaaguucacaaucaccauuaacuaacgacagcuccagagaauccaacucuuccuuaaauuccugcgugcagucggcaugguggcgcacaccuuuaaucccagcacuccggaggcagaggcagguggauuucugaguucaaggccagccuggucuacaaagugaguuccaggacagccagggcuauacagagaaacccugucucgaaaaaaaccaaaagaaaaaccaaaaaaaauuccuacaugcagugguacacaaaaacccaugcaggcguccaaagaagaguuuaugggaggguuugaaggaaagaaaaggagggggaaaugauguaauuauaauucaaauaaauaaauaaauuuuuaaagauuuauuuauuuacuuauuuauuuauauguaaguacaauuuagcugucuucagacacuccagaagaggacugucagauuucguuacagaugguugugaaccaccaugugguugcugggauuugaacucaggaacuuuggaagagcagucagcauucuuaaccacugagccaucucaccagcccccaaauaaauaauuuuaaaaauaaauauuaaaaagaacuucauaaaccaaaggaaggaaguauaaugcagugauaagggaguagauuccagaaccuucuugcuuggguugaaauauagcccauaaguucuuguguaguauucaguaaaacacucacuuuugugucucacuuucucuuucuguaaaauagagguuauaguagugccccuuaugcuauaccauuugaucuauuuaaccagaugagugaacugcugaggauuuuuccaugauuagaaaacaaauuuuagggcugggugcaagugucuuuaaucccugcucuuggaagccagaggcaggcagaucucagcuuuggguuguccuuaugcuguuugcauucugauguuaauucugauuccuccagaggagcugccccauccccaagagcaguggaucacuuacuuaggugaucucuugugaaccuucuccccauucugacugguuaauaaaggcuagggggugguggggauggguggugggaccggagguuuuugagagugggagcagguagagaggggggaagaauagaaggaaaggagagaggaccaaaguaaaaagaagaggaaaaagucaugauaucuguucuaucuaccacauggccaagaaaaaaaauccacaagucacaggggucucauagcugaaaaauaaguuaauauaguauuagacaugcccaaucuagacuuauaacuuaaaauaauuauaauauaguauauaacuuauaauaacuagauugcauguuuauaugggcuuauugggguuugaaauuccaacaacagaucucuguugaguuugaggguagccuggucuacacaucaaauucuaggccaggcuuacauggcaagacucugucuucagaaaaaaaaaaaaaaaaaaaaaagccaagggucagugagguagcucauuggguuaaguaaggcacuugcugccaaucuugacaaugaccugaguucagucccuaggaccuacaugguggaaggagagaacacacucccucagauuguccucugacaucuuauacaugcacuauggcauauuuuuuuuuaauaugaaaaaaaaaguaaguuuaggggauugaagcaguagcuuaguaaagugcuugcccugcaaacaugaggaucugacuuugauccuaggcccauauaaaaaggcuggguaugggguugugaugguuuguauaugcucagcugaaggaaggaguggcacuauuagaagauguggcccuagccuguggcccuagccgggcagugguggcacaugccuuuaaucccagcacaugggagacagaggcagguggauuucugaguucaaggccagccugguacagagugaguuccaggacagccagggccacacagagaaacccugucucgaaaaacuuuaaaaaaaaaaaaaaaaaaaaagauguggcccuguucaaguagguguggccuuuuuggaguaggcaggcacuguuagugugggauauaagaacuucacccuagcugccuggaagcuaguauucugcuagcagccuucagaugaagaugcagaacucucagcuccuccagaaccaugccugccugauugcugccacguuccugccuugaugcuaauggacugaaccucugaaccuguaagccagccccaguuaaauguuguugugcuuauaagaguugucuugggguggggaggguggcuggagagauggcucggugcuuaagagcaccgacugcccuuccagacgcccuaaguucaauucccaguaucuaucaagcagugcccuaugagcagagaggcguccugacucggggccaaugagcucaccugagagcagcuucccaauaacccgccuuuaauauagucuacucuggcuugaauuggcuccuuucaucagcagagaaauaagcuaucagucacgcugucaccugcagagugguacucuuauuucugcucuuuauaccuuuuuguuuccuucuuuacuucauuaggugggaccacccucauacuguaaaaugucaguaacaacaaaagcagagauaauaggugcaguaggcugaccaggggaugaaaucaugcugacuagauccucagaauguaaccucucugaaccagcaucugcagcaguuagcacuaagagucaagcugagaucaccuuucaucaagcaggugugaaauguggcgaaggcuccagacacacacgagauagaaagcacaacagagacaggaggagaugcugaugccugaggaguuacuuucauuuuacugauugguuuuaugagggaauagcucuuuguaaugugugucauggauauguuguuccuagauauguauucuccauaauaauacucuucaugcuuuuuaaauuuuguaaauuauauuuuuuauagcuaauacauuguugagauagggccaggcuagggacacauucaacuuuagcaugccugagagaucauguuuucaaagaauccuuagguggcuuuggcaaucuuuaguuauaacucgaggguucuuauuugcuaugcuuuaugcauuucugauagaauuuaaacucuugccaaguucacuggcacaugccuguggcgccuacuucuggaaggcugaggaaagcagagcauuugaguucacauguuaaaaacuagcaugaguaaucuaguaaauuagccucucucucucucucucucucucucucucucucucucucucauaucuaagaacuauugacuucagaaaauucacacaaguuuuaaauuuuuuuaaaaagcuggauuuuaccguaaggggaaaaaauaugaucugugaaaagagugaggaaguagaaauaaaaagacuagggagaggcaauccacucacucuuucccucuaugaacaccagacacuuuguauggacuuggaaauguagaauuauauuuauauagcuuguguuugaaagugagaaaauaacauacauauuuuaaaccucauuuguuaucuuacaaaucuaaaauguuaaccucguauuagacagcugcaagauaguuugagguuuguccuccauugucucugcaaaucaccuguuacuaaguaucacuuggccucuauaucaccucaguaguuccucccugaguaucuucaucaauggcuuaaggccaucaacuacuagauaaaaccagugacuuacaaacugucaccucuagcuuacuuucuucugagcccuggacuguguaucuaaagagcuacauuacauuugugcuugcuugugucaaaggcauuucagcuucucucuacccaagcaagauagugcuaauggaucuuccucuaccuaucaaaugaacggcucaaccaucuaucuacugaguaagccaugagcugagggaguaccuuucauacagccucacucucucugcguauaguaugcuaccaaaaucaggcauuuccuccuaaggagcugguaauuccauuucuuaguguccucacugccaacaucucagccugugcucuugucuuuggucugaccaguuuuucuucuugcauccaguuagguccccaucuuauaacuuucucuauagcagugccugaaaguauacagaaggaccauauuuuuuuaaaaaaaaugucaguccagacaaauguaugcaugcuaguauguauuuuugcacuucuaugugagugcaugugauauauguggaagacagguaacaauuuuuaugguuauuucuuuagaguuguugaccaugcuuuuugagacagucucucacuggccugugacuugccuguuuuuuuuuuuuuaauuucuuuauuauuauaucuaaguacacacuguagcugucuucagacagacaagaagaggcuaccagaucucuuuauggaugguugugagccaccaugugguugcugggauuuuaacucagaaccuuuggaagagcagucagugcuccuaaccgcugagccaucucuccagcccuuaaauaacuauuuaaggcuucaauuuuuaggcuuaguuccuagccacacauuuacuacaucaggccagaugcauuuccagaaggcucuguuauacuagucugccuuguagaacgaguguacccuuaaucaguaguaaaugugagugccacuucuguuucugugaaaugggcuuuucccuguuuauuuccugaaugacuucaguuuugcucucagucuuagggcauuguuaggucagaaggagcuuuugccaaucuuuuguuccuauugugacuccuauaaaccaauucauuauugaauuguauuugccuauguccaaccuaagcaggagggacuaugccccuuucuuaauucagcuuugcaaaaauguuaacuuuuagagacaagcaaaacuagugauugaccuagguucauguaacucugugggcacuaaagacauucucuguagccuuucacauucagaggcuuggaguaaagcuuguucuuuccugcaaggcuuaaaugucagaaaucacuaauuauaaaauucaggauguuuucugauuaugucaaugaagauccugauauaugcaacaacaugcaucaucuucaaucaggaauucuagaaguagggugagcuucagacuaguaaaggccugcaguggcucagugauauuguuauguucauuccucuguuuuucugcuagucucuguggaggcuucggcauuagguuggcuguuugcgauugcagcuuagcuguggcuauagagauauguagccagugguguggagaacagaaucuucuucuguggugucuugggacuauugaguuucaacucaagucagcuuaagcaaaaugggaguugauuggcauacggaacaggaaaagacaugaggauucuggcuuuuggcauauacuauggaacacuguccucuggcuaugaccaccacccucugagacugucaggagcugagauuaccaaaggagaucugaacaggacugagcccuucagcuuucugucauuagaggugcucaccaggccaugcacguucccaaggauuuauagacaguuucuaggacagaggaaacccauccucuccucaagaguaagagguaaggguuguuaaggaaaaggguucacaaagagugcauaguaguauuagagauguuuugcuauagagugcauguaguaguaauagagauauuuuuugcucccuaauuaagcuuauugucucacuaagcuagacuuuauuuagugcagucauucuccuugguuuguuguugguucccuaccuaggaugaauagauacauagcuccccagaaggucacacaacagcaucauuggcucuaaggucuccagugaaaucauuaaaucccuccuuuccucuauagugggcugccugcauuugguaaucagagggccaucugaagcccaagacuuaccagcuuggcaaccucagugcaaagagagugguauuccucagaucacucuggcaaaaaguccugggagcauucucauuagcuuccuuccaauucuugaaucaauaacuaugggcucaaaaagaaaacauucuaacugcuagaccuggcaugcuaaggcaguucagccacaccuaaaaugacuugaaagcccuuucccucuuggaacugauguaauuaugggaaaaacacaggcuagcauagauacccaggaaacaaauagcuucuuaccgccaugauauuuuaacgauucuaaggaggcuagauuaacuauagcacucauucucaaguucggccccagauuacugaaucugaaauucugaggacagagcuuucagucaugucucccuccagacaggguuucucuguguaacuggcuuugaacucacauagaucugccugucucugccuccccagugcugggacuaaacccagcuaucuucauuuuaaagagacucuuccuuauugcaaaugucuuuaguucuuucaacauauuuauaauggcucccgugaggucuuuucuaaaauccaauaccuaggcccguucuuaacagguuucugcuguccuuuuccucugcacgagucauaguuuaugucuucuuuacauggcuugugauuuuugugguugaacaugugacaucuggguagauuccuccucuccccuggggcugugcuucuucagugaccugugggcacuguuuggugaggucuguguucuuugugauggacagcucuuuacaccuguccuguuacucuggaauaaacaguguuuuaucaggucucugauacaaggccucucuugguuucagucaguccugagauuuguuuggugacuuuggugucguuucugaucaugcuccaaggcacaaauuucucagcggucugacucaauuaaacuuucagaucuuugcuugggugguuuuugagaacagcccuugaugcuuguuuauguccccugaagcaccugucauucucugucccagguaaacuugcuggccuauggcauaacucauggacaccaacgcugucugcuucuuccucuaauuucuccagauuucugagacuucccuuaggagcaaacuuccuauacuuggcucugaaugaaaucaauuucccuuuauucccuccuugaagacagcuugaauucuccauguuuaugcccugcccuuccagaagucucuggccacuaaugcagaacuaguauuggugauaguggcccacuuuuaggcugacugcccugguauauucacaguacuuuagucuugguggguaacuuuugaucuuuucaguuugccuuucugaaaucugaggggguucuuuuguuuguuuguuuuuaguuaaagaaaugguguuuguuuucuuuuucuuuuucuuuuucuuuuucuuuugguuuuucgagacaggguuucucugaauagcccaggcuguccuggaacucacuuuguagaccaggcuggccucgaacucagaaaucugccugccucugccacccgagugcugggauuaaaggcgugcgccaacaagcccgccuuuguguuugucuucuaauaagcuuauucugacuuugcauguagaagaacugcuaaguccacugagugauuauuccugcuauucagugucuugcacacugggagcugcaaaccagucuuucacuucaguagggaacugggcaucaggagcagaggguaccuccucaucuacagaccugucggccaccucauguaaggguccaugacucaccagagaaggauacccuggacucaaauaguauguaaacgcagaguguuuauguuguguuuuauaaaaagauaaggagagaagaauauguuugauggauguguagucagucaggugugggggaaggggugccucugcaggcccaugaugaggcaucccuucacccugagggaccagccacaugaugguauaguauagaagagaguuuauucaggguauggggaggggaguugaggaaguagagacagagaauggcagagagagagagagagagagagagagagaggaagaaggaggaggaggagaaagaggaggaagaggaggaggaagaagaggaggaggaggacgaguaagaagaagaagaagaagaagaagaagaagaagaagaagaagaagaagaagaagaagaagaagaagaagcugccggccaugagcaugugggaaggggauggggagagagaagggaaggggcaagaggacagggcuagagcaagaaggcaagagagagagaggagggggcaagcagccccuuuuauagcaagucagacagaccuggcuauuguuagguaacuguggaguggggcauagacaaaauaccaacaguuuuauuuugcagagguccagcaagcugaggucucccaugaccaagacagagagaaaaccaagugaguuugcaggccugauuuaaagcacguuagguaauucugggguagguggccuauauguuaaucuguuggguccaucucuauggacauuccauuacuggggugugggaccuagaaaccugcuugggaugucuggaaacuauugcugaagaaauagcugaggaaaucuugaaacuugugcugacucauuguccuuguuucaggccagauggcagggcagcuucugaggccuggacuugccuggaauugcccaguucuuggaaacagauuuaggccuagacuccuugacuaacaauuugaagccugucauggaaucagccgagcccucucacucagacuguguaguccauucacccugaauuccuccuuggucacugccuuucagcaguagccuacuucucccuuuuuagucucuuugggaaucucuauagaaguagagaucaggcaugaacucccacaagugcugacaggagacagugcugcucauguguaggucuuccuggaccagcuuccaccucaacagauugcugaguucucacugucauauaggauagcaauguccacaagcacuguuauagaguaguaguaggcaggguaaaacccuccagaagagauuggugauaggugcuggaucagucuccugcuuggaucugguuauuggaagucccaggauugaaauagcgcauaguaagacaggcuccuauguaguaggaaacuagcacagccaggaucucuggaggauggaaaagucucagcagggugguuuacuuuguuuuugcagugccugggauuaaacccagggccucaagaaguguucuuccuaccacugagcugcaaugccuagccuuccauaauuuuugagacucacacaauuaucugggcaggccuuuaacuaagucuuuaauacaacacaggcuugcuuugaaaauacaaaauacaguggcaaagaauacacauuagcauuccaaaaaaggaggaaagggaccauaguaaggaaauaugggacuaagauaagaugaaaaaccagcggggcaaacuccaaacuguguaccuucacaucuaaugucaaaauacucuccaggucuccaaaacacaguucuuuuucuugggcugguuucacucucuguuagcagcuuuccugggcauguaacccccuggcucaggcaucgccaaggcaauccaggcuucagcuuuacacaaugacaucucuaggccuccaugaaggaacacuccugacacaugccuguuuuuuuuuuccccuuaauugagaagggagaguccauaucuuuuuucuuguauccuugacucuaaagcuaaaaccaaguggcagaaguuccgcugcuuacugaggcuagaacauggucuccucguucaguuacauauucauuauuuucauuaguuuucuguuuucaauuuuuuuuccccauugccuaagcuuggcuguucugaaacucagucuauaggccagguuggccuugaacucagagaucugucuaccaggcucugccuucuaaguacugggauuaaagauguguaccccaacacccacccccacccccaccacaccugguccuaagcuuuucuuuaauuccuguuuacaaguuggaagcucugugcgugggaucuugcucugaggucacaacucucuuuauuucaccaagcaucuggcuuuucuuuaaucuguuugcacuuccuuuuguauuuuuccucagucagcuuuucccuuuucauuguagaucugcauaagacuggccacuauuagcuacuuaacagacacaaugcuagauuguuuuggaauguccucugcuaaagcuguugguccagaauucuucaauuuagcggcagacagacuuuuuuuuugggggggggggugaagggcagaaagcagauauacucuucaccaaaauaucauaagaaugguuucuaggucacauacucauauucuuuucuugagccaagucccacaguucaaagcacccuuagcaccacugucuucuaugcuuauacugcccauuaagccucacuuaaguguacagucacuuucuuguccaaaguuccaaguguuccacauuccuucaggcauaaacauggucaggccaaucacagcaaugccucaggucccuugucuugguaccugugccuacuccaacaagagcacaccuucuaauaaugccauucccuaugagccuuugggggucauuuucauucaaaccacuacaauacuucauuuuccaaagugggccucugucuagaaugcuuuccauaggcaauaugugaacuccaugcaggguugucagugcaggagacagauaacaggagacagaucacagucuuguagauuagucucauuuuaugcuugaggaaacuaugaauguuauuugaauuagaauuuaaauaaaugguuuuuugcuuaaugguugaugucgugccucugaaucaugauuuuacugaagaugaucccucauauucagauaagaauauuuguuuaugcaguaccacuauauaguuacccuaaaacuugaccgucucuaucaacaguguacauuuuuucauucuuacuauuuuugguggguugaaugucucccauagucuuaggcauuugaauaguugauccucauuugcuggugcuaacuggguagguuuaggagauguggccuugacagaggaaguaugucaccgagggcaggcuuugagguuuuaaaagccacuguccuuccaguuuucugucucugcgucaugcuugugguuuaauaugugagcuuucaggggagaccggggggugggggaggggcagcaauugggaugagaaugaauaaauaaauuaauuuaaaaauaugagagccaggcagcaguggagcacgccuuuaaucccagcacuugggaggcagaggcaggcggauuucugaguucgaggccagccuggucuacagagugaguuccaggacagccagggcuacacagagaaacccacugagugggaagucguaaaacuuuagagaaugaacuuuugggaucaauuacuuaugcaguagcagaauugauuaacaaucugaaagaacuugaaacucaaguuggguaucuuuggucaucgagcuauacagaggcaaagucauuuucagaaagacugagguuuuaagaaaaugagucugagaaagaauugagucuaaggaaaaaaaugaagaagggucacaaaaagaauucuuccauaaagaagguuagguagcuaagugacagagaauaauguagccauuaauggaccaggaggaauaggcaggaacucuaccuaagggaggguuuuaauauuguagaagccacaaggacauagacaagcuuugagauuuggcaggcagcuccuggggggaggcaaagagauuuguaaugucuggguuccagaggguacaaggagagguagagcagguagcuccaaugggaagaggacaaggaaaggguugcagacccuggagcauaugggcagcuccuagcaggaggugaggaaauuccaggaaggagcugaggagccaugauggagcagagugggcuaaguuauccugguaacaagaauuucagucugagguaaucccaagcagacugagagacuugcuugagaaaaauguccuaagucacagagagacaucccuuucuaugcgaugggggacuggcaggguaagaggaagcuuccuggcacacugguguggcuuuuguaauaaaaguauacaaagcaggggguucuacagugauguccaguaagagagagacaagugguuagagagguuagaggagaaagcagcuagagaggugccaguguuuuaguaaguagaguugcccauguggugggucccagaagauaguaauggggaaaugcccacauggugggcagcccaaaaggacauaggaaguggaugcucauguggugggugacccaaaaggccaucguaaggaagagaggacacuuacugaguaggugagaagagaaagaucauuaagguggaggggagaagcugcugaagagggggacucuagaaucaaacaaaugauuuuuacauaccuuaggagagucauaucagcagcuugguuuggagaguccaaauucccuggggagggaacuuacuuaagccacucccagauuuuagcaucagaugaaugaaaaaagaaauaaaaaggaaaggaaaggacaugauuguuccaggguuuggugaaagagaaaguuuauuguagauaaaaauggauaaacagguaaaggaaguguaauggcuauuccugguugucaacuugacuauaucuggaaugaacuacuauccagaguuggagggcucaccugugauccagaucuugaggcuggaagacacaaguuucugaccuggaucuuggaauggagaucuugagguauagcagccaugaaaaacuuaggcccaggcuagguaguacacgccuuuaauccugggagacugaggcaaggaaaucucugaguucaaggucagccugggacaaagcaagucccagauccaggaaugguguaaacaccuuuaaucugggccacaccugcuggaggugcucacucuuccacugcuugcacuuacuugccagcacuuccauuggaaccuacuucuacagaagaccagcugaaacaacuagcuucaugggacugagcaaguacuagauucuuagacauccacaguuacccauuguuggguuaguugaacugcagacuguaaaucauuacaauaaauuuccucaauacagagagauauuucauaaguucugugacucuagagaacccugacuaauauaggaaggggcaucuggaagagacuagaguagacaugaccaggcugagcugggccauguggggacagggggugcgguaucaggugcaacagucaggaggccaaaguaaaaaaggggcagauaaucaaaaugucuggauuguauaggaaagccuugagggaaagggccagccagccccugggcuggcaaggucaggguagagggcauaguauaugagccauacccuguaacagguaggaacugggggaugcugggaaaaucuggaggcuaguuccauuuugauguuaaauaggcaccucagcuguuugucuuggguuugaccuuuaaccaucacagcuauagaaaagucacuaauagacuguuuuuguaagucaagaauuuaggauuagggggcuggagagauggcucagugguuaagagcuccuacugcucuuccaaaggucccguguucaaaucucagcaaccacaugguggcucacaaccaucccuaaugagaccugacucccucuucugguaugucugaagacagcuacaguguacuuacauauaauaauaaauaaauaagucaaaaaaaaaaagaauuuaggauuaacuucaccauguaauucuuugcuguuaugcugcugcuuucaggaugucaacucagucuguuaccauuugaagacuuaguuagggcugaagcuucuguacuaaaaaagaggaucacuaaagggacuggcaguucuauaguuguggcauaagacuuuaugauugacuuagaguuuuuauugcugagaugaaacaccacaaccaaagagcaaguugaggaaaaaagaaaggguuuauuuggcuuacacauccauuuugcuguucaucaucaaagggaugguaccaucacaaugggaugggcccucaccauauugaucauuaauuuauuuuuuuauuuuuauuuuuuugucuucugagacaggguuucucuguguagcgcuggcuguccuagaacucacuuuguagaccaggccagccucgaacucagaaauccgccugccucuaccuaccaagugcugggauuaaaggcgugugccaccaugcccggcuuuuuauggcuaaaucuuauggaguggaggcauuuucucaauugaaggucccuccucucuaacaauucuagcuugcaacaagguuauauaaaaguaaccaguacaauggcuuuauuuauuucuuuauuuuaguuuucaguuuuauguuauguauauggguauuuugccuucguguauaucuguguacuauucaugugucaggugcucauggaagccagaagagaggauugaaucacauaugcuuagaacugcugugugggugcugggaaaugaacccagguccuauagaagagcaacaaaugcucuuaccugcugagucauugcacaagcccccguuacaguuguuuuuuugaaauuaauuuuauuuacuuacauuauguuuuugaguauguguuugcauguauguuuauauacuacaugcaugucugguguucagaugucuaaagggggcauuggauuucuagggcugggguuuacagauggcugugagcagccaugugggcacuggggacugaaccuggaucucucagaagagcagucaguacuuuuaacugcugagauacucucuaucccccaauuauugguuauuguuuuuauuuuuaauuuaauuuaauuuuuuuuuuuuuacuuauucccuauacuugcauccuacuuacugcccccucuuggucauccccacccauaacccuucccuuauacccccucccuuucucuuuugagugggugggacccauggguuuccccccacccuggcacuucaagugucugaagcuagaugcuucuucuucgauugaggccagacaaggcagccccgcuagaagaacauaucccacguauaggugacagcuuuugggauagcccuuauuccaauuguuugagacccacaugaagaccaagcuacacaucugcuacauauguguggagaggccuaaguucauugguguauguucuuuggcugaugguucagauucuuagaaccccaaggguucagguuaguugacucuguuggucuuucuguggauuuccuaucuccuucgggacccacaauucuuccuccuguucuuuuccaucccaaguuccauccacuguuuggcuguggacuucaagucccugaagaaagaaauugaagaagccgggcgugguggcacacgccuuuaaucccagcacucgggaggcagaggcagguggauuucugaguucgaggccagccuggucuacaaagugaguuccaggacagccagggcuauacagagaaacccugucuugaaagacaaaaaaaaaaaaaagaaaagagaaagaaagaaauugaagaagauaucagaagauggaaagaucucccaugcucauggauaguuaggauuaacauagugaaaaugaccaacuugcccaaagcaaucuacagauucaaugcaauccccaucaaaauuccaauacaaauuuuuuauugaccuugaaagaacaauucucaacauuauuuggaaagacaaaaaacccaggauagccaaaacaauccugaacaaugaaaacuuccaggggaaucaccguccuugaucuugaaugauauuacagagcaguagugauuaaaaacugcaugguauugguacagaaacagacaaguugaucaauggaauugaauggaagacucaaauaaauccacacaccuauggacacuugauuuuugauaaagaagccaaaaccauagaauggaaaaaugaaaacauuuucaacaaaugaugcuggaugucuacauguagaagaaugaaaauacuuauuacccuggacaaagcucaaauccaaguggaucaaggaccucaacauaaaacuaaaucucauagaagagaaagugggaaauacccuugaaugcauugguacaggagauaauuuccugaacaguacaccaauggcucaggcucuaagaccaacaauugauaaaugggacuucaagaaacugcauaggcaaaggacacuaccaauaggacaaacaggcagccuacagacugggaaaggaacuuuaccaacccuacaucugacagagggcuaauauccaaaauuuacaaauaacucaagaaguuagacaccaacaacccaaauaaccuaauuaaaaauggggccgggcggugguggcgcaugccuuuagucccagcacuugggaggcagaggcaggcggauuucugaguucgaggccagccuggucuacaaagugaguucuaggacagccagggcuauacagagaaacccugucuugaacccccccucccaaaaaaaagggggguuuagagcccacaaucccucaugcgcuuucuuuccaacuugggccuggcagaauggcucccacaaagaaggguggugagaggaagggcccguucugccaucaacgagguggugacccgagaauacaccaucaacauucacaagcacuuccauggagugggcuucaagaagugugcuucucagucacucaaauucggaaguuucccaugaaggaaaucgggacaccagaugugugcauugacccaggcucaauaaagccaucugggccaagggaauaaggaauguuccauaucacauccaaguaugcuuguccagaaaauguaaugaggaugcagauucaucacgcucuagacagugguaacuaaugugccuguuaccauauucaaaaaccuacagacgcucaauguggaugagaacuaaccugcugaauaucaaaguugcagaacuuccaaaaaaaaaauggguacaaaacuaaacagagaauucucaacagaguaaucuugaauggcugagaaguacuuaaaagaaauguucaaaguccuuagacaucagggaaaugcaaaugaaaacaacucugagguuccaccuuauacccaucagaauggcuaaaauaaaaaaacucaagagauagcauaugcuggugaggauguguagcaaggagaacaggucgucaucguuggugggagcgcaaacuuguacaaccacuuuggaaaucaauuuagugguuucucagaaagcggaauaguucuaccucaugacccagcuauaccacuccugggcauauacccaaaagaugguccagcaucccacaaagacaguugcucaacuauguucauagcaacuuuauuuauaauauccagaaagacaccaugaauuuugcagguaauuuuggauggaauuugagguuaucauucugggugagguagcccaaucccaaaagagcauguauaugcucacuuauaaguggcuauuagucauaaaauacaggauaaccauguuauacuccacagacccagugaaacuaaagaaggaagacccaagcgaggacgcuugaaucucauguagaagggggaauaaaaucaucauaagaggcagaucgagugagggaacugggagggagagaguauguuaaagggaauggggggcgguucaggauuagguauggggaaggacaggagaggagagauggcuagaugcccauggaaaucuacaauggacaggggugaggaggugggggccaucuccuggaagagacagaugugagauaagggaggcucccaagaaucaauagaggggugaccuuaacuucugaagccagguagaaaccccacuggagagauagagccacuaaccuacccacaaaacuuucaacccaaaauuuauuuugucuaagaaaugcaagcagugggggauggaagagagacugagggaauggccaaucaauaaccggcccaacuugagacccaucucaugggcaaguaccagucccugacaguauuaaugauacucuguuaugcuugaggacagaagcaaguccuccucugagagucuccauugucgguucuuaaugacuauguggaggucauuuaguaucuaguuacugaucuucccuagaguaaagaacccaagaggggcagcaggcaacagcucuccuuuuaugaaguagcuuugaguaucacuuaaugugcuuucuacuaccuuuucuucauuaaaaaguaaagucuaccucacauucuaaagaagguaauaagguuucaacucuugaagcgaagucuaucuaaggaaugugugauuguguuuaaaagccauucuaacaaauagaggcaaacugauaucuaguugccauugcauuuacuauuaauacucagaaaaaucacuggguauuuucugacuuuuguuuggacuuuuuauaucuuauuccuuggggcaucuuaucuccaaaaguuaaggauuaauuugaagguagguuacuuucuuaaacuuuauuuuuauuuuauauauacuugagauugacugcauguaugucugugcaccaugcaugucuggugcuugugaaggccagaaagagugucggauucccuagaacuggaguuucagaggguugugagcuacuguguugguucuggaaauugaacccaugucuucuacaaaauugguaaauacucuuaaccaccaagucaucucuccaacuagguuucuugauguuuaucugccuuuguauaauagaaaauucauaugggcuucucacacuuuuugaaaugacccucuaucuauccuaauacuuagauuuggguucugaagaaagaggaacaguaaaugucagaauccuauucauuaggacacuugcacuugcacugaaaugugaugagcuacuguguuacuaagaaggguccuguucuauuugcagaucaugggggaguuugugaugacgguucuuuccucuaaggcuuucaggcacugagcugugacugaugaacaugcagaaucugagcucuggagagaggcucaauucuugcgugguguuuuagucaggauucccauugcugugaagugccacccugaccaaggcaacucuuaccgaggaaaacguuuaacugagguuggcuuacaguuucagagguugagucugaaacaagauccagagagugcugcuaaaaagucagaggggcagggagccagcagcagagagcaaaggaauaaagcagagaggagggaguggggaucagcguuuuuguuaaugguccauuggauuuucuggauuuggacuggggucaguguaguagcgccaucugaaaacaaaagugggaagaagacagaaugccuguuuuagauugggucuuuggggcuagugccagggguuacucacaguccuugauuaaucuggaguucacacgugggucucuggguugccaguugggguauguguuaguugggcaccagaugugggucuguguuuugcccagcugcugggguccuaggcagacuaaacgcugagcaugacuguguuuacccugcacaguccaugcuggguguugaucuugagcaaagcgcugauacacuuuucaguggaugggaaaaugcccuaggaugugggaggcugaagcugggguucccaagcucccgggcauccaguccugcuggaaagcacauggagucaauaaccaagggcuggugcccacaggcccacagggaggagcccagggugggugacucucaaauucauggacauccagagaugcugcugggucgcagggaguugggaacagaguagagaggggggcggugguccaugggccugcaaagaggccagagccaggggcaggggaagcacuccagcuuggcucaucagcagagguccuuagcuuaguggagcacagagggaccuucugugggagguuuaggcagcacagcucuguuggcaaaggccuuuuccaugcuccccauaguugguucuaaacuguuuauugauuguucauuguggaaaaugggugcauaccagcuuuuuaggguggaccagagauuaaauaccuuuugcaggaaagaauguccuagcuuauuggcuaaacccucaaggccucuaaauaccucauuagcauggagaacuuagcagagagcugcguacuaucucaagcgggugccugggugccagggacucugaacccacucaaccuuacuaaguuuucuggcaugguccacuguuccacaaucaucaugguggaaagcaauucaguguccagguagauauggugcuggagaaggagcugagaguucuaaaucuugauccacacacaggcagcaaggaagagacuggauauguuucacacggggcauagcuugagcauuuaagaccuguguguaguaaugcagagcauuguggcaggcagucugugguggaggaaaguggcuaaccccaugauagacaagaggcagagagagauggagagaggaagggaccagacaccuuucaaggcuugaccuccaugugugcaugacucccauaccuacaugaccuacuuccucuaaccaaucaccaccuucuaguuuucacuugaauacccacuaaugcuaucaaauuaugacucccucaauggagccaauccagugguuaaaaucagcagccucaugauccaucaucuuuuaguagcaccuccagcugaagaccucuucuuuaauacuugaacuuuuugggacacuagucuuuccuuccuguagcugugauaagauacucuaacuaaaagcagcuuaggagaggaaaggguuuaguuagcuuguacuuccaaaucaaaguccaucacugaaggaagucaaggcaggaacucaaugcaggccugcuugaugcuuuacacauuacuucuaaucaaggaacucacacccaagcaacuacacacguaaaccgugaaaagagauauuugagggcucauuugcagggucaugcuuagcuagcuuucuuagacagacaaggaacacuugcccauggaaugaugcagccagucucauuuaauauaucccaucaauuaacaacaaaggcagcuccccacagacaugccaacgaaccaguaugaucugagaaauucuuuaacugaaacucuucaaaggugagucuagguuguguuuguuaaaugguaauguauggaggugaaguggaaauaaaaaaaaaaaaaagagaccagcagcuucagaagcagaauuguuuuuuuaaucggaacaacugaagagccacagucucucugcagaaguagagacuguacauacaugacauggcauaggagcagaggggugcuuggauauuuuauguaaauaaggcaaaaaggggacuucuagaagauucuuuugcgggucaguucuucuccagucucagagguagguaaccacucaaaagagguauuaugauccucuuagcagaagugugcuggaaccuaagagcccacagaucuuaucagugaagccagcuuuccuguucagagcucucaguccaccugagacuuucaggucauuaacccuucaguguuguauggauaguugaagcuaacuaggacagguacacuucauagccaaugcauggcagagauuauugacaguuuuaaaugggauuuauugaaguaauuuucaaagugacuaggaagcauaaaaauugggauuaucauggauauaagagucuguaggaaaauggugucuuuaugaccaucuuuuaggcuaccgaagauuuucagaugcaaauuuuauaaaucauuucaccauuuacauacuagaaaacugaacuccagugaauuuaggauaaagugaggcagagagaugacuugagguuccaguguuucauucaaugucuauguuaccacaaguguccuauaaggucaaguguucuaugucauaggguccccuccuccucuuucuuuuccaccacuuucucauaggguccccuccuccucuuucuuuuccaccacuuucucaacugaccuggcuuccuagcgagucccacgacuuggcacuugaugcuucucuagcuccaaaacucuucuucuagaugucugcauggcuuccuuuagaucucuuagaugcagccuccucggagagagggcuuccuugaguccccuguauaaaaaccccccuaacucuuuguucauuauuucccauuuucuuuuggaaauggaaaauuaucuauauuuuauaucaugacuauauuuauuuguuuauuauuucauaccacugaagguaaauucuuugaggguaagaacuucauuuuguuuguugcccugucuugcagugcauagaauacuugcauagaauaaauacucacuauaauauugguucagcuguauuacuucuuugccuuaaaccuuccauugcuaaagcccuuauaguuauaacuaaguuguguucuuaccuguuccauaugcaccugaauucauguguugaagucaacgcuagugcucucuagaaaguugcugcacuuggaaacuaagcuuuuacaaaaggguuuaaaguuaaaugaauuaguaaagauggggcucuaaaucaauguuauccguggccuugagagaggaagaagagacacuaggggugcugugaauggagaaaaggccaugugaaaaaauagugagaaccaaggacaaaggccucagaggaaccaaauccauugacaccuugaccuccagaacuaaguaagauacagucauugcuuaauaacaggaaauuucugagaaauuuuaucacugcaaaaaacaguauacauuugcacaaaacuagauaguaucagucagucaacuuaagcaucugcuagauacaugagaaaugcuaaguaaauacaaaacugcugcugaugugucauggaaugcugucagacaguaagcuuuuuuauaagcuggguguauucuaaauaaugaucauacaugcuugcaaugccaacacuugggaggcugaggcuggagaguuauagauuugaggccaaccugaacuacagaugaaacacagucugaaaaaauaaaacauaaaauaauacuaacaaauauaguaaagauaucaaacaauauuaaucacuuuuucugguugucacucaugugcuguauauaaguuugcauacuguuaaaugguagcagucauagguuguuuauacaagucacauguccuugaugauauuauaacuacuuuggugauuugaaugaaaagggucccccuagggucauagggagugagacuauuaggagguauggacuugguggaguaaguaugucacuuguuaugaguuuugagguuucagauacuuaagcuaggcccagugucucucuuuucccucugccuguugauucagauauagaacugucagauccuucuccagcaccaugucugccuguguaccaccacacuucccaccauaaugauaaaagaccagaccucugaacuauuaaccaggccccaguuaauuuuguuuauaagaguugccaccgggcgugguggcgcacgccuuuaaucccagcacuugggaggcagaggcagguggauuucugaguucgaggccagccuggucuacaaagugaguuccaggacagccagggcuauaaagagaaacccugucucgaaaaacaagcauggcuuacuguuguuauuuucugacaaaaucucaaguguucaguuuuaaccaaugaagauuucaggagccagauaauagcucagagaggcagagaaaauacacacugacuuucuuccucaucugauguuccagaaggaaugccccucuuucauaucucucaaaaaagccuccuuucaauuuaaugcccuucccucuacuuccugugcaucuaucuauccaacucccaacucucucuuacucuguuuuugucuuaauaauccuauauucacuuccugucagcugguugcuugcucugucucuuguccuauggcugacuuuauuuaauccuguuuacaauauucaagcagagagcucuugaauuaaaagugugcgcgaagggugaagcacaucacaacuaagaaguuuuuuuuuuuuuuuuacccccaguaauuucacagucuuggggaucagagugugaucaaauauucugcaguauauuguuaacuaaaauguuuuguggcuccugacucugacuccugcuaagcuacccagucuauggcacuuuguuauggcauuccuggcauccuuauccuauucacccacccaucuccuauucacccacccaucuccuauauccccuuacgcaagcugugacuggccauccaauaugccaagcuggcuuucuucucagagcuuucuguuuuaaccacuuuuccucucagaagucuaugcuauguauuuauaccucccagucaguucucugcucaaauguuucuuccucagcaauguaauccuuggccaucuuacuucaguugacagccuauagccuucccuuuucucuauuucuggagcuuguuuuuguuuucuacacaacauuucuuggacauauauaccugucaaagauaugucuaucuuccugugcaaggucucaugugcucugacugcaggacuuaguguugccuuuugauuugccauugacuuguugaugccaagaauaguucaacaccacuccccauaguggcauuuuguucugugcucucuuauaagauggucagucaggugcugccccaagaauagccaugauggugaggcccaggaaacagaauuuaccagaauuuaagacauguaagucuuagagacaggaaguaugacacguguggaaacaccucagucagaccugugguagucaggggagggauggagggagagcccacagugaggagugcaaggugagcagcuuaggccuggcuccuagcuaucgagaugauucuugggugccuggucucugacccugggguguggaauaugaccuccuagggaguugggaccuaggaaggaggauacugguaguuugccuuuuaaagcuuguuucugugaauuuacuaguccuagguaguccuaggaaauauaauuucuccuuauccaagauuuuuaggaugucacaauucauaaugaguguaacuaaaaccacgucuaauacauauuuacuggauuaguaaaugaaugaccaaguggcacugauucaucaggacaacagguacauuauuaauccacauuaguucugugaacucagcauucaggaacuagagaguuuugugaguuuuguaaaaagaaaacaaaaacaaagcauguaguuauuuuagcaaggguaugugugguguuugugcacaugaauuugcaugccaccauauacauguaugaaggcuagaauuugcuugagucagucugcucuuuccauuauaugguuccagggaucaaccucagguuguccuaauuggcagcugguaucuuuaccagcuaaacaucucacuggcccuuguccuuuauuuauguuaaagggaagauacacauuauuuacugcaaaagaaugauuugcuuuuaacacuugaaauucucaggacugacuucauucauuuguaagaacauaaaauuagaucuaggccaagaaaaaaauguuagauuguuuaaauguuuaaaugucaaggcaaggaaauugugauggaauucuacuuugcauucuauugcuaugaucaaacacugaucaaaagcaaccuggguaagaaaggguuuauuaagcuuauacuuccaggucacaauucaucuuugagagaugucaaagcagaaacuuggagggaugaacuuguagaaaggaaccauguaguaauaaauaggagugacacugcuugcuggcuuccucaugggcuuaacuagcuuucuuauauuguccaggaccaccagcccagggaugauacuguuuauagugggcuggggccuccuacaucaaucauaauaaagacagcuccuaguuuaguucccaguacucaugccaggcagcuuucuauugucuguaucucugguucugggagaauauguuggcucuugcuuucuugggcaucugcgcucguguguacaacacucuccacccccugacucacacagacacacaaaugcauccagauacacgugucuaauaaccuaguaguuauuagacaauuucucauuugaggcucucagaugauuuaaggcuguguugagcugacaauucaagguaccuaagguaaauaaaauuuagaaauauuugaagaauuuuauauaauuucuggguauuugcucuuguaaguugucuuagucacuguucuauugcugugaagagacacaaugaccaaggcaacucuugggugagggcuugccuacaguuucagaggcuuaguccauuauuaucauggcagggaccauggccacagggaggagagucucagggagcauggcagcagccagguguagaagugugagagauacauucaaaucuucaggcaaagugagagagagugacacuagaccuagcuugggcuuuugaaaccuuaauuuccccccacccccacccaaagacacacuuccucaaacaaggccacacuuccuaauccuucuaucaaagaguuucacuccuuggugacuaagaauucaaauuguuuuagucagaguuuuacugcugugaauagacaccaugaccaaggcaagucuuauaaaacaacaacaacaacaacaacaacaacaacaacauuuaauuggggcuggcuuacaguuucagagguucaguccauuaucaucaaggugggagcauggcagcauccaggcagucauggugcaggcagagcugagaguuacaugucuucauccaaaggcugcuaguggaagacugacuuccaggcaacuagggugaggaucuuaugcccacacccagagugacacaccuauuccaaccaggucacaccuauuccaacaaggccacaccuccagauggugccacuccuuggaccaaggauauacaaaccaucacacaaauauaugaguuuaugggggccuuuuuuauuugaauuaccacauuuucacucccugaucuccauaggcuuguagccauaucauaaugcaaagaugcauucaauccaacugaaaauuuuccacugucuaucacagucuuaauacuacuuaaaaacccaaaauucaauuuuucugagacucauuaaucauaaccucucauaaaaucaaaaggcagacacucccagcacacagugggucuacauuaccauuccaaaagggaagagaggaagggcagggaggagaugcuggaaccugugcuccugguaggagcugucacgcucuacuccuugcuugggcuggaacuuggaacuuggucucuucuuucaguuacuuuugcaucagcuuucugucgcuggugguuuucccaagcuggaagcuuagcuggguggggucuuacugugagguugcuacucccuuuaucccauuuagcaucaggcuuuuuuuuuuuuaauuaacuuaucuccuugaaaacuggucuuagcgccauuauacuucccagugcuagugcuccuucucaugccaaacuguacuuuuuuuauuucucuuuguccaccuugcuccuuuuuauuauagaucuucauaagagugauuacuaauaaccaaaugacacagucaaggcuagguuguuuuggaaucgccaaucuuccaaugucauuaaucuaaaacucuucaguauagccuuaagcaguuuuuagaaaaaggacaaaaagcagccacauccuuugccaaaauaucacaagaauacucucuaggcuaccuauaaauuuucuuucccucugaaacuucuugagcuggucccccacaauucaaguugcccucaacauugucuucuguguuccuauuaggaauagcccauuaagcucugcuuaaagugaucaaccacuuuuguaguucaaaaucccauacucuuccaacaaacagcgugguaaggccugccgcagcaguaccccagucccuaguaucaacuuguuuuagucacuauccuauugcugugaagacauaccauaugaggcaugucucgaagaauagaaagagaguaucuaacuaggguuugguuacaguuucagaggcuugcuuuauuaucaucauggcagagaacauggaggcauacaggcaggggcuggagcaguagcugagaagcgcacccugauccauaggccucuagagagagggagugugaaacaaucucugcucccugcagcgggcucuugaaagcccaaagcccaaccaaugggagggacgcaccauacuuccuccaacaaggccacuuaauccucuuaaugccgcuuugcuuccugaugaccaagcauuuaaauacaugagccuaugagggccauuccucuucaaaugaucacagaagagauagggugaggcuugcuagauuacaaagaaucugcuauacugggacuauagcaaagauuugauugcaugaaaauuuaaaguuuauaauggcagagacacagaaaauauuaaaggagagaaacuaaaugcaacauuuaacaaaagauaaauauucuuuggaaggcagcuauguacacuacuuuaucaccaacacacuauggaagauaaauauucuuuguauauaugaauuaccuucuaggcuggaaugaugccuuuggaucagaguguguacuguucuagaggacugaaggucaguucucaauaucuagaucagguaacgcccuguaacuccagcuccagaaagaauugauguccuuagccuucucugccaucugcauucacguguacacuauccuacacacacauauacaaaauuuaaaauaauaaaauuaaacauuuuuuuaaaaaugaauuaucuucuguuaagagacaaucaagucacuagauaugagaaaaauuuuuguaaacaaaugauuugaggcagagucuuacccuaugacucagauuggccucaaauuuauuauauauccuagacuggucuuugaguacagauccuucuaccucagccuauuucugaguuggauuuuaguuguguaccucccacaccuagcugaagugaagguuuuuaaacgagggaaaggccauggcuaguagauaugaaaugaugcucaauaauuacacacacacacacacacacacaugugcaccuacagauauauuuuaccugucagucauuccugauuucaacaaauauuuacuaacuuuucuacugccuugguauaaagugaggaaaacacaaauauuucugauuucaugggacuucugcuuaugaagaaagauccauaucuacauaucuaucuauaucuauaucuauaucuauaucuauaucuauaucuauaucuaucuaucuaucuauaucaaagaauaagaaauuaaugaugggggcuggagagacagcucagccauuaagagcacuggcuucucuuguaguggacuaugauucuguuuccaacauccaugugguaggucacaacccucuguaacuacaguuccagaggaucugauguccucugagagcacaggcaugcaggaacucucauauaaacauaaagcagaaauaaauuuuaaguauauuagaaggugauaaagcggugugauaauacucauauaaggaauuggcauacaagaaaaaaaguucauaaaagagacuuaaaggauuacuuugguuaaauguggagaaauguuuuaaaaacuuaaauguagugaauacuuuucagaaaaauauaaaugaucaaauugauuguagaagauugagaaaaaaaauaucaaaaucaaaauuuuaaaaccucuagagaaaacugcugauagauaacucuuaaaaaacaaaaaacaaacaaacaaaaacaaacaaacaaacaaaaaaaacccgccagguaguggugguacacgccuuaaucccagcacucaggaggcagaggcaggcagauuucugaguucaaggccagccuggucuacagaguaaguuccaggacagccaggguuauacagagaacucccccaaauagccccccacaacuaaaauaccaauaaaaauauuuuaaagaugggaugccaacauugcucaauguauaaaggcaauuuuuaccaaaccuaucugaguucaaucccugguacuaacauugucaaaagagucugcauauugucuucugaccucugcacaugugcccccacacaugcacaugugcacaugcacacacagaggcauacaggcaggcagacagacagacaauguguugcuaacuucuauggacccuccagcuauauaaauaagagacuguuacauauucuaaaagcuuaggcauuuaacuuugggcuaccucccagcuccucuagccugauuaauucugccuacaucccaccaugaccuggucuauucucuucuugugauagagaucaaccacacuugcugaauccuuucuucuuaucuuuuucccaucaugccuuucucccaccuuucacuuccugccuaggguuggcuaucagauuuuuauuaaagcuaaucagagaaugccuuuggcaggugaagaaggacagagaaacaaaagaaucucccaagaucucccccuuuuaguacaauaaaaggcucauucucuaacaacaauaaacuauguagaauaagaacuauuaugagaacuauuagguaagaaugacauucacaauguccagucaacauguauuugugaaccuugcuggaaauacuguauuaucuauucuaucuuggcaagucugaaguuguauaccuaaauugcuuucuaucauuaacuugcauugcauuuaucaaccuaaaaacaucauuuuagaccuuauaacauuuucuuaaauucuaaacaacuuaagcauaaugucugacuauaacuguguagucuuggaccccauuagagaucugagaaauauaaauauuaccugauuaaacaggaaguacagagaagcagcuuccaaacuauagaaaugacagagacugcuggcugccuggucagccacccaaacuucuucuguaacauuugagcauccaucuuuggccuguugguucagaauaucugacagacuauucuaaaucaggaauuaugaagacuggccuaccuugucuuggcaaaguucugcagucaucuuccugugugucuuucuuggucaaguuuuggacaguaugcuguuaaggcaagggcaguuuuuguccagugucuagcuuugccacauuucaagcaaauuccaugcagagguucuuggaugcucaucaucuucuuugaaguauuauugcguugcugccaagagcagacuugacuugucucauugucacaaaaagccuuuuauuaauaaaaaacccauaagugccacauucuacagaucucugaagugucuaaauaccaucuaucuaagguauaucugaauaggcagacauugcuuguuucaagcuauuuacuaucuguguaacuuugaaaacaucuacaggaggcuaaauaaaacuuauuucuguaauuaaaaaacuagcauucagggcuaggaagcaggaguggauggguggggcgcagggggagaggggaggguauaggggauuuucggagaggaaacuaggaaaggggauagcauuugaaguguaaauagagaaaauaucuaauaaaagaaaaauaauuugaaauuaaaaaaaaacuaguauucauaaugaccacaaguuugauugacuacuaacuugcauuucuuaauuauccuaaacaguuuguaauaguagguuuuaaggccuagaacuuuacaucacauuuuaaaaugaguugcaaugguacaauaccuuaaacaggagucaaaacauacaguacaugaaauauauguaaugaaauagaaccuuaaauuucuaccaauauauacaacucuaagccaaucuaaauauuuagcuuguugaugcucuuuauuucaaaaguugauucaauaaucuacccuuuuguccuauuauuccuauaucuccccccuuuuuuuccauccccucuucccccccuucccccuaacacuagguaggagagaaaaaaggauaaagagaaaaagaggagauccuugaaucuaaccuccuauacuugguuuccuuccugaucacgaccauuuacaacuugugaucaaccccccuuuaaugaugacaaacuuccaucacccaugaaaugaccauaaaaccacccaccccaccuuuugggagugaggcuaucauucucuuaaauugccuccagcugucuggggugagggcauccucugggggcccuaagaaaauugagauaugggccaaguucugggaaagcuagcuuuaucauuugcugucaaucccuaugugaugggaaagugcagagcauaacugaagcucuggcuggaacaauccucgagacuggaccaauugagcuagcugucugcugccaagcguguaccuaaagccuuaugggggguucccuaugaucuguugacugagggagagaagucuaggaccuggcuuacuggcaguccugaacauuauaccugcaccaccaagaaguggacagcugcagcauuacaacuccuuucuggauuguaguucauuccagaguccauauagacccauuaaacguugugcuucuuucuggauggugggaggauccagguacaguaacuuaccuuucaccuuggaaggaauaucucugcuugcuccacaccacuggacuccuaaaaauuucaccgaggaggaugguucuuuaauuuuuauuuuuuuuaauuuguaauuucuuguuuuuuuguuuguuuguuuguuuuuuuuguuuuguuuuuuuuuguuuuuuguuuuuuuuuucaagacaggguuucucuguguagcccuggcuguccuggaacucacucuagaccaggcuggccucgaacucagaaauccaccugccucugccucccaggugcugggauuaaaggcaguucaccacuguccugcaguccuuuaauuuuuuugaacuagcuuauauuggcauaacugagucaauuuaaaaagauagaacauugaagaaaacaguuaaaaaaauuuuagcccaaucuuuuucauggguaaaaucaaucaggauuauagauguucaccacucagguaguuuauuuuuugaauucugaaaugauauaaaaauuuuucaauauuagucuuuugacuuaaacuuuuuuuuuagaauuauuuauuuauuuuauguauaugaguacacuguagcugucuucagacacaccagaagcagucaucagaucccauuacagaugguugugagccaccaugugguugcuggaaauugaacucaggaccucuggaagagcagcuagugcucuuaacagcugagccaucaaucaguucagcccuuaacuuuuauuccuuucuaauuucccauuuuauuauucuaucuauuuuguguuguuugagacagggauguguagcuuugguuguccuggaacaucuucuguagaccaggcuggcuucuuucccagauuucugccugcaucuugccugucaagugcugagauuaaaggccuguaccaacacugcacgguguaauuucccauuuaagaggugggagauaagggcuggagagauggcucagugguuaggagcacugacugcuauucugaagcucacgaguucaaaucccagcaacuacauggugacucacaaccauuccuaaucuggggugccugaagacagcuacaacguacuuggguguggaggcacacacuuauaauuccaacaguuggaaggcagaagcaggugggaucuaugugaguucaaaguuccagaccuuuucuuuaaaaagggggcgaugggagugagcaguaaaagcgagaauauguuaauaagugaauguuacguugugauacugagggaauaguaaucagagaaggcuucauggaagagaagagggaugguuugcagguucuaaaaucuugagugauguuacccagaccgcugcagguguaggaccagccauagcuggcgaucgcccccuucuggcagagggcggccuugucccccgacagcgucucuggagaacgcggagccugaggcacgcaggcgcagugagcggacgagggcuuuaggcgaagaugcgcaugcguguagucccauggaggcgguagcugcuucaucgcggugacuggaggccgagugcuaaacuguguggggcacggaugggauccagcuguuagucgguaggcauagguagggccgcugccuugcggggagccggggacuggaaggcagagguccuuagcgcaggccccgagcggucccugccaggucgcggucgacuauuguaugugucgcagccgcugcguacaagauggcggcggcggggcggguggagcugagggaccccgggugggccucggccguggccuguuuccccucgccacucgccgaccgcgccgucgcgccgcagugcccgugggcgcagccgccggaugcugcugcucugaggaggagcgggcggcgcccucggggaguccggcugccccuuccccagcgccgcgggucugccgcuccccaggccugacagcuagcgggaagaccgccgcgugcccgagcgccuuucggagccccgcgggccgcgugcgcccuuagucgggcuggaagagcuuccuugcagggggcugggagcggggugugcgggcuguugugggccaagcgccccagugagcaccgaagccgagauugucggcccugggaugucgucgaaaauggcggugacacuuccacauucuuagaggagucgugaacacugauguggggauacaugcuuguguuggugugguuccuagcuuggggaagagcggagaggucuguacaccgacucucauccccgaggaugugccagacguccuuuguuguuugaaguaauugccuaugagggagucucaguauuacaaaaucuuugagcuugacagugauuguagccucgagcuauuuaauauuaaaauuacccuuuggcaguuugggaauucuggaaggcgcacucaaugugaaaaguucugaagaaaagcuucuuaccaggauccacccgaccauguggagucaaucuuuccuaaccaguuuggaaauuguucacucucacauaaaauucucccucucuucauuuuguguaugauggguuaacuuguuuuucaggggaguuguguuuacugcuuaauuuuagaaauuuaaaaugacagacuggaaaaagauuacaagaaaaauuaauguaaagcuguuaacacagaaaaauaaaguuguuuauuacauuuuuucaaaauguuauuaaugauuauacacuuaagauuuagugggcucaagcugcuuuacaaauuuugacuuuuauauuuccauauucuguaauguguacuuucauauuuguagaauccaaaauguaauauacuaaaauaugcuagaccauuccccgccuuaucauuuguguaggaaccaauggguaaagauaaaacaguugaaagaaauuacaaaaaucuccuucauuuguuuugauuagcugguuuucaaauguguucaugacacauacauaaccuuguacauugaauacguuguaguuuucugcauuuguuauggaaugugcuuuuuaccauaaauucuaguucuaaaaaagguugucucagucaucauuuucuggguguuguaagaguguuuuaagaucucugagacuuugguuuuuauguaauaaauaaaaaugaggagucuaaugggcagagaauagguuuuggaaccaaaaguuauggauucaaauccuuuuugcucuuauuaugugugagacuuuaguuguuuuagucuuucugaacuuuuguuuucuuuuuuuuuuuuuuuuuuuuuuuaaagauuuuuuauuuauuauuauaguaaguacacuguagcuaucuucagacacaccagaagagggagucagaucuuguuacagaugguugugagccaccaugugguugcugggauuugaacucuggaccuucggaagagcagucgggugcucuuacccacugagccaucucaccagccuccgaacuuuuguuuucuuauuuguaaacuugcacuacuuguuugcccuuucuuuuaguacacugagauccaguauggaaugcuccuaucccucaucauauagauguuucuuuuucuuuuuucuuuucuuuuuuuuuuuuugagacaggguuucucuguauaucccuggcuguccuggaacucacuuuuuagaccagguuggccuugaacucagaaauccgccugccuuugccucccaagugcugggauuaaaggcgugcgccaccuugcccgacucauagagauguuucuuaauuauuuauaucagauuuuauuuguuucaaaauuaacgugacuagguaccaucuucugauagaaaauuguagccuauggauacuuccucuuaacuaaaaacuggaaucuagauuaauagaauugaaaacuaucaaacuugaaaauauuuugcaucuauaaauuucauauaugacuuuuauugcacuuaccagaauuuaguguaauaguuuguugacuauuuauacaauauugcuagguagcacagacuagccuagaacucauuguguuaguucagggugaccuuggaauuuggagguagagguaguauacaauaacucccaaguguuaggauuucaggcaugaccccuuuuuuguggcaauuaaauaauuguuaguuuuugugucugaguaacugguauguauuggaugccccaauugaauauaugaacacaaucaauagaugcaagagccuacguggaauuucaugcuuaauucacugucccuugccauugauguuucgaauaagucuguucaguuucuuaaugaaaugcuauaauguacuaagaaacagugcuguuugacagucugagcuguuuuuucaaggaacuaaugacuauugaaaugugauaguuaauagauuagcaaauaaaauauuugcugugacuaaaguuaauaagcucucauaucuaaccuuuuauuguucuaacuuuguuccauuauuugugguugaaaauaaaaaugggaggaaaauauauaggaagucagaagagaauaguggaaauaaucaugagagaagguaaaguauagaauuauacucagccacauuguuucuaugagaaacaagaauaauacguuuuggauugacaaggauagggaacauagugauaucuccaaggguacauaugugagcuuagugauuacuugggauguaauuauuucgaugauuucucaagucuuucgaaaucaaacugugcucaauuuguaccaguccugaauugucuuuauauuuuuauuuucauacuuuuugaaauuaaacuuucaaguaguuuuuaaaguugucuguacuuagugaaaauuguaauuuuuuucuuuugauuuugauuuuuguauuuuaaaacaggguucugcaagguagcucagguuggcucuuaaguccccgugcuucagccucccauaugcuugcuaccagauuaaaauuuuuaaauuguuaauaaagauuucuuaauuggcuauucagacaauauugaaauuuccccucuaccuuacauagagguauuaaauuuauugaagucaggauccaaauaagauuuguaccugcaacaguuuauuauugauuguuugauauaucccuuaaguucauuuauaaguuccucagcugcuauucagccaagaaguacuuugcuucauaaauauuaaaugauagauaaguaaugccuuacuucaucaauauuugaaucuauguauuuugauguaacuuuaaauauguacuuaguggguaaaauugcuugcugucaaaccugacaacuuugaucuccagaacccacuuuagaaggagguaacacacuuccccaaguuguccuuagaucucucuacuaaugcuuaacgacacccacacccuccaaucuucaaaugaauaaaaauguguuuuaaaauuacucaggaacugcuagaugucacuuuaggaacuacugagaaagguagaaauauacaauuguuuccaacacagugcuuucaggagcuauaccuaacuccuuagucaaaguuuaauaaaagaauaccuaucuguugaaaacauuucauuuacuuaccuaaguguugagugccuguugcaugccaggaguuggaauuuuaauuaauagucacagaauauuugugaggguuuuaaaauuuuaugcauaugaaugccugaauguauguuugugaucuauguguauacagugccuguggggggccagaaaagagcauugggucccagguucugagccaccauuugggugcuggggaccaaaccucgguccucaguaagagcagugagggcucuuauuuguugagccaucuuuaaguauuuuuuaaaaauuuccauuucaggccgggcgugguggcacacgccuuuaaucucagcacuggggaggcagaggcaggcagauuucuugaguuugaggccagccuggucuacaaagugaguuccaggacagccagggcuacacagagaaacccugucucaaaaacaaaaacaaaaacaaaaacaaaaacaaaaaacaaaacaaaacaaaaauuccauuucaaaucacauucuucuugcuuauggccacauuguuaauaaacagcagaaauagaaucaaaacacugaauauagggucaaaauucuuuuauuaggguuuagauuuuuagacaguuuucugugcugccucucuaaaguuaguugauaguguuaaguuuuacuuaggggaguaaaccaacuuuguaugaagucaguaauuggcacuccuccuagccuggguggauauguuuaaaucaguggaaauuuccccaaagauuagauuauuaugaauuuuguaauugaccgacuaacagucaguuguuagggagaguacaugauguagaaaaaagagggccaaauucaguuuugcagcuaugcucuuuauuauauugcaaguuuucugccucuuguuuuauuuguuuguaaucuuuugacccaaaauacaauuaaaagccgggcgugguggcacacgccuuuaaucccagcacucggaggcagaggcaggcggauuucugaguuugaggccagccuggucuacaaagugaguuccaggauagccagggcuacacagagaaacccuguuauauagccuaguguuggucaaaaaauguugaaucauuaauauugugugaauuuaaacucuuugagugacaggaagaugaauuuucucagucacuacuugacaauaaauuuuguauauugugcuccuuuaucuuuaaauauuuagcauguguauauagggauaagauguuuuauaguaguacaguuaccaaugucaguaaauuuaacugauaaaauucuuuagucuguauuccuguuuguugcuuuacccauuagugcucucuauagacuuuuuccauccugaaacauaggaugggucuaggaccagguacaguauguaguugucaugucucuauacuugcuuacucuggaauguuuucauauacuauuccuuauuuuuuauuucauauacuauuugcuauuugucugguauucuuuuuuuuuaaagauuuauuuauuuauuacauguaaguacacuguagcugucuucagacauuccagaaaaggguaucagaucuuguugcagaugguugugauccaccaugugauuguugggauuugaacucaggaccuuuggaagagcagucagugcucuuaaccgcugagccaucucuccaacccuugucugguauuuuuaguuaaacauaguaaccauagguguaagaucugacuugcauguguccaucaacccuucaugggugacgcuguuucaucauauguugguuaaauaguuuguuguggagagacauuugaagacacaaauguccugcacaucacccagucauucuggguaugacacuugcauucuuguugaagauauucucuacugauaguuuaaaacugaugacuuuucuauucuaccuuuccucuccaguucucagauggugcuuagcacucaagaagagcuuucccuucucagcuauaucgaugacuuuauuacuguucaauuuauuauuucuuccuucuauuuucuguuuguaugucuugucuuccacaacaagaccccugauucccaacacuauaaaaaacauuuguucaauucaauaauaauaauaauaauaauaauaaacuguuuccauauccagugaugaggaauuguuucuuccauaucacuggaaacaauacaauuuuguucucuuuccuucaccucucccagaacugagcauauuuaaauugaauaauagauuuguaacuuacuugcauuaauuuuccuuuucgccuuaaguggauugugauuguguaaauuaugguuauaccaguuucuuuuuaguuuagauaaaaauacuucuuuccuuuucauccucauugguuuaauuucacauaccucccaaggucaaaaccauacaaaagauguccuacuugaaauguucccauguccccuuaguguuuuuaaaccauugccauuuauaaauaacuuuuuuccuacuguuauucuguuuguuuguuuguuuguuuguuuguuuguuuuuuucgagacaggguuucucuuuauagcccuggcugugcuggaacucacaggcuggcuuugaacucagaaauccgccugccucugccucuagagugcugggacuaaaggccugcgccaccacaccccccacucucuacuguuauucuugguuuuguaaccaugaguaauguucuuuccuccuuacaauaaagauacuuuguaucaaugcuucuuagccuuccuaaugcuaugaccauuuaauacaauuccucaugguguggucauucucuccaccguaaaauuauuuuuauugcuauuuuauaacuauaauuuuaccacuguuaugaauuauuaauaucuaauaugcaagggcccauagguugaaaaccaugcugcucuauauguucuuauguaucuuaagguuuugauauuuuaagggcucuuuaugcucuuguguaucuuaagguuuuugacacuuuaaggcacaauacuuauuuuaagauguuggaaucugcuuaaggcagauagaaacaauuuuuggcucauauccuacuugagggacgcauauaaccacaaggucggacaaggauagaguugcaucucagaagcaugugaaguuggacaucuacaucuucaguguuguuuuaucuugaucuuacuuuccugcauuguggaugucuuguuuuaguguuugugcuuucuugguaaggugaauucucaacagcauuugaguuuuguaaacauucaccucuuuucucauuuguaauuaugacuaaguaaucccgggccugauuucuuuauucuagcuuggauucaguaguuucucuugagcuaacccauuuauuuaugugucuguauguuuguguacaugugcauuuguguauggaggucagacaaccaccuuggauguucuucagguacuaucuaccuuuuuguguccaauuuuaucacucugcaccuuacucccacuguaauguggggucuuacugaaccuagaggcaagcuagugaccagcaaguucauugaugcugcugucucuauccccuaaagcacugacugggaugccucacuuuucugugaguuugggguccuuauguuaguguagugcaacaagcccucuuaauauuauuaagucaucucucuagcccagucuucuccuuguuuuggagaccuugucucuuacuguucuggaacuuaacaaguaggcuaggcugauuggccagugagcccccaaagaucuguaugccuuucuuucuccccagugcacaacuauagccagcuuugggaaucauacuuacugauccacuuuccauuucaaguaucaggaaagucagugcuacuuuuaaugaugcuaauuagugcuucugauuguguuugcuugaccacuuccauaaacaugacacauuuugguaguuuggcaucuaauguggaacuuaccuaacugcacuugugacacauaauuguaacuguaccucuuuugugagacacagcauaauagaacuaaugucaguaaagaguuggcugaauguauuugucugcacgauaggagagaucaacagauggaagaaagcacagaaugcauguuauuuuugugauuaaaugaacaauuggacuguuuuaacugacuauugucuuagcugugucccuaagugccaaaguuaacauauauuuugcaauuguguuguaacagaacagcauacaguagcauaggggaaauagaccuaaaaagaauguggugaguucauaagccauaagauaaauuuauuguauguaucugggaugcaacaugaaaagaacagugaggguaaggaugugugggaacuaaguggguguaggggaaagagggggaaggaggauccgacaucuggccagagcuccugugcucugggcagguggacaugggagggcugcuagacacuuuccacucuccccaggugggcaucuaagccacugaccccacuuggcgggggguggggggguuggacaaggggcagcccccgaccugggcccucggggcaacacccuguagcccccaggguuaugggagagagguucccacacaggcgagaguccuuaguccgggccuugacuggagcacaggaaggccuuucuuccaucaggagauuagaaacggcucauuacgagacagccuaucccaccauccaagcuuugauaaacagagacagucugugguuuuagagcuuuauuguagaaaggcaggggaaagagaaaagguagaaagagagacuggccauggccaagaggagggaagggggagaggaagagaaagaggaaagucuagagaguaagagggagugagaggagaggagagaaaggggaguaagagagcgagguggggccaaacagcccuucuuauggugugcuguuaacuuuauugcugcuagguaacugggaggagucuagccugaaggucagaagcuugggcugagggggcgguaacuucuauaggagccaggguuccaggagacaugagggaacuccuuccgcuccauguaggugaauuaucaccauugggucccuggguuccacaccucagcuuggcuggagacuagacuguguguauauagcccaaugcccaacaggauguagguucuguugagacguaguuacuuuguagcugugcucuaaggguuaaucuguaaacuggguaucuugguuuuaaggauuuuguguauguaaagugaaaugaguauuaaauagcauugaaaaccaugacacuauaaagucugaaguguaagguuuuaaaaauuuaauguauuaguauaaauguauauauauauguguauguaugcauauauguauguauguggguacacaugugcaaagucauguagguggaggucaguggccagcuuuguggaguuaguuuucuauauuucuccuuuuauguggauugggaggaucaaacucagguuaucagauuugcaugcccagcaccuuuaccacugaacagucucacugcccuaagaguggaguuauauguaaguucuuccacaaucaaugcaguggagccaucaugaucuaacuugugaugauuguucuagauacuaagacuuauugauacuuacaaagaaaauaaagccccuuccuucugaaagauauuaaaauaauaggcaguucuugauuuucuguggaaauggacauuucgaugcuauuuaaauuguaaggcuugacagccaagugccuuaguuacugagcuuucucauugacauugcuacuaguuucuaaaagaauuuuguuuaaugauauacaaaauauuugcuucagaguaauauguuucuguucuuaaaggacauugaaaagaauuuaagauugcuguuaaucaaaauaaaacgauucaaaugauuuaccauuaaauaauuuguuaugaaaaguauuaaguagagauuaaaauauuaguugaaaauagcaaauaggcuggggauagaguaguuggagacccuggauguuuguuccuggaauaauuuaagaauaguacuuuguuggcuggagagauuuuuguuggcuuagugguuaaggguacuugcugcuuuuucagaguaucuguuuaguuuccaguaaccauguuggguaacucauauuuaccugcagcaucagcagauuugaugcuuucuucugcccuccuugggcaccugcagucauaugcacagagccauacacacauauacauaaacaaauagguuuaaaaauaauauuugaugagcuaggcggugguauuguaugccuuuaaucccaacacucaggaggcagaggcagguggaucucagugaguuccaagccaggcuggucuacagagugaguuccaagacagacagaaauacacagaaaaaaacucuguuuuaaaguaaauaaauaaauaaauaaauaaauaaauaaauaaaauaauagaagauauaaauccucuucuaauuguauauacacagauagaaaacaaaauuucauuuuacucugauggugacucugucuaauguugcaaguuuauacgguguauucuuaauuagccuagagcucauuguagccaaggcuggccuugaauuugucccaguccuccuggcucuguucuuugaguguagggagagugaugugaaccaccauacgcagauaaaucuuguguugcccuuaaaacuacugggaucaagugauuuuucuuauuucagccuucuaaauaguuggaacuauuggcaugcaccaguauggcugcuauuggcaaugaauuuacuagcaaagauuuuauuugcugguuuucauuuauaugcauuagauacauaacuaggaauaaaaacuuaagaagggugugcuggguauggugguacauguuguaguacauaccuuaaucccagcacucaggaggcugaagcagucagaacucugugagugcaaggccugucuggucugcaaaaugaguucccagacagaucuguuauauagaguaaucuugucuagaaaaaaaaauugguauucgaagaaguuaauuaaaaguucagagcucaacuuagguuaguuuuucaacaauuucauaaguuggcuauccauaggugaagaagccucuuuaugaccagagcuuuagaauuaaaguuuaaaagguuauaauggcuaucuuauuuggcuauauacuugauguuaauguugucuuucgguuccuguuuuuguuacauugcuuucagguuuaucaguaucauucuuagguuuuguuucuuuuauuuauuuuaagauuuaguuuuauuuugugucaggguguuuugccuguauaugugcauauggauacagcaucugugcagagcagaagaggguaucagaucccuuggacuugaguuguagacaguuaugagcugauauguauucaaauucugagaauuaaacuuggguccucuagaagaacagccaaugcucuuaaaugcugagccauuucuugagccccagaagguguauuuucuucguuaggggcuuaccuuaauuuuuaaugaggucucgaagacaguugguaaaauagcugcugucuguauucuguaaauauauuauucauaucacuguaaggccagaaugcuagguacucuagaaaauauauagguuuuugccuuuaaagaacuuaaguguaguacuuuucagcuuauuuuuuaaggagcagauaaaaacaaaguuguucuuagaaaugaguccacugugacagagguaagcuaguuuaaugauuugugauuucuggauuuuguuacagauagcauuuuuaaaauagugaaauugccgggcgguguggugcacaccuuuaaucccagcacuugggaggcagaggcagguggauuucugaguucaaggccagccuguucuacaaagugaguuccaggacagccagggcuauacagagaaacccugucuugaaaaaaacccaaaacaacaacaacaacaacaaaaaaaccaaaacaaaaaaacccccacauacauacauacauacauacauacauacauacauaaaauagugaauuuguuacaaauugcauuuuuuuaaaagauuuauuuauuuauuauauguaaguacacuguagcuguccucagauacuccagaagaggguaucagauuucguuacggaugguugugagccaccaugugguugcugggauuugaacucaggaccuucgggagaguagucggcgcucuuaaccacugagccaucuugccagccccacaaauugcauuuuuaaaauagugaauuuguaucugcuguugguaaauucauagcccagcacaauuugcuauuauuuucuucuagcuugaaaucugagggcuagggagauauuucaguagguaaaacacucaucuacacacaugcacagauuaaugcauacagagcuuuaaaaauuaauuucuguacaguaauaauaaugcuuuguagucuuucaaauacgugaacaaauaguugagguucuucugaauagguuuuuaaauauuuggggaaaaaucuuauagugagcaaauagcuucacuugauucuuggaaaagagcaugcauguuauuagcacaaaacauaggcuacagauaccaaauggggcucaagcaauaaugaagaaaggauguuggcacucagcuucaguggucaaggaaaauuugauggaaguuaaccaagcagaauagguauaaaaucaaaacaguuaacacccaugacaaguuguuugcuuuaaugggaagagaaaggccuagcuggaguaaaugccugguuaauuacaaaaguagauagagauuggcuagauugguuggacauuacacauaaagagccaagaaauagaagggugauauuauucucuuagguguuugaacaggaauaauguggugaaaauguucuuuuacaaaaauuaaagaaauggaguguauggcgagguguggcucagugguagagugauuauuaggucucagcuuugggaaaaaauauauuggcaguaugcaaaaugguuggaugugaugagggagaauguuagccaaauaaauagaguuuuacccaaaauuacuuucauuuacaagcauaacuaaagcaccaggacuuguauccccagaaccuaaugaaacuagcuggagcugaauucagguuuuuccaacacucauaugggacaacucacaaacaccuguaacuaguucagggggaucugauacuucuagcuuccucaugcagucaaacuuacauguauguaauuaaacacauggauauauuuuaaauaacaaaguaaaucuugaaauacaugaagagggacucuguugcugcuguccuugguccugaacgagagcugauguccugguccucuuugaaggugauuagacuuggcaguguagcaauguguggaguuaguugguaaccacauuuaggaaaucuaaugucugagacuugcaggauaguguuguuugcaucuguuaaaugguugugagcaucaauuguaacuaagucugguuuugauuucaaugcaaaucccagcauugcauuccuauguguuacuuaaucucucaguguaaaacuaugcauauuucugggacuugugagaacuaaacgacuaaauucauguaaaaugcuuaggagagcaacuacaacauggacauuuucucuaaaguuaaucauuguuaccuauguauuuugucuguauucucaacaauugaaagaacaacaacaaaaacccuaacugguuuuguuaccauguuauauuguguauuauaaggaguuccaugcuccagcaccuccuuguuaaagacuuuguaauuagauuccuggugacacauuuuuuuuaaccagaaacaacuguucaauaacagaaauauaaguauagcuuaauugccauguggaaccuaguagaugugaaggcugauuccaaggaagaaugugucuuucaaaaaugggucuaaauaaaacuuuaaaguuacaauucuuucaugucugaucacacacauaguguuuauuucuaagaaucuuaaugccuccgucuuuuuuuucaguauaaaagcacaaaauaaauccucagucuuuuucaagauuauguaaaaggacuugugaauuacaucucagcaccuaggacagcacccaguacagcucggcaauguacaugaacuugagguuugggguuuguguucuggaaucagaaaagaagagaaaguuuuagaggaaauuuuaaaucuuuguaagcccuuacucuaaaaguauaugcaaugcaaaaugauaucauggcuugauuucaaaauguuuuacucuggcuguagaacccacugcaugaagcaguuugaguuaaaaugaucuaauauuuguguuuuaacuuucagcuuuguguuauucuuggaaaauuucgcaccacuugugaauuccuugagccugggcauugcgagcccacuucuguugggcccgucuccuuugcgcuuugcucagauugagacucaguuggcgcuucagcagcugaaugccguugccucccaugguucaacaccaccuuauacuuuuuuaaaucaggcauucuugaaaguagccaugucgagacccagguuuaauccucgagggaccuuuccacuucaaaggccacgagcaccuaauccuccugggaugaggccuccaggaccauuugugaggccuggcucuaugggucuuccaagauuuuacccagcagggagagcccguggaauuccacacagauuuccuggccacggaucuuaucagaacaugggaccacaaagaaugaauguucagguaacucaacaccgaaccgauccaagauuaaccaaagaaaaauuggauuuuccugaagcacaacaaaagaaggggaagccucaugguagucggugggaugaugagucucauauaacuccaccgguagaagugaaacagagcucuguaacccagguuacagagcaaaguccuaaaguacagagccgcuacacaaaagagagugcuucaaguauuuuagcaaguuuuggauuaucaaaugaagaucuagaagaacuuagccgcuauccugaugaacagcuaacuccugaaaauaugccauuaauauugagggauauaagaaugcgaaaaaugagccgccgauuaccuaauuuaccuucucacagcagaaauaaggaaacacuuaguaaugaaacaguuucaaguaaugugauugauuaugggcaugcaagcaaauaugguuauacagaagauccacuugaaguacguauuuaugauccugaaauuccaacugaugaaguaaagaaugaauuucagccccagcagagcauuucugcaacuguuucaacuccaaaugugauauguaauucuguguuuccugguggagauauguuucgucagauggacuucccuggugaguccuccagucagucuuuuuucccaguugagaguggaaccaagaugucaggcuuacacauuucaggacagucaguccuugaaccuguaaaauccaucagccagucuauuagccaaacaguuagccagacaacgagccagucucugaauccuccaucuaugaaccagguacccuuuacauuugaauuagaugcaguuuuacgccaacaagagcggaucucacagaagucugugaucaguucagcugaugcacaugguggaccuacagaaaguaaaaaggauuaccaaucagaggcugacuugccuauucggucucccuuugggauugugaaagcuucguggcuaccaaaguuuacacaagcuggugcccagaaaaugaagagacugccaaccccuucuaugaugaaugauuauuaugcagcaucuccaagaauauuuccacauuuguguucucuguguaacguagaauguagucauuugaaggugaguguuuuuaaaagauugcuguacaaugaugcucagugcccagguuuucucuaaauucuguuauguaugcugcuguuaacaaagcguuaacaaaagugcaaccccagcaccuacuuguaaucguaaguacuuaaguacugaaaugaauguuuggguuucuacauccuguuacuuggcauacuauauaguuugccuuuauuuugaacuuuaguuauuccauuuauguagcaucuaauuuuucuaaugaauuguguacucauaacacugcuacaugggaaaguauguuuaagauuuauuaggauaaaaauauaaaacucaucuguaacauacuuuuaaggacaauauaucuucuagcccugugcauaccuguucuaaagaucuuaauguugcuuuaaggguuuuuugauuuuuguauggaccaguaauuuuuuucuugagaaggugcuuuuaaaauaauuucauaguagaaugauucaggauauaaagaugauuaugauuauggaaccagccaugagcucagaaaagagaguaaaaugcuggaaauucagagagaaacauccaaaauauaugcuuaagguaccuugugguucguguagacagaggagacauuugcacagacgcugaggaaugguguuauguaguguuugcuguuugauaauaacuagugguaaauuugagcaggaacuaccacauucccccuuucuuaacauacguguauaggaaccacugauucuuuuguuuacuaauguaguuuuuagguaagaaugguggggaggagggaacguaccuuaagaagcuuuaauuucaagcuuuagccuggaauuggcuggguagcuugaagagguagguuuacauauguguagguuuuaguucuuuuguuauuuuuuuuucucugcaaauacugccauuuuauugucuuuguauucauuuaucaguuuucagucagugaccuaaaaccugaauugguugcuuuugucuucaaguuaacuuuagcaaaagaaaacaucauucugggcugggaguguauucgggguagagcacauguuuaacauauaucaugcccuacguucaaucagaaagcagcaaucuauccacagaaaaauaugcugaauuuuaguacaguaguaguugccuuauuccaucaaagagaauagaugucauuuguuacucagaaaaaaaaucucagaauaauuuauucauagaauaauuuauucauagaguuuguaaucuguaaauagcucuggacagaguauuggaugcucuuugcuauuguaacugggcauaccacuaacucucccauuuauuuugaacuguuagucauaaugaguugaagaaaauacaucuuaaagaacuugcauuuuuauuuuuauuuuguauuguagaaaguacacuauuuuuaguauauuuacugauuuagauuugugugugauugugaugcuggugcagacagaaauaaaaaacuguauaaaauuuaauuguuuuauaaaacaguuuauacagucucaucaagggaaaaaaaauacccacauaccugaaaguuagaaacaaauaguuuggugauauuuaaccauuugugcaugcacaggggaaagauauuuauuauuucuacauugauuucagauuuguaguggucaguccgcauuacaguaccuauagauuagcuagcaauuugugaugaaaaagaaaaacaaauauacucuuauauuuuauaagacuuuauuuuauaagacuuuuauaaccuaguuagauaagacugauagagugguaguuaucaguuguacuaaguuuguuuggaacagaaugaucugguagggagguauguauagaauaguuugaagacaguuuuaaaugaugagaaggguuaaauaugccuauuuaaagaggaaguggcauuccagaugguaacagcagcauucagagaggcaaggguucuuagaagagaaggcuuaugguaggacacagugaagaacuuacuagaaaggccuugaaaagcuguugucaauuuagauuucacauggaagauauuggggagcuaauuaaauucuuugguaugugaagugacacauugaaaauguuucagggagauuucaguguagaugaauaggaagaagggagaugggguaggcuaguuaauuggaaguuucccuagauaucaagucuaagguggagaauccuguauuaacaagauagaauaaaauuuugagagcagagaaaaaucauuuagacucuuuuagauuguggagauggcucaaugaauaaaagcacuugccacacaagugugaggaccugagcucugaucuucaggguccaugucaaaacucaacagucugaauauuugcagcaauccuagcacucauauugggagauggguagauagacaccagaaaacucuucagaagcuugccugguguaugcaaugacaaaacgacauagacucuugucucaagguggaaggugaggacugaucuccaagguugucuucuuacuacuauaaguuugccauaguuugucuuguauacugugaguuaacauacauuguacauauaugcacaugcuuugcuccuggucuuuauaaucagcauaacagauuggggcucaucuaacuaaagaauuccucauggauuaauggacaauguuagcaugugaauguggauuuagauguacaaguugcuucuuguuuccaugauauauuuuauugccuuguguguguauguauuugugacauuagaaauauauagccaguaauugugaauuucuaauuucaggcuuuucccuaccaaguaaauucuacaauaucuuugcuucugauauauaauuugaaaaugcaauaguagcauguagaaugcauuuucucacaaacuggaguucagguuuuaaaggaguuugccuugauuucuuauaaccuucugauugaaauaacuugauucaagaaaaucccccuauuuauauacuuauuuauauauuuuguauguaugucaguguggccacaugcguccauagugaguuuguggaggucacaauauugugagagucuggcugucuccuuucgucauauggguccagguugggauugaacucuggcaacaucggaaacaacuuuuuuuuuuuaagcuagucagaggaggguaaagaacaagcucugguagaagucaguguugucauaguuugauuuggagccagcccaaguucuuggaccauccuuguuucucaggucauuauuuuuccuauagaaacagugcugcuuuugagcagguaucuggguacugucaucaugaagccuagaaauugggguuacauaguuauauuuacugagcuuuggguuaucaagaaggaugccuguugaaagucagugugcaugugugaauugaauuagagaaagcagggcagugaccaccuucagcuuacacagguaucacaaagaagcauauuuguuaucauuucuuuguauguguuucaagcgaagcucaaaaucagauuuggggguguaaucuggauuuuaaaauguuggcaacuauucaaauaaaacauuuuaugguacaaauaaaucaugccuaauuuccugccugccagugugucuacuugguaaaaaaacgauaccucauuuauaucaaagacauggguugggcacugcuguggacucuugauugcugguuucuuuuagcuuucuguuuguagcacuaaugaggguagcagacauuuuguuuucacaguguacaauuaaucuaggaaguuuaaugaaauccuuuaguuugcuaaaacuuauauacacuguuggaaguagcuugacuuucagguaguucuugccaagguagaauuuagaauuaaagucaacuguaguuuaauuguggaggcuuuguuuuuagggaugauaaaaaguaaaguauuuuugaaguggaaacaagaaguuuuucucagaacauuuuaaaacacagaacuguuuagugagggucgguuuuugucuuucuauuuuccuuuccagcugcuggaggaaacaauaaaauacugaguaauagacugaaugguuugaacuaauuaacaaauuguuucaccuuggagauuauuauaguaaaaaacuguauugccugcccuccuuucucugcccucucuuuuaaucaaauacaucuucuaggagcuaauaauuauuguuacacauuguaauuuuaagacacuuauuuuuaaacaaaguguauaagaaagcauuuuuuuguuaaugauaaagcuguauauauguaagggguagcaugccuuugaaaugguguuauuuuccuuuaagucuugaaaauagauuuguuaaguagguuuuacuauuuuacuaaucauuuccuccaauauaaugaguauuuuguuuggaaugccacuagccuuuuagcucacauguuuggugguuagugucauuugccugacccuagaggaggaagccauuggacuacuugaaaaaauuuguuguuguuuuuuaaaauguuuuuauauuugagguguuauuuuuuuaauuuaugcuuuucuucaggucuagauauaugugcauuucaaaaugaauguuuugauucuugauucaagaaauauuuaugcuaaauauuuuuuaaguggaauuaauaugguaugggguuaaauguauuuguuuggaggacuuuaauuuuuguuuguauaaauucuguuauaucuaaaugcuauuucagauuagauuuguaaauuucucaaauauucuuuguuauuuaaaaaaagccuaauugauuugucagcuugagaauuguuuuaauucaaccuucuuuuuuuacaacaggacuggauucagcaucaaaauaccuccacccacauugagagcugucggcaguuaaggcaacaguaagaauaguuucuucccuucuuuacaagcgugauaauauguuagauacuuuaaagcuauugguuauuuaaaauaauaaucuuagaaaacuauguuuaguuuuccaaaaggagagcuucaugugaucuuucacugacuccuucuuaacuuaaucucuaguagguaauuauagacuuuuuuuuuuuuuuuuugugucucguuugccuuuuccagaaugguugaggacagauagcauucuuuucuauuaucuugggccauuucucaaagguugcauaauuaaaaacuaacucagaccauaugccagcauuuaauuuccauuauaaagacuuucccugucuuaggaccuguuuuuagaaugaagcuuuuuaaaaaaagauuuauuauaucuaaguacacuguagcugucuucagacacaccagaagagggugucagaucucuuacagaugguugugagccaccaggugguugcugagauuugaacucaggaucuucagaagagcagucagugcucuuaaccucugagcuaucucuccagccccuuauuuauuuauuuuaaguauaugaguacacuguagcuguacagaugguuguaagccuucauguaguuguuaggaguuuaauuuaggaccucugcucacucuggucaaaccugcucggucccugcucagucccagcucacuucgacccaaagauuuauuuuuauaaaucaguacacuguugcugucuucagaugcaccagaagagggugucagaucucauuacaggugguugcuaggauuugaacucagaaccuucagaagaacaaucagugcucuuaccuguugagccugcccagaauuuauaauccucuuucccuuugaauaacagcuaaauuguuucccuaacaucguuaaauaguucuagucaccagccugauauucucauggguuuugagauuauucaggauuuuuugaguaaaaagucauaaaccuaacucaaaauacaguaaacucuguugaaaaaaauuuagauuguuuacuuauuuuauguguaugaguguuuugucugcauauauguuuaugccaccacaagcauucccgguuacuucagaggucaaaaaaaugucaaaucccccugaaacuggagcugugggugguugugagccacuauguggaugcugagaccugaacccaaggcaucuguaagagcaacaagugcccuuaacuacuaguuagcucuccagcagccacaguuauucuuagaggaagagaauuaguucaucugacuggggaguuguagagaguagcucuaguugcaagaacagcugaauuuuaagucaaacaaaaauaaguuuccaggcuggugagauggcucaguggguaagagcacccgacugcucuuccgaaggucagaaguucaaaucccagcaaccacaugguggcucacaaccacccauaaugagaucugacucccugaagacagcuacaguguacuuacaaauaauaaauaaauaaauaaaaguaaguuuccauuucuuggccuugcucuggucuuaagaaaacuuaucuggggggcuggugagauggcucaguggguaagagcaccugacugcuccuccgaaggucggaaguucaaaucccagcaaccacaugguggcucacaaccauccguaaugagaucugaugcccucuucugguaugucugaagcuacaguguacuuacaaguaauaaauaaauaaauaaauaaauaaauaaaucuaaaaaaaaaaaaaaaaaaagaaaacuuaucugcauaguagauaguuccuguaguuuuuggacucuagugaacuauagagcugguaauuucaggagcuggucuguguuuugguuugaauuuuuguuuguuuguuuguuuguuuguuuguuuguuuggaccaggguuucuuugcaguccaggguagccuugaacuuccugccucagccuuuuaaauucuggaauuauaugccccacuuccccuuuuccccuuguuuucuuuuuucucaguaacuuguuuaaagacccauugucuuugucuagacuuguuuuauaguggcuuuaguaguaagauacacagcuuuuguugcaugugcccacuauuccugcuuugagaguaagagaaccccuucaugaaucauguggacuuuaagaguagaggcuugaagccuuuaaucaacagcacuuaggaggcacaggcaguuggaucuugaugaguucaaacccaccccuagagggaguuccaggacagaaaucccaucucagcccuccccaagacccucccucuccccccccaaaagaaaaagaaguaauuuauugcuagaauugaauaugccuuucuaucacucuaaacagagaaucaaucccuccuaaggagugaguuaccugcuguaauaguuauuaaugcuaauaccaugaucuaguuacaugaaaugcuguuaauuuacaagaacaaauaacaugugugugcauuuaauuuucccaucucuccuccccaugcauauccccuuuaaaguguuuuguauagagagcuuuucccuuguguacauaggaccuugauuuuucaacugcuuuucaagcuuuccucuuuuaaugcuuuaucccacucuauauuauucagguuguguucuccuguaauguuuuuuuucaugguuucuccuccacugcaaaauauuuaccaaguuaaauauuuuuaauuaucaccuuuauucuuuguucuccuaagcugcauugaguucuauauacuauauguauauacuauauauauauauauauauacuauauguaguucacauugauacaugcuuaguauuuuuagucuuuaaggcuuauguuuucuuccucugucuuuuuuagcuuuuucuggauuauauagaacaaggaguaguugagggaaaaaaagucacauugugccauaauuuuauuauuaaacacagauauacuguaucauaugcuagauauacugacugcuuuauaauauaugcuugauuuagucuuaucauuacccaugauacauaaacaugcuuauugcugauuucauccaaaugaggaaauggaggcacagggagacaguuucccuacuauuauaauccaguauuuaauauuuaaugaguuuauauagcucaugccccuuuguucuuuuuuucuuuaguauuuuuuuauacauuuuuaaaaagauuuauuuauuuauuucauguaugugaguacacuguugcugucuucagacaaccagaagagggcaucagauuccauuauaaaugguuagugggaauugaacucaugaccucgggaagagcaaucagugcucuuaaccacugagccaucucuccagcccacucuuuaguauuuuaauaugaaaaaauuucaagucacagagaaguugguaugaaaugcuauauuaaauuuuuucauuuucaccaguuguuaacauuuagcuaguucauuuauucaaauuuaacguuugucuucuaagaauaaggaagauuuuucauagccacagcauaccacauuaagaacauuaacacuaacuccacaguaccuucuaauacacaagccugauucagagccuuccaguuguuuguagaaguccuuuuauaacuguuauugacagcaaccaucuguacccccaauccaagauucugccaaaauucauaaucuggaaagacuucccucccuuuauguguccuucgcuggugcuuucacaaccuugacccuuuuuuuuuuuuuuuaaauguguggcgauugucuuuugaaugucucauauucucuacuuuuguguuguucauuaauaaguuaagguugaaugucuuuugucacaaauauuucauagaugauacauaugcuuagcuuguugcuagucaucaacuaguuuguuuuuuuguuuguuuggcggggaugagacuuagaccuauuacugacuuucuagggcccuuccuaauuugcuuccuauuuuuuuggugggguggggggguugguuuuucgagacaggguuuuucuguagcccuggcuguccuggaacucacucuguagaccaggcuggccucgaacucagaaauccgccugccucugccucccgagugcugggauuaaaggcgugcgccaccacacccggcuaauuugcuucuucuaaggcagugguucucaaccuguaggcugaaaacuuugaaaaacacagauauuuacauaaacucauaacaguagcaaaauugcaguuaugaagugacaguaaaauuuuuaugguuggguucaccacaacauaaggaauuguauuaaacggucacagcauuaggaagauugaaaaucacuguuuuaaaggaaucuuucuagguugucuccuuuuuauugucucugucauuucugugcuacagcaaccaguaccuggaguaggaccauuggggguuugccucuggguucugcuuuuguucuaucaugugagcauaaaguccaggccuacuaauauacuccucuccucuccucuccucuccucuccucuccucuccucuccucuccucuccucuccucuccucuccucuccucuccucuccuccuuucauuuuuuuccuucauucuuucuuucauuugagacggguucucuuuauguagcccugguuugucuggaacuuauuuauguaaacuagaugguuuugaacccauaaagauaaugucuaucuaccucuacaaugccaagaaagagcuuccuaaaaugcuaucuuuucuuucaauuccucuuucuuacguauauuuuuccaaguucugcuggauauaacuuaaagaguuugauauaauacuguguucuguguguuucaacagaaaguaugaaaauuguauguccccuggagcuuuguuuuuaaguuauguacaugaauaugugccaguacauggguaugugcauaugaauauagguaccuaugaggccagaaaugcagauccuccugaaacuagauaugggugcuccucuucaagagaaugccuuuugggcuggagacuuggcucagugguuaagagcacagacugcuacucuuccagagguccugaguuugauucccagcaaccacaugguggcuaacaaccaucuguaaugggaucccaugcccucuucuggugugucugaagauagcuauaguguagucauauacauaaaauaauaaauaaaucuuuaaaaaagagagagaaugccuuuuuaaccuuaccaagucuuccucuaucuacagucuuauaaaaugggugagauacuucuuuuucuuuguucucucucgcucccccccuaccccacccccaccugcuuacugucuuuuucugcgugugcaggcuucuauuggccacaggucaguguuggaugcuuugaucuuagagcuuuccaccuacuuucuugagacaggauuuuucacagugaccugggggucauaauuagacuggcuggcuagugagcccaagucaucggcaugucucuaccuccaccacauugaaauuacaagcacacagcuuguagugcucagcuuuuuacaugaguuuagagcucaaauucuggucuccugucuugugcagcaaguucuuuacagacuaagcuaucuucucagccuguaucucacaugacacauaguuuagucggucucugacuuaccauguagaucagugguucucaaccuuccuaaugcugcuacuuuuuaauauaguuacucaugguguggugacugcaaccauaaaauuauuuuuguugcuacuucauaacuguaauuuugcuacuguuaugaauuguaauguaaauaucugauaaaugaccccuguaaaaggguuacaucccaaagggguuacgacccucaaguugggaaaggcugaugguggacaaagaucuugaacccucaguucucuuguuucuaccuuccacaugcugggaaagcagguauguaccgccaugccuaucaucuaucuuugcuacuuucuguuuacugcuaccuagacuuaauauuuuauaucaugaaacaauuuuguuauacuauuuauuugacuuuuaaaaaaguugaggucuuggugaauguuuuucugcuauaucuacuagcauauauauaccuuuauuauauaguggauuagauauaaaaauauuguccucaagaaguauauuucacugucuuaaaucauauauaaacuuaaguuugagcagucuugacacauuucagauaaagauuaauuggaguuuauuauuuuuugagcugucauuaauaguguuuauuuuucaaauagauacccugauuggaauccugagauccucccauccagaagguaaguucuuuuuuuuccucucucucucucucucucucucucucucucucucucuagcccugagguccuggaacucacucuguagaccaggcuguccucgaacucagaaauccgccugccucugccugcaagugcuaggauuaaaggugugcgccaccacugccaggccaggagguaauauuauuaauaguauuaauuauugcaucuuuuuuuccauuuaaaaguaaacaauaaauuuuuacaaguuauuuuuuggaauuguccuguuuuuauuguguuuuguuuuguuuuguuuuguuguagacaaagucuggcuugccuggaacucuauauagaacaggcuagucuugaacucagauccaucuacuucugccuugcaaaugcaggauuaaagacauacacuacuacacuacacuauuguauuguguuuauuuuuaagcaguuggaaaauccaaaauuugauacuuacucuaccuuaaauguacuuucuucuauggguuuuacuuucuuuucuuaauauuuuguugugauccuauuaccauuuuguguuugugggagcuuaauuauaaacaccucaaaugcucauaguugucuuacugaguucugaguuccuuuagggucuauguagauauguucagaagucggugaaauauguuuggauggcauagucucucagggaaaauuuguucaaaaacaguuuauauaaauaauuccuaauuuauuuacauaacuuaaaauaguugcaaaauaacugauacagagaaaaaucuaagaagaacauuaaaauaauguaaauuagaaaggaaaagguccuaagcaaacugaagguucauucaacuguuuggauugcuuuuucugugcucauaacaguggauacauuuucauucauucauucauucauucauucauucauucauucauucuguguguguguuuguuuguucauguaugauauguauauacaugcccaugugccauggugcuuguggaugucagaggacaacuuuccagaguugguuuucucuuguagccuuaaggggucugaugauggaacucagguuaucagguuuacuugcaagcaucuguauacaccucacuguuuugccagcccaguagauuguuuuaaauaaacuaccauugagccagacauggugguuaacaccuguaaucccagcauuuaggagacugagauugaggguuguuacaaguucagaguuauccugggcuacauagugagagcuuugcucugaaacaaaagcaaauacaaugaaaggucuggagacauugcccagugguuaagaguccuuaagugcucuuuuauagagggcacaaguucaguuccuagcgucuauaugggguagcuuacagcaauguauaauuccagcucugaaggaucugauaccucaugggaaccuggacacacacucaggcaaugguauaaacacucaaaaauaauaaaaauaaauguuuguuuaaaaaauuauuucuauuucauauaguuuaaaucuacauuaaauuguugagucuuguuucuguuuucuacucuguagaaaugagagcaauaggaaagaaaaugaaacuccaagaagacguucucauucccccagccccagacauucuaggagaucaagcucaggucacagaauccgucgcucucgaaguccaguccguuauaucuauagaccaaggagucgaaguccaagaauuugccaccguuucauuucuaaauauagauccagauccagguccagauccaggucccguucuccauaucguagucggaaucuccuuagaagaaguccgaaguccuaucggucagcuagcccagagaggacaucaagaaaaucagugagaucagguacaccgauaauccuaaugccaucauuuuuuuugaguuuuggaaaugagauauuguauuuuaauuaaacuuuaaaguugcuguaugaaauuagaaucacacuugagagucuguuauucuuguaacuuugguuagauauaugaaacauuuaguuuaucagcauccauuuuaaaaaacaaggacugaagauaagcuggaugguacacacguguaauuucagcaaauugggaggcugagguagaggauugagaguucaagguuauucucugcuacauaaaauaaauuugaggccaacuucauguuuugaauaauuaucuucuaauuauuuaauaaugguuuagugacuucuaaaguagcucauauauuuggggggggggguugguuucgagacaggguuuuucucuguagcccuggcuguccuggaacucacuuuguagaccaggcuggccucgaacucagaaauccgccugccucugcuacauauacauacauagccuauaaugaaggaaaucauuguuuauauuaagguagugccuugcauaugucuuuaacuauauucaguauauuuaaagaaauugaauggaaauaacugaaaugugucagcugucuaaucugaguaugguccaagacccuaaguuccuaauagggucuacaggucuuuucagaguuguguaaggucuuuuccuuuuccaaaaccaaauuuguguucggguugauuuuccuuauauuuugacccaaaaguguacauauagcacacauaguggauuggauacagagcagagguuaacuuucaagcuuaguguuaacauguuagggaaaauguggaaugauacuaaucaucucauucuuuugccaguaguuaauuuucauaaaaauauuaauauggaaguauguuauuaaaugaguuagcaguuuuaaaauucuauuuuaaguucugauguguuaaauaaaauacacauaagaaaaaauaagcucugggacccugagauuguuaagagacccugaggcuaaaauuuugaggacaaaaggaacgacgaacaaaggaacuacugcauauaaaguuggaagaugagagguuauagacugagaacuguguucgugugugccugugugcaugcuuacaugcaguaugugagcugcuuacuaagccugagaauggcucuguaaucuuacucauguuacucuuaguguuuugaaauggucuuuuaaguuguuuuuuaaaauuuuucuagauuguaugguuuugugaacauugucuuguaaacuagucucucaucaaauaaauaugugcuuaauaaaauaaauauguucuugaauaaauaaugaauauacucuugggaauaaaaucaacccccagcccccccccaaaaacuccagaagauauuagggcuguguugucauaaaaaugcuacaugccauuuaguucuuuuuaauuuguacauaugaauauauguauuuuuuuucuaaucagauaggaaaaaggcauuagaagauggaggacaacguucugugcaugggacagaaguuacuaaacagaaacauacugaaacaguugauaaagggcucucaccagcacaaaagccaaaacuugccaguggaacaaagccaucagcgaaaucucuaagcucuguaaagagugauucacauuuaggagcauauucugcucacaagucugagaaucuggaagaugacacuuuaccagaagguaaacaggagucugguaaaagugcuuuggcccagcggaaggucaguaauucuuuuguggauuaguucaaguauaccuacaucuguuacuaugacaaauagaaaauaaauugggucuuuggagucacauuuucuguaaauucaaaucgguuuuuguuaaauuacugggaugggagacagauuuuuuucuuaugaauaacaaaagccuaauaauuuacuauuguagauuaggaaugccagaugguuaauguuugugcucaaaaauguuguagucagggcaguucauguuccuguaguguaguuaggcaggcuaaggcaggagacuucuuacaaacacuaucucagaacaaaagcuuaugcugugauauauugaugaaggcuuugguuagcuucaggagcuguguggaccaguauuagugacuuaauuuuuaucagcuagaauucuaagaauugauaauuuuuugucuaugcuuguauguugauuauaaccuacuuauuacuauacuggcauacucuuacauuuuguugauuuauuguuaaauaacaucuaaacugucauuuguauaauucuaguagaccuaauauuuuauaaugugccuuugaaauugucuaauacacugaagacuuucaacaauuauuuucuguguucuaaaagaguauauuuugguuaaccuuaaaacaauaugaagauuauuaggaauauuggaggagucagugcucuuaccugcugagccaucucaccagccuguuucaggaccucuguugacagaauuuucaaaggaauuuuccuuuuuuaguuuauuuuuggcaaacuugcuacuagguauagccagauuccuuccuauuguuuuguuuugagacaaggucucucuguuacauaucucuugacugcccuggaacucacaagaaaucuaccuggcucugccuccugguuuguuuuuguuuuuguuuguuuguuuuuugcuuguuuguuuuuuaaaagaaauauggaacaaucaacauguuuacucuaugaauuacagaugaugucuuauucaccuuucugagcuuugaucuuccucagaaagaacucuagcuucuguccuguagcucauaucuaucugcucuaccacaauggcccagucuugcggcccauccucuuugcucauucucccaaguguggggggauuagcuguguguaccuggcaggugugagaccuuaaauguucuauuaccaucccuugaauuacuggaauggagaacgaacaaagauguacuauuuauaagagaucuauaaaaguauugaguaauagaaauuauauguggaguuaugauuacuauaccuuauggcuuauguucuuucuuuuuaauuuucuuucauuccaaaaucagccacagaaggaucagucuuugaguuccaacucaauucuucuuguaucugaacuuccagaggauggcuuuacugaagaagauauuagaaaagcauuucugccauuuggaaaaauuagugauguucuccuuguuccuuguagaaaugaggugagucaucgagucaguugugaaaauccuuacagacuuguugcuuuuguggggauauuguugguauuguagcugcuugugcuaucuaugucaugguuaacuauuccauaguauuuguauggacaggaagagcacccaggaauaaaacaaggcuccagagaauugacauaauagaauaaagugccagauaauaaauauuuaagguuucauaggcuggucauaggggcacaguuauuuugccauugucauauagaaauagguguggauauguaaaugagaaaacauugcuguguuucuaagaauacuaaaaauaaaagugaaaguuugaaaagaaaugauuucucuuguaccguuuauauuguuuacauguauguuauauucaugauaaaguuugugaauuauggaccaacccuagacuaaggauaauagacuauuguugaguugaggcaaagggaagacaugguaguuuccguaaagggagaggcuuuaaacauuuuguaguugggauuuagcucaugauagagugcuugcuaggcucuggguuugguccuaagcucaaaaaauacaaauuacacauguauaucaggcuuaugugccaccuaugcucaugcaugcaauuuuaaauaaauacaguaggccacaaaccaaaaaagaaaagacaucacaauauaagagagaggcuugcucagaguaugaaggaauucagugaagggaggggauaagagaagaaccuggugauuauuuuagauguaauacuuguagcucaacaccgagucuaguuucacuagauacaacuuucaccaacccaaaauauaucuuacaggguuuuauggaaacuaaaagucuauaauuuauuccacauuucuuuaauuaaucuuuauguauauagguguauuuucuacauguaguccgcagaccacauuccugccuggugcugcagcgaccauaagaguucugggaauugaacucagauccucugaaaaaguacccaaugcuuuuaacuauugaaccaucuccccaguuccucuccucauuucucaucacuuauaaguauuauuuggucaguauggauaaauguucaguagaaauaaguaacauuuguuugguuccaaacuucagugaaacaauauguuuuuuaaaaaacuuguaugggaagcauacuaaagaucauaauauagguuagcaaaacaaaaagacaaaagcuccaguucuugagauaacuuuauaacuuuauguuccacagagcuaagacaguaaguccauuuaaaaugcagaaccguaagccuaguggguggcacaugggagggagggacagagagucaacauuugaagggcagucuugacuauauaacaauucaagacuaguguggaggagacugucucaaaaagaaugaauauaaauaaaauggauuuuuuaaacccaaauuuuccauucacacacaaauuuuauuuuaggcuuacuuggaaauggagcuuagaaaagcaguuacuucaaucaugaaguacauugaaacaaugccucuugugauaaaaggaaaaagugugaaaguauguguuccaggaaagaaaaagccacagguaaauugaauuuagauguuuuuuguuacuuaaaugugugggauacauguagaaaaaugcauaaaucuuaguacaaaaauuaaaaccuuuuaucugucuacauauguacaaccacaacuaguauaauguuaagugaugaauaacacacuaagacagucuaguaccagaggcuguuacagaccuuuguuuaugaaaccauaauuaugauuauaaauuuugaauuuuauauccauauguucacuagagucuuuuguuucuuuagacauaccuuauuugaguuuaguuuuucuguaccauuuccuauguuguaaauguccauauauaauaucuauagaauuauuuaaaauuuuccaguaaguuuugcuuugguuuugcuuuguuuuaauaauuuacauuuuuauuugcuauagaauaccucuuuuagagauucauuaacauauauuccucaaucaguaguaauuuaaucuuaaaaguaguugagacuuuccuccuuuugugacuuuuauguugagugauugucuugacaguuccuuauagaaagauacuugaguuauuacuuuuuuucauuuccaaaggcaagacuuuaguuagcucuuuaugauuuuauuggugacacuuuuguacuuguucuuguguacaccagaacaguuguucaaugaaggauauaggugcauauccuauagaauagcugcagucauuuacaccccugugauucaugagaccuggaacacuuguagccaucaucuuaaucucuucagugaaaaaaucuaguauguaaauaugcuguauuauuuaauaaauaauaauuauuaucuauguuaaaacucccuuucuugaauugccuauaucuuuuccauuuucuauugguauuuuuguugauugaggggaaucacuauauagcccagaccgaccucaaauuccuaucccucugcuucagcuuucauauacuagaaaugagccaguaucaugcauggcucagugaaguaaggcacuugccacugaccaugaugaccuaacccauaugggaaaaagagagaaacagccaacuuggggagguuguccuuugaaugccacacuuguauuguagaacaggcauaaacagagaagacagacaauaaauaaaauaaauguaaaaaauauuuuucauuccauaugcuugaaugcauuuaaauuuucuucuauggauuuuguuuuucucacuugucauucuuuauaagaucaucucuauuccagugucaaaaauaaagucuguuuuuuuugcuguuaaaacauacauacauacauacauacauacauauauauauauauauguauauauauauauauauuuauuuauuuaacauauguuauguguauacacacacacacacacacacacacacacacacacacacacacacacacacuaucuaguguauaaucugguugaggucaguauuuccagaacaggcagggaccuaaacccaaaacugucuaaccuguccuuucucgacaguuugaaagcugccuguauauaaacuacucuacaugcauagaucugucugagauuauccuguugcauaaauagaguucuugaaugguauuauuauauaguuuuaaacugcuauacccauaauuccuugucuuucugguagaguucuuuuucuuuguuuuuuauuucaauugaugugaauaaaucuauuuuguguguuucuguacauauaaauauauacaugcaagacaauuugugggauuuuuguggauauugaggcucaaacucagguuucaggguuggcaguuaguuuucguagccaaugagucuuucauaaagccccauuuuuguucaaucuugaaguaauuuuauaauucauuuagagucucuaguaaugcugagauuugacuugcuuauauugaugauuuuacagcauuacaucuauucagaaauacaauuuaucauuccauuuauuuacauuuugugcucuuuaacaguuuuguguguguuucaauagaauuuaucacuuauuuguuuauggguugcucuauguauguauguauguauuccaugucuuuacacuuguacaugucugguacacuuggaaacuagaagagguuaucagauccucuggaacuggaguuagaaacaguugugagcugccugccaugugaguguuggcaucaaagguaucuucuagaagagcagucagugcucuuaaccucugaaccccaaacuuuauuuuguaaauuuaaauuuuaauuauuguuuugugcgucugguguacauauagauacaggcacauguauaugugguguacauaaggcagucagcgaacaauugguucuguuuuuuucucccuagaaucugggcaucaaauuagucagguuugcucagcaaguacuuuuaccuacuaaaccaucuuguuggccuaaaguaguugguuuauguucuauacacucuuuuuuuuuuuuuaaagauguauuuauuuauuuauuuuauguaugugaguacacuguagcuguagagaugguugugagcuuucaugugguuguuuggaauuaaauuuuuaggaccucugcucgcuccguugaaccuuguucacucaggucgccccagucccucuggcccaaagguuuauuuauuguuauacauaaguacacuguagcugacuucagacgcaccagaagagagugucagaucucauuaugggugguugugagccacugugugauugcugggacuugaacucagaaccuucagaaagacagucagguuugcucagcaaguacuuuuacuuacuaaaccaucuuguuggccuaaaguaguuggcuuaugagugccacugaguuaucucaccagcccucuuaaguguccauuaucuguagcccuucauuuugaauauaauuuucuauaguuucacuuacugggucagcuuucauaucaaaguacucaauggaaaguucugaaauagauauuccauauguuuuagauugaauagcaugaaaaaguccacaauucucuggcuuuauccugccaagaugugaagaacccuucugucuaagcauaugcaugauguauauacugccuguccuucaguuauucaguaauggucucuguuuucuauugacuguugaaagcucuuauuuucauuuuuuuuaagauuacaauauaguuacauaauuucuuucuucccuucaagcccucccauauaccaccccuuguucucucaaauucauggcuacucuuuuuuuuuuccaguauagucacaugcauauauguacauacauauauauuucuaaaaauacccuguucagucuguauaauguuugucuuaggguuucucuuccugcacaaacaucaugaccaagaagcaaauaggggaggaaaggguuuauuuggcuuacacuuccacauugcuguucaccaccaaaggaagccaggacuggaacucacacagggcaggaaucuggaggcaggagcugaugcagaauccauggagggauacuguuuacuggauugcuuccccuggcuugcucaguuugcuuuuuuauagaacccaggacuaccaguccagggauggcaccacccacauuugacacucccacucuuaucacuaauugagaaaaugccuuacagcuggguauccuggaggcauuuccucaaaggaagcucuuuucucucugauaacuccagcuugugucaaguugacacuaaagcagccaguacaauauuacuuaaacauauguuucagguauugguauggacaaccaauuguuauacucuucucagagaagacuauuucuucuacucucagcauuccuuacuugccuauaguuccuuguguaggguuccuugugagcacuccucccaagccuccacuugagcaugucuauuaguguaauguuggugagacuuuauggguguagcuucgacucgacuauacaacauaaucuuacagcaagcucccuguucuucugacucuuagaguuuuuccuuccacuuccacuucugauauguucucuaguccuuaguuugaggaguguuuugauagauuucuccauugggauuuggcucccuuuugauuggauuuguugugguuuucuguaauggucuugcugcaaaaagaaguuuccuugauaaggauauccuuaccuaccgguagaagggcagaugauuagauuguuguuaggggcuaugcuggugaagucaaguggccuucacuaacagaauaguugguuaguuuuccaguacuaggcauuaggcaugguuucuaucuuguugaauaggucuuauguuuaguuagagaacuguuaguuacugccaagauaugcauguccuuacguuaggguuauugugccaggcuguuuauuguugugguucaugggcauuauaccuccauagaacuguugguugcuucucuccuuuggaaccuugcauggcaccuuuuggcaccucugcuuccugccuccuguccauugccuccugugagugcuagaauuaaaggcaugcaccacccuuuuuaaagcccauuuugcuuuuauucaaguaauuacuuugcucaguauggucuuaggguguauguugguggucaguauaugcuaaagaaaccaugagauacuucuuuaagugaauaggaugaugugauguuuugagagaccauaccauguaacuguaaucacaguauauuauguucuuuuacuuucauuaaugucuuauuguaccuaauuuaaacauucagcuguuauagguauguauguguagggaaagauauauaccucugguuucauacuuuguacaguuuaucuacuagagaucuuugagacauaccacauguauagauguaacuacuggacugauauuuccuuaaguaugaugaaaaguuugaagaguacagguggcaagcuuaauuucauuuuauguuguugaaagaaugugggcauauggaaaaggagaacagaaucagaggcccaucugaagcugucauagugacuaaaacaugaucacaaauuaaaggaaauguaaagagaaaaggguaagcauuuauacuucagaguaggaagauuuugaauguuuucauuguugaacucuguaguuuucuauauugucuaaacugacuuuuuuaguuggagaaagcuaauuuuuuuuuuguaaauguauuuucuucuaagaacaaagaaaugaagaagaaaccuucagauauuaagaaaucaucugcaucugcuuuaaaguaggugaauucauauuuucauaugaaaaauuaauauguccauguuagauuuaaguuuuaagacuauaucuuuaaauaccacaauuaucaaauuauacauaaauuuaaauauucauaaacacuuuaguuuuagacauauauagaacuuuuaacuaguuuuuaguguuuucuaauuuucuuucuuuuaaauagaaaagagacagaugcuucaaaaaccauggaaacugucaguucaagcucuucugguaaguuguaaucuugguguguagcagucaguggacauccucagaugucaguccuugcuuuucacuuauuuugaggcagaaucucuuauuguucacugugaguuucagaguagccagcccuugagcuucucaggguucuucuguguauuucuaccaguuugccugaggcaugcugggauuacagauuagugcugcuauauuuaccuuugcauggaucuugggaucugaacucugauccuuauguuuguaaaggcaaacacuuuauccacuaagucaacucccuagacuguaacuuuaaaacucacucaaaugaauguauuuugucaguuuacuagaaacuucuugcaaaaugguguuaggaagauauuuacugagucuuuaacagugguaucucaaacacuguucauuuuacuguuguuggcuuuuuguuguuguuguuguuguugcuguuuuuuuuuuuuuuuuuuuuuuuuuuuuuuuuuuuuugagacaggaucuuucuacauagccuuggcuacucaacaacucacuuuguaaaccaguuugaccucaagccacagagauacuccugccucugcuucccuggugcugagauuaaaggugugagccacuauacuuggcuuacaggagacuuuuaaacaugaacauuuauauaccucuccauaauuaaagaaaaagugaaccacagaguucuacucagagugaaagaugggaucuuugcuaccagaauagccugaugacuugguaauacuuugcuaguguggaaauagaggccacucaacuuucaauuaauauuaaugaaaugauuuguacugcauuucugagggaagauuaauauuauucaauuuuauuaaaugaaagaaggaagaaaaaaucgaaacauuuuccuuuuuaugucugugugaauacauacacaugugcauguuuguggacucuggaaaagcuuaguuuuguucucaggaauacuguccucugaaacagugucauuuguucacuuugagcucaccaguuagccuaguccucaagccgggauuauaagcgugugcugccugucaguuuuuauauaauuuuuugggaaucuaacucaaaucguuauguuuacaugagcaaguaaaaguaacuaacagcccucccccccccaaaaaaaacacuaaaagugugcauuuugacuuggucaggucuauaucuaagaauuuuuuaaaguaauaacucccaggacaaaagggauuggagacugcagugcucuuugaaaacuagcucuuuucuaaaucagaauguuaccuguaauguguuauagaaauauauuuuucuucauuauuuuagccaaaucuggacaaauaaagucaucuacggucaaggugaacaaaugugcagguauguugguuuuauauaccccauuuguuucuuguaaugcuggggauugaaugcacaacuuuguguguucuagacaggugccuccacuauugaacuacacugcauguccuguugguuuaguuuauuaggauuuuaguuacuaaauugcuaaagaguugcauaggcauagauucaugagauaaaguauguauuaaauauauguauuaauauuugagaauuaguaauuuaguugucagaaugagauuuaauacugagugcucuaauauucucaaagauaaauaacuggagaagcauuucugggaaugaauaucauauuuuuuucuuccucuuucaugaauuaucuuuauuuuauauaguuguccagauaaugcacauacaauuuuuauaaacuauaguucuuuuuguuguuguuuuuugcuugaaacugaaucccauguaucccaaauggguucugcacuugccauguagucaagguuauuuuuaaauccugaucuuccugcuucaaccuccugagugcuagaauuacagguguguaccaccaugccuggcuuaguguuguggguuuuuaaguaacaauuacaauuucuuucacuuuacccggguguguuccacuguucuccuuuccuuccuauuucugcuaaauacagguuauuuuagagauauugaggauaaagaguaguguguuaaauuguguucuuuguguuaaaaagguaaaugccauuguaacuggcagauuuggcauuuucuuguagucuaagauagucuucugagaugaucaucauguuuuaggaaacuuuuugaaauuucauuuauuuaacaaacaauuuuauuuaaaguuuauuggagucucaaauggagaucacuaggcugugaacuaaaagugcuagccauccauuaacugcuggggauaaaugcuagguaggcauuauuuccuucaauuucuaguguccucaucuaagugguaaagugacuuguccaugauaauaacagguauacauaaagaaaucucuuaacugacuuacugagguuuaguuuauucaggauagcaaacuuguaaauugcuaauaauugacuaguuaagugccaaacucuuaaggguuggugcauaauuuaucaauuuuggacaaggauacauucuauauuccaaaacauacaauaaaugucugauauugaaaaaguccaaauauguauaugcuucaguguuaacuaauauauuuuuauauguacauauguucauauauguauauuuacauaugaauaugugaauagguacauauuuuauauuugcauauauacauacauauauauguauguauauguauguguguguguauauauauauauaugcauauacacuuguaauuaagaauuugagacaggguuuuauuauguaucccaggauagcuuggaacuccuaaguagaccagcguggccuccaacucaagagaucagcaugucucuggccuguugaguauugggauuaaaggggugugccacaccuggcuaugauaguuuuaauuuguaaauugggcacaguaaaaaauuaguuauaugaacaaucuuuaugugaccuucauguguuuuuaaaugcauuucaugaacugugaucuagagaaucaaucauugagagccuuuguauaauugcuuuuggaaccagggaacauaggagauugcuuugugccauuguauuuuagcuuuuaguugguucauacauucagagagauauuuaacuuaaauccuacuuucuaguaaccaauaccccucuccuaaagaaauuaucauagcuagaugucccaaaauauggaaccauuuuauauuuugaauaaaauacuguuauucuuauauuguuuuuuuaaaaaugagguucuuuggagauugauacuaguuuuguaccaaguaaaaacaguuuugacuauagcuuuugugauuuagggaaaucagcggguucuguaaaaucugugguuacgguagcugcgaaagguaaagcuucuaucaaaacagguaagacaacugagggagagaggcuuauuaaauuuuaugaauuuaaagaauacauuauugaaagcaaguuuagaauucauucauuaauuucuaguaucuaauaacauugaaaauuuuguaggagucuucaguauuuaaaauuuacaauauaggauuuuuauuuguugguacuauguucuaugucuucuguaccaauauauauuaugguuauacacuauauuugcaaguauauaacuauauggccugacaguaauauguugauagguuucucugucauuguccccuuuaaauguuucccucuuuugcucuuguuguaacuguuauuuccacucccuuccacagacuuacacaguucauuugaugcuuguuacuuuaaaacagauuacuuucccagauagagaaaacacuuuuuaacauaaauguuguacauugaccuuaucaugguccuauaauaguaucuuuucuaauaguuuagaaucaagaacuuuccugacauuucaaaauauauacuuuuaauucuauauuucacaugagaauuaaacuugggacuaguuuaagaccaaggggagaaaaauguuucaacuuaaauuugcuuuuaauauuacuuauaaaaauuuaaacauaaauauguaauaaauugcuauucagauaagguugagcuauuuauuucugauauauuaauaugaaauaugcaaaaugaguaggcucuuaaucuuagaguaaugguguaauucuacuuuuaaaagcaaaaucuggaaagaagucucuagaagcuaaaaagucugggaauaucaaaaacaaagacuccaauaaacccgugacuguaccagguaaccaugugcuaucacucaguguuguuuuuuuuuuuuuuuuucuuuuuuuggauuuucuugguuuauauuaaaaauacauuuugaaaauuuucuuuaaaaguccuaaagaaaggccugggagauggcucaguuauuaaaauguuguugaguauacaagcaugaaaacuuguauuuggcucccagcaacccacauaaaagccaggcauagcacacaccuguaaucccagugcuggggugggguuggggcagauaauacaggccauuccuggaggucauuagccagccagcuuugcugaauaucccuuucuagagucagugagauccuaucucaaaaaacuaagauuugagagcaauggagguagacacuggguguuuaucuuugacuuucauauauaugacacacaugugcaugcauguuuguacacauagaaccacacagccccaaagggauuauuuuauuuuucaaagagguuuauuagcaugagagaaccugaagugauuaaauuacuagcucagauuccaguucagauuuauuaguuuaauuguauuaguguuuucuugaaaaugaaaguauucuguuuuaugcagcaaacucugaaaucaaggcuaguucagaagacaaagccacuggaaagagugcugaagaaaguccuucaggugggcuaguacaaauuuuauuuuguacuuuauauuuaaaauugaaaaaaauacuuuuaauaaaagagauacacauguauauuuguauacauguugauuuuucuaguacugggguaaaauccuaaaucaaauuaaauauauuaggauucaguuuaaacucuugucacuguaucauuaugaagguuuacucuccaugaggaauauccaaaauguauuguagcuagugcuacuuugugaguucuucuuucuucuacccuucuccacccuuuuuucacccuuucaaccccuaauacuagauaagagagaaaaaaauauagaaagaaaaggaaagaccccugaauaaagucagguugaaaaggcguugaaguuguccuuagacuacuuccugguaacuuagggaugucaagugucuuuaggcaaguuugaucuucucaucuuugcucucaggauauucaguuucuccguuucuuuuuugagcaugacaguuuaaaaaaccucagacaaccaccaaucaacaauccacccugccucuuggcacccuagcauuuauauacccucuaaaaaguccccagaauucuaaacaucauacaguagcagaaaauaucuacagcuggcaaaaucagaggggguggggggaggaaggaggaggagaggagagauagagauagaggaguagugugugugugcgugccugugucugugugucugugugugugugugugugugugugugugugugugugugugugugugugugcgcgugcgcgcgcacgcacuuguguuuaaagaaaccaaaauuccaaaguugucacuacaauguauuuaaaagcuggugucacgggaaaacaaggcccucuaaacucaacugaguaaaagcucauaugaacucagauggaagcagaaagccauggccugcaugaaugugcaucauuguccucugagcauacauggugauuuucaguuucuuguauuuaugggauuucuuuguuuucucuuuuuucucuuuucucuuuucuccccuccucuucccuccccucccauccccuccccucccauccccucccuuucccucccuucucuucucucugacaggguuggucuguguagcccugguuguccugaaacucacucuguagaccaugcuggccucaaacucagaaaucugccggccucugccucccaaguucugggauuaaagcugugcaccaccacugcccggccuuuauggacuucugaguguguguggacuauuucuugugccuuuucuuguacucuuuuuguucucuuauuugccuuguccaaauuuggauguaauauuuuuauuuuaucuuacugcauuuuauuuuguuaauguucuguuguuaucucuuagaagcuuguuguuuucuaaugagagacggaaaaggagugaaucuggauguggggaggauguggggagcaacuggaaggguagagggaagagaaacuaaucaggauacauuguaugagaaaagaaaaaauuuucaauaaaagagggcaauuuugguguuccuuuuauacuuccauccuacuguuucuuagccauuugucagucauaaauauauccggauaacuugcuuuauuuauuauggaauaaagaagaaccuugaagauugcaugaauuuuuaaaacuuguguuuuuauuguuuuuuggaauuaagguacuuuggaggccacagaaaaggaaccagugaacaaggucaguuuuuguauuuuauuuacauagaauucuuugagcaacuuuuuucacuuuuugguguggcaaaaauccuuagucauuuucaacucuuuagauaugguguugguuuaaaaagccuugaauuaguguuaguuuaugaagauuacucuccaaugagagcauguuaaggcaaaauugguuuagaauagguaacaacuuucuggaacugaaaaaacuagaaccuagagacauuggaaguuuguuuuguuuuguuucauuaggugauuuuuguuugagauggacuucuuuguaucgcagacugaauuugaacaugcuguauugcaaggacugaccuugaacuuucauuuccugcuucaacuuuuuuuaguuuggguauuacuggagucuguuaccacacccaguucauucauugauugggauaacacccaagaagauuuuguacaugcuuugcaaguacuucuaacugagauaguuuuuaauaauccuuuaugaaauuucauuuuuguaucaaaagauggccuagucggccaucacuggaaagagaggcccauuggacacgcaaacuuuauaugccccaguacaggggaacgccagggccaaaaagggggagugggugcguaggggaguggggguggguagguaugggggacuuuugguauagcauuggaaauguaaaugagcuaaauacuuaauaaaaaugggaaaaaaaagaaauuucauuuuuuuccuagccuucaaauguaagauaugugaauauuuugaauaccaaggcuuauuguuugcauuggauuuuuuuuuagagaaacaaguaacucuucuuauuuauuugaaggacauaaauuucacuuuauuuucuuauguucuaagaguauauuaaaaucucauucaucuagauuuuauugguuagaauuugagguugaucauaugcaguacccaaauucauuuuuuuaauaauccacugaguaagaaaucacugaauaguaugucuuacuuuaagaaaaauauuuuuaagcaccaauguaauggggucaguguacagcauuuccauaaagcucuuuagaaggagccacguauaaauaagcaugagaagccaguuguuaaucauuuguuuuuuaaaguucugacucuuugcagguuuucuucuccuucuccuccuccuucuucuuuucuuucuuucuuuucuacagucaaaauaugucaaguuuaccagagaggcucuggaauuuucccaguaucuacaaaagggaaagcuagcguaaugagaaaaccaacuuagagaauauguagaucuggaauaaaauaaaacagaaaaguacuuacuuguugguauaaagaucuuaaagggaauaagugaacuuaaaaaauacagccuaagagaguucguuguucaggaagaugagaagaaacuggcuuggauguuagaucugcauauggcauuaugaggcuugccucacuguagucagaaauaggaggauaugaccuuacguuugaaaacaguaagccuaaaggaggcugaugaccugaacuugaugagagaugguaugacuguaguuauccuauguaguugaaaauuguaaauuuaaaauucuauuccugugacugagacacugugaccaagucagcuuaacaaagaaaguauuuaacugagggcuugcuuacaguuucagaggguuagucuauuuucaucaagguugggaagaauagcaguuggcaggcaugcaccuucccucucccuccuccaccaccagcacagccaggaagcagagagagugagacuggaucugcagaguuucuggaccuccaacagggucacaccuccuaauccuucucagacauuucuaacuggagaucaaacauuuaaauguauaaaccuuaugggggccucucucauucaaaccaucacaaaaggcauuucauuuuagaucccaucaguuuccugauuuauuuggcauuuccucuauaguaaaugcaaaguaaaugucaaucacuuucuuaauuuguuuuguaggaaucggaggaaaugaguguaguauuuauuucuaauuugccuaacaaaggauauucuacagaagaaauuuacaacuuagcaaaaccauuuggugcuuugaaggacauuuugguuuuaucaucucauaaaaagguaagaauuuaugauaacuuccuauuauaagcacauuuugauaacuaacauuuuaaaaauacuaaagauuuuagggaccaucucuaaucuguuuuuuuuaagcuacugauuuaaaaaaaaaaacuuuuuuauauguuauuuuguuuugucuuuuugaaacaguuuuacuugggcuggcuuuaacucaugaucccuuuaucccagccuggcuuuauaaucagccgaucucaaucucccucuguccgugcacucuucucuccaucucuuucaggguuggaugugggguguugguaauugaacuuagggccagggacaugcuuuacugcugagcuguaucccuagccuaacaaaaggacuuuuaaaaugaaaaacacacuauuucaguauugucuuaauuaaguauaauugguuuugguuugcuuguuuugcuuuuuguuuuuacgauuuauuuauuugggaagcuggggugaugacuuagcaauuaaguguacuagcuguucuuccagaggacccagguuugauacguagcaucuauaagacagcucacaacggccuauaacuacaguccuaguggaucgaucccaugcccucuucugaucuccaagggcauuaauaugaaucuagaaacucuaaugccuauuaaauaucagugguaggacaacaaaaagauuaauaaauauuaauaaagguguggagagucagcucaguuuuuaagauuacuuggcuguucuuacaaaagaaggaccuagauucagucaguucuuagcucucacuuggcaacccagaacuaccugucuacuucuaaaagauccaauauccucucuaaaucacaugguuuccuguauucauaugauacacauaaacucauacaagugcacauacauacacauagauaaaauaaaacuauuguuuuaaaaacagcucagcaaaauuucuuguuaauaaacaacuaugugaagugcuguaauaaccuuacaggaggggauauuucuguaaagaauguaaaacuaaaaguauuacucuuugggcgguggaagucuuaggacccagccaaguuggcagucacucaguuuuuaagaguagugggauauauggaucaggaccaucagcuagugugcuuacagaacaauagagaauacaagguaaguuaugugcaguuuuaaaauaaguguaaugguuacacagcucucuaaguagacuacugaauuguacacacuuuaaaaguggugaagcacgagauagaguauagcuuucuuuauauaguuuuaugucuuuauuguaauuguaugaauguuuugcuuucauguauggcuguuugucacaugugugccugguccuuuuggaggucagcagaaugcaucagauucucuggaacaggaguuaaaggaggcugugagccauuguguguugggaaucaaaacuggaucuucuguaagagcagacuguacucuuaaccacugagccaucucuccagccccaugaagcuuauuuuuaaauacagguuauuuguaauguuuaaaggaagauaaaaauagaaagcaguucauucuuuaacauuaaaguuuuuucauaugcuaauaaagugaaaugggaaauuuuuagcuuuuuuuuuaauauuuauuuauuauauguaaguacacuguagcugucuucagacacuccagaagagagcaucagauuuuguuacaaaugguuguuagccaccaugugguugcugggauuugaacucaguaccuuuggaaaagcagucagugcucuuaaccacugagccaucucuccagcccaauuuuuagcuuuuaaaaacaauucaaauuguuaaguuuccauuguaauaccaaaacauguaauaaauacagauuuaauauuuccaaauaucuaagccaacaaaccaagauuaucugcccagauuuguuuaguauugaguauauuuaguauaauauaauaaauacuugagaauuuuauaaaauuauaugggcgugcuccaccaccgcccagcuuaccccccacccccacccccagacaggguuucucuguauagcccuggcuguccuggaacucacucuguagacagggcaucagaacucagaaaucccagcacuuggaggcagaggcagguggauuucugacugcccgccugucuugaaaauaaaauaaaaaaauaaaauuauaugggaaaauaccaggcuuugcuaccagcaguauccccuuaucuaugagaauuguauuucaagacccauguggguguuugaagucaagugauacugaacccuagguauucaguauuuuucauauuucaugcauacaaagauuuaacaucucuuucuugauaaugaaucauuucuaugucacacacuuuaauuuugacaguuuaagggauuuaagguauuaaugcaaagcuagcacacauuccuuuccucaauuuuaucaucucaaggauuuggcauuuguucuuacuauaauuucuuaccaaacucaacauaugauuauuuuucuuuuuguuuuugaguuacauuuauuuguguguaauaugugaccaugcauguaccauagugugugcauguaagccagaggacaauugaacucuggugguuaggcuuucauacaggcgccaugcauuuuuuuuuuuuuucuuagucuguuauacuguuuaguuuugcuuucucacaggaauuaucuuuaagggcuucuccuuaguacuuauaauuguuagcaucgcuauuauuauacuuuguggccgugauauaaaauaaagguuccuugaacacagguugcugcauuugauagauugauaacaaauggucauuaagucacuaaugggcagguaauacaauguagacucauugaauaaagggcaaauuguuaguagaguaacuggaaauaccauuacaccacuaaugacaguaauuuaaagcuaaggaauuauuuaaaugucuuaaaauuaaaaaaaaauaaauaaauuuuaaaaaugucugcuuaugcuguguacuauugugaauugaaaaaaauaagacuuuuuuuugcauuggaauuaguuccugguuguaauuccagugcccaagguccagaauaagacccuguaucaaaaauaaacaaacaggguaggcaugguggcacauaucuuuaauuccagcacucaugaggcaggggaggaccucuguuugucuguuacacagagaaacucuuucucaaaaaacaaaacaaagcuagauaaauaaaccaaaccuuuuuuucaguaucaguuucaugauguguuuugcuucucuuuuuaauauuguaucucaauucacuuauuuccugcuuacuguuaaguuagucauagcccauggacuuugcuauuccuaugacuucaguugcuuucuuuauaagauuauaaucauuugacccuaaggaauaauuaauuuuucauuuuuauauuuaaaggcauauauagaaauaaacaaaaaaucugcagauucuaugguaaaauuuuacaccugcuucccaauauccauggauggaaaucagcucuccauaaguauggcuccugagcauguggacuuaaaagaugagguaaauaauagaagacuuaaaccaucauuuucccuagauuuuacuaaauuucuaagaucaaauuuauuauuuuuauuaucuaguuuauuuggggcgcggucacaguguuuuugagcuacaaaagucuccucucuuuuuacugaccacugagcccacuuuuaagauagaauccuauuuagaaaauaaaaauaaaagaaaucauucuugacugcuacucugacuaacaaucaaaacagaguacuggugauugucuuuaauuuuuccuccuccuuugucaaauuuugucaauuaguaguccuugucuauuguaagcauaugaagcuuguccccugcuccuugcaguuuaaucgcuuaaagcugcaaaaguuauagauuugcucuuuaugcuacuguaaguuuugcuuucuuuggguacuuugaccacaaagccuugauaguaacaugaaauucuaaucugaucaaauucagcuuugacuuacgcaaaaacauuucagugucuguauguucuaaaaggagauagaaucucauagaagcugggagaaaugcaaauuuaggaccuuuuccugguagucauccuaacuuguuagcaauaguaggguuguuauacaugucaguaguauuaaagagaaaaagguuaagaaccauauuuuaaaggacuuuugcuaccugauuuuaugaaagacuggauaaugcauaucuguguagcucuuuguauaacaucaugauuaaguauuagcuugugaaugagauagaccuuuuaccuuuuccuuugaauguuugacuuuauaggaagcucucuuuacaacuuugauucaagaaaaugacccagaggugaguuucacauuucaaugcuuuuauuuacugguuuauuugaaagauuuguuuuuauuuuucuuuuuaagaauuaaaguugacugagauauuagaugguucuuggaaaaaacggaaaggguaucauaguccuugauaugaacauauuuauacacugaaauucauuauuaauuaguaacuauauaggugauauuugaggauuuuuuuuaugagcauagaggaaauacaggucccauuauuacuaaaugccuaggcgauaagcuuuggcucaugcccugacuaccuuuuaacuuauuaaccuauuuaaauuauucuguucuaugucuagcacuugauuaguugccccucucucgccaguuucagccuucuuuuuuugucuaccuuuugguuuaugccagucaccucagucuauagcuuucucugccucucuuuaaucucuccuuuuaaucucuuacuauuucccagaauccucucuuuuccuaccagugucccaccuccuauuugcuaccucaguucauuggccguugucuuuuuuuaauugacaguugagguuuauaagagauucucucuauauguugacucaaugauaaaugccuuuuuuaggacaaugaugcucuagguuuaaucccuacacuggggaugggaagaccacuugcuuuauuccauauagucauuuucuuauucuuugaagaaacaucaccuagccucuauaguguuaaaugaaugcuaaucagugauuuaugguuuaauucuuauccuuuuuuuuuuuacauugucucaaaaaaaacucccaacaaaauacaggcaaauauugauaaaauuuacaaccgauuuguacaucuugacaauuuaccugaagauggacuucagugugugcuuuguguugggcaucaguuuggaaaaguggaucgcuauauguucaugaguaacaaaaacaagguauuuaaacccuauaugcuugcaaucuauagcuucuaacuuggcauuugaguagaagcauccauaaagauuauucagccaugaaagcagaaguauaacagaacaauuucuucuggacuguaauaccaaaaaaaaaaaccaaaauagauaaucuauuuuuaguuuuuaaggagaaguaagauucacagaauaacggagcaugucuuacuaggggaguuacacauuacuuacauuaguuauauaaauauugcagagauuuuuuuacccucauuaaauuaagggcacauuacauaguuuuaguuuucaaaauccucuuucuaaguguaaaacacugauuuauuuuaaaaggcaauguuuuguauuaaaacuccuuuguaauuugguaagugauugcaagugaugugaugguauaguggugaccauaggugccuuauaaaccuauuaaguaacacgcagcuacugauuuucuuugguauguuuugaacugauaaguagagccugucugguacucuagacaagguauggcauugcaugggaaggcagggcacaggugccacauaagcagucugaacuuuuaaaacuuugcacauuagcccucuaugggguuuugguuguuuguauggguuuugggguuguguuuuguuuguuuguuuuguugcagguguguguauguguguuuuaauuuuuguggauuugugugcauugcuguauguaugugucugugucugugucucucuguguguaccagaggaggauagaaaaggguaucagauucccaggagcugggguuaccaaaacuugugagccacucaauuuggguacuaggaacugaacucaggucuucugggaaagcaguaauucccaagccaucucucuagcacacauuaguccucuguuuuaaagaaaggggauuuugccuaauaauuuuaaucuuuuuuguuuguuuguuuuuguuuuugcuuuguuuuguuuuucgagacaggguuucucuguguagcccuggcuguccuggaacucacccuguagaccagguuggccucgaacucagaaaucugccugccucugccucccgaguacugggauuaaaggcaugugccaccacgcccggcuuuuuaauguauuuuaaauuauguauuuacaauuuuagccuuaggugucaguccagcugcauugaacauacuugcauugugcagcuauugccaccauauaauuguauaacuuuuccauuuucucaaacugagacuucuuguacuuaaacaauaacuguuuaacaugccucccauccacccagaccauaauuggcacccuaugucuguuucuauaaauaaggauaacauuugaugccauaaagaauuuuaauuguauuuacuauuuuguaauuguuuguuucacuuggcauauguuccaggcucauugauguagcauauaucagaacuucuuuuuuaagguuaaacagcauucuauugugugcuuagucuauguuuuaaaaauccauucaucaguugguagauagaucucuuuuaacuguugugccuaauauuucuggaaauguaagugaguaaauaaauguuugguucccugcuuucaguucuucuggguguacauuaaaaaguggaauuuguuagaagacauccuaauucuacuuguaauuuuuaaauucauacuuuaaaaaaauauuuuuuucuaaaggugauccuucaguuagaaaguccugaaucugcucugucaauguacaauuuuuugaaacaaaauccacaaaacauaggugagcacguguugaccugcacuuuaucuccaaagacugacucagaggugagugguuuauuucuuauuuuuuaaaaaaucagcuuuuguuguuuuagaaguuuaaaaagcugggcuggaaaaaaugguucagcagucaagagcacuggcuguuccuacagaaggcccagguuugguaccuagcaucgauguggcucacaaccaucuguaaucaagauccaggggguacagugccacauuugaccuccauggccacuagaaacacacaugguacagacucauacauucaggcaaaacacucauauacauaaaauagaucuacaaaaauaauguaagaaacucagaaggcauaauagaaauuuucugaaaacugagaagauacaucaugaguguaauuccaagaauaggcacagauaguagucagacuucuucugaguucagauauuucuuuauauugauuauuauaaaaaaugauuuaaucucuuacaguuuuuaucauuauaggaacagugaaugauauaaauuaguaauuuugaaauuucauugggauacagacuuaaaaagagacuuuguauaaacugguuggaggugguggcgccgccguggugcaugccuuuaaaccuagcacuuggaaggcagaggcagguggaucucugaauuagaagccagccuggucuacagaacgaguuccaggauagccagggcuacagagagaaaccuugucucagaaaaaaaaaaagaaaaccagagagagacuugauagagcuacuaugauuaucuguagaagcaggugcuguauuugauccauuauugcuuucugaaaggaaaaaaaauuauuuguguuuauuauguuuuuagagaguguauuguauaagaaagcaaauuuuacaucuucuuaauuuacauagcuguauaguagaauauaaguagaaaaauaauauaaauacaucuuuaaaagaaaucuagggcuggaaagauggcucagcaguuaagcucuuccaaagguccugaguucaaaucccagcaaccaugugguggcucacaaccaucuguaaugaaauaugaugucuggugugucugaaaacagcuacaguguacuuacauauaauaaaauaagucuuuaaaaaaaauaaaagaaaucuaugcugaguguggugacacacaccuuuaauccuagcacuugguaggcagagacauucuuuauuauagagcaaguuccaggacagccacggcuacacagagaaacuguggcaugaaaaaccaaaaaagaaaucaaaaucagauuuguguguguguuuguguguguguguguuuuaauagugccauuguguuucuguagcaggacuaaauauuagaaccuuauauuuaguaucuaugcuuuuugcuaaucuuucuaaauucuugaauuaacugaaaaaagauaauguguacauguguauaauaaauauaucaaguaauaaaauaccagaugauuaaaaaguacugugaagacaaaugaaaauuaaaaugaauuaaaaaguuagauauggugacuuauucuuauaauuccaacacuuacaagagaguaguauuaguucaagauuagccugaacuacacaaaauccugccucaacauacgcauuuccucacauaagagacagacacagauggagaauuauguauauuaaaaugguaaguuauaaccccuuucaaguuuagaaaacuugaaagaaauaggaagaaagcuguauaaaaauagagugaagauauuuuuaugcagccaggcaauggcaaaggccuuaguauguuucuggugauggaagaauuucugggcuagcaagcuugcucaguaaagagccugagcacuugaguuuagcccacccugaguucaguuccugggcugcauucccauucaaguugucucacacuguucucuuaccucuacuugcuugaauauaaaauguuucuaagagguaucaauaguccuacuguaaaaaucauugaagugauuucuuuuuaaaccuaaaagcuauuguuuuuaaaaauguuguuaauccuuuagaauuucauaaauguguuuugaucacauucacauuauuucuucucuuaacuuuugucucgauugacucaaaccuuccuacugucccugcaaucuuuuuuaacuucuuauacagcgcauuugagcccuugauuuuggucuuccauaacauugcuuuuuggggucucagauaauauuuaaaaggauuacuacuguagcauuuauugguguguguguuuauguguauacaucuguguagaagcuagagguagauauucaguuucuuccucaauugcuuuucuaucuucuuuuuuuuuuucugacauaaguugucucaguguuagaguuagacuaacaaguuagacaacaagacccaggagucuuacugucucaguccccuacacacacgcacacacacuccccagcacugagaugguaagcauauuacugcuccccauuuuucucagauuuguguuacgaaugugaguucacauccuuguacuugcaugacaagcacuuuuuaaauuuagccaucuucucagccccacuucuccauguuuaaucagggaagucuuuauauuguuuugaagauuugcuuuaaguugccuaggcugguguuaaguuccugaguucacaccuuccaagcucuaggauuaugggccuguacuaugcccaauuuagugggaugcuuuauaaaaaguuuuccuuauaaauacaaaucuuuaaaaucaaaucuacaaggaauuuguuguauuuauugguuucauucuaaguaaaagauguuauuuucaggcuuuuagauuuuacaaauucuugucauaucugucuuaucucauaaauugguaguuggacuuauucuguauaacuuagcagcagguuuuaauaagaaaauaauuucuggaauauaaguuauguagauauagaaguuaacuuuuuaaaaaaagggauaaccuucuuuuuacuuuuguuaccuauauuuuacuaaauacuaaagagccacuagaauaaccucuaauaaaaugugaauuauauugcagguucaaaggaagaaugaucuggaacuaggaaaaggaagguauguugcuuuagguuguuuccuucauuuuuuguguuaaauauuucuguaucuuacaguaacuauguccagaaaguuccuaccuuacuuguuccuuuuguuuauguguaagcuguuguccuuuuacuuuuggguucuguuuggccuuaguuuguuuugguugaugccuauauuuaaacucacucagguguuuauugacuaagagaaacugcauguauaagccauuggaaucauauauaaaaauguuccuucuuuaugcuuuguaaacuauccugggcaguuuaauccaugauaaguaugacaugcucuuuacuagauuuuucuguuccaaaauagcuaaauacaguuuuauauuuucaauuuuaaaauuucauuagcuuaaaauaaaaauacaauguucaguguauauuuuuaaguugguacaauuuuagacuguuuuaaaguauggaauggaaauauuuguccaaaaaaauacuacuuuguauccacuaaugaagcuugcuuuucagagucucuucaaacuaccaagucaaguauuuguuuuagccaugguguuuacuguuuauuagucuauauuuuaaaaucuuacaaguguaaaauaauaauuugaaaauguuuaaauagaaaaguaacuauuugauacuuugcaaacaaugucuuauaagauuucuucucguuaacuaguuuguuauaaaaugagacuauuuuggguuguugaaaugacuaugagcaucugaaacuacaaugguaacucaugagccccgcuucuagguuguggugugugugacaccacauucuugaaguccacagaaagcucaguaaauuacaauaccauacaaggucauacagacaggcuuacaguuugcucuguugguaacaagaaauagauuuuccccaaaauucauuuuuguguauucuguuuuguaauuuuuuuaaucugcaaaaacuuguuuuuaucagaaacagugaguugucuguuuuuauugguuuuguuucccuuuaaaaacucaaaauauugauauguuuagaaauaguuucuaaucuuaauuugauuuaaaaaaauucuuccaauguaauuuuuuucugccauguaauacagagagaaaaauauguguauaaaaaaugugggagggcuggagagauggcucaucaguuaagagcagugacugcucuucuagggguccugaguucuauuuucagaaacuacuugguggcucacaaccaucuguaaagggauacaauacccucuucugaugugucugaagacagugacaguguauucauauauauaaaauaaauaaauuguuaaaaaaaauguaggauauggccacaguauuuaacauuacuuuuggaguaagcuuauacccucccucccaaaaaaaagugcuguuguuauuugcuuuaaauguugagucuuuuaaaaguaaaugugguugccagauuaccuuaaaguauaauucuuuuguuucucauuaauguaaauucuaaucacagauugcuuaggggaaauuucgcauuuauagcuuaguaauaacuuacauuauccuucauuaauccuccccauacauauccuauuuaugugucauuugauuaugacuuuaaauaagaaugcugggaaauaccuggugaagcucucaaauuaauuuuuuucuguuaaaucuuauccuaaaaugucuugggaugugugcauugcagugugguccuugauccccaugucuagcuuuuauaguauuccuucuuggaaauucugaauuggugggugggugggggaguaggaucacuguguacuaauugaaucacuguauauuaacuaauuuccuuucuggaaauuuucuuuuauuuugugaaugugacuguuuuccuuucauuccuuaaaagcaaaaacaagcaaacaaaacugucuuuuuaacucuggucuuaauaauguaauuuauuugacaucucacuggcauuccaaacuaaauugaucaucagcauugaaacucuccuucauuauagcuaaugaacagauacuuacuuuuguuaaaauaauaucugugaagaaaacacuauaauucuuaaagacuuccacagucuuuaagugcuggagagauggcuccacaguugagcaccuguucuuuuggagaacccaaguucaacuucucacacccacauggaggcucacaacuucgugcaguuacagcuccaaaggcagugccuuccucuggccuccauggcuuccugcacauacauacauacauacauacauacauacauacauacauacacauacauacauauacauacauacauaugcauaacuuuaaaaugacugucauagaagcaaaauauguaauugaaccaucuuuacaaacagaccuguguuucaaauguggaacuguguaguugcuccuuguauagaugauacuaacuuuuuauauacuuuaaaugugguaauugagaaagccauguuacauuuuucagaugauauuuuuuaaaaaucuucauguuuguucagacuugaauguuucuauauaguuuucuauauaguucaauuuauaaauuguuaggaucaauauauagcucacuaaugaggcaggaauuugaguuuauucuuuauuauagauaugaaucuuguaacugugaaugucacaguuguuucuucuaauauuugugcuuggccacagacucuauucuaguuccaggaguuuugaacuaauaucagcuguugguaucuccaguguuagugauaucaaaaauuuaagaugggagcauuugaauaugcuaaauagcuuauaaagaaauuacuauauauuguuauaaugaucuaugaucccuaguuguucaucuuaaaccucucaugcuucacagggaacaguguguuuauuuauaaacuuacagcuguucuucugcgagaaccaauuuauuugaugaaaugacuagacccuggucguggcaaauagcaccuuuuugaaaucucugaaauaaaaguaauauaggacacagauagacauguggcuauccucugaaaagcaugucagaaacaacaguuuaucuucuccuuggaaacaaagaguuaauacugacuauaauaauauaacaugugcccuuucugguguuuuucuccaacucaaccacuucuaacaaaauuacaugaauacacuuuaugacuguauuagacaugaucucucuuacauacaguuggccauguauuuucuuuaguucaucuagauaauugaaauauauuauaacuaaaugagugguuugguugguuuuaguaagaguauauuuucguguuuuggugguucuaacaguuuuacuuauaauuuuaaaucuccaaaagcuaccuaggugauucuagagaaagguuucuuuaaauguuaucauucauaagcacaucuuuuagaaaauuuaaaguaggucuuuuguauucaaaaaggagguaaaaugguuaaguggcauuucccuccaugccaguuucauguugauuuuauggaaguucuguagccauuuuaaguucacaugcauagaucacagcuuuauuguaaaaccguacacacucuguacgaguaaagagccuaauaguaauuugagaugucuuaauagagucuaauaauaauuugagauguucagccuuuucagguacaaacuuggaaugaaaaauuguuaacuuacacaagaaaaaggaagauacuaacaauccuaguuuuucuauuguuuccuuugaauuaaaaagaagcucucuuauauuguuccccuuguguauuuccaucagaacaucuuagccacuugaaugcugauuggcuggauuucccagugcuuaucauuugugcauuaggaaaccuguacaguuggcaucaacaggguuauuuacaaugauugaauucucaucauaguuugauuuuuguuuguuuuguguucuuuuuguuuguuuuuaaguacuuuuagcccugacuugaaaaacaguccuguugaugaaagugagguacaaacagcagcugauaguuccucuguuaaaccuagugagguugaagaagaaacuacuuccaauauuggaacagaaacuucagugcaucaggaagaacuugguaaggaagaacccaaacaagcauugugugagucugacuuugcaauucaaacacuagaacuugaagcucaaggagcagaggucagcauagaaauuccucuuguagcauccacuccagccaauauugaguuauucagugaaaauauagaugagucugcuuuaaaccagcagauguacaccagugacuuugaaaaggaagaggcagaaguuacaaacccugaaacugaauuagcaguaucugacagugucuucauagaagaaaggaacaucaagggaauuauagaagauucuccaucugaaacagaagauauauuuucuggaauuguacagccuaugguagaugccauagcugaaguggauaaacaugaaacuguuucagaaguacugccaucugcuuguaaugugacccaagcaccaggaaguuacauugaagaugagaagguugugagcaaaaaggauauugcugaaaaaguuaucuuggaugaaaaggaggaagaugaauuuaauguuaaggagaccagaauggauuuacaaguaaaaacagagaaggcugagaagaaugaagcuaucauauuuaaagaaaaauuggagaagauuauagcagcaauaagagaaaagccaauugaaaguucuguaaucaaggcagacccaacuaaaggaguggaucagaccaguaagccugaugaaacugguaaaaguagugugcugacuguaucaaauguauauaguaguaaaucaagcaucaaggcuacuguggucucuucuccuaaagcaaaaaguacaccuucaaaaacugaaagucacagcaccuucccaaaaccugugcuuagagagcaaauaaaggcugaaaagaaaguuucagccaaggaauuuggucugcuuaaaaauaccagaucaggcuuggcagaaagcaacaguaaauccaaacccacucagauugguguuaacagagggugcaguggaaggaucucagcccuucagugcaaggauucuaaaguggauuacaaggacauaacaaaacagucucaggaaacagagacuaaaccucccaucaugaaacgggaugacagcaacaauaaggugaggagaguagaagaauggcucgguguaccuuugacgugcauagcgcuguagcuguaaaguaggaaguguaguuuugguucauguuuuuucaucucuucacucuagccccaagcucccauuucccugucugaaacaauuccauugauauaagccaguagacaguuggaguacugagcucaaaguucccauuuacucacacacuugagaaguauuacauggucacaaauguagcugaauuaaacuuuggucagaacaaugauugugauuugaaggaugugucugcaguggcuccuaggaugaucauuuggcauucuuguuccucugaaauugaaacuuccuuuauuaguucacuaauugccuaaacuuagacauugugggcaaagaggaaaaaagaucuuagaaacugaauuuagcuauagcuuuuagagacugcauauaccauuaaaugauuauugacuuaguuuuguuuauuugcuuaacauguuugaccauauuuugauauuugcuaauuaaguuuuuucucuuuucuuaaagaacauuaauaaccuagguauaaauucuuuuuuuucuguauuucuuaauauuuuaggcauuggcuuugcagaacacuaagaauucuaaaaguacuacagauagaaguuccaaaucgaaagagguaaaaugagaauauucacauucucuauauccauucuuccacagcagcacccaucugucuuaauacacgugcccucacuuuuucauaguuagcaugggaguuaagagagugggugguguagaacauaggauugaagugaaaugcuucauguucuaucuugccacuaauucucuggugcuguugcugugguagacuaaacaguuuuauaugcucugugugcuaguugugguucauugacagcaagcaaaaugccagaaccugcuagaaaugucuuuacuauaauaucaauuuuaaaauaauguuuucaaauacaauuauauuagcuaugaagucuuauuaaucuuaggguuuuaucaauauaagcuucaaacuuucuuaguauuguauaaguuaaaaauacauauaaauuaauugguauaguuaacuauuuacucuuuauuuucgagguacuuuuaagagucuaguaagugaaaauuugcuagauaauuaacauauggaagagcagauucuuuguaugacaauuguuuagacaaguguuugaaauguagcuuuaaaguauaaauuauuuuaaaauuaauugugugcuguguaugcauauucuugaauguauauaauacucuuacauacauggagguuagaggacaauuugugugagucacuuuucuccuuauacaauuaguccuggauaguaaacucagguguugcacuuggugccaggcacuuuuacccacuuagccaucuuccuagccuuaucacuuuggaaccuuuuaaaauacaacauuaauuuuauuuuaguauuaggaagugucuuuagaguagaaauucucacagaugaucugcauauuaguuaacuaugacuuagccaguggucauaguucacaguacugauucuuaacucuccaacaggaaccauuauuuacauuuaauuuggaugaauuuguuacuguggaugaagucauagaagaaguaaauccuucucaagccaagcagaauccauuaaaaggaaaaagaaaggaagcccucaaaauuucuccuuccccugaacuuaacuuaaaaaagaaaaaggggaaaacuucugucccucacaguguugagggagaauuguccuuuguaacauuagaugaaauaggggaggaagaagaugcaacugugcaagcucuagucacuguggaugaagucauugaugaagaagagcucaauauggaagaaaugguaaaaaauuccaacucccuucuuaccuuagaugaacuaauugaccaagaugauugcauuccccacaguggaccuaaagauguuacuguccugucgauggcugaagaacaagaucuacaacaggaacgcuugguaacuguggaugaaauuggagaaguagaagagucagcagacauaacuuuugcuacuuugaaugcuaaaagagauaaaagggauucuauuggguucauuucuucccagaugccugaagacccuuccacuuuaguuacuguagaugaaauacaggaugacagcagugauuuucacuuaaugacuuuggaugaaguaacugaagaggaugaaaacucucuggcugauuuuaacaaccuuaaagaagagcugaauuuuguuacuguggaugaaguuggagaugaggaagauggagacaaugauucaaaaguugaguuagcacgaggcaaaauugagcaccauacagauaaaaaaggaaauagaaagaggagagcuguggacccaaagaagucaaagcuugauucuuucucccaaguagguccaggaagugaaacuguuacacaaaaagaucugaaaaccaugccugaaagacauuuggcagguagauacuugaaaguauucauuuuuucuguuucaugagauuacauuuaaaacuaugaacacagugccacaguaggaauaaugucauucuguugaaauucuguaagguggcaguuacaaccacuccacagaacuuuguuuuccacagaaacaagguguugguugcacacauuuaguuuacagaacacagguugucccaaguuguuaaaccucaagaaaggaugucaaaacugggagacaaagugaaccagccaguguagagcuucagugaacacauuguguuauggauggaggaacaagcuuuuaaagaggagaauacuguucacauuacagugccucucacuuuuagcuuaaacuuagguuuaggacaagcaggaggacaaauuauuuuuuuguuuguuuguuuguuuguuuguuuuuuaagauaaggucucacugugugaaccuuuuagaccuggaauguagaccaggcagcuuugaacucacaaaaaucagccuaucucugcuucugcuuucuggguacuggaauuaaaugugugaauaaccauaccuggaagauuuuggucuuuugagaugaggucugacucuguaguucauguuggccuagaacucagaauauagacuugaacucaggauauucuuccuucccaugugccaggauuacaggugagaguuaccacacuuggcauagcauaauauuuugaugguauggcauaauggagcagcuugcuugcuuauaggacaugagagagaccaaauuaauuuccauuuagaaaacuuugaacucagucgccauaauauguuacaaaauaagucacccugaugagaaggaauucaaauaguaguuuauuuuguuuccuuagauguuauaaaugaagcuauuuaauguguuaauaaaugucuacuuuguaaaaguuaaaaaaagcaagccagguagugguagugugggccuguaagcucagcacucagggggcuacucaggcaguccucugaguucaaggccugcuuggucuauagagucaguuucuggacagccagggcuguuuguuauacagagaaacccugauuuaagaaaaaagaaaggaaaggagaaggagaaagaaggagaaggaaggaaggaagggagagggggggggagggugagagagagagaauaccuugaaauauuuaacuaaacuaagaauggaauaucaggaacaucuuuuuggauuggcaacaauucaggggaaaguauaaagccauacugugaaaagaauaggaagggacaauuuuucagaacacaaauggaaacauguuauucuaacuaaacugccuuuuaacauagauuucuauuuaguguuaaguuucucugcugugugugcuggcacaugccuguaaucuagcacucagcuucagcuacauaagaaagucccugugagccgggcggugguggcccaugccuuuaaucccagcacaugggaggcagaggcaggcggauuucugaguucaaggccagccuggucuacaaagugaguucuaggacagccagggcuauacagagaaacucugucucacaaaacaaaacaaaacaaaacaaaacaaaacaaaacaaagcaaaacaaacaacaacagaaccuaacuaaagaaagacccugucucagaaacacaaggcaaucuccccaaauuuagguaguuuuuugcaacaaauauuagaauuucuagauaguuuaauaugcuaaauuucaagcaauuuaaauacuguuaaugaagcaauaaauuaggcuuucuuuuuaaagcuaaaacgccaaugaagagaguuagaauugggaaaucaucacccucacaaaaaguggcagaaccaacaaaaggcgaagaggccuuccaaaugagugaaggagguaaaggggcuauucggguggggaaaaaacacacaacaugagaucaugauagagcuuugacauauaaccaggcaagaaacuagaaaggcagcagccaggcuuagaagagccuuguaaacuucuuucuucauaauuuagagagauuuuggaacagugacaauagaacaaaaaaauauuuguggaaauuacucacaagauguuauugugaccauguucuagcaucagggaucaauaauuuauuaacugucuguuuacaggcauccagccuguaaaaaacagaaugcuuaauaauauuuaaguugaugcaaauaaggaacauugucaccgauaaauaacuuguuauuguaucuaauauuucauuguauccuauauccuuccuguuguugacaguaaaauacuaaggucauuccugauuucuaagagugcauugauaggaaaggcaaaggaaagugucuuccagugugacgauaucccuucagcaucuucuuugcaguacugaggaaaaguucuuugaaucugaucccucuacccuccuuuccuccuccaacgucuauuaaaacucucuuuauuuuauuugcugaccaguggugacgauauuuccuucuccauuaccuagcuaacucacacugcuuucuuuuauauuuaccuaagaaaaugaaucuucucugauggccaccuugaguuuuaccuuuauugacuccuuacacauaaacuacagcaaacuuccuauaucauuagaggacaaaaaucaauguuggcuuuggaauuccccuagcaacaaaauacagcauauagaauagugguuuucagccugugggucacuaccccuguggcaauccucugucuucaaaaacuacuuagauuacgauucauaacaggagcaagauuauaguuaugaaguagcaacaaaaguaauuuuaugguuggagaucaccacaacaugaggaacuguauuaaaggaucacagcauuaggaaggcugagaaucacugauccagguauuuaaaaaauauuuccucucuuacuuuagucuugaggucuuggcauuguuuguuacugcuuaucaugucccaaacugguaucccuucuuuucuauaacaacuuuuuacaguaagcuguaguuaauaguuuuaucucaccaguagcuccuaauaugaauuccuuaaguuuuagguuuuuugguuuuuuuuuuuuuuuuaaucaaagauuucugguauguuaggucaacuuugacaccagguugcuuagaauugcuucuucucaacugaauaauauaggagagguaauuuauuuaugguucauuuaauaauuguuuuuccauuaauuuccucaaaagaccuaauaaugucagaaagucauuugcaacucaguuuuaaauuuaagugauuuauuuuaguuuacucuuaguuauuauauagcuuuuauauaagauacuguaguguauaaucaauccauuauuaacaugugugugccuuuggaaugcuaggagcaaauacaauaauaaauaaguuaaaauuuauuacuugaguaaagaaaaaagaagagaucagaggcagagagaauaaguuguuugaccaucgagccaagaaaaaggcuguguacacccuuaauagacuuaagauuugacucuagaacagaauuacucuuugcuugugccuauuuccauuaaucucaugcauugccuccuuauaaauuaacauugacucugucaggucuacagaacuugacucuuaaaaggaggacugugagggagaacaagagacagggaugggaguugacgaaaggauuguguuuauuucaugcagaaucuagauuuaaguagaucaugagaacaggacuguauuugagagaaagaagggcagauacaauugaaauacagcgaugugcagaucacaaagauauuaugaaacucgcuauuuucuacuaaaaauaauaauaauuaugucacccuucuccuuucuagagcuauaccaauaaaauuuuacauaggcuuuagccguauaucuccuacacccauugaauauaucuauauuuacucauuugcuucuuggaucaaggaaucauuaacuaaggcauaguuuaaugaguuuuaagaauaguuuuggaauauggagaauauccaauguuaauuugacaaauauaucuauuuuaaauaacuucauguuuuuccuuuaacuuuuaaugacuuuaguugaugacgcugaacuaaaggauucagaaccugaugaaaaacgcaggaagacucaagacucuucuguaggcaaaucaaugacaucugaugucccuggagguaaaguaaaaaaaugacauguuuuucuuauacccaugaagucagaagugagcagguuaaccuugcuugguguuccugaauacaacuucucuaggacuuuuuuuuuuuauuuuaaauccuggcauggauguuuuuauuucauucuugaaggcugggauaugcuucuuguuuuguuguuauacuauaauugcuguuauggugaaaacugaguuauacuuccccaagcaaaaacuccaguuauuaauaggaaacuuugcuuacagccaacuacuaugcugaguugaagggcuuuuacuuguuuagcagcccaacauugugcugcuucuccauuuuguaacuuaacaggguguuucugagauguuuguuuucuacucucucacucuucgacguauauucaaagccguuagcauucuggcuucucuugagacgcucaauauauauauuacauauuguuaaagauacaugucuuaaacugcuaggggauagagcuaaguaguagagugcccuagguucaagauccucaaaauaaaucuguguuuugugacuucauugcugucuuaaguauauagcaguguguguucuguguguguggugggguggggugagguaauacuguguguuaaauguucuccccagauuuggauaaagugauugacacacuguugauggaguuuucucuuugucuuucuuucugucuuuuagauuuggacuuucuuguuccgaaggcuggauuuuucuguccaauuugcucccucuucuacucaggugaaaaagcaauggcaaaucacugcaagagcacacgucauaaacaaaauacagagguaacacauacaaaucuucaaguguugucaccaucuuuugauuuaaaaugagucugcccaacguauaucuuucuuugugagaacuuggguauuuauuccaguucauugcucguaaauugaaaaaaucccugcuuuccuguguugcuguguguugcuguggucucuagcccuaaucuuuuuccuggagcaauaucauuguguagaacagacuguggaagccaguagugucuuguggacauccuuuacaguacaagauucugcuuguccugauguucuguuucgaaugcuuguacauauuaacauacuaacguuucugaauuucuagucagaagaaaaauguuauuuucuuuuuuuguuguauauguuuugagaaaguucugcucuaagaaaguuuuagucuuagccaugguugaagcaguaguucugcuccuaauuaucuaagauuguuuaauauagucuguguauugaacuuuuaaaaccaagauaucucguagcaggccuugagccuagaguuucaucucgcuuuguuuaauucuaggucuaaccccucacacauuauuauauuaaauuacuauucuuaagcuuuuaaccuauuauaaucuuacuuuuuuuuuccauuugaaaucuuucaacuggggccagaugugguaucauacaccuuuaguccuauacucugguggcagcggcaggugauauuucgaguuugagaaugauagaguucaaggcuagucaaggaaccuugucuuuaaaaaucaagaauaauuuaaaaucuugcaacugcuucauauggcccuuggaauaauauccacacugacuguggcucuaugagacugcacagccugccucaucuguggcuuuaccucugucuuguuacucuuuuucuuucuuguacuucagaugccauugugccauucccuuaauuacuaauccugcgccccucucaaacuuauugugagguuacuuuuuccuaucuuuuggucucuacucauacauuagcuacuaugaagggccuuugcuuaaaaaagcaagcuccaaaagccaacugucguggccuaggacuccgauuucagcacuuggcaggcaaaggcaggcagaucaccuugaauucaaagacagccugaucuauauagugaauucagaacagccaggacuacauagaguaaccugucucacaaaaccaaaauuaaagaaaagaaaguaaacuugguucuacauccacaaaaagaucaacuuuaccuaguuucucuguuacuauuuaauuuuguugugcuagggauugaacccaagaauaggcacaugcucagcaaggacuuggagcaccgggucacaccccacacuacuccuuccuucuuguuauaguuguagaguaauuacugccaccuacacggauuucagguuugcuucucuuugguuccuuuauuauaguguaaacacuuggaaaaaugcauuauuuuucuaucuacuacuaaaucccccaagccccaagcauaauguguggcauaccaucaaauaucagaaggaugaauagggcaagaaaugaauguaauuaagacacugcuuuaaauuuaaauuuuaaaauaaauauaaugaaauacacuuaggauugcacacauagcaagcaucaucuaacaaauguuucauauugaaaauugcuuuuaacagaaguucauggccaagcaaagaaaggaaaaggagcagaaugagacugaagaaagaagcucuaggugauggaggaaaggagaaaagaauucauuagaaauucauuuaggguccaguugauuuguguauuuuuguuaucauuuaauuuguaauuuuuuuguuucaaaagcauauucauguuguacaaauuucugauugcccuugauguagagaaacugaugggaaaauaugauggguuugauuuuuauaucaaaucaucaggcauggauaauaccuuuuagaaguguuuaaauaaauguuccuacuguauauuucaacacuguuguguuuguguugauuuguaaaggcuugcuugccucugguuacagacaaggcucuucuccacaacccugggauuuagaguauuuggcaguucauguguuucuggaaguaauaguaugauauguuacuuugucucaaccauccauguauauaggucugauucuuauauguucaguuuuucugcauaaugagaugacaucauguuuguccaagggaggauugaguaaaauacugcuuaaacuuuu

SEQ ID NO: 3134 - RNA, 1541 nt, Mus musculus
cgagggcuuuaggcgaagaugcgcaugcguguagucccauggaggcgguagcugcuucaucgcggugacuggaggccgagugcuaaacuguguggggcacggaugggauccagcuguuagucgguaggcauagguagggccgcugccuugcggggagccggggacuggaaggcagagguccuuagcgcaggccccgagcggucccugccaggucgcggucgacuauuguaugugucgcagccgcugcguacaagauggcggcggcggggcggguggagcugagggaccccgggugggccucggccguggccuguuuccccucgccacucgccgaccgcgccgucgcgccgcagugcccgugggcgcagccgccggaugcugcugcucugaggaggagcgggcggcgcccucggggaguccggcugccccuuccccagcgccgcgggucugccgcuccccaggccugacagcuagcgggaagaccgccgcgugcccgagcgccuuucggagccccgcgggccgcgugcgcccuuagucgggcuggaagagcuuccuugcagggggcugggagcggggugugcgggcuguugugggccaagcgccccagugagcaccgaagccgagauugucggcccugggaugucgucgaaaauggcggugacacuuccacauucuuagaggagucgugaacacugauguggggauacaugcuuguguuggugugguuccuagcuuggggaagagcggagaggucuguacaccgacucucauccccgaggaugugccagacguccuuuguuguuugaaguaauugccuaugagggagucucaguauuacaaaaucuuugagcuugacagugauuguagccucgagcuauuuaauauuaaaauuacccuuuggcaguuugggaauucuggaaggcgcacucaaugugaaaaguucugaagaaaagcuucuuaccaggauccacccgaccauguggagucaaucuuuccuaaccaguuuggaaauuguucacucucacauaaaauucucccucucuucauuuuguguaugauggguuaacuuguuuuucaggggaguuguguuuacugcuuaauuuuagaaauuuaaaaugacagacuggaaaaagauuacaagaaaaauuaauguaaagcuguuaacacagaaaaauaaaguuguuuauuacauuuuuucaaaauguuauuaaugauuauacacuuaagauuuagugggcucaagcugcuuuacaaauuuugacuuuuauauuuccauauucuguaauguguacuuucauauuuguagaauccaaaauguaauauacuaaaauaugcuagaccauuccccgccuuaucauuuguguaggaaccaauggguaaagauaaaacaguugaaagaaauuacaaaaaucuccuucauuuguuuugauuagcugguuuucaaauguguucaugacacauacauaaccuuguacauugaauacguuguaguuuucugcauuuguuauggaaugugcuuuuuaccauaaauucuaguucua

SEQ ID NO: 3135 - RNA, 1541 nt, Mus musculus
uagaacuagaauuuaugguaaaaagcacauuccauaacaaaugcagaaaacuacaacguauucaauguacaagguuauguaugugucaugaacacauuugaaaaccagcuaaucaaaacaaaugaaggagauuuuuguaauuucuuucaacuguuuuaucuuuacccauugguuccuacacaaaugauaaggcggggaauggucuagcauauuuuaguauauuacauuuuggauucuacaaauaugaaaguacacauuacagaauauggaaauauaaaagucaaaauuuguaaagcagcuugagcccacuaaaucuuaaguguauaaucauuaauaacauuuugaaaaaauguaauaaacaacuuuauuuuucuguguuaacagcuuuacauuaauuuuucuuguaaucuuuuuccagucugucauuuuaaauuucuaaaauuaagcaguaaacacaacuccccugaaaaacaaguuaacccaucauacacaaaaugaagagagggagaauuuuaugugagagugaacaauuuccaaacugguuaggaaagauugacuccacauggucggguggauccugguaagaagcuuuucuucagaacuuuucacauugagugcgccuuccagaauucccaaacugccaaaggguaauuuuaauauuaaauagcucgaggcuacaaucacugucaagcucaaagauuuuguaauacugagacucccucauaggcaauuacuucaaacaacaaaggacgucuggcacauccucggggaugagagucgguguacagaccucuccgcucuuccccaagcuaggaaccacaccaacacaagcauguauccccacaucaguguucacgacuccucuaagaauguggaagugucaccgccauuuucgacgacaucccagggccgacaaucucggcuucggugcucacuggggcgcuuggcccacaacagcccgcacaccccgcucccagcccccugcaaggaagcucuuccagcccgacuaagggcgcacgcggcccgcggggcuccgaaaggcgcucgggcacgcggcggucuucccgcuagcugucaggccuggggagcggcagacccgcggcgcuggggaaggggcagccggacuccccgagggcgccgcccgcuccuccucagagcagcagcauccggcggcugcgcccacgggcacugcggcgcgacggcgcggucggcgaguggcgaggggaaacaggccacggccgaggcccacccggggucccucagcuccacccgccccgccgccgccaucuuguacgcagcggcugcgacacauacaauagucgaccgcgaccuggcagggaccgcucggggccugcgcuaaggaccucugccuuccaguccccggcuccccgcaaggcagcggcccuaccuaugccuaccgacuaacagcuggaucccauccgugccccacacaguuuagcacucggccuccagucaccgcgaugaagcagcuaccgccuccaugggacuacacgcaugcgcaucuucgccuaaagcccucg

SEQ ID NO: 3136 - RNA, 3534 nt, Mus musculus
cagaggcccugcuauaaucaugucaucuucagggacuuaagacccaucaugcuggacuuaggguaucagauccuaagcauguaccuccacagccgugugaggacucugggacaagggcugggacaccggaaaaucuuacuaaguggugucuaacugacccaccagacagagagaaggggauccaagucggaagccuccugagaugaggccugaaggccacacagaagagcugaggcccuugguacccaggugaguaaggaguaagaaccaugugugugaugugucagggggucaggguggugugugugugugugugugugugugugugugugugugugugugcaaauaaacaugcagauaggcacacaccagagccugaauucagucuucuuccuccucugucucugagucagaccuagagcuagaaggcagcaguagagagaguaaaggugacguagagaugacuagauccaggaugcgugggcaugaaaccccaaauccaguccuuacuggagcaaacaucaggcuagucacuuuugucuuugugccucgguuuucccuucuguaaagugggacaaugagaguugcuaccaaccgugcuugcuacuggaccaggaggugguucauguuauaggcucuauucagaagcgugucagguguaauaagucuggauacucaucauaggauuuuuguagccuuuuacagaaacaguuucugaaaaugaugucuugcuuguuuagccaauguccacuuccccuccuugugauaaagacguuaagaagucagaacugggagguguaguauaggccuuuaaucccagcacucaggaggcagaggcagguggaucucuguauguggccauccuggucuacagaguaaguucuaggacagccaaggcuacacauagaaacccugucucaaagaaguuaggccccuccaccuuuggguuauuugaccuguauugcgauccuuacaaccuuauguucccucuccuagacucaacccuacacugggcauccagccugguugguguggguggcacauggcacgcauuccaugugcccuuucuuauucacaggccucuugggaggggauucucuggcaaguggaccaccuuggcaaagcuccuuggcaaaaucucucugggccaagucuuagugaaggggauaauagccuugcccuuuaacccuguagaccugacugaauuuacucucccacagagaaucugugagauauugugaccacgucacugggaaggcaggucugggucagcuagggagaauaggcuucccagaagugcgguucacauuucucugccucaggccagaggcugcucuguaaucauucaccagccuggcccugacggagaacagcagaagcgugagcaagcuuaaaugcugcaagacacccaaauuuagacauggguuaagaguuuggcuaaacgcaggagguggaagguggccagggccugggggaagggaaagacugcauucuccacugccugacaaugacauccugggguuaugcaucccagccagccugcuucucagguugagagcacagacaacacacuuccuuucuggacagugagcucugggauccaggaaaggggaacauacccagaagagccaggcagcagcuaacaggaggacuauggaugcccuccccccacagugagguugaggaaagauccagacaggucccuggggccgguaacuaccagcugugcuucuggugagcuagaaagcacucccauucauuauccccacacccaccccacccccaccccccacuccucuagccuuccuccuacuagagcuccugagccugcccugggggaugggugggcaggagaaagagaaggcaaugaaccuuugcggaguucucuaagcucuucaucuucuucucuuagugcaggcugcuuuccaggcugcccacccugggucucuguccaaagaugcaccaaguccuacacugggcacugugugcucccaacacaccuacgugugccaugcuugccucaagccuucagaugucccagggacuccagagugugcacacgcuugugagcccaugugcauacuugaugacuggugacaccaaaaagggauuuucacuggauggccaggggcagacugaugcucuaaucuccugggucagguaugaagggaaaagaggacuagccgggaaggaaggcagagaaggaaauguagagaguggguggugaaauuggcccaaacccuugcccucuacuccugauccccauuaugucucagagcugggagauaaacuaaagagccagguccuggucuggucccgggauagggaaggguuguccuggaaaagcaaacacggccagccuucacauccuaaaagaaaagcgcaggcacaacucugccaaagcuugcuguggaaagucacaggaccagagaggagcaggcugucaagcauuaggggaccccagucuaauaaagccuaaauaacgcccccgccccaaacagguguuacucuguugacaguaagggagacuccuaaagauugauaauggugacagcuaaacuucccccacuauggggugggaaaggggagagagggagggaaagaaagagggaaggagggagggagggagagagagagagggagagagaaugagagagagagagaaugagagagagagaaugagagaauaagauuucuggaggcguggcuguuugcuucaguggcaggcagucugcuagucuagcuucugauaaugaguaaaggcccggggaaguuauaaauagacagaggccagggccuuccggggagaggagcagagcccugcuucacaggauugugcagccaagaguggaaagacaucuuuuaagggauccagagaaaagaguaguagccugcccucagcccugguccagcugaagcacaguugggccacuucuaucucacagccucaguuuccccugaggugccccaccccucuucucugugucuuaucgauauucaacguuagucagguguuguuaggcagucuuuuuccuggcuuccaggcacucccugaucacuccuuaggauacuauucuggucccgauagggugccuggcagggucuccccggcgguccuaccugcaaacaccgcggagcaguaggcaucgcugaugucggaguccgggguguggacauucuccgcaaaaaggaugaagacucgcagcaucgcuaagcuggaggggcagggucaaggcgcaggcggagggcucgccccaggagcgaggccgacuuggaugaauggcugccggcucacagguguugcccugaagaggaacaagcuaguccaggcggccccagugggcccccgccucggacggccucaccccgcuagucagagugcguugcgaggagaacaggggauucuguucauuucccacccccgcaguuguacuccagcuccauggaauuguaauucaaugccccgccaccagcuuucccaaugacacggcacuuugccuuagacccugaagcugcgggcugggcggcggccgc

SEQ ID NO: 3137 - RNA, 22497 nt, Mus musculus
ucucuucgacagugucccugccagccacagccagccuggggcacugcccauaccccaucgccaucgggcgggcucuuccuuuggacacagcugccaguugcgccccuuccaccuucuaucggcaaguccauuuucagauugcuuuagacuguauugguuguagggcagaaggaagucugggcuuggggcuuugauggcggaggaugggaagagucacuucuauaaaauaauuccuccugggcaaaguguuuggagccaaggccuccccaggugaggagugugaugggacuuggcugccucccagggaaaagagaaaguucuuucccagagggcuguagaugggugggugaggggccccuucuagccgggccugucugugaaguugggagugaggagucagacuccugccagacugauccuuuugcacauggacuguuauugaaaaaaaaaaucaagaauauugcugaagauacauggguguggguaggagguaggggcaagucuccgcaagggacagagaaaaggacggccugaaggagaaaacggcagaaauugaauauacccuuggauuugguagcagugaccagaaagaagguaccuccaaagaggcuggggcuggugagguucaggcaaguggcauuugugaggggcuucuugaauucucuguacagccagacagcccgcuggggagugggucauuuaguucugugagcucuagagaggcaauucuuaacacuggaggugauuuucacagcagcuuggacagcaggaguccagccccucucucaagagcgagggcacacuuaugcgguguccucuaaccuguccuugaguuucugggcaccagagggcuaccacuggccuuguggcgcccguucuggagaacccagagaggcagggugaugggcaaaggcagggagaggaacgcucugacaaaagccgaaaucuagggugggggcccuucuuaucugcaggacuuuacaguucccacccaagcucugcaaaagggucugagcagaaccugcugacccagggcuuuuccagacaagggacucaggauauggggggggggggggcagggggaggaccucagaauagaacaaaggcagucugggacccuaugagguuagcuuuccaaagauuccuuggagcuaguggggcuacagaacucugggaauuaccucuuuuauucuuucagcuauacuguccccagacagcugagggacacuagacgagccuaguuggucuuuaagugcccaggcaugcuucccacccaccacugccuggccuuucgguccccacuuuacucuugcucacauuuuuauucuggcuagagaaaugaaaagcuuuggggugaagaaauugaagcauuaacugggaaaaaaucagggccuaaacuaugcaaauugaguacaaaauggaggguuuccuccauuuaacagaaaagugccccaacucaggggauauacuccuguugguaggaaaggaaacagagcgaaacugugagcaguguccucaucaaacaaauauacaaaucccucuacaaaauaguguuacuuugcagugcugugcgcaguguguggaaaggaugaucaggaaugcgcacagagaaggguguggaaggggagcuguccucucuacucuguguguaggaagcuggggacacagagccauccuggcagcucuguguccugagaaguaggccuugagacagacagaucugugcuugugcagguauuucuagagccccagaggaauuugccuugcugccugucuucagccucgaacagugccugaggccuacccuucauauuuucucaggcucagcuaccaagccuuacaaaugucacccaggcagagccucccuugacacaauguccccugacugaggucccagucugcuccagcugauuucaaugugccuggagugcucuggggacacucccugaaccugggcuuuggugcaccuugggcaggaguuggagcccuagauguaucugggcuguggaaaggguuuugugaguugcugagauuagcaguauuggccuggauggggagggaugcugauccggggacauggcagaucauuucaaguccuagcugacagaagcauucugaccuagagcccuagccuacuccaggagacuuauggguuaaauccuagcuuaacgacagcuuguaagggaaauguguucuguggccagagcuggaccuggaaaugccuguuugcacagagccucagccuggggucagagucaguaugucucagugaccaggauuaaggguuaaucuggucaacaauuuguuuucuggcaugggcuguggaccaggccugugucuggcaccaucagaaguccaccccgggcacuaacagauugucccuccuguguauguggcucuuggccucccuuugugcugguagcgucuuugcaacuucuugucagaugcagcuuuccaauccaccugcagcaccuccaagaagccuuguguauuucugcagcauacauuccuuccucucuccuccuccucagcacgcaggggacuugaagagaaacacgucccaucaggacacacugcagcuguuacagugaggcugugugucccccaggacauucgccagagcagcacuuggcagcucagcaguaaggacuuaggaccccuuccuuuccaucccaacucccacuccacacuugagugggaagaaaguccaggcagggggagcaaaauaggcuccaaagccaaaguguguguguguguguguguguguguaagacaguacaaggaaguguggacuuuugaccccagagugggcagguccucuggauucaguuuggcugcuuagaaagaagcauuuccuggcuguggacaaggaucuccuguguauggccuuguagauuucaauaccuauuuccaugcagccucauaguagaccuucauguggcuguguucaugucccuuugcccacagcgagauggccccaguauuggucuuccccuaaggauauuuugccuggaaauacugguaaacuggucauauucauaggguacuucaagacaucaagguccccaaaacuucccaagccacacucugccauccuccuagggagacuggacuagcacuggccucgcugaucuugcuugcuaagagguccuguaaaguaaaauucaccuaagcaaacacuccccagcucucuauuucuggggucacagugguucugaugugacuucgugucccgguuccgacuguccuguggagauggggcagccuuaggauucuuaaacugaaccccugggaauaucuucaggcugucucuuuggagcuuguccccaguuaggaaaagauauuuaaggagggggaagcugagacaauaugcccugcggcuguaguacuaaaacuaaccaccaggugggguuccaaggcagagagugagcguggagcugacccagcgcuugcagccagagccgggcugaaagagcucugcuggccgagucaacuucaguugccgcgcucucugggcgagagaccgcgcgcgcguagacgcgcaucuuagacgcucucgcacauuuucugauagugagcucuaaagcagauccuauaccggaugcaggggacuauuagcagaguaggaugauuaguuuacacgcucagcacccuaaacugcagguggcaugucuaggaugauuucuuuuuauuauuacuaguauuugcuccgggagugugggaguggaacaagaagacuagacgucuggggaaaaccagaggcaacggacagggagagcuacgcgcuacucaugcaaauacuggggccgcugugugcagcuccgucccgggcucucaggagaggccauauaacaggcagauccauggaugcgcagacacauacgguuauggauagacucucaaacucaaguucucuccaccagcgucuggugagagcacaugcaggugccacaaucacaccccacauaggauggggcucuggacucuccguggcuagcucugagaagguggucgcgcucaguggcauguuuacuuauucacacauaucugagaacauguguacaggacucccgcggccucuggguacaggaccacugcacaugugucucaggugcuggacacuuuccaggaccagcacuagugacuuguuaacguguguguguguguguguguguguguguguugugguccucaggaguguuagagcauugguagcccgggacucacacaggcacagaagacccuccaggcauuggaugguaagaaacauguggaucuagacuacugagguuuguagaugcagauauuaggaaugcggacccuggcuauaggcaaucaggagggaauaacauguaucuuuugaguuugccgggucccacggaauuccgcgagauggagucuggguagagagacuucuggcaacucccaaucgagggggacagucggauaaggaacuuccacgcagaacagccaaaagcugggaaccagggaggggauccaggagggagaaaaagcaggaguaaaguagcuuuauagucaaacuagcaucaagagggugcgcaccgugugcgcuccuguguaugugugugugugugugugugugugcgcgcgcgcgcgcauuagugugugcaugcgcgcucgggcaugugucucaucucauccguuugaaggugcuggacucggcgagacccgggcgagaaggaagagaaggcgcgaggugaacugaguuugauccugaggcgccuacaaguggguccccggcgggcggcgggcggggcggcugggcgggaggccggcgggagcucacacgcucggcagccggccggccucucaccacgccucccgcuuugugagcgcgcccagggggggugcuggacgcgcgcccacggcgcugcucccgccucuauauaaacacacgcaucgccuugccuuggaucaaaucagauugagagacgcuuuucaaaccaccagcccugaaguccugccuccugcuuuccccuucuuucaucccuuuuugccuuucuuucuuucuuuccuuuuuucccccccucaucucuucucuuuucccuaacagcaacuccagagccgagagacugcgucccgggacagacugccuuuucuuaauugauagauagccgggcucggguuuucccaccuccucccccaaccccaccccgccuuaccccucccucccgccgccgccgccccagagcccgcccggggcucugucgccggcugcgucccuuccccgcugcggcucgccgacuccgcacucgcgcucgggccaacgcgcccgccugcccgccuccgagugccgcggccgcuccagcuucuacacucgccucaucuggggagucuucucccaagcccccaaaguuucuggguucguuggaauuuuugaauuccgguuuuuuuuccuucuuuuuauguaccuaggaaucuuggaggaauaguuuugauaaauugaucgcacuuuccgcuagcucucgguuccccuucuuuuugccccccuagcuuuaagcaggaaaggggcuuccgagagauuccugguggauaaaguuuuccaaaguuuuucgugugugaugguugcugggagaacaagcucaccagcuuaacucagcuccaucucaccuccccagagcccgccuaaagggacaaacaaacaaacaaacaaaguuacaccucgagucgccucgugucuucucucuucuuccaggcaaucuuuuuccucucucucuucgaucaccucgcagccuccagccccuuccccucggccccaucuccuggguuucuccgaggggugccaggacccccugccgcagccuccccucccccgucacucugguccggcccuccccucccccaucgcggaccgcacagccaaucccccaagcggcugccaacaugcuguuugaaggcuuggaguuggugucggcgcuggccacccucgccgcgugccugguguccgugacgcugcugcuggcggugucgcagcagcuguggcagcugcgcugggcugccacccgcgacaagagcugcaagcugcccauccccaagggcuccaugggauucccgcucaucggagagacuggucacugguugcuacagguaagcgcucucucgaggaguccgcuagccgcggguguccggccagggggcgccgagagcucggacacucggaagcaccgguccccgccccgccccuuccuugccucagccggcgccgccuggguuuccccagcucgccugcagcgcggcucagagaccuccggcgcccugugagcuaguuaacgaggccgggugagcuaguaagagggauauugaccaggguagguagcagagagggcucccgagugugaugcuccgggcugcaggcguccaagcaggggugugcggagagcgcuggggagcgagucuggagggcuucgcuuaguuuucaccucugucucugagccccaguagacuuuaguguccuaggcgcgggagagguagaagaggagagggccuguggcagcuugaguggcccacuuuaagaccugggcagcauucugcaguacauugggcucaggcucagguacaacugggcuaguacaaggugcuacucaccucucucucccccuccucugguguguguguguguguguguguguguguguauguauguauguaugcacgcaucuguaucucuguguugugguggcagagaaaagaaaaccuuagagaaauucaaggcagagaguugagggcucucagcuuucggggggagaaagggucuguuugcuuauuggguggggacaguuuagcagaggauagcuaggagaaguaugcaaaagacccagagugugcccaugcaacuggacgcuucacaacuccacucuggugacaauuggggccaggcgcguugaggaccaaacccagguagguagcaggcagauuaaccuggauuuaaccucgucuaacgcuagacaaucgcuuauugcaauuugauacaccccagguuguuugagggggguguaccucuaggguaacugagggagguguguuuaucaggcgggugcucauggauuuuagaggcagccuggauauccugacacacacaaccccgacccccgaaaggagaaaugaaaggugagcgcgcgcgugugcgcgcagaccaauggguuuagacgugugaaagcuuggcuugaaauuaauagacgcgugcaguccgugcgcgugaacacacacacacacacacacacacacacacacaucaccgcgccccgucggggggccgagugacaggagagaagccggauggaggggcuugagagguuccccuggaucuuuccaugccucacaauuggaccaucuuuuugggggguugcuugccuaaucgggugggguucccuucaaccaaucggauguuucuuuagagacaagaucucuuucgccugcuuuuucucuuucuuuuuucuuucuuuucuuucuuucucuuuucucauuucuuuuugucuucacauuuaaagaguuaacuuuggcagugguccaagcuuuagccgagaauuuagaaaauaaaauagcucaaguggcagcauuucccgccuguuuaaggcaaauccuccgaacccugaacccucguucucauccuguuuccugaccugccccucccccgugucccuugccauuuuucucaaucucacacaaggccccuugcggguguggugcagccagcacaaaaguuggagaggcgcuuuucgccugggcauccgcgucccugggggucaaaucccucgggaggacagacagcgggugcugaagggguuaaaagcgaacccuccgaauccgguguuuucuucggaguaauuuaucagauuuuacgggagaccuccaagggcucucgguuuccacuaagcaccaucuaaacagagcccagggcuaaaaauacauuuuuguauaaauuggacucgcggcccgaacggccgccccuaugaaaguccucuuugugaaggccguggaaacggcggacaaauaacucuuuauuaaagccacaaaaaacgcacuuuaauuauaguuaggcagaucagaggcgggggugggggcaaggcggcggcgaccucggaaaauucacaacccaacuuuugugucgaaagaaaagaaaaacagagggaaagacgggagaggagagaccgagugagacggagcgagggagacugcaaggcagacgaggacgggaaccccgcuccgcgccccccucagccgcaccccaccuccgccccgaccucucuuaaaggagccggcgccgucuaagcuggcgucuggauggaggcguccccaaaucggccccuccaggcggugcggggguucccggcuuguucccugucgcgcgccgggcccagaagcauguggaaaagccauuaagaaucuggguucuguagccacuuuucgcaucuggggcguguucacuucuaacuggaguauauaguuuccccgagagaaaggaaaguggggggggggcaacccaggaaagggggccuccugucuccggguugagggagccgacguguuccuaggagaccaggacgccaaggcgggaucccuugccacaguucuccuggcuggcuggagagacuggacaggugguucccugccccguugcacccagugcguccuggcaggagaaggguuaaggcgggccggguggcgagugcgacgaagguuuccggcaccgcaggccgcuggccguggagcucagagcucggccgagggccggcgauccgauuaccugcgcggguuaccgcgccccaucccgccgccccucagaagcaccuuccgggugcuccaguuccaaauuuaagggcggagacgaaaguccaucccaguuauucccuggacaaaugcuucaggagaguuguugcucuggacccaagacuccacccugcggagcccacgaagggccacaccggagcagagaggaaacuccaacccccuucucuagggacagccuccgggcacgcacaacucgccgcuauaaauaaucuuuggccugcggccaccccgcggggucucgccagcccguggccuggagccuggaaauauuuauuccgagaggcuccgcugcgcaggggugggggagcaggcuccagcuucagguucagcugucggggauacacgcccccaccucaagucauuacuaaacgcagccuuccgugggugccccugcaucuccauccucccgcauuauuuauuacccucuaggccccacuucccaguccuaaugcaagcugcgaaaaauaaaaccuguaaguguguguguguguguguguguguguguguguguguguuggguguugcggggugacagaaaccggguggcgggugccuaguguggggcaagaugaaguucccuacagguccucagugagcccugagaggcuucuggugugguucccacaggguuccggcuuccagucgucgcgccgggagaaguauggcaacguuuucaagacacacuuacuggggcggccgcugauucgugugaccggugcggagaaugugcgcaagauccuacugggcgaacaccagcuagugagcaccgaguggccgcggagcgcacgcguacugcugggucccaacacgguggccaauuccauuggcgacauccaccgcaacaagcgcaagguaagaacucgaaccuuugccuuaggaguaacuaacugccugcuguaaggggcacagauauuugagcuucccugccuagaggauuuccagcccgaauccggucucugcuugggccucuucuugauccacucugaugcaccuucuggcuagcccacugcacgguggacaccacuagggguaauacggccugccugcggauggucuggacaaagccuguacguguggggucugcagugacggaugcaguugcucagugcaccacucuacuggaaaagaagggggcggggcgggcgguuguuccaccccggacuccccaccaccuuuuucucaaagcugccgccuaaagaaugaucgcgcugaaaaccaaaccuggccuagcagccacagguugcauggaaggcgagucugucauguguugcuggacugaagacacccuaugggcagcggucucccaggcuagccaagggugggcuuggggccccugcuuuggcaggagcgcaguccggugggggaagggcaaggggugggcgcaaagucuaggugugcugagguucaaagcgcacccacucuccagaaagaggaagagaaaguggguguuuauccaguggauuucccgagcuagagcaaagacucgcagcaggcaagucagcgcgcacgcagcacgccuccccgcccccuccagcugcgccgccgccaccgcugggcugggagcgcgggcggcacgugcuguuugaacugcaguaacccgaaggcugagccugccggcgggcggggcgccggccuugagcuggaagccgccagaaaggaggcuguaaggcuccuucacucuguuuuuuccauugggucagaggacucccucagguuuggaaccuaaaaagaagaaaagggggccucuggccucggggaggagcgguggaacaaggaauagggaagaaaggagaccgcgggaccaugaugucugggugacuggggagcagugggaaugcucacuggugcugccugggguuuccuguucucugaaucgaaccacucuguaaggaagcgaaccuucucuuaggaaagcacaagagggagagaggaagaaaaaaaucaaagaggguguacgugucucccaaaaauucuacagaaaggcucgcuccgaaggccugacuggaugcuagaagcaguuaacacagcuugcuggaacaugggggaggggcugggggacaguggcuucucagucucagaggcucccucaaagcuuccuugccuggaguugagaccuucagggaacccagcuccaagccacugagugcuuccucacucucacccagaggcaggaugcagacggaucucagagugagacuugaaccagcaaagucaucacucagccugccucaccaacuccugccugcuggggcugcaggaagcugaggugagggaaaggugcucagaggaagaaagcuugaccaagaaggaggaugauaccuaaucgagcagauagccagcacagcucugaugagaugaguaacaagacacuaggacucugcagucuucagagcuccugccuggccuucuugcucuuagagauagagaaaggucagaggcuagcacauacuugauccaggcaggaaugaaacccagagggcugugugcgugcuugcuguuugguggucacaugaguaggacccuuccgaggauccacgauccugaguuuacuggauuuuauagauacuaagaagcaggaagcuugauccuugaccucaggaaauaggaacucacaggagggacaagaauugaguacucaugggccauggucaugaauguccauguugcccugaagagaugggacaaucuugaggaugcaaagucucggagggcaucuucuggccagggugaggcuuuugcagcuuacacugcagugagggccaugccccagccugguuaggaugaacgugcaggaagagggggcccaggugugcggggcacgacuggcugagaacuaggagagucacuguuuccauuggagugggugaccaccccuucucugggaggucuaaccagauguguggggagaggguuccucacagccguugcugcaugcaccccacauguuggcccuggcugcccugguggucuagggcuagcuggggcugccuggagaacucaagaguguccccacucggguugaaucaccugugaaagccaggccucagacucccuccgugucuccuccuuugggaccccucccaacucggggcagaggcuucuaucugacagacuguaugguauggaauagcuggccugaugcccagggaggaugggaggagucuaguugagaagguggagacaagaaguaagagacaaacagaaauucauacuucuggaagccucuggucuccggucuccuuucuucccugcuuuuguucagagcuuuugcauggagcugggucuuagcacuaagagacuagcaacuucagugugccaaacagggucccaagauugcccuggagagggaagaccccacaguaggauuucugcccagcaggugagcagagcccagagugguccauggaaauaaaaucuugggggaggccagccccacucuacugggcuuugggugccucuagcucauuacacaggcuauagccauagacaugaccacacagaucuaggcuuggcucugggcugaagcucuaagcuaauucaggguccaugggcagguggguaacauagccugacagccuaguuccaggggaacaagucuuuguccuaauaggugaaguucuucacccagaaguuacuguagguccugcaaguggucccaggggcugcugagagggcagggggcaggaguggaucucuuugaaggucagugggggaggaagcccaggccagcugccagggugucugagugcgggcgccucccgcugcuugcccuuguacuggguaacaggcagggugaguguggaagcuucuacuuucuguauucccuccuugugguauucucgguauucucuucccgagguagagagggauccagaacucuggugucuccucgaaguccuccuugguccuucugcuggccccucccccugccaguuuuggaagagauaaauggccuugguggggacagcagaggcugucuuuucuggcccugagcccuaaugccaaccauuguagccauccuggacucuccuggcccaaaagacuggugugaggcaggggcuugaggauccugccacaggguguagacagucacccuacccuaugacuuugggaggcuuuucccucauggcucucagcuuuccaaagggguuuugugguuggaagaugguaggcaaaugggcagucaguugcucccuacccuucuaguacuuugguugggguacguagaagaguuuagauagcaugguacacacaagggggggggcauaugcagguagggaagggcuugggugcuuugucccacccugucugaccagaaaugaugagugaacacagcccaagguaaagggaagccagguggcauugcaggcagcuggagaacuacucccuccuuagucccccuccuuacuggaguauaaaguacacaccuuggcgucaccccuaugcagaccgcugccugccuucuguuauucuuuccacuccacaggcugaggcuccgguggcuuggcuggguggccugccuggcccccaccccuccugggcagcaacuuccauuccucuucagcugagucacuggcugggcagugggcucccucuggggcccugcccucugcguggcagcccaccaaugugcccaucuauccucaacugcaggcugaucaggccaauacgacuucggagggagcugugggcuuuacaaggggaccucccaucccagagacagcagauuagaguugagaggaagucuggcugagagagaaggcaucuguaagaacaauuauaggggauuuagacuuugaggagcucaggugagcacuccagacccuaugcauucaaguucuaaucacguggacagagacagaaaauguagguaacuguguuuuuggggagacugaggggcccugagaguguucucuaaggacauauuuaaaacagagcccaugccccccccccucggccuucuuguaauucuauggguauacugaggugaguguucuggggucuccaggacccucucucucuguucuugcucucccuggacccaucccuugcaaaguccauaccuguggcucuaucugcugugucuguccgugccuggcugguccccaugggccuuuuuguggcauucuuggcuucauuaugggaauucccagggaagaccccaugaaagagaaaacagccuggccacuguguugccuguggccagggccaauguuccugggccagaaccuucuucacacugagccacucccaggcaucuuccucugugccccaggccugaccccgguggccagagcgucauauccaacaagcugaugaggcucaggccucgccccgcccuggcaggcaccucugccuguucuccguggugacuggugguuucuggucugccuggcuuugggaagugcccgccuuguuagcccugggcacacacccagagaugcagacucggcaccuucccagagccugggaggccccugugucucuaaaggcacugaagcagaggcagggccaucgacuuagugacucugaucaaugcuggagugacugcugcuagccuuugccuggucuuuucaugacugugcuuucuccaccuuuuggaagugggaaagaggaaaaccuccaaugagaaguggggacugucuggguggaaagggacuuugaaauauuuagauggacuccccauaaaaaccaaugggggaacaggccaggaggagcagccgcaagucagaggauggucuagacaagagcccagggucacuccucuucucagggccccaggaggacagugcccaugcuuccugguuuuucucaggaccuuuucccauuucagggcaaguuuagacaccuugccguagaguuccuugcucacuccccccaacccccacuccugccccaucccugaaucccuugucuuucuggguugucucacucuucaugggccccuccggucagagaagugauucaguuagcuaucgcuagagggcgcagggauaggcaccuaaggggcaccagggguuuguccaugaucuuacuuuccccuucucaggaugcccccuuuugucagccuuugggauuauccugucccaggcccccagggucuuggugagguaugaguacagggugucaggcugucuccaaagggcucaaaugucgagggacuguguugcccauaaagguuucaucuuagagaaaguagaaguaggugcuaagaugcuguguaucuuggaaaugucccagagguuccuuggguaggucucaccaucuuauggauuaagaaacugaggcccugggguaaguaucaugaucauggacacacacugagcuggugacaaauccuuuauuauaaguuaggcuccugggcauccaaucagaccuuccuugccauuuucuugcuguauccagaaggcuugcuugguuuuggcuggcccugaugacaguggcaucucccugucccuccugcauaccccauccuugaguccagauuuccccugggccauuuccuacccugugccacuuccaggagcuugcugguucucaguguggugucacuauccucuccuacaccauagccagcuucuccaguguuuggucacaugaguuacccucccaccuccccucuguguuuccuggugaccccacuccaaagcucugcucucuagagcccacuguuggucagucucugauuagauuccuaggggugaggacccacucuugcucccucaccaaagccccuuggccaaaggaugaaccugguccuaagaaugccaggacaagggcucaggcacccaauacagucuuccucuauaacccuuugacuauugaagccccccaucaagaaaguccccaaacccccuaaaaugggcaagugugggugaccuagaggaccuccugucacccuuguuccuccaggcuguuccuuggcagugagacuggucugggcaguacgguccucugccccucacuggccucccuccccucccucugcccacugggaauuggggaaugaaagugcuauugugcgaaaagccugggccacugaagggccagcacuguuauuucugcaaaccagcccucccauuagccaugcagggcacaggccaggaaaauguuaccuuuuccuccaugagccgacugcaggggaaauucucacauuuacaguuuguguggugguuguguuugggggcaggcgggagggcagugcgcuugugugguuuuguaugggcuggugggcauccuccccuccccucucccucucuuaccaguucuggggggaaucuccugcucuggacuuguaucuggggguauaaguagaccccucucuuggccagagaauagcugugugaaaaacaugccguguuuggguggaggcagggcacugccaaucaggaggaugaguacaagaccaggggauaggaucagggaaccuugguggucuuagaagaugcucagaauuaaagggucuucugucucuaugaucuucuagggguagcaagcuauugucuagaggccugcccauacaguagauguuugagugacacagccucugcacuuccuagagucuccacucaauugucauuacuuggggacugaugacaguuugggucccuagcaaauccugcuuucugucuagguucuguagggucuccugccugcucaccggcggaggagaggagagcuaguugcuucuuuccuacaugugcugugaccagacacucaucccacuucuccugacacuuccuccuguggggccccaaggcugggagagccucccacccuuuuacaaacacaggugguaaacugagggcucaguacagggaaccgcacaggggagcuggguugaagccaggaagcauguuaggguaggucccuuaccacuugccucuggguccuucaggucuucuccaagaucuucagccaugaggcacuugagagcuaccugcccaagauccaacuggugauccaggauacacuucgagccuggagcagccagccugaggccaucaauguauaucaggaggcccagcgacuuaccuuccgaauggccgugcgugugcugcuaggcuucagcaucccugaggaggaccugggccaccucuuugagguauaccagcaguuuguggagaaugucuucucucugccaguggaccugcccuucaguggcuaccggagggugaguacuguaugcgugcgugcgugcgugcgugcgugcguguggaaugggaaagcauaggacugccuuugggagagaaaugcacuaccggaugaggcugggagggagcacagggcauuggagcaggcagaugagauuggaggaggcaacagggugggucuggagccuuugcugugguccaggggcuuagagugagcccugccuucaagacaagcugaugguccacacuuuccccuagggcauccaagcucggcagauccuucagaagggccuagagaaggcuauccgugagaagcugcaguguacccagggcaaagacuacucggacgcccuggacauucucauugagagcagcaaggaacauggcaaggagaugaccaugcaggagcugaagguuggugggcagugccauguuccaccauggaacgcccuuucucucuccccucacccagagcagaggguuaccuggcugcuuucugagcagcaguggugguggcugccuugggcccagcaguguaguggaagccacaacaguccugagccagagguggagcaacauccuugccauggcucuaaaggaugcuuggagcuguucuggucacgauagaacauggcuuggggcuguguacacuauauauuagggguggcaagcucuauccuacacauauccuucucuauuguucuucagauugguccuuaggccugucaugggcuuguuggcaccuccuauugagccuaucccuggguuacccccuccguucuuuccaugguccuaagaaaaaacaugaccagaagccacucacuggaggccagcuccagacugcaggagagguuuaauuguaauauggacucccuccucuuaaagcuucucuaguggcauuugauaauuuuguccaucccacugccucagcacagcugggccucaguccccuggcucugccguauguccuuacuaggcuuguucauccuaacauucugaccuccuuaccuggugucugcaaaccuccccagcuuccuggggaguuaaguagcaaguauccaggccuuaggaggaggggaccucuggucucauugcagucccuucuuagguccuccuggaacugcuuuaugcugccuccagauguugccuguccaccugcccaccuaaaaggcaccccucuucuggugauggaggaggaagcugggggcaauacccaauaucaacacacaugcacacgugcacacaugggcacacaugcauauacacauacacaaucucacacacacacauguacacucaugccuacacgugugcgcacacacaugcacaaacacacacagugcugagcgucugacuguauccuuugucuuccaugagcucacugcauuaaguaggccugcuggugcuggccaggaaucuagcacugagcaagaaguaaccuuaagcucuggagccagcaggcuuauacuucugccugagucacagcaguguguuuccacccgagcuagggaccaggcugugaccuacaugagccuuuugagaguaaggcucagagcaacacuguuagcaguagggcucuggggaaagcuagcagcaaaggucagccugagugacugcugcaaaggguccagaaugccuaucuucuuacugugcaggauggaacccuggaguugaucuucgcagccuacgccacgacggccagugcaagcacauccuugaucaugcaacugcuaaaacacccugcugugcuggagaagcugagggaggaacugcgggcccagggccugcugcauggcgguggcugccccugugaggguacccugcgccuggacacgcucagcagccugcgcuaccuggacugugucaucaaggaggucaugagacucuucacgcccgucucaggcggcuaccgcacugugcugcagaccuucgaacuggaugugaggcugggcuccggugcugguggcagugggguggcuggggcucuggcuagacgcuggggaaaggcagccguuuugggaggggguccucaguaaggugagggaguagggaacacugccugauuccaguagcuuucaguccugugggagaggcuucacccuaaaugcagagcugagugaagccaaccugugugccaguugggaugcuccugugaucuauagauauggagacuugaucuagcauucugggggagugacuuugguuagggacaggccuugugcauaugagaauucggacagguaaguggaccucuaggcucuuaccacccucuguccggucuuccuccaggguuuccagauccccaagggcuggagugucauguauagcauccgagacacucacgacacagcgcccguguucaaggacgugaauguguuugacccggaccgcuucagucaggcacgcagugaggauaaggauggccgcuuccauuaccucccguuuggcgguggcgugcggaccugccugggcaagcacuuggccaagcuguuccugaaggugcuggcaguggagcuggccagcacuagccgcuucgagcuggccacccggaccuucccucgcaucacucugguccccgucuugcaccccguggauggccucagugucaaguucuuuggucuggacuccaaccagaaugagauucugccggagacagaggccauguugagugcuacgguguagccucacucuggucucagcccagcccaacagcaggggugggggacagagauagaaaccugugggguggggaggggcugggugggaggccagcagccccccuauguuguucucuggccucuucccuggcagaaccucccccaaagacaaaagggccccgcccccuccugacucccucucucuuggaucuccacugccaccuagcuuagcuccugggacagagccaggacuguaugcccaugacaguguuagcgccggccgguugagcugcaguauaugcuuaugacaucugaauccuuccuucccuugcccccuugucuuuuuguuggugaguggucagguggcucugaaggcagaagggaggaaaagagggggccccuuggagcacucuuugacacccccccccccacgucccucuuucugucacugaucaaauggugaccagaacaguguucuggagauucucgccuaagccaaccgaggcagggcagcggcugccaccagccuugaggggcccauaccagccuaaccaguuuggacauuggaaauuaccuaucgcugcuauuuguccucucuucugaccuuggggguacaggagccuauaggcuuaauccucagcaucuuccuugguggcccuggacagggacaccggcaugccucccccaugggaccaacugagccggguggcuucuggcuauagcugggcuccccgcuaccuacccuugccccugucccauauuuauucacugaccuuggccagacugaggucuggagcacccucccccaacaccuacacaccgccauugccaccacacgcacacaccugccagccucuguccuuuccagggcuucagugaggcaagaagacagugugucuggucuaacccaguucuuugguagaggguuaacagcccugcugggcucuaggcaaaagauguaguuuaaccucagagucagacacccugcaucucugccagguguacuuagcaccuccucccaggcugucaaagcccugggcaugugggucuaggggccaccacuuccuguucacucacugccugucccagugccagccacuccccuggugaggaugaauaaggauacggguucuucugaagggacuucugucuucccuuccuuagcucucugccccuuugcucuuggaagagucccccaccccauaaccacucccaccccaugccacugucugcuaagcccagcccaggguuugggguagagaagaaagcagagagguaagguggaaagagaguccucucucugagcugcuucaggcccuguggggucuggagaagcugcaggggaggcuguagcuagaaagcaauggagaaggagaggaggaagaugagggcgauugaggucagggcauaagugauuugucagaagugguucaguugcagaaaggccaguggggguguggaagaugacuggguggaagacgagggauuccugccucuggcauuuugaggguuggccaugugggaccuuccugggaaggguuugggguucuggugugucucuaggcaauuuugucuguuuucagauuccccuucauuuuccguccauggcuuuugccuguuacuaagguaguggcucuuuuucuccagaaaacagaggcacagaaugacaguccauaucgaucugacccuggauggccacugucaugagggucagccacaucucaccagccacacagaacauccuaugagccacauuucuugauguuucacuggucugcauuuuuuuuuucugacagaaccagaacaaacuacagcauuagaaucccagcaaaauuauuguggagucaaacauagcugucagcccucagcucccuuucccuguucuaaaacaggccagacuguguaaagacucagcaaaguuuaugaaaaaggugcaugcugcccauaccccacagaccagugcccgggaggcucaucuuccugcacgcuaacccugccugccugcagccaucugcuucagacugacgauguggcaugugacucugguccuggugagggaugggcacuggggggccccuccaggcgucagaggccuucauuuucagggggccggccgaggaagugugaaggaaaagcugaaggggaucccugugggggugggaggaagaaaagauggucugcccggaugggucucagagguaacaggaaaagagaccucgccucagcaccugcggugugauacccgucucaccucuguagaugugucuguuccguguucgugugucucguugugguagcauuaaugggugauguagucucacauuccuaacuauuguaacuugacauuuaaaaaaaaaaaacaaaccccacaaaaauuccugccacgggcuugcagauugaagcacuuucaaaguuaggcgcuggcgugugcauccugggcagccauuuugaugcggcccagauuucuauuauuuuauacacaaaacuuuuuuuuucauaaauguuauaauuuugugucugucuuuauaaacuauuauaaguacuauuuuuguuauaauucaaaauagauauuuaguauaaaguuuuugcuguuaaauauuuguuauuuaguaaaauaugaauuguucuuuauuguaaacaugguucaaaauauuaauaugcuuuuaucacaguuguuuuaauauugagaaagcacuugugugucucguuuugguaugagcuggugcuguguguguguuuuggcugucgugugguuuugauguguauauaauauuccguguugcauauuacaacaaugaaugccaugcauuuugugaaauacucaauguggcucuuuuauuggcuuccguaauaaacuguggggacucacccuugucucu

SEQ ID NO: 3138 - RNA, 2788 nt, Mus musculus
ucacagauuuugaaaggacaauuuuuaacuccauauggaaacauacacacacauauacacaaaacaaaaacaaaaacaaaaaacaaagagagcuaaaauaaaucccaaauaauaaaauaacugcuggagaaauuaccacccccaagaucaaaucauacuacagagauauaguaauaaaaacagcaugguauuggcacagaaccaaucaugucaaucaauggaaucaaaaugaagacccagacauaaauucacauaccuauggccacaugauuuuuggauaaagaagacagaaauacauaauggaaaaaagaaagcaucuucaacaaauggugcuggucuaaguggaugucugcauguagaagaauacaaauagaauacaaauauuuagcacccugcacaaagcucaaguccaaguggauuaaagaccacaacauaaagccagacauacugaaccuguuagaagacaaagugaggaauagccuugaaugcauuggcauagaaaaauacuuucugaacagaauaccauuaguauaggcacuaagaucaacaaucaauaaaugggacuucaugcuuuugcaugacaaaggacuucaucauucagacgaaauggcagacuacagacugugaagguuuuuguuuguuuguuuguuuuaaagcaauacacauccaauagagagcuaauaucaaaaauauauaagaaacugaaaaaaaugaauaucaaguuaucaauuaacccaacuaaaaaggggaaguacauuccccuaaacagagaauucccaaaagaggaaagucaaauggcaagaaacuguuaaugaaauguucaacauccuuagucaucaaaaaaagugcaaaucaaaacuacuuugaaauuucaucauaugccugucagaauggccaaguucaauaaaacaagugauaguucaugguggugaugcuguggaguaaaguugaauacuugaccaccgcuggugggacuacaaacuuguacagcuauuauggaaaguauagugguuccucagaacaaugggaaucaaucuaccucaagaucuaacuuuaguauucuuggguguauacucaaagggugcaucauccuagcacagacacuuguucaacccuguucauugcuauucuauucauaauagccagaaacaggaaacaaucuagaugucccucaacauaugaaugauugaaaaaaauaugguacauuuaccuaauggauuauuacuuggacauuagaaaauuaaaucauaaaauuggcagguaaauggauggaacuagaaaaaaaaucaucagacccagaaagacaaauaugauauauauuugcuucuguguagauauuagcaguuaaggauaagcaagcuauaaucuguagaaccacagauguuaaguauagaguaaggaacuagguguauagauagaucucccuaggaaagagaaauaaaacagagaguuauggaaggauggauggaugaugcuggugggaggaagggggccugaaugggaagaccaagaggagagcgagagagggaagagugacuaaagaggggauauagggagacacaccuaaaauuaagggucauuugaggaauaguauggaaaccuaauacaguagaagcauccuaaaauauauacauauaugaaggcaauuuaaaugaaaucaccaaauaaugggagagucagagccccaacugcacaucucuugucaccaaaugaagcuuccaguauaaggaaugggcuauaucuaauugaguuguuggccaaaggggucccaugggagccuccaagcaaauuaggcuauagccaaggcuauagguuguuuuccacaagcccauggcaaagcccuauugcuguagacaacaccuacacaacucacugaacaugaaaaaguugagcugcugucuaccuagagccguugaccccuagaaacuaguguucuugguacccagaagguacucugcacacuaucgaaggagaaacauaaaugcaaccaagcuacaaacccuucaaucuacaaugguggcuugccugaaagaugugcuagagcaaugguagcacaaagcuugugggaguaaccaaccaaugucugauuuuauuggugugacuugugucacaccaccagauggaacccauaucagauccugcuuggguguccaagaaccagugacuagauagcccaaggaccuaggguaaaacuaaauacuacuguucuacuaaaggggcauaacaaugaaguacuccuaaugaaauucuguuauacuuaugcaucagugccuugauccgccaugaccaaacaagcuuccuucugcagcagguaggaacagagaaaaagacagccauauaauaugcaggaagugagagaccuugaaacacccagcccuaagugggaugucuccaacaauuccuuccccucagggcucagggaauccuaaagaaaaaggggugggaagaauagauuguccagagggaauggaggacaccaagaaaagaaggccuucugaauacaacaggacagcuacacauaugaacucacagagacagagagguagcauacacagggccuuuccuggucuguaucagauggaguccuagaacugaaaggagaggugggcacaugaucccaucccuaaccaagaagcuaucuccaauugauaaccacuugcaaaugaaaauucaguuuucuccgugggagucucacugggaaaaccaacuauuuauuuauuuauuuacuuuuuacuuuuuauuaguuauuuuccucauuuacauuuccaaugcuaucccaaaagucccc

SEQ ID NO: 3139 - RNA, 2788 nt, Mus musculus
ggggacuuuugggauagcauuggaaauguaaaugaggaaaauaacuaauaaaaaguaaaaaguaaauaaauaaauaaauaguugguuuucccagugagacucccacggagaaaacugaauuuucauuugcaagugguuaucaauuggagauagcuucuugguuagggaugggaucaugugcccaccucuccuuucaguucuaggacuccaucugauacagaccaggaaaggcccuguguaugcuaccucucugucucugugaguucauauguguagcuguccuguuguauucagaaggccuucuuuucuugguguccuccauucccucuggacaaucuauucuucccaccccuuuuucuuuaggauucccugagcccugaggggaaggaauuguuggagacaucccacuuagggcuggguguuucaaggucucucacuuccugcauauuauauggcugucuuuuucucuguuccuaccugcugcagaaggaagcuuguuuggucauggcggaucaaggcacugaugcauaaguauaacagaauuucauuaggaguacuucauuguuaugccccuuuaguagaacaguaguauuuaguuuuacccuagguccuugggcuaucuagucacugguucuuggacacccaagcaggaucugauauggguuccaucugguggugugacacaagucacaccaauaaaaucagacauugguugguuacucccacaagcuuugugcuaccauugcucuagcacaucuuucaggcaagccaccauuguagauugaaggguuuguagcuugguugcauuuauguuucuccuucgauagugugcagaguaccuucuggguaccaagaacacuaguuucuaggggucaacggcucuagguagacagcagcucaacuuuuucauguucagugaguuguguagguguugucuacagcaauagggcuuugccaugggcuuguggaaaacaaccuauagccuuggcuauagccuaauuugcuuggaggcucccaugggaccccuuuggccaacaacucaauuagauauagcccauuccuuauacuggaagcuucauuuggugacaagagaugugcaguuggggcucugacucucccauuauuuggugauuucauuuaaauugccuucauauauguauauauuuuaggaugcuucuacuguauuagguuuccauacuauuccucaaaugacccuuaauuuuaggugugucucccuauauccccucuuuagucacucuucccucucucgcucuccucuuggucuucccauucaggcccccuuccucccaccagcaucauccauccauccuuccauaacucucuguuuuauuucucuuuccuagggagaucuaucuauacaccuaguuccuuacucuauacuuaacaucugugguucuacagauuauagcuugcuuauccuuaacugcuaauaucuacacagaagcaaauauauaucauauuugucuuucugggucugaugauuuuuuuucuaguuccauccauuuaccugccaauuuuaugauuuaauuuucuaauguccaaguaauaauccauuagguaaauguaccauauuuuuuucaaucauucauauguugagggacaucuagauuguuuccuguuucuggcuauuaugaauagaauagcaaugaacaggguugaacaagugucugugcuaggaugaugcacccuuugaguauacacccaagaauacuaaaguuagaucuugagguagauugauucccauuguucugaggaaccacuauacuuuccauaauagcuguacaaguuuguagucccaccagcgguggucaaguauucaacuuuacuccacagcaucaccaccaugaacuaucacuuguuuuauugaacuuggccauucugacaggcauaugaugaaauuucaaaguaguuuugauuugcacuuuuuuugaugacuaaggauguugaacauuucauuaacaguuucuugccauuugacuuuccucuuuugggaauucucuguuuaggggaauguacuuccccuuuuuaguuggguuaauugauaacuugauauucauuuuuuucaguuucuuauauauuuuugauauuagcucucuauuggauguguauugcuuuaaaacaaacaaacaaacaaaaaccuucacagucuguagucugccauuucgucugaaugaugaaguccuuugucaugcaaaagcaugaagucccauuuauugauuguugaucuuagugccuauacuaaugguauucuguucagaaaguauuuuucuaugccaaugcauucaaggcuauuccucacuuugucuucuaacagguucaguaugucuggcuuuauguuguggucuuuaauccacuuggacuugagcuuugugcagggugcuaaauauuuguauucuauuuguauucuucuacaugcagacauccacuuagaccagcaccauuuguugaagaugcuuucuuuuuuccauuauguauuucugucuucuuuauccaaaaaucauguggccauagguaugugaauuuaugucugggucuucauuuugauuccauugauugacaugauugguucugugccaauaccaugcuguuuuuauuacuauaucucuguaguaugauuugaucuugggggugguaauuucuccagcaguuauuuuauuauuugggauuuauuuuagcucucuuuguuuuuuguuuuuguuuuuguuuuguguauauguguguguauguuuccauauggaguuaaaaauuguccuuucaaaaucuguga

SEQ ID NO: 3140 - RNA, 451043 nt, Mus musculus
ccagggggcguggcauccgagggcggggucgcgcugcggggugcuggcccagcggccgcagauccugggcagagggaucgugggguacucgcugagagagggccgcgcggcagcgcccugcgauggagcgggcgaagauggcggaggagagccuggagacggcggcggagcacgagcggauccugagggagaucgagagcacagacacggccugcaucgggcccacgcucagguacuggggcggggccgggucggcuggagcaggcggagcgcggcggcuggcuguggggagagucgcgggugucccgcguccugggcgaggcccugcuggggagcuacucugaggagaaagggugaggcgcggcucuacugggccgccgcucccuuugguuagcugcucuucagucaggagcaagcgccggcucugcgcgcuguggaacugcccaucacagguccuccgagagcgucccgguuuucucgguccuggaggaaguguccucccaccuucccucgccugagagcccaguucgugaggacgacccaguccagguguagucucaggaccuugccacuaccuggacaugcucugugcucccuccccugacaccuucuccgagagcuuccaccugcauugcccguggagaugucaggacguacccggccuuucucggcuuacuuaccuugcacuuguuacacagagcgugaggcauugugugaguuaaugugcaaacacaucuauggaagccguugagcaauccuaccgcugggguacaguuaccguucccucuguaucagacgagaugccuggaagaggagugacuuauccaaggucgcagaggaagggaaauggguuucuuguucccagcucagacacugcacugaacacccugccuuuccgucuuuuuaauuuuuuugugguguuguggauggaacacaaugucuugcagugugccaggcaagcccucuucagcugaacugugcacagcccacagauucuucgcuacuuuuguucugccuuaguugcggauugccaucugcuguacuuccuguugaaaauuauucagcaagcccaauuuugaacacccccccccucaguuuccugguguccuagaacuaguuccuuccaauccuuuccuguaguacuuucuggucucuguucaguacaugaguugaaaaucaucuuuaccccuccuuguacaauauauaucaaugcgccucccuccauagagcaucacuaaucaguguuggcauuuucauggggagaguugucccugucacgagugaccaagacugggacuuuuacuuuuagcuucacuugcacagcauucuucuccaggcuccauuuuuggugccaagcaaguuuucucagugucauuccuggaaauaacuguccuuaauaguuugucuuuccuccccucugcccacccccacaacccagagccuuggaaugccacacaaugcucuuccacugaauugaaccccaucuuucccccugccccaggugauuuuuaacucccguuucuuauugugccaguucuuucacagaguugauuccuuuuccucugaaucaacaucaugaccaugaucuuggucgugcuccucuccuuuacuguuuucuugugggaaaggccagugauuuacauuucgucguaguccuuucuaaaagcccaguugucacucacuaauauucuccuacauauguuauuaguggcuauuacuauuuggcuuucaguaacuaaagugauaguagagugacugaaaauguuauguuaagaaauuugucuguuaaguugaggguuuagaaucaccagaauuuuaggaagaauuucuuaucaggacaugcugucuugaguugcuugugguuucugauugcuguuguuuuauguaauaaauaacuuuaauuuagauuacugugauuuaguguguuaacccucagugaaauaguaguacauuuugucuuuuauuucuagcauggauauguaguuucccuuauuccaggcugucuucauacuugcucucuagcugaggguacccuugaacuucugaucuucaucauacuuccuaagagcugggauuauaguuuagccucaucaagcuuaguuuuaucacagucaugcuagugacugaacaggcucgcugcugccugucaggugagcauucgaccaacugagcucuauguccagcaccaguaguguguauuuguauaaacugaauuuugcuguuuaauuuucuuggcuuuaguaauacauuguaacuuaaucauguugguaucuuggcuuuaguaauauauacauuauaauuuaaacauguuaccuauucucccccaauuuuuuucauuauuguaacugaauucuuuuucuucugguucugugugugugaauuaugaagucuuuuacuuuaugaggacauuguuaguaacaauaaaaaaggugcaggaacuauuacaugacccuauuaggucuaguugcuuucucuggcuauaguauuagaaguuuuguauuagggcuggagagauggcuuagugguuaagagcacagacuguucuuccuaagguccugaguucaaagcccagcaaccacauggcggcuuacaaccaucuguaaugagaucugacguccucugcuggugcaucugaagacagcuacaguguucuuagauauaauaauaaauaaaucuuaaaaaaagauguggauuaaacuuuuuuaacauucauauguguauguacauauguauguauguguuuguguacacacacaugcugaugccauagcacacucugaaggucagaggaaacuugcaggguauguucuuuucuucuaucauguaaauucugaggauugaucucagguugcuaggcucuauaacaagugccuuucuuuaccugcugaaccagagaccugcuguuucuggcucaaggauuuguguuauuuauuuauuuauuuguuuuuuguuuuguuuuuguuuuuuguuuuuuuuuuugagacaggguuucucuauuauguagcucucuguuuguccuagaacuuagcaaauagaucaggcuggccuugaaacucauggagaucugccugccucuaccucuccagcuucgauuaaaggcacgcaccacaaccguacauggcugagaacuucuuuugaggcuauggcauagagacacaaccacaguuaaacccuuggcuaaagagaguccuccgcucauggagguuauccucagugcagcuugggaagguugcuucuugagcaaugaagaaggaagggaacaccugccuagcuagccaugucagccccgucagccauagugaucagugggguuacagaugucacaagcagauuacccucacaucccaaguacuauucauucugguuugaaaucaguuaugaauaugaacaacagccuauauuuucauuuuucaaauuccaugucuguauuucuacucuuuuaaaaauuauuuuauguauguuaguguuuugccugcauguauaucuguuugaggguggcaaaucccuuggaacagguccugcagauaguugugagcugcuguguggauacuaggaauugaaccuggguccucuggaagaguagguagugcucucaaacgcuaagccaucucuccaucuuuuauacaucacauuuaacuaauaguagucauuuccuuauuuugauugaugggucagagcaauuagcauucacucuaauuguaucuaaauuuuuguuuuuaaauuuuuaacuugaauacugacauauauugccauuuaaaaaguauuuuuauagcuggguguggagguucaugccugcaaucucagcacuuaggugguggaggcaggaagauugggagcucagggucaugguugccuacacagcaaguuuaaaacuagccagggggauuugaaaucccaucugaaaaaaguagcuuuguugagcuauaauucguauaacaugauuuacauauuguuuagaacaugugacugaaugacgugcaguauauucacagaguugagcaacaaugaccauagucuaauuuagaaccguuuuaucuuuucccagagaaacacauucuguaagucacuuuucauuguuuccucuccuccaugccguucuuacuucccucuuacuuuuuuuuguuguuguucaggggugucuuugaacuuguuauauguagucuaggaugacuuugaauuccagacucuuuugccuccaucuccuaagugcugggcuuacagggaggcgugcaucaccacacccagcuucuuucuugcuuucucuaugagucuggcuauuuuagacauguggacauuuuguguaaacagacuuauacaagaauuauuauuuuuuguuacuaugguaauguucucaaggcucauccgugcaggugcauaucuguacuucauuucuuuccauugcugaauaauacuccauuuuacggacauacuuuauguccauaaaauuuuauuugaucauuaaauuggugcauauuuugaucauuuccauuuuguaguuguugugaacagugaccuauguuuuguuuucuguguggacauauguuuucauuucuggagaucagagcaagcaagcaguuggggucauuguuuagcuuccccaaggcagcugcagaguguuccaaaugucuagugguauaaggucgauuuggccaucugcuugacugauagcccuuuugcugaaggcaaugagagcaagggagggucuagcagcugccaauuaggaaaucagauugccccauucuccaagauuuucacuuauuuauacaaaaauagauaucagaaggauguuucauuuuuaucuuugagacaaggucuuugguagccuagacuggccuuaaaauugccauauauuugagacugcccuugaauuccggauauauugcugccucuaacucccuugaguagggaccaaaagaaucuaucauuaauacuaauaaugaauuuuagcaaguugguaguguuuaacaguuuguagcaucuggccagacaaaggagguccuguuauaaauuuuaaugugaaaaaaauauaugaaagucuuuuaguagauuccaauaaagucuguccuugguagucauugaagggaaagacaucauucauuauagauuauuuauuuuuauaacaguaaccucuuuaguaauauuuuauauuuuaguuaugauugaaaucauuauuguuguguguguaugguauuugugggggugccugcgugccauggagcccuguggaaucagggucauugugugugugauguguaugggggugcauccacgcuauggcgcuuggguggagaucgggggcagcuuuauggaauucauucuccuuccaauuccgauauugggcucaggcccucaggcuuucagcaagugcucuuauacccccaagaccaucuugcucaucuuuuuuaaaaaauauuuuaaaaauuacacuuuaucuauuuauuuuugggagugugccauagugugugggcauaugaagaucagaggacaacuugugugaguccguucucuuuuucuaccaaggggaucccaaggauugaacucuagugugugggaagugucuuugaaacccacugaaucaucucacugagucuaagaauuuuauuuuauuuaauuuuuuaauuuuauguguaugucuauguacuauguguuuguucagugccuguggaggccaggagaggauguugaaucagagagagagagagagagagagacagagagagagacagagacagagacagaccgagagacagccacagagagagacacugggucuucuuuugaaccucaaagcucgcccucuccaacaaguucaccucuuccaucaaggucacaccuccuaauccgucuaaacacaucaucaacuggggacuaagcgugcagauacaugagccuaugguuggggaacauucucauucaaaccaccacaaccaaaaguaauagguuacuuccuuaguacagcauguguucagucuccaugguuucuagucuagaugaauguauguacucugugugugugcgcgcuuauugcuaagaagugaauaucacuauguuuagguuauauauuuuucugucccaccucuacuguacugcccagguaaaguacaggaauaccugagugcuacagccacugagaggcagagcuagcucuccugcuuuuugaguuagcugucccaccuucucaggugaggagugggccaguuuuucucaguccuuggaugucaccauggccccaggcagcagcccauaucagggacauccucauggccaucacuuugaugguaauauggccaugaauauugacauagacccuugcugccgcagggccauggacccagacauagauugcucuuagaggcagcaugggucugacaaucacuauggccucagguggcagcaaaggcuacuuacaucaggcuguuccucacuacucucaugucuccaguuccuccucucuucauagugcacaagccacucugcuucucuuucucucccauuucuucaucacauacuugcuuaugguaguggcaccugugcugccaccuaugcaucaacaaugacaucuucuuuugaaagguuaaauaaauguuuguccaacccaaagauuccaaaggagauaaaccccuggucaaaguuagacagagcuuggaaaaacuguaauucaacauagaguuguccagucucaugguugaacaaccauaacaaacaacuagagagauuagcaaaaggucagugaugagaagcaaacagagcaggacauggugagucaggugugggucuccaacucugcagguacugcucaacugccugggcuaggaugcagcucugggagucacagcaacucacacaguagucaguguucucaaaggaguaggcaugggcccacuggcacuuguauuuauuaagggaucuauugguggacagaguaacucaccauuuccuaaggagcaagaacagcagugccucuucauagugcuuggcuuuucuuccuuucccaucucuuuaccaucuguuugccugcuucuuuccuucccguugcuccaccaccuacuuguuugcuuacauucuccuagcucagcaaagcucauuuguuuuguauguaacucuggguuucuuguacucaggugcucuaccaccacccuaucuacuacacucuuucuauugaagaugaguugaauuguuuuuuuuuuuccugaaaguuggaguugauggagaaaagaguuuaaugcaaauaguauaaauaagagaaagagagagagagacagagagagagagagagagagagaaagagagagagagaguguguguguguguguguuaaggaaagggcaguuguacacuccuaaggguggguaaagacuucucaagauaaugguucaggucagcuuuccauccagaaaagaccauuuuuaugcagcaaggaguugccaaguguuuguugcauucuagggaaagaauauccuuuuaaguaagggcuuuauuuuguuugaacuuuuaagucaguuuuaaaguauaaguaucuauaugugugacuaguacugaaucagauaguuggcuuuuucuuuuuaguaguuauaugaagaaauacuugacaucacuaaucaucagagagaugaaauugaaacugcuaugagauaucacaucauuaccucauaccuauucagaugaucauuaugaaaaagacaaaagaaacacagcuuggugaugcacgccuuaaucccaguguuugggagguagaagcagaagaaccaggaguucaggaggagccugcacuguauaagaccacgauuaaaaacagaaaaaaaaaagacaauguaaguguugguaaagaucgaaugaaaaucgcuauagacugcuaguggaacugugccuugguccagccauuauggaaaacaguguggagaguccucaaaaaguuaaaaguagaaccaguaugauucaccaauagaugaaggaaacaugguguuuacaagcaugcauguauauacacaguaaaaggccacacauacuuaaagaaaggauuuaaucuggaagacauuuuauuaagugaaauaagccuucugggggauucccccaaccuccuauuuccugagguugccuguuuacauucuuucugcuggcccucagggccucaguccuuuucccucacucaauaccagaucagguucccccuuaccucccucccuucccaccccaucuccuuucccuuccaugucccucccuccccacuugugauugcuuucuucucucucccaagugggacugagguguccucacuccaguacuucagcuugcugagcuuuuugaguucuguggacuguaucuuggguauucuguacuuuuuuuuuuuuucuaauauccacuuaucagugaguacauaccaugcauguccuuuugggucugaguuaccucacucaggaugauauuuucuaguuccauccauuugcuuguaaaacucaggauguccuccuuuuaauagcuaaguaguauuacauuguguaaaugaaccacauuuucaguauccauucuucaguuguggggcaucuagguuguuuccagcuuuuggcuaucacaaauaaggccgcuaguggaacacauuccccuguggcaugguggggcaucuuuuggguauucagaagagugauauagcugggucuucugguagaccuauuuccaauuuucugaggaaccuccagauugauuucuagagugguuguaccaguuugcaaucccaccaguaauggaggaauguuccucuuucuccacauccucuccaacauguguugucaccugagguuuugauuuuagccauucugauuggucucagagucguuuugauuugcauuucucugaccacuaaggacuuugaacauuucuuuaggugcuucucagccauuugaaauuucucaguugugaagucuuuguuuaguucuauaccccauuuuuugauuggguuguuugguuuuuuggugauuaacuucuugaguucuuuaucuauuuuggauauuagcccuuuauuggaugugggguuagugaagauuuuuuucccaaucuguagguugcugauuugucuuaucaacuauguccuuugcuuuacagaagcuuuccuguuucuugaggucccauuuaucaauuguugaucuuagagcgugagccauuggaguucuguuuaggaauuuuccccugugccaaugaguucaaagcucuuucccacuuucucuucuaauagauucaguguaccugguuuuaugcugaaguucuugauccacuuggacuugagcuuuguacaaggugacaauaugggucuauuuucauucuucuauauacagacagucaguuagaccagcaccauuuauugaaggugcuuucuuuuuuucauuguguauuuuuggcgucuuugucaaagaucaagugaccauaaguuugugguuuuauuucugggucuucaauucuauuccauugaucaacaugucugucucuguaccaauaccaugcaguuuuuaaucacuauugcucuguaguaaagcuugaggucagggauggugauucccccagcuauucuuuuauugguaagaauuguuuucacuagagaccugggagaugagagacuccuaggacucaaagagagggacuuuagauaaaaagccugacaguagggagagggaaccuauagaguccaucuccagcaggaagauaggacaucaagugagggauggaguugccaucccaaagucaaaucucugacccauaauuguuccugucugaaagaauuacagggaugaaaguggagaggauccugaggaaaagaagguccagcgacaggcccaaagugggauccagcucaaggggaggucccaaggccugacacuauuacugaagccauggagcgcucacaaaaagggaucuaucaugacugcccucagaaagacccaacaagcagcugaaagagucagaugcagauauuugcauccaaucaauggacagaagcaacugaccuuuguuguugaauuaggaaaggcugaaagaagcugaggagaagggugauccuguaggaggaccagaagucuuaauuaaucuggaccccugagaucuuucaaauacuggaccaccaaacagacagcauacaccaguugauaugaggccccuaacacauguauaauagagaacuuccaggucuguucauucagagaugaugcaccuaacccucaagagacuggaggccccaggcaguuuagaggucagauagggugagggaugggggcauccacauggagauggggucggguggggaggggaggcggugugggauguuguacagucagaggguggaugugggggccggggaauggaauauggaguguaaaaaaauaaauuaaaaauaauaaaaaaggacaaaguguguguguguguauauauaaauauauauucuuuauauauauaaaagaaauaagccuagaacauaaggacaaauacugcaugagaaauaacucauaauacaguguaaaaaaguugaacucagagaccagcuggaguagugguuguuagaggcugccuauagggagaaggagaugcugguugcaggcuacaaguuucaguuaggcugaguauguucaagagguguauuauguaacaugguuacuauaagcaauaauauagcucuuuagaaugguccagugauugaugcacuaccauaggcuuuucuacaaacuaccucuaacaaaacuaggcuguaauagaacugaguggaaaacccuuugcaauagaauuguuuacuuucauaccaagaagguugagaaagcacaaugaucugcuugugauguuaccugacaguaaacugaguccuggaagcucaguuucucugcugcucaaauuauuuuuagguuauaaauauuuauugauaggagaagagaaauuugucaggauauuugaggcagagucuuagaagguuuuccuuugugacaggcuacuggaaauuuucuugacugucaaggacaaccauguguggaaguggugucugacauaauaacucuuacaagugucagugaagagcuggcugaagguguagcucacuugauaaaaguuuucaucuaacaugcauaaugccuggauuucaguuuccagcaucacauaaaaccauacauggugauguauuccugcgaguccagcacucuggaguugggggaaggagaaucagaacuuuaaggucauccuucucuacuuuugagaccaugccuuaaaacaaacaaguaaaagguauaaguaaaagucaagggagccuguaaaaucccuuuuggauaccugaguagauucgauucugugccucaaagaggcacaccacugccuuguggcucugaaagagcuguguuagacuuugucucuuguaguguucuuguagccagaccuauuaaaugaaaaauuaaaaguccuucagaaacauugaagagaaucuauaggaaauucucaugcuaguuugauuuucuuauauacuaaaaucagacaucaaaacaauagcauguauuugauguacagccagaggaacuuaacccagggccucuagcaucccagacaagugaucugucuugccugucuugucacugaguuauagucccagguucaauuuuaaguuuggcagcuuugaacaguugugcagauuguauagugcacagcuguaccaucucuaaggucaugauauuuauaguuuauauaguguagauuuauauucugacuaggacaguuaagcacagucaaggaucuucaagaggguuaagggcaagaggguaaguguagacucuguuuuuauguucaaguauuuaaacaaguaagcgaggcaugacagcagucagagguagagaccauucugggcagcaugagaacuuguucaaaaaagaaacauaagaaaacaaaugggcagaaauaaauaaaaaccaaaaacaacuacaacauagacuauaaaggagggcugaggaaauaucucagugauggaucacuugccugggacacaaguucacacuaaaaugcacauucauagacuggccaauuuuuuccuucaguuuuuggaaagaaccuuaccuuguacaugcuagauaagcacuuagcuuuauucccagacuagagaacuuuauuuuauagauugauauuauuuuuauuuuauguguaugagugguuugccuucauguguguucagagugaaguguucaaaggccagaagagggcauuggaaccucuggaacuggaguaauaguuuuagccccuauguuggugcugggauccaaaccagggucuucuggaagagcacuacauacuucuagccucugagccaccucuccagccuccaaaaaaggauuuuaaaauugaguuucuguguuuagagugcuuaguuuguucacagguuagcaacuccaaagccuuagaaaugagaaaugaugucuuugcuaucuugagaugaccaugcuuggaugcaguuaauaguuccauuguauauugaauaauccucacuuuuuuuguaagagauuugcauauugcucucugauucuaucauuguguagucagcugggauuucaaguuuguuuguuaucgcucagaguuuucugcaaguugccccgaguagcaccaagcuuuagauaaauaacuuguacuauuuggagauauuuuuauaacuguguugagaauuuuauuugaucuuuuugagucacacuaagguggggcugcuauuuuauuuaugauauuuuaaguauauuucucuuaacuguuaccagcaaacaggacaguaucuagacuuaguuuucauuuauuucccacuaacaauaccaaggcccuuucccuguacuaugcaguggauccaucuguaugcugaucuaggcuuuuugugugccucuagccauuuugccagggaacucaccagauuuugaguuuauuuguuuaucuuaaaacuguuuuuuuaaaagcucuaucuaucuaucuaucuaucuaucuaucuaucuaucuaucuaucacauaccaccuguagagcugaguauguuuauguauuucuaggguucaaaacauguuauauuuuguacauacucuaccaacugagcugcaugcccagcuaguauaaaaguauuuaaaacaaucacuuugagggcugagaguggagcuauaugcuuucuuuucucccuucccacuccccuuccaaucccucuugugucccauguuuuucucuauuucaaauccaaaccucuuaaaaauguuguuaugcauauauguacauuuauaguaauauaacuuucucagcucauuuaguguuguuuguauguauaugauuuuuggauuggcguuuugcuuugcauagccaguaagaggguucauugugaggaagaauauuuuucuguuuucaacauuucuuaguuguccuuaguucuuuguuuagggguaaggucccaugaaacuucccucuuccaaauuauuauauggugguguauuuguucaguuguuuuccuuuuuuuuuuuuuaaagaaaaagauuguuuuuuuuaaauaaguguuuaaaauacaguuuauuuuauauucauucugauauuagaauauauuuaauacagcuaggaguggagcucaugucuauaauuucaacauaaccuuaaugcuuaaaauaaguuagugaagaauacaucucaagggcuagggagaugucuuaauugguaaagggcaccuugaggauggaguuuagaucucuagcacccacaaaaaagguggcuguaaucccagcacuugggaagugaagcuguaagaucacaggagcuuacuggcuguccagcuuaguuaaaucagugagcuccaguuucagcgagagagucuuacuuaagauauagguuggagagcaauugaggaagaaaucuuauguugacaucugaucucuaugcacaccuucacacacacacacacacacacacacacacacacacacacacacacacacacacacauugcuguuuaccauugagugaagucagggcagggaaauagggcaggaaccuggagguaggagcugauacagaggccacagagagaugcugcuuacgggacugcuucccagguuuguucagccugcuuucuuauagaacccagaaccaccaucccagggauggaaccaccuacaaugcacugggcccucccccaucuaucacuaauuaagaauauaccuuugauagaccuuuuuuuauagacagauuuuauggaggcacuuuuucaacuuaaguuuccuccuuucagguaacuguaguuugugugucaaguugacagaagacuaggcaguacagauguacauauauuguugucagcuuuuguuucccagucgcagagaccuuuguguuaguccagauuccauuuacuccucuucuuuugguuagauagagggaaaguguaugguaaacgagucauaauguuaguuucuuuacuccuaugcuugucaauaauuuccauaauguaccauuuaauaccaggaaaaacuaaggcacuuaaugcauuuuguguaucaaaaauaaaaggaugcuuaauuccaaguaauguuauuucuauacuggcuuuuuaaagcauuuaaagaacuauuugcuuauuauguauauguauuugaauguauguacgcgcaucacauguguguagaggcagaauagaggguauuggacuccuagaacuagaguuauagguggauguaaaugcuaggaacugaacccagauccuuuugaagagcagaaagugaauuuaaccauugagccauuucuccagucacucuauuaccuuuaaaaacuuauguguaugaguguuuugucuuccgugugucuggugcuuacagaagccaagaauagggagucagauccccuggaccuggagaugcagauagugacuuucuauguggcuucugggaaucaaacaaggguguucugcaggaguggcaagugcucuuaacugcugagcagugguaguugagcaguugaguucuucccacuucaauacucauuugcuuuaaaaacggaaugguuauucuacugaacuaugaacugggucagauguuaaaucacagaggcuagagucaccacaacugagccauauguuuucuagagagaccaacaugaauaaaaauauuuacaaaaccaguaguuuguuuaauucaugucuacaugagcugaauaucccaugguauagcuuuucauccaucuucaguguuacuuuuuuuaauccuacguccgaucccaguagaaacaaaugaccacagaaaagacgaugaucaaacuaauguuacuuccuauauuucuuguauuuugugaauaguuuuguucuuugaaaaagagaacaucggacaguagagaaacuuacauacacaucaaucacuuuucauuguacugcuaaggauguuccuaauaaacuaugcuuuccuaauucugucuuuauagucuuugagacuaacaguaacauuagacacacuggguauuuaagaaaugucaugaaccaaaauguaaguguaagcacuguuaaagagaguaaaaguaaauauaaccauuuugugaccuucacauuuauuaucuagauaauagcaagcauaaaacaaugaggaauaauuuuguguaacuucacagcaaauaaaaauuaugcccaaauuuuacaagucugaagcuuuaucaugagcucauguuuacuuugcccaaaguaagacugaaauaagcauggcauaaauuggaguaauuuuuauuguuuuuuaaaaaaccuguuuuuauuuauuaauuuuuuuuguauguaugguugaguaugugugugagguaugugcuggugcauuugggggugagaagaggucagauagucuggagcuggaauuacaggugguugugagcugccuguugggacugcuggaaauggaacccagguccucuagaaaaacgcaggugcucaaugccaagauaucucuccacuuaaauaagaaagcuaaacuccaauguugacaauaaauuaagacuagacauuuuuuuuuguuuguuuguuuguuuuguuuuuucgagacaggguuuuucuguagcccuggcuguccuggaacucacuuuguagaccaggcuggccuugaauucagaaauccgccugcuucugccucccaagugcugggauuaaaggcaugcgccaccguacccggcaagacuagacuuuuaaauuuuacauuuacuucauuuauuuaguaugugagagagagagagugcgugagagcgagugagcgagugagagagagagguagguaugugugugugagagagaggggagagagagagagagagagagagagagagagagagagagagagacugagaauacauguauguuauggcauauauguggaggucagaggacaguuugugggagucagcuuucuccugucaucugggcuccagggaucaagucuagguuauugggugacaagugucuuuauauacugagccauuucacuggcccagaacuugaguauuuuaaucacugguugucuuaguuucuuuucuguugcuuugaagagauaccaugaccaagguaacuuauaaaagaaagcauuuaauuggaggcuugcuuacgguuucagaggguuaauccaugaccaugacucuggcaucuccaaugucuuggggucuuuagugcaauccaggauucaccuucucaguuuuauguguuggcuucucugggccuaaaugcauggauucccuugucacaugccaccuugacuuuacugguuuuucauaacuaaagaggaagguuccacaaguccuuuacugcuguauucuucuggacccuaaagccagaaacacuuauguugccaauuacugcuguauauuugggauggaauauggccaccuccuugaauuucauuuucauaaccuuugaucucuugaugcuuuccuuuguugaauaagcuuuccuuuguuuuuggaguagauucccuagggauuuucuuuucacaaguugaaugauuagcuagguggggucuugcuugagaguaccauauucuucauuccauuucuccuuauuucuuuuagcauaaaucuagguucagacauuacauucccugguguucucuuuuuucccuccucaaauugugcauuuuguauuucuucuugccuugcuuguacuuuuucauucuagaucuccaugaagagugaucacuaauaacuacaugacacagucaauacuagguucucuugaaaucucugccuauguaugguauuauagguccaaaacuuuucaauuuagccucaggcagauucuuaggaccagggcccaaagcagucucauucuuugccaaaacaucaaaagaaucaucucuagcccaguugccuaauauuauuucccucugaaaccucuugagcuggaucuccauaguucauauugcucucaguguuagugucuuccaagcucuuacaguauucuuacagccccacuuaaacauucauccacuucgcuaaugcagaguucccgagucagcuuuacucuaacaagcagcaugaccaggucugucacagcaauaccucacucccaguaccaacuuuacaacuuugcuauuguaaagagacgccaugaugaagacaacuuguuuacaguucagaguaugaguccaugaccauuaugacaugggacaugcaucaggcaggcaggcaugucuguggagaauagcuaagaguuaacauuugcaaguuuguaggggcgaggagggagggagguagggaggaagggagagagagagugagagagacagagacagagagagagacagagacagagagacagggagauacagaaagaugcacacacacauuugagagcgcaugcacacacacacacacacacacacacacaggaggggggcuguccuggguuucugaaaucuuaguucacuauggguuuugcuuuuuuaagcccuugaaauaugugacucagggccauuuucuggaaacccagaguuagaccuggccaaaaaguccaucaaccuggccaguuaauuaaagcuugcuuuaaaauuugcuuuaaauuguggcaguggucuuauucucaaucagugggauaacaaagugugucauuggagguggacuuuaagauuucagaaagccaggacgaguucuaaucaggggcaagcaugaacccugacacguauuuccugcuuuuauaccuccugcccacaugugaucaggcacauccaguggaguugggucaaacagacuuguuuaggggagugaaaccuguggcuugcuaucuuuuguaaacaguagccagcauuucaggaagucuuuucuuuuuuuucuuuuuuucuuuuuuuuccgagacaggguuucucuguauagcgcuggcuaucauggaacucacuuuguagaccaggcugaccuugaacucagaaauccaccugccucugccucccaagugcugggauuaaaggcuugcgccaccacgcccggcuaggaagucuuuucuuaggcaaggugcuuacacguuagaagcaguuuuguuucauggcucucucaggcacaguaauuaaaauuuaaaauguagcuucauuucuuacagccuccuccaacaaggccaucuuuccuaaucuuucccaaaaugguuacaauaacuagggacccagcauucaaauauaugagccuaugggggcccauuuucauuuaaaccacuacauuaaucaaaauagucuugggacccaaauugcucaauaucauaauuaagagacaacaaaaauagguuccagagacucuuggagaaaagaaguguauguaaagugaucacagcuuacuuuuucucauuaccauuuuaaaauauuugaugccuuggcuuucuguaaaccauaauacauuucauuauuccuguuggggccugcuccuuuuaauuguagccauuuuguauucaguuuccauuuugcucauaaggugaaauuaaauucagguucucagacuucacuuuccagaagugauuaccuacaggugacacugaagcauguuacuaauaagccaaaaaguuacggcuuuguacucccauaucucaauguacuggcacacuucaguucacuaccugcacacuccuucucuuaugucgucuaggaccaguuagcucgaaggagagcuggcaauaccaccuaguaagcuaaaauguuguauugcuccccucucugccucuuaaacuugguuuuuccuauaaaaagccugccccuaagagcuuuaauuuguuuuuuuaccuaguucuucagccguuuccaacuuguaccuuucuuuuuauauaaaguccaaauucuagauaauuucuuucauagacucuuacauuuucuuaaaaccaaccaaaccuuuauuuugcauaccccccucucccucucgcucgcucuucuccuuccuaagugguagacuugggaagucagagauuuguuucauguugguuuucuccuuccaccuuuaugcaaguuacagggaaucaaacugaggaggcgagguuuuguggcaaacaccuuuaccuguugagccuccuugcuagcccucuucuguguuuucauuauucuuuuuccccacacugaacuaagaaaauagaguucuuccucuuuugugaagaacgggagaaaagaccuuucuuuuuagaggguggguuuggggauguuugcagauggaguagggaagggugcuuuacacacacaccuuuucucugccucggcaguaacuguucuuguugagaaacuagguguaugccaaggcugcuugguuacuauuggcaaggguaagccagagaaaaugaugggguugucccaguugcuuacuggucucaggcauugggauccaguaugguguuuuccaggacaagcucucuuuucaauuccguuucuagagugcccuucauugagaggcccccucaggagcuuaaugcccucuggaguucaccucucuagaagcacuucauauacuuauuauuuguuugcguguuuguuuuuaagauuuccugaggucuguauuugaaccuaacguguaggccaggcugccugggcucagauccuuuucucucagccuguucaguucugcaguuaggauccaauaccaccaguguccaccucugaaaagugcaccagcuugagauauaucugcucagcauuaacuuugacuuacugggaaguacuuugugguguaccuguaaaccucuagguaaauucucuucuuauucaugggugaucccccgaggcugagugaaauuggugagguugaagacugagucaguagaguugagaggagaugcccaggagagcuuuuccuccaaacugugauuaccuuuugaggcagagugccagggagagggcaugugugcugguaguguacugagacuuacuggguaggaagaugguuuuucccuuuuacuuccaaaacugcugguggaaccagaaaccuagccaccauacccuaaccuagaguuuucuuccuuuaauccaucucuagacucaguauuuuguguaaauccuaucucuguauuucuuuauaauguaacucagaaucauucucaaugauagaaaauuuugugccguagaccuuugccuuucugccaggguugagaagcgcugauauucccacgcuaggcuagugaguucuccgggaaaguacauggauuuuauacuuaaugcuggccccuguucuugcuucacauuucaucuccuuuucuccuuucaccuuuagugcauaauccugguacuucaaguucucgaugagaugcagcucuuuccuaaauguuuuacuucucacuagaaacucucaaucagcuguggugcugccaccugugauccuaaaacuccaugcugguuacauucuguuacugcgauuuccuguucuguguauuccuucauguuucuuuccauaggcuaugaauuccuuguuucuagugccuacuauauacagugagugagucaaaguagcuacccagugucugucugcucacuuaccaagugagcccucaaauuacucaucugcuuuugauuaggacgggggucgggggagucuuuccgacugagguagugacugggagagauacuuggcagggcaaaauuaauacugauucugauaaccaaguaacuuuggacaaauuuuuuaaccccauuacaucaguuucuuugguuguagguuagaauaguauaacuauuuugugagucuagcaugcagcacauaaguauacauuauaugacuuauguuucauguuuuguugugacucaccgugccauagaguuuaugaaccacaagcuuuggagagagcaggugaagcucagcagaaguggauacaagugaaacaagaggaaaaacgggaagagugacagugacaaguaaacuacuuagggugcugcugcuaccaugucauuugugauacuauaauagcugguuuaugauuuaaucuucagaauaaagcugaaguaagcuucaguuagcacauccagagccaaccaugccuuuugacuuugguguugucauuauuuugugauacugguuacuugugacuugaucuugguucuucagcuaagaaauuguagaacuuggauuugcaucaagauuuuucucucugcuguuguuaaaugaugaaacuugacuuguaauuugccuuaaaagaacuacuaguuuauaccuaguaagaguguucaaugcugucagauacacugagaagguucucuuaaagaucacuggauuauuuccauuuccagagauagacugcuaccuccauggccauguagaauuugguuacacucacccacucugugccaggccuuuggcauuaacucuaauucugcagucuagacugaaauguugagguaugcaucuggggauauuauuuggguucuaaauuucagggaagucaagauuauaggacaaaaauuacaggguuuguugcugaauuauaccucauguuauuuuuuuuuuuucuguauucacugucuucaauguuuauuguggugagacuggauuugaugguuuacacucagauuuacaguauacucaaaggauuaagacaaugacuucaucagagauuguguauccacuagguauugaagagaagggauccuuugggcacuggcgccuucccacuuguguuuauucucaugguauuacuaugcuaauugguauuuauguaguucuugauuuuaaauuuauuuuuaauagacuuauuuuaaauucagaacauuugacuuauauuguuuucauuuuuagcauauauauauggucuguuggguguggugacaugcaccuguaaucccagcauuugagaagcugaagaggaggauugaaaauuuuacucuagccuagaauauguaaaaaguucaggcauaccuguucuauauguggugagaaugaauaucaucaaacaaaacaacaacccaaucaaccaaacaaacaccaccuagagagguuauaauaucauauucauagccauaugauccuacuaauacacucuuaauuucuacacucuuguuuuaaugagcagcuuuauuuacuuauuuaagacuuuuuauugauucuuugugaguuuuacaucauacaccauuguuucacucaucucccugucccuucauauuuuucuucugcuccugcaaccuccccgccucccagagagccccgccaccaccaaauucaaaacaaaacaaagcuuagaaaauaucucauuguagaagcugcaguaugucacaguaucucccacaauauacacuuuuguccacacauccccacuugcaaauguucauugcaauaaaugacugcucugucucaaggccucuagccuuagcuacaucagcccugguuccucacaaggacuccucucaaucauccuguugcugcccuguguccuggaaaucccgaagcuuugaaucaucaggaccagcccuuucacacacuccaggauugaauauaugagguagauuuugggguaggccaacucaaagcucugaaucucggccugggugaccuguauaguggggauaaccuugaacucuugaucuugugggcucuugugcauacacacacacacacacacacacacacacacacacacacacacuuauuuuguguugaucuuguuuaaacaaguguauaacaccacauacuugguauucugccuuaaaaauuauuuauuuauuuauuuauuuauuuauuuuuacgucuaguuguuaucccccucccaguccauccucugcucucuaacuguuucucaucccauuccuccucccuggucuccaagaggacauccucaccucaucccuagccccaccagacuuccccacucccuggggccucaagucucugaggguuaggugagucuucucuuacugaggccagaccaggcaguccucugcuguauaaguguuggggggccucauaucagcuggugugugcugccugguugguggcucagugucugagagaucucagggguccagguuaauugagacugcuguucuaacuauggggucacccuccuccucagcuucuucuagucuuucccuaauucaaccacaggagucaucagcuuuugucuauugguugggugcaaauaucugcaucugacucuuucagcugccuguugggacucucggagggcagccauguuaggcuccuguccguaauaguguccgugcagcuuccccuugugcuagaucccacuuugggcuggucacuggaucuccuuucccucagucuuuucuccauuuuugucccuguacuucuuuuagacaggaacaauucuggucagaguuuuugacuguggaaugacaaccccaucccuccacuagauguccuguuuuucuauuggaggugaacuuuacaaggucucucucccuacuguuggacauuucaucuaaggucccucccuuugaguccugagcaucucucaccucccaggucucugguacauucuagaggguuccccccaccccaaugccuguuuccauucuuucuguggccuucagggcuuccccccccaaauaucugaucauguucccuuuuacccucccugacuccucuuccacccuggguucacccccugcccccaauacaccugauugcuuucuucuccuuccuaagugggacugagguauccucacuugggcccuucaguuuaauuuggguauuguguuauauuuuucauuuuuuaccauuuaaaaaaucauuuugucucuguuguugaaaauauuuaaucucaaucagggauuucuacccugccuuugaucauuuaguucccagaugaaagacacaaaaccguuguauuuaugaugagccuuuaaagcacuagaccugggcagagauccacccucuaggcuauuauuaguaucugcuucucuaucaauaaccccaaguuauaauuuguccuguucugccugggccacucuuccuccaauuggucaucccuuauggccauguuuucaugauucacuuaccccaugacggcuucucuuuuuucuacuuuucuucuuccuuucauggucuccugccucagaucccaggaaucaagcccaggaaccaagaccuggccucucucucuuaugcccagcuauaggcuguggcaucuuuauugaccugucagggcuaauggggguggggaagcguggagguuggggguugugaggacacaacaaggcuacaaauacacaaauaugcgaggaggaucuuguuucggaggcaggcuggaccaguauuuaacauuacaauacauagcaacagaccaaaccuccacaguguuaaauugaggagcaaaguuugcacaacaaaggaagauaaaugugggaauucacucuuaguccuagaccuucugguacagaauucaguguuacaauccauagcaacagaccaaacuucacuucaaccuuucagucucugucucucuguuucucugucucucuccucucucucucucucucucucucucucucucucucucucucucucuuucuccucucucucucugucucucucugucucucuaucucuguuucucucuccucucucucucucucugucucucucugucucucuaucucuguuucucucucugugucucucucucucugucucucuguuucucugucucucuccucucucucucucucucucucucucucucucuguuucucucucucucucucucucucucucugucucucucucuguuucucucugucucucucucucucucucuuuguugcagauguguaggucugagaacaacuucuaguaauugucuuuuuuuuccacuguguaaguguuaggaacugaacagaggcugccaggcuuggcagcauaugcuucuacuuacagagcuagcuucacaaauuaaaaaaaacagucuauuuuuuuuauuuauguguaugccagugucccuguauuuauaauaccacaugcauccaagagccuauggaggucagaagugggugucagauucuguggaacuguaguuacagguggcugugaggcaccuaauguggguucugggaacuaaaccuggguccucugcaagaacaggaaguaaaugcucuuaaagacucuguacagugucuucaguuaccaacuuuaacauuaaaaaacaaaacaaaaacaaaacaaaacaaaaacuauaguugacaagcuuugaaggucauuuggugauuuuuaacuuuccacuaauacaugacauuuuugagaaaaaccuuacuggaguauggcagcauaugagccaaagauguggcauguuuagaaggacuaggagaugcauucuaggaaaccaaauugugacuugaguuuguggcuugagcauguuuguggcugaaauuuacauacuuuuuccugaacuaguaugacaagcugcagcaggcaguauuuaaaauggcauuuuaauuccuagcuauuaagcaaucagugaauugauucugguuucagauagacaauuuauuauucuagaaagaauaauauauagacuagaaccugagaacugauuacugaaucucuaaaauagagaauucuacuguuacuagauauggugcuguaugcagauggaucucugcgaauugaggccaguguggucuacacagaaaauuccaggccagccaggacuauacagugaaacccugacguaagacaaggucuuucuauguagucauauaguccuggcuguccugaaacugacuauguagaccaggcugguucuuaaacucuuaagaguuucucaugccucucucugccucccaaguccugggauuaaagacauaugcuucuguaccuggcaauuuuaauucugauaacgauggacuuaguuuuguccuuuauuuuuuuuuaaaauuccuuaauuucuuguuauugccacuuuuguauucacuccuuuuuaaaaagaauauauagcucuacacauacauauucuuuuaaucauauauaugauucauuuauuuuauuuguaugauuguuuuggcuguaugucuguauauucagauuuuuggcugauccccacaguugucagaagagagcagaagagggcaucagauuccauggaacuagaguuaaauaugguugugagcuuucauguggaugcugugaacugaaucggggcccuuugcaaaagcagaaaguacucuuaaucacugagccaauuaucuaguucuuuuuaguauauauuuuaaacuuagugguuguuuuaggaguuacaguuacuauuuugcuuuguggcauucuaguucaguuaacaacuuaguuucaguacagaaaucuuuguuucuacacagcuccauucucucucucucucucucucucucucucucucucucucucucucucucucucucucugccucucucucugcuucucucugugucucccccaaccucccucucuuugugugugugugugugugugugugugugugugauuccguaguccgcuagguuggcccugauauugagucaguccucaagucucagccucccaugaccuguguaugagccaccauguccaguuuuaaauuccaucuuuguauagugucuuuaucuuuucaauuauauaaaaaaggcaguaugaauaaaaauucuuuaauacuuguaaaaaaaauuuaaccuuuacuagauauucuuauuucucuguguggauuugagacugcucaguguauuuucugcuguagccugaggaauagccuuuauauaaaggcaggcuugguggugacggaucuccucaguuucugucauuuggaaauaucuucauuuccccuucauuuugaagacuagauuugcuagauaguaauauguuccugcuuaacagguuuguuuguuuguuuguuuguuuguuuuuaacaucucaaaaguguugucuaucuucuaaccaauaugcauucugaugugaaauugacuuauuugcuuuagauccuugguauacuagaauuuacuuuuuuucuuuuguuccuuucaagauuuuauguuuauaaucguuuuuggcaguuugauuauaauguaccuucauauagaugucuuugcauuuauucugccuagacuuuguucaacuucuuacagguguacgcucauaucuuuaaccugauuuacaaaguuauuggccauuacugcuucaaauguuguuucugcuauuuucucucucuuuuccuugcagaauuccugcuuuguguauuuugaugugugaugauggucuauuggccucuugguucuuucauuuuucuuuauuauuuuguuucuuuuuacuacuaaaauuagauaaccucaguugacauguugguaagguuagcugguuguuuuuucuaauuaaaucaucugcugagaucuuuacugaguuuucaauuuugauuauugugauuuuucagcucuagacuuuuguugggucccuauucauuauuguuauuacuuauugguauucucuacuuggugaaacauucaugugcucauguacagcuagacuuuuucuaguuucuggguaggguauaauaauuuauauuugguuuugucccugauuccuuggaauuuccuaggauugguuggaacaguucccuuucagucauaucuugguuuaugcuaaugauacagaaauguuaaggaaacuauuucagacaguuuugguugagucugguaccagagagaccaagccuugauacaagaguucuagcuuucuguuauacaccccaacaagggcagaaagguuaguuaaguaaacauggcugaugagcaauacucugguaaugugaugugcuucggaauggaguuagcuucuagguuggugaccacacugagcugcuggaagcugucugcagaggacauagaagcuucaugucucucuucuuuccuguucuuccuucccugacccuuuagguuguuuugagauaucuccuuugaguuaccuccuuaauaauaagccaguaaggaaagugcuaauuacuaaaucugaaggucuggagggucaugggaagaccucaguuuauauagaaauagcauauauaggaacaaauaggauaucuggacaccuucuugugacuuguguaugaagcaggcuuagucgguagugugaacuccuaacuuguaaaguguuauguggagagacagugucagaguugaguucaguuguagagcacagcaaguauccgaggauugcuguuggcaaagacagcauguguguggugucaggaggagaaagaaccuuucauugacuauugugaguagagcugcugagaacauucauguacaaauuguuagugugucuuuuuuccauauaguugacauuucucugcagaaaaugcccaggcguauaguugcugauaauguguguuuaauuaauugacgaauuauuauuaguuuuguggugcucagccuugaacucaaggccuuguaccugguagguguguacuguaucacugaucuacauucuaguuugaaugugacuuaaguuuuuucagaaaaugucauuacaguuucucacaaaaugucaauaaaaauuacaacaccuuguaaaguuuugcucuuuucuauaaaaguaugugugucuuuggauguuacuucucucggucacauucaaaaauacuuuguacuuucccaggaauguccaugugaagcugggucuuguucauagacuucaguggcagcuacagaauaguuugggugccuuuuaauugcuucugguaucuugaaauacauaguucucaaaaauauauuaauguaucuuccauuuguuaauuuucaguggauuaaugcuuugaaauuucuauuucagauuuuuuaaugguauugagguauugucaaauacugcauguuuccagcauacagaacaugugauguaguugaauuguaaaaguauuguugcgaccaagcucacugucuauccuuuauccaaguuaacauauuugugguaugaagauuuaagauuugcucucacaaguucuaaucccuguugcauuauuauuaaguauguguauuagugggucaugugcauuaugggaugaucacuugcuauauguguucuucuauagcucuuccguguuuguaaaaggcuuugucuggauuucauagauuuuucuuucuuuaugguuggucacuggugcuuaauuuuucccuugacucugcuguguaggcaacgugcuuguaggcuugcuuugauugcugcacuugaggaaggaagcaggcagcucucagucuuuacauaugggcugagggagggaaagccagucacuagucagccugucaagaaauucugggugggucugggugggcuccauugugaguuugcugcuggagaccuugggugggcugcuggcaugauuccugggucaguggaaugaaugccuauugccugaguucauagaaacagacaugggcuuaggucuaggcauggugcugauuugugagaguugagccuggcacugauaucuucucuauuagaccugaaacaaucaaugcuauugcuuguucucaauuucuccacagggcaaagccucauucuagggucuaccgaggcaggucugcugaugaucagugagaguacaccugaguuuguaggaacauccugguauguugacccaggaguagcgagguugguaaauaguucuaagagagcucucuuggcagcagaggcuacuggcauggagcuagacauuucacuuuggggucuggccuggugcuagaacaugucuagagccugggucuguggaggaaaaaccuagggcuuuggauuacagagccuuguggcaagucuaggcacucgucugggugcugaggucuccagugaagucaggaguuauuauucuacuauuuucuugcccccuacaaaaagagaaccugcgcagcugaacugugaauaccugggggaaaggauucauggauagugugaaauuguucccuucuuuuacuuucaaugugucuuuuuuuuuuuauuccugugcucuuaagugcugugagcucuugucugcauuccuuaguuuugaacgaauguuuauuaaagccaauauuauuuugguuuuaauuuguaauacagcauauaauauaauauaauauaauauaauauaauauaauauauaguauaauaacauuaaaagguucugaaagauccucaguagauuguaauugugcaaaguguuccuguugggcuggugagaugacucaucggguaagggcgcuugccgccacccaagccuguucaccugaguuccauccuugggacccagaggauuuaaggagagaacagcaauaacuccacuucccccuauaaguaaguaagucaguaaguaagccugaaaagggacuuuuuuuucuuuugucaaauauguuagagaacugaagguuuagauaggagauguuggagagacccgaugacaaaguguaugaucuugguccagaugcuuuauaagaaaugaaaaugcucuaaacaugauuggacagugaacagaauugaaauguggacugcauuuagacuauaguuguaucacuuuaaauuugguagugaugcgguaauuaaagaagcauacacuacugguuuaaaaacuuaauuauuuuguguguuuaugugugugaguagguaagcauacaauguguaggucagaggaguuuuugugaauggacucuugucuuucaccucauuuuugcaaggcuucucuucguuuugguuuuugcuacuuauuuguguacccaggcuaguuggucagugaacuucuuucuagcuuauuuucuugucuuugacucucaucacccagugauagugcugggauugcagauuggcaccgcuguauugcaggugugggguuguguugcagggguugaacuccuguugucuuaucugaugagcuaucucaguggcuccauacugauuuuuaaaagacacuugaggugucaaagugcuuacaaaugauucaggaaaauaagaaugcagauucauauguauuuagaaagaauaaaacaaauaugguaaauacuauaaguugaauuuugcauaaaaacuaugcaaguauguucucacaauucaaaauuacuuauauaaaaaucagauuuacuucaaaauaaaacuuaaaaauuauaaagcaugagucuuagaaacaauuuuaaugcaugaauuuugguuucauuugcuugaaaacugaaauguuuugagcagcuucaaaggauccucuauguucugcugcccucuagugucccuucugcuucugcgcagcucguucugcaaguggggcuuuagagcauagcauccaguacaagcucaccaaguaaaaccgugaugagguggugagacaguacaguaccgggaaaccacaccccacggcccauuuucucuugguugcuuccuuuuuaugcugggcuugccccuucggccugcuguguacuggcaacacuucugagcuacagccuggcugcuccaccccucucaagaaaccagauuuguuggauucucaccuaagaucaacuaucauauaacuguauacuuuucucuucuucauuacuacuaaauauuauuuaauuguaguaucauaguauuuuucuuuguagccaagcauacuggacuugacccauaaucuuucauauugagucccaauucuuaaaagcauugaauaucauuuguucucaaaauuugcuuaaauuuauuuggcaagaaaauuugaccugaguuggcaugagauuuuguauuuacuaacuuauuucuagaaauacuaaugugaagugcugcugguuuuugucuuuaaacuguugguuuauugauuuuuuuccuuucagucuugauuucuccaagaauuucagcuuauaucuucaacucauuaauauuuauuaauauuuugaucauuucuuuugcaacuuuagaaccacaugcgcugacauuuuuguuuuugccuuuuucuuuguugcucgagcaacauagugaauuguaauuuauguguuuguuuuguaaagcacucacagguuuuuaaucgugaguuaguuuuucuugccuccuggguuuguccuccuccagagcuacuuagugaggagcuccauucaggguuguaucuugugugcccgugugggguauguauaggucagauuuucuugccaaaugaagucaagcugguuuugacaacaaauuguuuucaaagccuuagagacgugggagucaauaaugagagaucauggguaaaaucaaauaugcuugguuugaaaaauagaagccuuacuuuucaugauaaaggucuguauuucaucuuagcuuacuuaaaauuauggaaaacuuaauauguuuaacaugauaaugguguucgucucucucucucucucucucucucucucucucucccucccucccucccucccuccuccucucccucccgccuucccuccuuaucuaucuaucuaucuaucuaucuaucuaucuaccuacuuuugagacagggucucacguuguacaucuagcugaccuauagcuugcuaugcagagcaggcugucuuugaacuuuagauauccaagugcccugccuucugagugcuuggaaaaaagguuugcaccacugcuccagccuauuuuaaccauuuuaaagucugcaccuuauaguguuagcuauaccaucuccagaaucuuuuuccuuuucuccaacaggagcucugcucacgcacgacaguaaguuccucacccucccguuccccggccagccccuggcaggugcuguuuuacucucugacuccacgaauuugaguaccuuagaagacuguuuuaaacggagucaucucguaguuucacugaccuaauauccuuaagguugaugcagguuguagcauaagccagaaauuacuucucuuuuaaauauugaauaauaguuaccuuuugccuguuuaccuguuuacuuguagugagcuuuguuugccuauuuauuuuuccaugaacacaugaauugcuuuuuuuuuuuaaaaccuuguguuuaaugcagccaugaagauagcguauuaucucuguguguccuuguuuucaguucuuuuggauguagacccacaugaugguaauggacuaaaccucugaaacuguaaaccagccccaauuaaauguuugcccuuugcuuuggucauagugucucacagcaauggaaagucuaacuaacacaggcucucucucauggaauggaccuuaaguuaaaacagauacugguuggccacucccacaaguucuguaccaccauugacccagcauaucucacaggcaggacuuauuuagguaaggguuuuauggcugaguuagguguuuaaguucuguuuuugauagccugcagaguaacuuccugcaccaaagagacuagagauuuaagggugaaaguuccaugcaggcaccggcucaacuucucaguguucagugaguuggguggauguuguccuaagcaguuccccccuccuaaccccaguuuuuauagagugacccucuguccuaucaucaaccuggguuguuuagggaucuucaugggauccccuuggccaacagucaacccaauacagcccaguccugccccugggagccuugccuggcuacaagacauggccagucauauccucacuagaaucacccucauaggugccaggaaguuuuuccugcacuagguuuccacaccacccuccaaauguuccccagauuccagcugcuuauuuaucucccugcacucuccccucccaucugaccccagucaccugcaaucucaucagugacugagccaagucuaggguuugacuuuggcuaacugugcccccucugauucuuacugauuuaugguauggcuacccagacuaccaaccuaauaccaggaagagauguuaagauucuucaaucaaguuuuggauucugugauuuguuuccauuuuuuuucccuccucuauugcuuacuuucuagaaacugaugguauggccuuauuacugaagaaaaauacuauguaacucacugaaaauggagaaguugagcuauuacauaucuagaaccaucacuccaacugacuaauguucauaguacaggaagguacuccacacacuaccggaagagaaggguaaaguccaacccaguuacagacccugcgaucuacaaugaugaucugucggcaagauaugcuagugcaauaguggcacggucugauuugaauuaaggccuacuccaugaguggacaccauuccagacauugcaugggucgccaagacccuaagacuagauaguccaagaaccuagaggaaaaccaaauacuauuguucugcuaagggaacguaacaauaaaauaacuccuaacagcauucugcuauacucagaucaguauuuuacucaguuaucaucagagaagcuuccucuugaagcagaugugaacuaacacagcgacucacaacugcacaguuuacagggagugagagaccuuggagcacucaguccuaaaugggaugucuccaccagaucccucuccucaggacucaggacacuggagaagaggggguggaaugagugccagagccaguagggaugaaagacaccaaggaaacaacacuuucuagccaugacagggcggaagcacauauucacagagaccguggcagcauacacagggucugcacaggucuaagcuaagacgggacguagauacaagccaucucuaacccagaaacuaucucaaguugauaacugcuugcagaagaagaauuaauuuucuccaaugaugucuccuuuacuuuauggcaaacuccacgccuagcagaagauggcuaaugcaaaaugaacucaaugguguauuugguguuuuuuuuuuuuugucucaaugcuuuuucuaggcuuuuuuguuuugcuuuguuucuuuuacuaaagccuuacaauuuuuuugcuugaauguuauguuuucugauuuuguuuuuauguguugucuguguguaucaauauuuguauacuuuuuuuugugcuuuuacuuuguuuuuuuuccuuuuuucuucuauuugcuugcuuguugugauuuuuuucagaaaccuguuuguauucugagagagagagagagagagagagaaaggguguggauuuugaugggugggaaaguugggagaaucuagaagaauuaugggguuccucauaaucaaaauauaguauaugaaaaaaucuauuuucaauuaauaaaaagaucuuaucugguuaggauaaaacaaaacaaaaguaaacaaagagucccuaaaauuacucugcuucuuuaagccuuuuaaaaaaauuuaaauuaucuuaguucauaguuuggggaaaaacucuuuauuucuguccaguuucuccucuucuggauucuaaucccuuauaucucuaauuuaaauuauuucaugcccguaaaucugucaaaagcugauuuuuuuucccuuaaaccucuuaguuagucauggucuuuugcuugaucccuuuacugggaacuugagcuuccucugcagaugccuugagggcaaaaagaaguggcugaggaauauggacucaaccuuucucaucuuuccuuccucuccaauauuuuguuccuguauugucugguucccuaagcaucucucaguuaacuaagaaagaacaucacaaacagauucaggaggucuuuagugaauuagucuagauuggagcauaggaagggaaaaacucaagaaggggcuuuccugcaaaggagagauuccagugagaaagaagaaccagguggcaguggagaaggaugacuucaauucuagcacuuggggaggcagagcuagaggcagagcuagaggcagagcuagaggcagagcuagaggcagagcuagaggcaggagaggcaggagaggcaggagaggcaggagaggcaggagaggcaggagaggcagaggcaaacccuguuuugaacaaacaaaaacaaaaaaccuacaaagaagaaggguaaucuuaauaugcauaccuggcuuauaacugaagaauauuuguaaaguuacaauuguguaaacauguuuaaugguuuucaaaaauaaaguauuggcaguccaugaagaacaggaauagaauauauauauauauauauguauauauauguguguauauauauauauauauauauauauauauauauauauauauauaaaaucauccuaucaguaugaaauucauggguaccguuggaaaaggcaggaaaauaaauaaaaaggcaagagaaaauuaauguuuaauuuaccuguuguuaauaauguaaaacuaaaaacaugaucauacuauuuauauaaguaauauuuuggaaaauuaagguggaauaaauauaucuggagguggagagaacaaugauauagugagguuuggugaggagggcauauugaguaacuauuuaauuauguauuguuuauuauaacaacgauuguuauuuauauuauuauaaaucauuguuuaugaaaguuccuggugaguuucuuuguaaaauuagagugagaaauuaaaacacguaaguuguucagaaaugauagguaccauaaauuaauuuucuuucuugaguuucauguguuccucaugguauggucugugacacuguugcuuauucccuugguggcuaauaauagcaaagaacuaaaugugauauuauuuguuuuuaggaauuugcuaggaacagcauugccuauaaaagcuaagauuuauuucuguaucuuugaaggagugaaacaagagcaaaaacaacuauagucucugcaguugucauucauuaaacauuaaauauaugccaaaugaugucaugagcucugcauaaguguuugcuauuugucauauuuuuguuuucaucauuccuuuuauuuuuccuuccuuuuuuuucuuuugcccuaucacuaggaaucagaaacuagagauacuauaauggauaauaaauguuuuuguauuugguuuuuuauagauugggggcagcacaaaaacagaaaauuaaaaaaaucaagcagcucagggauccucaaagcaggaugaacauagcaaugacguuucacccgagugccacucagaaguaguaggaugcucuggggggggggguguagaagccaagaagggaagcgauaguuugcauuaguaacugugugauagguuuagauccuccaucuuucuguuuguuuuguuuguccaucuguucuuuguccacguuuccucuguucauuauugacaccuuugcugauguuuuugcuuuguuuuuuuauucucauuaacugaguuaggacagccagguuguuauuucaggguucaguuguacucuuguuggcuuacaagguacaucuuaugagggguuuguauuuguuuuugguaguuguuguagguuuuaauauuaugucuuuuccuuaucagccucuauguuuaaauauuauccuucccuuuccuguuuggcguaagguucuuauaacgguaugcuucauuugucuuugaggcauuauuaauauacaguucacuucuucauuuuauaaauuccauaauugcaguuccuucucauucucuucuuuucuccuuuuucuuccuucaucucauuuuaaauuuaccuucugaagaaauuaaagaaaugauaaaaucuuacauuuaccacuucucacgcucuguuucuuuaugcagacccagauagacaucauauuuuauaguuucugugacaaaucucucuuucauauuucuuucaguucacuuuucagugaauucugguagauuuugucuacaguggucuuguucuuugguuuugaaggauguagaguuguaggguugcagugucucuuucagcaccagcaggcugcuuuccuuugugugcuugcugguagaagucuguggucauuccguuguuuugugucuuuuucuccaccugugcuugcuuuuucuuuuaagauuuuuuaacuuuuuuuauuauuuguuuuuaguaacacuacacauuucugacagaugcuuuguacugcucguuuuuaauucauauugguguaaugccuaaguggauacauagauuuuaguacuaauuuccauacaagauuguauuuaguauuaauuguaguuucugguauauuccuucauuaauuacaauauaggcuuccucaaagggaaacauuuuaaacuucauuuuguuuuuaguaaauacauuucaaaugaaacauaucauuggaaauugucuagacuauguagcauuucuaauaugcuaaauuuuugagaaaaaaauucuauuuacuuuccugaggccacugauuauuuuauuuaauuauuuaauaaucauauuucucuuuuuaaaaguuuauuuuuuccauuuuggugcaacuuaaaacuauuaccugucauuaguugaauagucaaguuacuccauucauugaagaccuagaaugagacagugccauuucauagcuuuuagaugguccuaaaugugaacuuugggaaguaauacauucuugacccuuuauagucuauuaguuccuguauugaacuaaucacagcuuuggugaccuaagcuuuuucagagagaucucucuuaccauguuaagcuucaugaaaaaaaauagcguuauugaaguaguauuuccuaaauuuuuauuuuucaauguuauuauuugaguuuuguuagaauuuagucuguucaguuuuauuuagguuauuuuuaagaccuuucuugaccuaaauucauacagauaauuguuccucagguaugauugucuuucacaguuuugggaauaaaaucauaguuuuguaucauuuauauaguugaucauauauuuaauuucuucauucagauauuaagacaaauuauugaauagggugaauacugaagugccucuguauagaguuaaucacaaaacucuucuaaaacugggaccaugaccacuagccuaaccugaacuuggaacaaaaggggucaucuaggaaggccaugcacuauggcaguguugggaaugucuuacagucaaagggucuggauguugacauuugaaaaauauuucuugguggagcaucugugaccucaaaaauuaugaauugucuuaaaauuucuuucuaagggaaagaccauaugaggggguaaacaaaauauuuuguuuauaauuugcuguaaagaugauuuauuacaguuuaauauuaaacagcucuguaggcucaaaauuuaucucacuugguucuaacugguguuucucucugacacauggugugaaucaacuguccuuccaacuugaaagagcagagaguucacugacgcaauccuuuguucuaggggaauuguuuccauugugccuucaaaagggagggacaugaaaagccuuggcucaugacaaguucuuuccaaguuagacacaguugggggcugaacacuggccugaggaagugaggucuauuuccucaacuuucuuaaagguuaacauuaaccuuuucauaucucuuuuuaaagacuacacaucagaaacuuuccauucauguguuccuauuuccagggcucuuccuuagauccuagaaguugcuuggauuucuuuccuucuccauagcaaaucugcuuuugagaagaucgaaugacaaagauuauuguccugaaaggucuuaagagacuagaauaauugaccgugauuguaaaagcuuguaaaucauacggucaaaauaauaguugaaugcaugcagcaauagauaaagacauuagaagauuuggugugagcauaggugccaugcacaggguaugacugugaauaagcaugucauuagguuguuuuuaguagaagccaaggaacuggagagggauguuaaauuccuaguuugacuguguuugcuuuagaaugugcuaguauuaagccaggccgugguggcgcaugccuuuaauccuagaacuggggaggcagaggcaggcagaucucugaguuugaggccagccugguuuacagagcaaguuccaggacagccagggcuacauagaagcuauccccaccccaaccuccuggaaacagagacagacuuugcuauauuauaggauguauugugccccugauacugcugacagugcuucauuuguaguuccuuuuuuugugugugcacgcugcugaaugaaguaguagcuauuuuuaaucugcauuucccugagcuggaauuugaauuauauaaaaacuagccauggucaccagcuaauaaguuguagagucaagacuugaaucuaagaagucuggcuuuguagcuuguacuauugaacacggccucauggacuguuuguuauguuuuaagaacagacccuacugaaacuugcccugagaauggaaacuugcauugaaguguacuuauauguuggguauuggaauaauuuuugaggguugcuagggaagagagggaccaggaccuagucuuuguauuuuuuuuuuuuuugaggguaaaaauaagauaaaugauaaaaauuuuaagaaagcaaauuuuggcuuuaagaacuuugcaguuggucuugcucugggacugacugccgugagugagcgagcugacuagauguggcagcauaggcuggacuaauagcugaugaagagaucuggagaaacuugucaugcugugaaauuagauuguaucgccucugugauuuccucuuuuucuauagguggccguacuaaacagaagccauuaaaaucauuauucuuuggguuguccucaaagaagaaaaaaaggggcggggggaggcugauuugauauuuaauggaaaugugugcuggucuaaaccaugaaaguuaaaaacauuuuuuuuuuaauuuaauucacuaccaucccucaaauguguguuuuuuuuuucuuuuuucuuuuugagacagacucucucauuauguagcccugguaguuuugaauuugugaucuuccugcuucuucugucucuuugguuuuaggauuauagacuuugguaaccauagcccaugaaauugucuuuaauaauuuugugcuguugauagagaauuuuuguauauuaugaguauagaacaggaagcaagagaaaggccuacuuuuugaguuuacaaguaagauuucuuagaaaaagacaagagauuccaucauagcaaacacuggagcuccuccuuucccaagucccuuuugagggauaaugaaagcagacuaauuaaauuaauuuugagauuaugaucaauaauaagagaguaguugaaaaagacacuuuauguuuauuuuuaguuuuaacuuuuuauugauucuuugugaauuucccaucaugcaccucaaucccacuuauugcccugacccuuccuaucugccuucugcccuugcaaccuucccuacaaaauauaauaaaauaggauauaauaacaacaacaauaauaaagucuugucauggaagcuauagugugucacacaguguacccuuuuguucacauaucuuuaacuugcaaauguucauugcagugggucuuuggucuguuucaaggcuucuggcuucugcuacacuaucaauacuggauccuccuggggauuccucucagaguuguugcucugugucauggagauccugcagcuuuggaucuggaggacuggcccuuucacuagcuccaugggguagaucuugggguggaccaacucaaaagcccuggaucuggcugggccugggaggaagcugagucgguagucugacagggcgagcucuccagcacugcccagccagcucacccagagccucagcaagcagagggcagggucagcucucccauucuggugccuuguggcuagcucacugacacuuuugccaccauagucagcucuacugugcugcccagugaaguacagggcaugcucuccagaaugcuucagcuggugagggguggaaccagcucuuccuccaucagggccaauuuacccaccugcuucaaguggugagggguaaggaggguagagggcauuuuuuccucccccaugucaccccgugguagaugagggacgaugccaguucucugcucuuaugacauugggccuagcucuuaugccugcuucagguagcaagggguggaggaugggagguggggaauaagggauuggggugcugaaaagggggagagaacaucucuccuuugcccacacuggccuauagcagaugagaggcgagguauuuuauaguuuuuaaauauuuuguuucuuaagacagucucagauaugcugggcuuaaacucgguagguagcuaagguugacuugaucuuguuaccucugccuuucaagugcugggauuauggagcuguguuuucagccuggucuauucagugcugggcaauccaaggcaucuugcauuuuacauaaacacuuuuaacaauugagucauaucaucucccacccccgagaucaguuuuguagcucuguaacuuaggaccauccucuugugccuuccuucugggagcugggauuacaaggguaugcuacuaccucuggcugccacuccaugguucucaauuuuauuuuauuuugauaaaauuuuaagaauuuggucucauguuaaccccaaaguguuuguucguguuuccuguuuauuuuaguuaacaucuuauuuaggauuuacugugagucuaguacuguucuagauuuuaaaauggaauuucuuuguucaaucauuaaaaauuacacuuuaaggaaaauauuagaaacagaaagguuauaaaaaaaaguaagagucaaagucaggcacggugguccacaccuuuaaucccagcguacuguaggcggcgacaggcggaucucugugaguuccugguuagccugaucaguauagugaguuccaggcaagcagggcuauauagugagacccugccucaaacaaacaaauaaacagacagacaaacaaacagacaaacaaacaagcagacagcacaaaaacuccgagucaccuuuauccagguauuuauuucuuuaaaugauuuuccuuacugucccuucucuucccucuaggaauguaaauguaaguauuuggauauauuuaccuagcuguugaguggacauaugguuuaaauaccuuguuguuuucaucucaucuugcuuucucuuuuuucuacucuucaaaaaaaaaaaaaaaaaaaaaaacccuuuccucucaccuuuuauauuucucuuuucuuuuuucuuuuauuuugagacgggguaucucuuguaccuuggcuguccuggaaccuacucuguagaccagacugaccucaaacuugcggagagccgaaugucucugacuuccaagugcugagaucagaggcaugcacugccaccagcaagcucauuuuguuguucuugauaaaauugugguaauuuuaguaguaauaaagggaacuauuucuauguaauagcagucuuggaaagauugcuucauaugcagacugaugauaauaacuauucuaggaggauuauuauuuuagucacuguucuauugcugugaagagacaccaugaccucagcaacuuuaaggagagaaaacauuuaauuggggccuugcuuauaguuucacugcauuagucuauuaucaucauggcggggagcaugguggcauauagacauggugcuggagacguaguugagaguucugcauuuagauccacaggcagcaggaagagagagucucugagcuuggcauaugcuuuucaaaccucaaagcccuccccuauugacacacuucuuccaaccagaccauauguuacgucuuaauccuucucaaauagugccuuuuucaaaugacaaagcauugaaauauaugagccuauggggccauucuuauucaaaccaccacaguuauauuugagggauagcugaguuacuauaugagaaauguucauuugacauuuugacacagauuuaaaagaugcuuccuuuuauuaugauuuagaaaugcugaauuagguauauccucuucaguuuuagugucauggggacaauuuugcccagauucggucagugucauagaauuaauuuuucucugcuuuuugcauggcuagcaauauagcccccacuucgaguuggcacacauucacuuugauuucagagacagacagacagacacacagacagagccuuuucaguaccacuuucagguguaaacugaucuagcuuuucaucaugacaccaggucaaaguucccuguguacucuuaugaugacagaagggcuuaauggaguguucaauccaggccagacuaaaguuauaaaaaucuguagguaacaggacacagaagauugucccuucuuauuucuaugucuguguuauguggggcugguuggguacugaugccuaucauuauaauagagaguucuuggcuacuuccacaaaucuuuaauaaacaccaccuugcccuuuccuuuaaaaacaaaacaaaacuuugccaaugaauugagaguaaacuugauaauuuggagcauauaaccauguuguuuggaagcugucugacuguuuccauuguugcagccugauuguccaugguuuaaucaucaguaguugugaaggaaggcagggggagaaggggggcagugcugcaggcugcauaguaccauaaaaaauuuccaccuggaagcaauuuuuccuaaaagcccuuagggacugcugucacccucccccuucaacuggcaguaaggacuagaaacaccagcuccucuuggaaccagccuuuguugcucccagcuuccagaagggcuagaggagagcuagggaaauaacaaauuauucccagacauucuucuauaagaaauucccuugagccuucuuucuucuuuuccucugguucuuucuguauuaauauuuagcugaaguacagguuauuugcaguaauaggacucaaauuuacuucuuaguaagaguguuuauuaucaucccuagugccuguucucguagaaaguugaaccgucuuuggguucugccauaggcccugugucacuuuauaaugccuucucuguggaauguaggcauugauccgggugugaacucucucaaggaacucaugguccugugggagugaaacacauguaaauaaauuguauguauguggugccuuucaaagauaaugaacaaauaaaaauuuucaagcaaaccaauguuaacccucuaccagugaaauguccuuaauggugcucauucauucuuaggccuguuuuccagugugacuggaggauagaaugagggguuugggaaaauggaaggauaauacuuuugauggaauuuacucccaacuacacaugguuuccuagggucaaggucaguucagauuuuuauugucaauaugaggguuaagugggaaauggugauaccaugccugugaagaaauaacucacucuguaucucuccaaaugaagaguaaccagguguuucaacagauuuuguaguuuauuccuuuaaaaccagacuauuauuacauuuauuuauacaugucuguauguguguugcaugguggcggucaggggacaacuugccagauuugauucuuuccuucuauuaugugagucccaggaauggaauucagauuguaaggcuuagcagcagguaaguaccuuuaccuucugagucaucuugcuggcccuaccuauuugcuuuugguagugauuuuguaauuucuucaguuuugggauuaaauguuuaaguuuuuguuuugguuuaaaucuuugcuauuucuuuaaauauaucacuuauuuuuaguuuacacauaucaguuuuaagccuggguaaauaauuuuuuauuauuuuuaagcuuuguuguugguuuuuuuuaaaaaacuauccauguucuaagauuuguuuuuugauacuuaaauucuacuuuaaagaacuauuacuucucagaagucuuagaacuaugaauuaaacuauauuucucuagagaagauuuauguucauucagucaguuauaucuggacauugggaaggacauugcuucuaaaauaaauaacaauuauuauuugugagaugauauuuugcuauguuccccaggcaugguuugaacuugaacucaagcaauugauccuucuacuucugacuuccuuagugcugggauaaaagaugcaccuccauaccuggcccuaaaaugaagaauuugacauuuuuugacuguacagauauuaauaguaccacugugagacuuauucuuuuguuuaaaaugacuagaagcuuuucuuucuccugcaaccagaaucaauaccagaggagggaggucuccuugcaggcucccuuuacccuucacugagguaucuugguuuuaguuauuuugagguccucucguuugucucuuugauuucuguuccuuuuuacuccagucacuggagaugguuuuuauuuucuuuacugcagagucaugcacuaauggucuagaaccuuaguuuagauuuuuaagauuuacuaccggaaguguuuuucauagcaugucuaaugcuuugcauugcucguggggagcaccaucuuauuuugcuacuuuguuuuugauuacauuuuuuugaauggaaacaacucuauuauccuuuauuggugccucaggguuuucagugcuagggacuuaauuuuggaguauuaaauugcucugguugguuggauucacuguggagauuaggcuggccuugaacuugcagugauccuccuacuuagaauguuggauuuacagguauauacuacugugcucauucauucauucuuuuuaaaaauuaguuaauuuuaauuucuuuagagacaggaucucauuguauccuaggaugacuuacuguguagcucaggauuuuagucaugcaccuuccuuaggcauucuuuuuguuuuucucaugucaaauggguaauguacccaacuucauaacaagguuugaggguaguaugugucacacaaugaugcaaauacuuaaucaucuuacuuaugaacuaaaaaaagaucccgccucaaguacucuuauuucuaaucuuauaauuaguaacauucaugauucagcuaaaaaaaaaaaaaaagcaauggaauaauaaauccuuuugcuuuuaacacgaauuuguacaaaggaaguaaugaagccacugagaaacuuuguugagacucucuucagaugaugauggugcuuuguuccaacaggauaguccccaaguuguaguuaagacucucuguaggcuuacguugggcuaucuuugcuucuauuggcuuauuuccuguuugacuucuguuguugauuuggauauuuuaugacaaauuuuccuuuucugagacuuucuaguuguauuuaacccaagucacauuguuuggaaggcucuuuggcuaggugccagcugaagcugccccgacccugguuuuuggaagugcccaccuuuggcuuucuuucuugcccgagacagaauucccuuaaagcauccucuugguuauaugggcagucuuggugaagccagucagauacauugggaucugcaaagacagaaaaagugcuggaauguguuugcucuugugcgguguuacaaaaccauuuauauauuauauuacuugccuuuuguauugcuuugaucaaauacuugacaagaaguaacuucaaggaggaaggcuuuguuuuggcucccaguuuaagaggauacaguucaucauggugggaaaggcaggguggcaagauagaaggugguugguuauauugcaccacagccagaaaauaugguuaugaaauguuacuacucuaguuggucugggagaguagagcccaaaaaugagguggacuauaguaucaugcaauagccaacuuuauucagaguaucagacaauuuauaguuugaggguauucuugaggguuaagcaaggucagaagagcaaaggccacaugaguuuaagccauacacugacugucauggggcaagucaugcuugggaacaucauucuggauaccaguggguagggcgaugugccaucuacaguaagcccugcuccugucaguacaucugagagggcucggaagcacaucccaggagcaacgcauguuauggaggaaugaacagaugcuacacgacuuuugucuuguuuacucggcguuuucucacaaggucucaaaaaucucagacagcuucauucauagacuguguucugacaauuagauacugguguuugagugaaaaaaagaaauaaaaaggaaagaacaugacuacuccuagguaugauggaggagaaaguuuauuuuagguaagaaggagcacagucagaggcaggggcaugugugagaguccagaguggacaagaccgugagagccauguguggagagaggggcaggggagagggcacagcagccaccgaccaggaccaagagacuggacaagagaauaaacuaaaggaauagguaaccaaaaugguuggauuauauagggaagaacggcugggggaagggcaguuuagccccugggcuggagaaauuuuugguugggggugggagggaugaaugcuagccaugcccuguaacagguugggacugaggguugcagagaaccugguggccaggucuacuuugauauguuaaauaggcaccucagcugguucagcuugcuucuuccuuuuuuauugaagucacaaacucuaucccagcuguucucaaccugucaagaccucuuuggugggggacgaacuuuuuauaggaguugccuaagaccaucagaaaacacagauauauacauuaugauucauaacaguagcaaaauuacaguuaacaaaaaaauuuaugguugggggucacaacaucgugaggaacuauauuaaaugaccacagcauuagggagcuugagaaccacugcuccagcccuuuaaaugguacgccuuuccauauuaguuaaccugaccuagaaacugcaucauggacguucccagaggcuugucuccuacauuauucuagacaagucgacagaacaguauuaacuauuagauguuuugugaucaccuuagauuucauuaauuacaauaugcgucuccagguauugaugaugauaugcaguggucuauuuuguccuguacccagaguguccaauuuauaauccugaagucugaauacaaucaguaagcauacugaaguaaguagagauauaaacuccuuuugaccucuugucguucucuuucaacaucaugcucaaauguguuuuuccacuuuauuuuuaacuuuuggaguaaacaaaaaugcuaaugauucuuuuauggaguuuaaugagaagaaaauguuugagggauaaagccaugacaaguuaaaaaagauauaugaaaaagaaaagaccagaacaaacucuggaaucuuuuucuuggauaaucaaaaccaaaacuccaaacugaaaauguucaguucuuugugucuugaguuuuucuuggucuuaagacauaugaguagauauguuuggucuccuguauuaauuacucuugcagccaucucugaaacaaggguaaauccacauccauugcuugauuuacauuuccucuuuguauccauuuuuguccucuucagugggagaaucuuuccacuucaggcccugugaaaacacccggagauaaaauggguaagagagucuuugcacaagggaggacuaauguuuuaguauaggaagacugauaauugaacagaccaucaugauauaguuuaauaaauuuugugagggcaguuaguuacagaggagguggggaugaaaggugcuaagugauuagaaauggcucuucggaagaaggaaggugugaacugugguuuuaagagugaaugagauuuacuuugaaauggaaggaaagggaggauaguugaggcuggagacuggaguccuuaacaaacuguggauaccuauuguuguuugucucuuugauuugccuuugcaaacugaacaacuugcugcauuuaggauacuuuaccaugcaaauagcagaggauugagggaaagugauuuaaauaauugguaauugacugacaaauggaguaucuggagacagcuggugagaauuucuucacaguccaggacucagguguuuuguacacuuuccccuuucuccgccuagauuauuggcaccauuuccucucauuuuaguaugggugcuucaccugccugugucuuauuucuacagggcaguauuuaugguaggaaaagcaacuuuuuacacacuucccuccccaacuuuggcaugucacuaacaguuuucccuuuucauuggugagaguuguauccuuauguuaacuggucacugacaagguaacuuaaaguuuaccucuaguuguaggauaggaaggugaaacaccagacagagacgggauugcucaaacagaaaagcaucaauaguugcuauguagacacagcuaauccacaacucacucauccugcaguggaauuccuccucccuccuuucucuucucucauacuucucucucucuccucccuccucuuucucuuucuagucaggguuucucuguguagccccuggcuguccuggaacucacucuggagccaaggccucuagagauaugccugcuucuuccucccuugugcucagacuaagggagugugccaccacugcccagcucccuuuuagcccuggcugaccucagccuccugagugcagagauuaugaguguguaucauccacccuauaugguuccuuccuuaucuuugcaaaaguagauugaagcugauuuugacuuuaugcaagucauacacuucuguaguggcuuaguguaggagaaugguaaguauuuguugaauucaaguuuuaagugucaguuuaucaguuaaaagcuuuuaaaauaaugcuuuugaaaucuaggugggagggggauauggaaccauuaugauguaucaagguguauuauuagcaaugcacacuaggaugcacaaauauaccuuuuguaaaaaccuuugauauacuagggagguuauggaaaucaaacucuuaggccuccauuuuacuugaaucaacauuauuguauacaaaucacgauuaauuucuaagcauuucuucuugcuuacuuuuuacaguucuaggauauucuugugauggaaugauaagcaauuccccauuguuugcuccauagucuuuuuaaaaacuuuuuuauuuuuggauauuuucuuucuuuauuuaaauguuaucuucuuucccgguuucccucccucuuggaaacacccuaucaauccucccucccccugcuucugugaggguguucauccacccacccaccuacccacucccaccuuccugcccuugauuccucuacacuggggcaucuauggagcuuucauaggaccaaggaccucuccuuccauugaagcauuacaaggccauccucugcaacauaugcagcuggagccauggguauuccuuuguugauggcuuaguccuuggaaguucuggggggucugguuuguugauauuguuguucuucuuaugggguugcaaaccccuucagcuccuucaguccuuucucuuacuccuagagaacucacucuggagccaaggcagagaucugcuugcuucuuccuccccugugcucagacuaaggaaaaggacugaaggaguugaagggguuuguaaccccacaggaagaacaacaauaucaaccaaccagaccccccagaauuuccauagucuuguuuaacuguuauguaucuugugucagaaagcauagagaaguacagucauauuucaaagaguuggucuuuucuaagacuuuuuuuuuuuuaaggagguuggggugggugggaggugcggacaaggucucagguaacuccugcuggccucaaacuuguaguugaggauggccuugaaugccuaguccuccugucucugccuccagaguguugguagcauggccauuuuuaugcaguucuggggcuuucuguaugaaagguuacacuauaccaguugagcuacauccccugccuuggacccacagauuugaucaaaugccuuuuuuggauguuuuucaucagucuguuuuauuuaguuacaucgaauuccauuuuuaaagaaauauuagaaauuggucaucacuagauggcagucuuucuccacucuaggugauuuauucagaagggaaaguguaauacuauuaaaaacagugcugacugccaguagaaagcuaauuuaguagaucucgaacuuuuccaguuuaagacuuguuuauuuauuuguuuuugccuuuuguaucugauaggccuguugguuauugaugacuuaugcugaaauauauuugaaaugcugagucuuuaugguuuauguucacauugcuuuuuacugugauagaagcaauuuguaauuaaagacacaaaaugcaaguaaauauauuuucaccugucucauagcuacauggaaacuguguauccuuuucccuugcauguacacaaagaguucacccagaaccagggaguacuguaaguuuccagaacaugggaacuauagggcacuuucuacauuccuucauuuagauuugugugcuuuagauuucaacuuuuuuuuuuuuuuuuugagucagggucuugcccuguuguccuggcuggcuugguacuaaucacugagcucagaccccugccucagccuccugaaugcugggauuacaggccugggagcuccuuacuaaccaauucuuauuuuaauuuuuaaauuuucuacuccaagggcccacuguaaaccuuuaaauuuaugcuacauccuagucuaauagaguguuaaaaucaugaagauucuaaguaggaacuuggcgacauugauaaggagauuaaaucuaccaccugcugucugucacagugcacuccuccucauuaugugccugcaucagaaaguucagcgcucagcuaggacuucagggaaauuguaauugauugcuguuuccuauuuuguaaaugagaaagagcugaaggucagagagauuaauugaauuggccaaagauguagcuaauuacagggcuaagaccaaggccucacaaucagacaucuaaaauccacauuuucuuacuuugauuuuuaguuuagguuuucuuuucuuuuuuaaaaauaggaagcccagggaggcauuaucuaaguucugauucucucugcuuauuuuccuuugaguaggccuuucauaguucagggggcuuugcccuaguuaguuaggcuccucuuggaggccucacccuccuugcuccacuucccaacugcuaggauuacaugcucugcuauaccuggugccugaauuucugaacuuugugauuuuuuuuccccaucaaguuuguucuuuaucuuuggagagaaugaaugaaaauuuuuuccugguagaaccuaauguagacacuauuacugugucagaauauacugaaauuaaaccaaaaguuuuuuaaaaauugaauaccagccuauauuuuuaaauuugaggauuuuucagugucccccccugcagcccccuaguuuucuacaugacaaggaauauuaauaucuuuacuuagaagauuccuuuucuuuucuuugaaagaggaagguuuaagcuugaaacuuacugaaaugucagugguagguucggucaaguguguucuacauagcuuuuguaaaaucaucuacuuggagggccgcuuauaauuuuguucaucuuuuucuuuccaaggaaggggaaugaaucuugauggcuguguuuuuacugaagucaguguuuguaggcauguguguguguguguuacccuuaauuuugcggugaacugacaugaugaggaaaauaaacugucuuauccagaggauaaguacaugaugauccuguaccauacauuacuccagacucaaaaaacaugggcacugagcaaauauguguuugcugaaggagugucagggaucagagauaauguugacaugucccagucagcguguguguuauugguucugaauugauacugauuccaggagaccuuaagaagcauuauggcccuccaguuaaagcagggcuuaauggagguuagaggauuaauggaguuuggcugaagucugauucacaggucuagugggucucuuaacucauccugugguaauccaaccuucccaccccuaauauauauauaguugggauagauauacguagaaguaggaggaauucuugcacuaguucccugaccuagcaugagggcuauuaugguugugguuggaaagacuaaaugccuuuagaguugccuguuccuggaaaaauagugaaucaaugcaguguugcaucccuagaacaauugcagaaauuaguacuaucaucaaggacuuacuugaaagaugccuggguggagaaugacaguugacugucaaaaacuuuuaucaaguagugacuccaauugaagcuacucuaccagauguagaguucuuuucuugagaaagaaaguuccuuucuugagcagguuaacacaucuccugguacaugguaugcaacuauugaucuaggaaaugucuuuuugcucuauaccuaucuguaagguccuccagaaacuauuugcuuucaguugucaagggcggcaauauaccuuuauauuaacuauacauuagcucucuagcucugugucauaacuuaguuugaauggaucuugauuaucuggcucuucuuccacaacguauuacauuaguguaccauauugauggcauuauacugauuggaccaagugagcaugagguaucaaccauauugaacuuguugguaacacaaaugugcaucaagucgggaaauaaauccauguaaaauucagaagacuucuaccucagucucuuggucacuguucuauuucugugaagagaugccaugacuauaacaacuccuauaaaagaaagcauuuaauuaggauuuacagugucagagguuuuguucauuaucaucauggcagugagcauggugguacacagacaaacauagugcuggagaaguaacugagagcucuacauuuggaucugcuggcagcaggaagagagagacauugggucuggcauuugaaaccucagagcccacccccaucagcacuuuuccuccaacaaggccauaccgccuccaaaaaagccacaccuccuaaucuucuaaucuuuuucagucacucacuggugacuaaggauucaaauauuugaguauguggaaccauucuuauucaacccacugcacucaguaaaauuccuaggagaccagaggugugggacaugccgagguauucauaguguuuaguuugccuauuuggauucuggagagaguauauuccucacuuggguaaguuacugugacucagauaccaauggcuuagaaaaccauuagcuuugcauggagccuguaacaggagaaggcucuuuaacauguccaggcuguugugcaggcagcucuaccacuauaugauccagcagaccuaaugauaacuugagguaucaguggcagacaaggaugcuauuuggagcccuuggaaggccucuauuggugagucacagaagagaccuuugggauuuugaggcaaggcucugccguaaucugcagacaacuuauucucccuuugaaagacagcucuuaaccugcucuuaggccuuaguggaaacugaauguuugacagugguccaacaguuuaccauacaaccugagcuuguucuugcucuugcugcaagaccuuuccuuuacgggcauuagagccuacuuagggauuccagcacauauuaaagaccagcuaauacauccagucucuuggacugaauaacuacuggguucuuggcccuucuguugauaggcagccauuauuggauuagcuggaccacagccuguaagccauucuaauaaaucuccuuuauauauauaugcauauacauauguauauguguauauauauacacauauacacauacauagucauucuguaagucuguuucuauagagaauccucauuaauacagaagccuuuggagagacuuaagcugggggggguaauaucugaaauacugauucaaagagauuguuuuaacugccauguggacuauguaauuggugguggugauggugcugaugguagugaaugcaugaugaaauuuuggaggcuuuuuaacuguucuggugcagcuaaguuuuacauuuggacaaugauuuaaauagaaaugguggguuguauuuaauucuagaauauguuuuggagguugaguugucaugacuuaguaguagacuagauggggagaggauggacagaugauaaaugauuguaaacacuugacauauguacacacauguacacacacacacacacacacacacacuacauuuggauggcuuuuaacaaucuaauuggaguacugcaguaguaauaggaaauuugaguuuaaaguucagagaaaugcucucauuuguagauuauccaucaggaagucaguacuauaugauugauaauuuugagccaugagauugcuugaugggagagcauggagagguguaauagaggaggaggcucuagaagggagauugagaaggugugucagugaaaggguaaauucauguuaaugugguuacuaucacucucuccagaagaaagugcuuaaugaagaagucagcaccaagccucaacaaauacugcuguuagaggaguaaaauaaauacuugcucuagugggaagaaaagaaguagaaaauguuuugcaagaauggaaagcagaaaaccuaugguagcuggaaggggacaugcaguucagggcaaguuuuccacugaucuuuauacagacaugaucugauggaaagggaaaauuacaugauguagagcagaaguuugugaaacaauaagcaggguuagcugcaaaugagcucugucuguguagagcagacagaggaggaaguacagagguaagcagguuggcugguuuucaugagggaagaagaaauaguuaaguguauucccuucucuccuuucuggaaguguauaguuagaacaguaagugagagggguggcucaacauugaggcagaagaaauuaaaguuuccacacaaugagaguuuauauuauuuuuugagauguuaaucuuugcuuggguugaucauuccuaauucaaaagucucaaguacgaaugcucauaaggaauguaugaugacugucauaaguggaaaaugccaggcuggccucauguuugugaccuguuguagucaaaacacuaagucacuaagacauugaauagauuuaccuucuggguauaaguuauaugugaaaacaugaugaauuguguguuuggauacaagauaacucauacaaauaugaguuauucccccaauuccucuaacuagaaacauuaggugucaagcauuuuagacaagggauuucaucuccaguaggauuuucuaguaguguugagugacuauuuuagauuguagcuguguaguuauacugaagcuagccagcuugccugugauuuuuuucuccaguacuauucagcuucuuggguggagucauggaguaaauggauaguuggauuuauugaaaucgaguuuuuccagaugagcuaaauggagaaauggacaggagcuguaauucaagucuuuuauuuugggaugacagucugauggugugccaaaugcuuuaaaugaacuagaaagcaacuuuuuucgauuuuucuaaaacaacaaaacaaaccggacacucuuuucauguggggauagaauggacucaguuggugguuuauguauccugaauaucuaguuucuauagaaguuucuuccgaguuugugauucucuucuccucagaaguacuguaaucuucaugccaucuucucuuuaaaggucugucuaugauggugaggaacauggacgauucauggagaagcuagaaacucguauccgcaaucaugacagagaaaucgagaaaaugugcaacuuucacuaccagggcuuuguggacucuauuacugagcugcugaaaguacgaggagaagcccagaaacucaaaguaaggagacauuacuggguauuugcuccucuguccucuucugggguucugauuaguucugaaagaguagggccauacugcauggcguguagaacagguguguuuuauuuucauggggcagauacuuuaguucccacuuuucaaauagagaguccaggugaaggugcauggacagccuguccaaaccacaaaauugauaagaagugaucauuacuaaacaaaguaccuguacauuuagauaugaucauaucauuuuccuggcuuaaaaaccugcauagcucccuuuguuagguuugagagaacacaguccagcauacuuaguauagugcuuaagguuccguucaucuggcucugccaugucuucacucucauuucuuggcuucgauggugauggugaugauuauuuugagauaggguuuuccuauguauccuauucuggucuccaacuuccuccuuccacagcuucucagguacuaggauuacaggugugucucacuguaccugggguacagugagauuuuuaugaaguauggaaaggaauucauuccaaaaccuauauaaagaauacucuuuuaaguuaguuuagugccuacaagaggauugaaccagugaccaguuacuuagacuguuccugaagccaccagcuucuuugcuggaauuuccacccaaccccccacgccccaggcauuaaaaagcugccauuacucacuuacuugaaaggucaaggugaaaaggccuguguggcuguggagugcugccuacagcauguuucauguucaggcaggucaccgcagagcccuucucuuagaugacuuugcuuguugaucugaagacuauucuccuaaauuuguuauguuaaacaguuuagauuuuugccauugcuaagaagacucaucugcucuaucauuaauaauaguuuuauuuuauucucucuggucuuuauacguuuauuuuucuuguuggaauuuaaauuagaauccuuaauugaauuuuuuucuucaugggguuaacuguauaauggguauaaaauucaucucaaagaauauauuacuuaaaaaagcaaagaaacaguuuuuaaaaaaaauuuuuuuuauuagguauuuuccucguuuacauuuucaaugcuaucccaaaggucucccauacccaccccccccccaauccccuacccacccacucccccuuuuuggcccuggcguuccccuguacuggggcaucuaaaguuggcaaguccaaugggccucucuuugcagugauggccaacuaggccaucuuuugaugcauaugcagcuagagacaagaguuccgggguacugguuaguucauauuguuguuccaccuauaggguugcaguucccuuuagcuccuuggguaauaucucuagcucccgcauugggggccgugugauccauccaauagcugacugugaucauccacuucuguguuugcuaggccccggcauaguuucacaagagagagcuauaugcaaagaaacaguuuuauugaaaggcuaagcaagcuauuagauaucaaauauauucuaaaacugcaauaguuaaaaaaaaaacauuugccugcaaaauauuacuuaaauagacauaaaaccauuaagcuauuaaaccuuguaacuucuuuuauuuaaugugaaauuuuguguuuaacuacagaaauauugauguuugaaauagaggugcuauauugcuucuagcugugggauauuauauaacagauauauaauguaauauguuacauaaaaauaucauuacuuauauaaaguuuucaauacuuugaagucucaaacacauuggauccuaagguuuguaugauagaacucaucuaccuugagaaacagaauaaugccaacaucaucaaauacuucucuauucucuauguuucuuaguugcuuucuccaucuuagauguaacaagucuuuugauuuguugugaauguggaaugugcugcuuguccucacucaggccucauagcucccucacaaucuugauuauucuuuuucuaugcuucuuagucuugugcauugcaaacuucucccacauauucuugggaaucugcuccaggaugggccaaagcauacaagggauguaaaauaugguuuaagcaaaauuauacagauaauugccuggaaacuuagcaauugcugaccuuaguuucugauugauacucaccuuuguucuacuuucuccccuacuuuaaauuggcucaaguuagaaauuucuuuagauuggucugaaugcuucugagggaaugccugacuauauuuuuccaguuugguauuuuggcugcuugagacucuuagcuaguuccucugagggugagaggaaucaugucuagcugcacaccugguaagcucugcucuggguacccauuugaccugggugaagaaugcugaauuucuuaacucuagaaaggaauuuagagguggaaauuuuaaaguuuuuuuuuuuuaaagauuuauuuuauuauuauauguaaguacacuguagcugucuucagacacaccagaagagggagucagaucuuguuacggaugguugugagccaccaugugguugcugggauuugaacucuggaccuucggaagagcagucgggugcucuuacccacugagccaucucaccagccccaauuuuuaaguuuuaaucaaccacuuauaacacuaaguuaauaacauuacacuuuuugugaugcucauuauuuuguguucacagcaucuuuguauaaguauauauacaguguguauaugugcaugcacguugucuuaguuaggguuuuacugcugugaacagacaccaugaccaaggcaagucuuauaaaaaacaacauuuaauuggggcuggcuuacagguucagagguucaguccauuaucaucaaggugggagcauggcagcauccaggcaggcauggcgcuggaggagcugagaguucuaugucuucauccaaaggcugcuaguggaagacugacuuccaggcaacuagggugaggaucuuauauccacacccacagugacacacccauuccaaccaggucacaccuauuccaacaaggccacaccuucagauggugccacuuccugguccaaggauauacaaaccaucacacacguccauacuuuuuuauauuagcagugucuuucuagacaguuuuuucauuguaguauauagaacaauauacuagaauuacuagaauucagcuagaauuaagauaguuacuauuuucuuacuguugacauagaauagagcuaggaggcuggagagauggcuaagcaguuaagagcauuaccauugacauagaguuggcuccuauggauuuguuuuuggugaugguuugcaugaaaucaguuugcuagaauugaucaguauuucuaagaaaacuuggaauuaagcagaagggaauuaaauagaaaauaaaauguacuauaucuaguaaagauaaacauuguuucuugaaaauugucucagucugugucucucucucugugugugugacuuuguuucugucucucucugugucucuguucauuuuacaugucugugucugucugugccucucagugugucuguuauguuucucucuguauaucuguuuguauccccaugugccuguaguuucucuguguuuauaucucugcauauaugucuguauucaugagucuuaauguaaaauaugugucuauaaguuugaaguuagaaacuuugagaaaugaugcaauaaacaagacuauuuuauuugcguaugaauaauaguguugaauguaguuguauuggagguuuuaauuuugggagaacucaagaauaggcuaaaaacauccaguuucuugagaccauacuguuuuuuauccacauugguuucucuuacuuugaccugaauccuguuuucuagugagagaccuucauuagaagcagccuuucacauuccugaggcugcuuagccauaagaggcccauuggacacgcaaacuuuauaugccccaguacaggggaaugccagggccaaaaaaugggaauggguggguagggaaguggggggggaggguaugggggacuuuugggauagcauucuaaauguaauugaggaaaauacguaauaauaaaaauauuaaaaaaaacaaaaaauaguacaacuuuuuauauauugguuaaaaauaaaauuaaggaaaaacuaaacugcaaaaaaaaaaaaaaaagauaaugacaugccagacuggcccagugccucucuaucucccgcccuucugaccuaaguuaaauguuaacaggcugcuaauguuuaaauggaccaaucaugugaaacugcgccaauuccucccccagccccaccccuuuucuauaaaaaccccuagcuuccaagacucguggucgacaccucugucuccugcaggagauacgugucagcccggagcuccaucauuaaacuaccucaugcuuuuacauuaaaaaaaaaaaaaaaaacagcagccuuucuuguguuagcucuucaagagguuugaaacagccauuguuuaggugugggaugaagaaugcagaguccagauauaguguguaggaucuccaaaucaccuuuccuuuaucuaugggcuaaaaauaacuucguuuguuuuuuaugugguauauguuuggcucuuuuauuuauuuauuuauuuauuuauuuauuuauuuaacauuuuuaaucauacugcaguuugacaucugacaucugaaugucauucucaucaguugaucgugucacccuaccaucuucuuuuauuuuagagugggcauaacaacuuuuggcuuguaggccaaauucaguuugcccccuauuguuguaaauaaaguuugaucgaguccuagauauaccagcacauaacauuuuauuuguggcuacaguucugucaguguuggcuaguuauagcagaggauuuguggccagaaaaacaaaauauuuacugucuuacuguaguggaaccagauugcuuuguugaauguuuuagaguugcauuuagggacuacauccuuucuugccucucacugagcucacagucuauugguuaaugguguucuucacaucuaaugguccuaggauccuaaguaucuauugcuucuuuuccucacauuuuauaaaauauuuuucuggaagaggucagauuuuauuuuaucuuugaaagcagggauacagucuccaaucuguuauggauuauauauuauccaguuauuauauacaauuuaagauaaaaauuuuaaaaaguguguuuucugaaaaacuaguuucuugagaugauguugaaucaaauaaguguggaaaacacuccuuaugaugucucuuuccuaagcauuuauaguguuauuuuuccccucuuuguguguauguaugcaaugcacgugugcacauguguuaauaacauuagcuagcauuucuugaugcuuuaaggggcauuguaggaaauacuggguugagguugcaguaaaaguauaaggaguggcagucacuaguagaaggccugauugucucuguuuaagaaguuuacaaguaaauauuguccaugcuuugauaaugucugaggugauaaagaauugcuauucuaaaaauuuauuugucuuauguuaguggaaacaucaagaguagaucauugaaaaggucugugcuugucccuuuaaauuauaagucauagcuuauuuaaggcuuauucacuuauuuccacugucugguggugaaaucgaugagguaaugaaaguguuagaagcuguuaugaguuaaugaucccaaacuauuuaguaauucauuuuguaucauuaagaugauaaguaguaacaacguggcuuguguuagaaaguugaacuuauuccuagccuuugcaggagugccuugugaaguaagaagugucuguguuaaaauuuguguucuagacauugcacagauaguaaagcucuuuggauuauuuuccauuuuauuucuuucuccuuuuguuuuucuuguuuuguaguuuuucccucuuuuuucucagaguuagacugugaucgaggcuaugauaauaucuuacuuaggaaugcacuaucuaaaguacguccuaaagcuuugcuuuuccuuuugccaaaggucaugggaugccuaguagagagguugguaaggguuuaaguuguagagcgagcagcuggacccccaugugcuggaaugcagaaagcaccuagagaccuaaccccagucuucuuauauuacauuuugaucuuuauccaacuguugucuaagcguuuguuuuuuaugaguuuaaauugucuucucuccacagaaccaggugacggacacuaauaggaaacugcagcacgagggcaaggaaguaaggccacuuuaccuucuacaacgucuuuucuguuucgugcugagggcuguucuucacuuugggacuuacagaauauaagcaguguguuggaaguacuugggugcaguuguuacuaauuguaaugucuaccugaauaaaaugaaugcagcccuucuuggcuguguuuaaaaaaagaaucauugaguagucugccauaccugcuggaauguuccuccuccaucuucaccuggcucagaccuccacucuugugguucuuccguuuucagucaggaucccagguagccuaagccugauuugaacugauuuccacuuucucauuugugauuacugggaguaugccgcuguaccugccuuauauuacccccaccuucuuuuguagaaugauuuuacuuauuuuaugucuaauaauaugccaaauaucaggauuuuuuuuugaacaggguaugacuauguagccuagaacucaugaacuuauaagaaucuuccugucucagucucaagaguccugggguuacaggcacauauuuacauauuaccuaguaguucauauauuaccuaguaguucauauauuaccuaguagguaggaucuuuccugaggaccuuguuggaaacugcagucuuacccucauucccugcguucuuuuuguuuuucuccacugugcuacuguacuuucgguccauauuuuuuacucauguaguuguuuuuguuugucuuccuccauuagaauuagcucuacuuuaguagcagguuugcuuguuuucuuaauugugcaucucuucugacuuucuaaacaacaaauguuacaaagugagugcgcaacaacuguuucuuuaaaaaaaaagcauaaucaauucuguuaauugacaaacucaucauuuacaccuuuacaauuugcacuuauaguuuauauccauuuaauuacuuaauccaaagccaggacugcuauuuccccuacuucauugauggggaaacaagaacagaugauuugaaauuuuauaauaauccacaaggcugaggucaaccuuuucugacuugaaguacauuccucuucugugucauucaccuucauucucuuuauucuuuucacauauuuaagggauauaauuuuuagggguguguaugugugugugucugucugucugugugucuguguaucuguguguguguggcggauccugaaagcagauauagaaauuguuuuucauuuugcacaguccauauucuacagauguaguuuguuacauuuugagaugacugugagaaagaguaaaucaauguccaguaaacuggaucuuauacaagauuguaucuuuuaaguggguagcuuguuuguuaaaauggaaccucuuaaagauaagaacugccucccucuaggagcccagcgggcacaaggaaauguaaaucauggagucugguaggguuuggagaaaugggcaaccguccugacuccccauagccuuuguucuuuaggauucauuuuaaauagcccuuuuuagaugcauaugcaguguggugggaaagcaggaagcuauguaggagugcuauacugauugaggagggcaguucuuagcuuacaugguagauuauuacuagggaacugggauucuuggaugaauugaaugcagaaugggaaaaauguaacugaaaauguuuauuuacaguucuuggcauaauucuguuuuccccccuuuugccaagcugguaauagcaauggaggagcugaagcagugucgacuacaacagagaaauauuucugccacugucgauaagcuaaugcugugucuuccaggugaggaacagcuaauggaguggaauucuugacguaauuccuuuagcugaguuaguuuauuuuguuuaaugaugcaugugucaucuguuuucucuuucaaguccuagagauguacagcaaacugagggaccagaugaaaaccaaaagguaagauuuuuaaauuggucuuuauuaccaaaauuuucuuuuauuuacaauacuuaaaaaagagauuuauuuuauuauuuauuuguguguguguguguguguguguguguguguacacgucuguguuuuuacuacauguguguggauacccacagaggccagaagagggcauuggauccccuggagcuguaguuacaggcauuuguguguugucugauguaggugcuggggucugaacuugggucuucugugagagcaaguacgcucaaccacuguccucucuaguguccuccuugcguguugagcugucucaagucuuuccuuuacucccauaaccucuucagguuuaaggagugcgggcauguuauuuuauugccuuuuuuuuuuuuuuuucuauuuuggagauaagagauugucaauaugcauggcuugauuuugcuguuuuuuuuuuuuuuuuuuuuuaaaaggucauguguacaaucuggaauuuaguugagcucuuuagauuuuuuaugcccgacacaguuaucuuuguauggcuuuuaguaauucauuuuccauuuguucucacuguuacuugaucuuucucuguguaucugcuuuccucucaaucaguuaguuaacuagauuuuaagagucuuaucuuguuuucacuagugucuuauaauccacaccucuauauuuccuugaaaugcuugcuucuaagcuuacaauaaucuuuaacuaauauuggaucuuaaaauaauuauggcaaaucauguauaagcaagauuuuuguaguaguaguuucuauucaaauugaaaugcuuuauagauuuaauuauuauaauuauuaauugauaauuauaugaaauuaucucacuguaccgcauauacauauauaauuuuucaucaauuaaaaauuuaaaacuauaccucuguuuuaccaucccucccuuaguguuauuauuguaauuacucuuguaucagaauauggcauaguaccuauaauacaguuucauuuuugauaaaaacuuucacauaaaaauguuuuaaaaguaagauucaaaaaauucuucauuuauuuguauauuuuaagugauucugacacuuuagauccuaauucuuuacuaugccuuuuugaauuaaaaugauaguuguaaauucuuuaagaaauauggcauuucugaaauaguuuauguaaauaauuguuguuauuuucuauacugucacauccaccauuuuauguauacaguuuaguguugucuucaaaaggguguccucacggcuccucugcagagcaugucagugaucuagaacagaagccugcuccccuuguucuuucccuuagucugcacagccaccauguccauuuagccauauguuugccuauugugacuaucauauaaauggggccacacaguuugugccccuuuauguuugacuucucccuuuuacaguguuuuuaggauuuagccaugcuuuggugugaaucaguacuucacucuuuuugugcgggugcuucuccacuggguggaugacuacauuuuauuuuuuucaucauuugaugagcaguggggucauuuucacuuuuuaaguaugaugaauaaaguuauggaugcuuguaaauuuuucuauggaaaauguacucacuaaguucucuugggaagcagugauuugcagaucugauacuuccagacccaccccuauuuuaaggcucugcuagggccagcuaugauagcuuaugccuuuaaacccuuaggaagcagaggaagguggaucuuugugagcuugaggccagucuuaucucuguagugaguuccaggccagcuggggaugcaaggugagacauucuacaacagcagcagcagcagcagcagcagcagcagcagcagcagcagcagcagcagcagcagcagcagcaguaguagcucugccaggccaaguagcaucaguuuuagagacuauuuaaucuggucuggauggcucagugguucuuaugaaccgugcuguuuggcuguuuaggguuaggacauuucucuuguuuuuuuuuuuuuuuuuuuucugaccucccuaaguguucaucucauaccuccugucacucuguccucuucucuucucuuuccccccacuucucuccuccagugcuucucuccccauuuccuuaccucacauaccccugucuggucuaguacucagcaaagacuccaggcaagcccuaugcagguuuccccuuuuuggucuacuauuugaugccuuaggucagcaaaucuuuggacucugagacuuuuugcugacugugaccaugauguagcaaucaccuucagguagauaucccaccuuguuuguuuucuuccuuuggaguucacaguugucugcugccugcugcucgauggcugaagacaguugucuagguauuagacagaaccuacuugguuauaaaguguugcaucaugucuguuccuuguuaagcuuucauggcuggaggccuucuugagcuguaaauauuguuuauacuauugacuuuuguguuuucuaacauaucuuuguuaauaaugcucuucuauuacgaaaggaacugcgauuuuucugccaugaaagcuuauauuucauauuuuauuguuauaaaugagaggaaaauauuuauagguaacucugauucacuuuuagggaccucuuaguagaauuaaaaaaacaucaucuugaaagaguucuucuuaucacaauagcauucaacuauuuuauuagaaacucuucuaaagcagcuguucuugagcugugaguugcgacccuuuuggggucaaacaacccuugcacaaaggucaccuaagaccauuggaaaacagauauuuacagugugauucauaacacuaguaaaauuacacuuaagaaguagcagugaaaauaauuuaugguuggggguggcagcacuaggaaggcugagaaccacuucuaagagggaaagaggagagugagcaccaugcggauggaguggaggaacugcucuucagggggauuucuuuuuaaagacaagguuuuugcucugcagcuuuggcuaggcucacucugugauccuacuaccuuugucaccugauuaaagguauguguuaccaccacacuugaccucauuaguuaauuuauuuuuacauuuuguaagauuuaauuuuuuuaaguuuuugauuuuguguauauguguguaugaguuguguauaugugcauuaaugcauugggguauagguacccccagaguuuagaagagggugucagauccccuggaacuggaguccuguaugguugugagcugccagauauaggugcugggaucaaaguacucuuuauuuguuuguuugugggaucaaagugcucuuuguuuguuuauuuguuuguuugagacaggguuucucuguguagcccugguugucuuggaauuuauccuguagaccaggcuggccucaaauucagagaucugccugccucugccugagugcugggauuaaaggugugugccaccacugccugacuccaaaaaacucuaacaaugagucaucuccaguccccaauuguuuuaaaugacuguuucauuuguauauauuaccauaugugguauauaugcuugucagugugggugcauauuacauguaggcagguauauguauauguguauguguauauguauaugaucuaucuaucuacacacacacacacacacacacacacacacacacacacacacacacguuugugguggccagaaguugauuuuuuaaaaaaaaaucacaucauucucuaccuuuauuuuuugagauaagaucugccagugaacuucagggauccaccugccugcaccucacagaacugggguuauaggaauauccaccacacugggcuuuuuaugugggaugaggauccaaacucagauccuuaugccuaugcagcauuauuuacugacugagccaucucuacauccuucuuucaguuuuaaaaaacuuuauuuaauuuuaugugugugugucuaagugcauauacauguaccuuuaaaguggaguugcagauaguugugaacuacaugggugcugggaacagaaccuggguccucugcaagaagaguaagcauuccuaaaugcugagccaccucucuagcccuuugcauucaguuuuaauaaaguauagguugaugaaaguaaugccaacaucuuguaugagauuuucaaggacucuauaagugggguuguauguguguuaaauauuuaauuggcugccauugguuaguuguuuaucuguuauauaaaacacuuuagaaauuugaauaaucuuacugaucuauuauguuuggaacauaagcuugcuaggagaaaagagacagugggaaauaaggugcuguuauuuguuucuaggaauaauuggguuuugaaaaauguggugguucuauuugacagagcagauguuuucaucaugggcugcaugucugcaugcagcauggcugaauucuucucauucuguaaacagaguucuuagauagaacuaaaccccagaauguauuuaucuuggugguucaauuucuauuacaugcaguucuucauaccuaguugagucauugcuauucugcauuugcuaaaucauguaaaauuguaauguuuuagagucuaaaauuuuaauggaaacaacuauuucagauuuauauuuguacuuuuauuucuaaguuuaagaugaacaaaccucucuuuucuccaucugcuuggacuaagaguuuaauucuuagaaccuaugaaaaaagccaaaaaaaaaaaaaaccccaauaaauagacaaaaaaagaaauaaacaagucuguagucuugguguuuguuuuugaguguugagucaagaaucgcugaagugucugcuguaaagagacuguguuuaaacuagaacuguguaucaguuucaucuauggaaggaaugaguuuucccuuucuagacagauggaaaaugucaaaauuagggaauuuuaaagucuaaagaggaaaauuaugaauauuuugcugucuaaagaaaaaacacuauaugauucucacuuucauguuugauccuaguuauuuauuugaacuuuuuugucuaugauuuguauuuggugcuagauaucuaugauugaugaauaaauuaugcaguuauacuuucuuuugaagacagagucugaccuguaaacuuacuauauaguccaggccuugaauucauggugauccuccugcuucagccucucaagugcuuugauuauggcaagagccacuauguuuggcuuuauaaauccuaugauuguauuuguaaggucuguuuguuuuuaaauuaguacaccaucugggaaacauuacagcaucagcaucauucaugaaaaggauaaaucaaaccuccagcucagcucuuugcucuaaaaaccuauuuagcacauuauucagagguagaggacucaucaaccagacacuaaagagaaccagugcugucuuuggucuuaggcaaaaaccugagaaguguuuguuauuuucaaauguuuucuauucaauaauauuguaaauauuuuaaucaguuuauugauauuuuaauacauggauguaucacaauuuauuuagccagccagcuucuucuuauuuaauaccuauuuuacuuuaauuagucuacaauucaagaggcuuauauaguuuugacaauuacacuucuuuugaaguuauacaggcagaaaggaugccuugagaagggauggagaaauguucagguguagagguaagugaaggaaacagagcaguggggcaugugguaagagagcaggaggcuucacaguugcaguugagacaagacgcaggggcaagagcaacaucuuuagcuaccaggaaaacguaaacuaaaccuauacagagauuccaucccugggggccaaugagauagaugcucauuggguaaaggugccuaucaggcaggauuacugcaaguuguuccuaaaccugacacaugccuauaacugcgcucucaccacauaagcaaaauaaauagauacaaaaauaaauaaaaguuuuaaaauaacagaaacaaaaaaaaaaaaaaaauaaaucccaucucugacuuauccuaguuagaauagcuguuauccaagaaggaaaaagacagaaaaugcuagugaugugggaaaaggacauauaugaaguaaagacccucaugaagauauaagcacuguggaaaacaguuuagagauugcucaaaaagcuaacuauauaauagaacuaucauauuaucaagcucuaucucuccuggguauauacugaaggaugcuaaaucagcacaccacagagugaaccacagcacagagguacuuccauaucaugcucaauuauguacuuaaucaugauagccaagguauaaaaccaaccuuagcacccauuaccagaugaauggauaaagaaaaugugguuaauauacacaauucacccauaaaggaaaaugaaauuagggcauuugcuggaaaauguagcauggagagaucauuauguuagauuaaauaaguuagacaaauauugcaugcuuuuucucauguacaagcuagcuuaaaauuuaagaauauguaugaauaagguauaaugauauaugauaauucuaugaacccuuuuuuguauucuauauuaaaaugcaggaauaaaucuagauuauacaaauauuuuauauacuaauuaguauuauauaauaagcauauauaugacaugguaacaggagauaaccaaaggaggaggaagguauaaaaacagugaggaggaaaaaacaagaggguaaugggggaauuaaaugcaagcaugccauguuuucucuuacgugcagaaacuagauuuaacugcacacauuagcauccuucccuauacaaacgcugugacaaccaaaggagacugaggggaagauggugauugcugaaagggaaggagaaaggaaggaggaaggaagaaggaaggugcuggggaguaaaagugagcaagaugcuuuuguuauaaacccauuuuuuuauauuaagacaucaauaaaaagaaacuuaaaauacugauuccaguuacuugagguuauucuguaguuuaucguucaucuuuaauuuuuagucuauuuguaucuuucaauuuaaaguauguuuccuguagauaaaauaugauugugcuuuuuauaguugcacccuggaaugaaaggacuuuauaguccuuucauacuuaauguaauuaaaguuggauuuuucuuuuucauaguuuuuccagucuccuugguuucuguuccuccuuucuacuuuuuuguuuuaaauauauugggguguaugcuuuuauuuuuuauugauuuugaaauauuaaaacauuuuuuagauucauuuacuuuauguguuugaauguuuuaccugcauguauauaugcaccauauguguacaguaccagagguggccaagagagggugcuauauccccuggaacuggaguuaaagaugguugugaguugcuauuguauuugcugggaucugaaccccaggacucugcaagaguuucuaguucucuuaaccacugagccaucuuuucaaccucuuuaaaaguguuuuuuaauuugauuucuuggaguuugcuguaugaacacuuaugugcaucucaguucauuacagcuuccuuuaauaucuuugccuauucaaauuugauauacauauacugcuagcuuuguuuuaguagcucauuuuuuauucuucuuguuuacuguuacaauuuaugauuuccauauauuuuaugagcccauaugccauuaaauuacuacuuuuaaaacauuauuuuuucaaggaaauuaagaaauguauuuuuuauuuuuuuuuuaauuuuagcacauauuuacuuacuuuaccacuuuauauauucuccauccuuugcuccaaauauguuuugucuuaauauuaauuauuaauaucaaugcugguuuuucacaagucaaguuucccaggggaacugcagguaagauaauggaagcaccuuggacaaggcugguagcagcacuucuguggaacaguuccauuaauuccccgggaauucuguuuuguguuaauuuggauacuuuugccauacauaugugcauguguacacaacacacacaaacauaugcacaugauuuuccagguucaucucuuuaccaucauuagacgucuucuuggacgaacucucaauucugaacauuuaugcuccaaauucaagggcacccacauucauaaaagaaaauucacugaagcucaaaacacauauugcaccucacacaauaauagugggagacuuaaacaccccacucucaucaauggacagaucaugcaaacacaaacuaaacagagacacagagaaacuaacagaaguuauggaccaaauggauaucuauagaauauuucauccugaaacaaaagaauauaccuucuugucaucaccucaugguacuuuuuccaaaacugaccauguaaucagucacaaaacaggccuaaacagauacaagaagauugaaguaauuccaugcauccuaucagaucaccauggacuaaggcuagucuucaauagcaacaaaaacaacagaaagcucauauaaacauggaagaugaaaugauaacuuggucaaggaagaaauaaagaaagaaauuaaagaccuuuuagaauuuaacaaaaauaaagguacaacauacccaaacuuaugggacacaaugaaaaguauugcuaagaggaaaacuuauagcuuugaguaucuccaaaaagaaaauggagcgagcauacacuagcagcuuaacaguacagcugaaagcucuagaacaaaaagaagcaaauacacccaagaggaguagacggcaggaaauauucaaacucaggguugaaaucaaccaaguagaaacaaaaaagaacuauacaaaccaaaccaggagcugguucuuugagaaaaucaacaagauagauaaauccuuagccagacuaaccagagagcacagggacaguauccaaauuaacaaaaucugaagugaaaagggaguauagcaacagaaacugaggaaguccaaaaaccaucagauccuacuacaaaagccuguauucaacaaaacuggaaaauuaggaugaaaugggacaauuuucuagacagauacuaaauaccaaaguuaaguaaggaucagaaaaaccaccuaaacagucccauaacuaaagaaauagaagcagucauuaaaagucucccaaccaaaaaagcccagguuuagugcagaacucuaugagaccuucaaagaagaccuaauaacaauacucuuccccauaaucagccaccaaacacagucacuauuggauacgccagcaagaauuugcugaaaggacccugauauagcugucuccugugaggcuuugccaguaccuggaaaauacagaaguggaugcccacagucaucuauaggauggaacacugggcccccaauggaggagcuagagaaaguacccaagagcuaaaggggucugcaacccuauagguggaacaacaauaugaacuaaucaguacccccagaacuugugucucuagcugcauauguagcagaagauggccuaguugcccaucauugggaagagaggccccuuggucuagcaaacuuuauaugccccaguacaggggaaagccagggccaagaagugggagugaguggguaggggagcagggugggggaggguauaggggacuuuugggauagcauuugaaauguaaaugaagaaaauaucuaauaaaaaaacagaacaaaaguaaacaacacaaaacugggccuucuagguuaagcaggcuguugcaagcgggggagugggggaggaacaaaccaauacucuucaaacuauuccacaauauagaaacagaaggaacacuacucaauuuguucuaugaagccacaguuacgcugauaccaaaaccucacaaaggcccaacaaagaaagagaacuucagacuaauuucucuuaugaauauugaugcaaaaauacucaguuaaauucucucaaauugaauccaagaacacaucaaaaugaucauuuacuacuaucaaguaggcuucauuucagguaugcagggaugguucaauauuuggaaauccaucaauguaauccacuauguaaacaaacucaaagaaaaaaacaugaucauaucguuauauguugaaaaagcaguugacaauauucaacauccugcauguuaaaagucuuggaaagaucaggaauucagggcucauaccuaaacauaguaaaagcaauauacagcaaagcaguagccaacaucaaacuaaauggaaagaaacuugaagcaaucccacuaaaaucggacuagauaagauugcccacucucucccuaucuauucaauauaguacucaaaguucuagcuagaacaauuagacaacaaaaggaagucaaagagauacaaauugugaaggaagaagucaaaauaucacuauuugcagauaugguaguauacuuaggugagcccaaaaauucugccagagaacuccuacagcugauaaacaauuucaacaaaguggcuggauauaaauuaacucaaacaaucaguaaccuuccuauacucaaaggauaaaugggcugagaaagaaagggaaaugacacccuucacaaugaucagaaacuauauuaaauaucuuggugugacucuaaccaaacaagugaaagaucuguaugacaagaacuucacgucucugaagaaagaaaucaaagaagaucucagaagauggaaagaucucccauggauuggcaggauuaauauaguaaaaauggccaucuuaucagaagcaaucuacagauucaaugcaauccccaucaaaauuccaacucaauucuucauagaguuagagcaauucucaaauucauuuggaauaucaaaaaacuuaggauagcaaaaccuauucucaacaauaauagaacuucugggggaaucagcaucccugaccuccagcuguaagacagagcaauagcgauaaaaacugcaugguauugguacagugacaggcagguagaucaauggaauaaaauugaagacccagaaaugaacccacacaaguauggucacuugaucuuugacaaaggagcuaaaaccauccaguggaaaaagauagcauuuucaacaaauggugcugguucaacauguagaagaaugcauauugauccauucuuaucucccuguacaaagcucaagucuaaguggaucaaggaccucuacauuaaaaccaaacacacugaucuaauagaagaggaaguggggaaaagccucgaacacauggucacaggggaaaaguuccugaacagaacaccaaugacuuaugcuuuaagaucaagaauugacaaaagggaccuuauaaaacuguaaagcuucuguaaagcaaaggacauugucaauaggacaaaaugguaaccaacagauuggggaaagauuuucaccaauuguacauccgauaaagggcuaauauccaauauauagaaagaacucaagaaguuaggcuccagagagccaaauaacccuauuaacaaauggaaaacaaggcuaaacagagaauucucaacugaggaaacuccaauggccaagaaacaccuaaugaaauguuuaacauccuuagucaucagggaaaugcaaaucaaaauaaucccgagauucuaccucacaccagucagaaagacuaagaucaaaauucaggugacagcagaugcugguaaggauguggaaaagaggaaaacuccauuuugguggauugcaagcugguacaaccccucuggaaauaagucuggguguuccucagaaaauuggacacaguacuaccugaggacccagcuauaccacuccuggacauauaccuagaagaugcuccaacauguaauaaggacacaugcuccacuauguucauagcagucauauuuauaauagccagaaguuggagacaauccaaauguccuucaauaggaauggauacagaaaaugugguacauaaaggaguacuacucagcuaugaaaaaacgacuucaugaaauuuuuaggcaaauggauggaacuugaaaauaucaucuugagugagguaacucagucaaaaauaacacaugcaguaugcacucacugauaaguggauauuagcccaaaaguucggaauacccaagauucaauuuauagaccauaugaagcccaaguagaggaaacaccaaaguguggaugcuucagugcuuagaagggggaacaaaauacucacagaaggaaauaugaagacagugugaagcagagacugaaggaaaggcuauccagagacugccccaccuggggauccaucccauauacagucaccaaaaguuauuguggaugcuggaaaguacuugcugacaggagccugacaauggcugucucccaagaggcucugccagagccugacaaauauagagguggaugcucucagccuacuauuggacugaacaugggggucccugauggaggauuuggagaagggacugaaggaacugaggggguuugcagccgcauggcggaagcagugucaacaagccagauccccaggagcuccuggguacuggaccaccaaccaaggguacacauggagggauugauaguucugcauacauggcagaggauuuccuuguuggacaugagugggaggagcgacccucgggccugaggguguuuguugccccaguguaggggaaugccagggagggaagacaggaguguuuggguuggugggugaguacccuuauagaagcagggggagggggagugaugggauaggagguuucugaaggggagaccuggaaaggaaaaaacauuugaaauguaaauaaagaaaauacccaauaauaaaaaggaagucuucauggaguauuuuaguuuguagaauggccuuuugacauugggauauuuaaaaaaaauuuuaauuuuuauuuuauuuuauuuuuugacuuuacuggauauuuucuuuauuuacauuucaaauguuauccccuuuccuggguucuacugugaaaacucccuaucccuucccuuugcucaccaacccacccacucccucuuccuggcccuggcauuccccuaacugaggcauagagccuucacaggaccaagggccuuuccucccauugaugaccgacuaggccauucucugcugcauaugcagcgggagccaugaguucuaccauguguauucuuugguuggugguuuagucccugggagcucugggggguacuagcuaguucuuauuguuucuccuagacauugagauuauuuuaaaaauuauauaugaaaaauuucauugguguucaugauuacuuguuuuuuggauguuuuuauuuuuaaauuauuagucuuuaaagcauauauuaauuuuuaauauuuaagaaaacuuuauuaaaauacuacacuggauuugucuuaauguacaacaaaagcuaaucgagguuagauuuuuuuuccuugaguaauguauuuguucaucuaagaaagacugaagugcugauuucuguuguaggcauuauccugcacugaagacacuggagcaucuggaacacaccuaucugccucaagugagccacuaucgauucuguaaggugaugguggacaacauccccaagcuucgggaggaaauaaaagauguuucuaugucugaucucaaagacuuucuggagagcauccgcaagcauucagacaaaauuggagagacugccaugaagcaaguagguccuugguuugugauagguuggcuuauuggcucugcuaauauuugguuauacacagauuucuccuuggcaaguauguuaauuacuucuuaacucauuuuaggaagguccgucauaaaugaaaauguuacuaacuuaaccaagugcugaguugucguguucacucucugacuguugagugaacagugacugaugaugaugguuuguaucagcgacuggagagaauucagcuugauuuuguauaguauuuaaaguccaaagucuuuuaauacuuuccuuuuaguaaacaacaugaauuguguugcauguaccauugguugauuaguguuaggaagguggcuugucaugcauaaauauuucugauauugauguaaguuagugacagaaaggucugugguggacuguugguuaugauugcagaaagggauauacuuacagccccuaaguucaucaaauguguuaugaauauuuacuuucuuuaaauauuuucaucucuaagucuguagugccaugaggcuugccuuuugucauugccaaugaagaacaguaaugauuuucaguaacacuucuccugaaauuuaagucacauugauguuauaaagaugcucuagcauauuugaugauguagccuacaacuuagcucuuaauuauuuauggaaaauguuuuaugguuuugucaacaaguguuuucaaguagauuuauauuauaguguggggaacaagagacagcagaucacaucuggaaaccuuacuuuaggccucagcuaguacugauagauauaguucagucaucuauuugauacugcagaagagaucugccaauuauuuuauauaagacaguuuuaaaagucccccuuuaaauuuuaugaguguuauacuuuaaaaugcgagaagcguaggcuacacucuuuuugucucagcucucgugugcugugacugcaggcuugugcugccagaucuuagugcugaaccuggaagcugacuuguaaagguugcuuucuccaggucucugcuagacaaauuuacuugccuuaguuaaaagagaguuauguuaugaauauugucacuucauuuaauuuggaauuagcuggucuuauucuguaaguaucugaagaaaugaaugcccagggaagggaagagacuugcucaaaugcaagcaacuugugaaggucagaccauguaauagaauucagauaaaguuggaauagauaugcuaaccauggcacucagucuuuauaaaccguuagcuaguuuauuuuuguuccacaaagaaauagugaagaaaucuuuuuaugaauucaguacuuuaacuauuaaaaguuuucauauuggaaauggccuuagugcaugaauugcuauccugcccaugcaugcgugcauguaugcauaggguuguuguuugcuuuguguuuugagacaaagcccucacuaauacaguccugacacgugguauauagaccagccugcucucaaacucagagaugcaagccuuccaaaugcuugguugaaagguguaugccaccacgaucagcucuguauguuuuuuguuuuuguuuguuuguuuuuuguuagaauacaaauaauugguuuuuuaaagguaucuucuuauauguguuauuauccuucguucucauuuccgcccucccgaccgucauucucuguauucugaccugugucuagcuuauuccccucccccacaucuguuaguccuccuucgaguuguauccugcccauuucucuugaugcucuuguugccuacuuucugggcuaaaguaauguaucuguauuuuauagucacauguaacuugaaaugauuuuuaaaaaaugccuacaguacuucucugcuaauuuucuacuaguuuuauuuugaaaccuauuucuggaacucuuguuauggaaucuguuuucguguguguguguguguguggggggcauuucuguauuucuuauuuugauuagcuugccuugggcuuuguaggccugaaugaaauuugugaguaaacauuuuuugcuagguugauuucaguugugaggcccuuucacugagagaaggauuuacuuuuaaaauucugucuuguuuuugucaaauuaugugguuguauauauaacugauguuaagaaaagaagauauccucuguuucuauugaguguuuuaugggauuccugaguaugugaaugagcgguucucugcuucugaugacuucucuugggcucuuuucuuucuauuuguuuuuguucaauugcaauauguuuuuuguuuuauuuuguuguauuauuaaaaaaagaaaaaaaauaugcacacaugaaaggaaucucaauagagucaccaaauacuggggagacaaugccugaacugaacauuuuaugccuccaacugaaaucuccacuuccaggauuggguuacaucuaguugagucauggaaacccccaaccaucuuagguucuugcccagacuguugcuuguuucccacaaacuggugguaaggcccuauuacugaagacagcacuuacguaucucauugagcauggagaagacaagcuugugcuuagaggccuucccuguacugacuaguguucauauacuaaaaggcaugcuguaugcuacuagaggaaaaagguaguuaacccacucugcuguaaacccuacuaccuacaacaauggccuuucugcaagauacccugguguaauagugauacaaauguggguguaaacaaccacccuccgauuuaauguaagauccacucccugagauggaacaaagacuugacacugcuaagaaccugagacuagaugggucauggaccuaggaggaaaaccaaauacuauuacucugcuaaagaaauacagcaaaaaauaacaucuaaugauauucuacuuuguuuagcuacauuagagaagcaucuugaauuagaaaggaacuaacacagagacccacaacuggacuaugugcagagugagagacuuuggaccccauagucguaaaugagauuuuuccuuaaaccucuccucucaaggaucuaugcagaagaggagacagaaagauuguaagagcaagauguguuggauaacucaaaggaaauagaucucccagaccugugcaugcugcuguaauccuuaugcauucauauguguaucaguucuguuguguaccuuuucaauugcuacuuacuugugaaggaagccuuacuuuucuccaauggagucucacuagguguauuaaucauacuuuaggguaggccccauuucuaguugggcaaaaaugaacucagucauauuuuuggagaauuuaucuuauauuucuuugggcauauauuugccucauuuggucauuugcuuguuuuuuuuuuuccaguuuguuuuccauuuuuguguuuuuguggcaguuugggguguguguguuuaaaaauagaaagagaaagggccuggaguuggguggugaggaguuugggaggaucugugaggaguuggaggagaggccaucagauuauauuauauggauuuuuuuccaauaaaaauguaaaaugaaaaggaccugauggacuauaaaaaagaagguacuuagggauuuuuuuuuauagaauuaaagaagaauuuuaaaagauuuauuuacuuuaugcauauauuuacacuguagcugucuucagauucaccagaagaaggcauuggaucccauuacagaugguugugagccacccugugguugcugugaguugcacucaggaccucuggaagaacagucagugcuccuaaccucugagccaucucuccaguccugggauuuuuuuaaaaaauaacuuuugaaaauugcuucuauugggauacauuaauuauacacagcaaugaguuucauuaugacauuuccauauaugcauaaaauaugucgauuguguucaguucccugcacucccucuugucaccucccauucucauuaaucuccuuccuuuccccagcuuuccauuagacuucuuuacaggcucaugaacaccucaccagugguugugccccagaagagaauaucuuuccuuucccuggcaccauuagcugccuauagauccucagagagggcuggcccuuuaguaacuguuuuuccagaguugaccucaggagaggauuaauggucaccaugauucuuucaaccuuugacuucuuuggcuaaguuugacuauaacaaaauaagcuuugauuuauuguauagaacaucuuaguuuaguucuggcacaguacuccccucugaguucauacaggccgugcagugaccaucauggcuguauugagauauucuuugugaugaauucuaagcagaacauacacagaauaaacccuuuggagccaaagaaauuggucaggcuuucuuagacuuacuuucaauucaucuggcuuuugggacuuaugauguuggcauauaauuugggaaugguaagauagaaauaaauaaaucuuccucucaguuauaagccucccaacugaaauuaaccuggccaagauugucugucucacaaaguacaggauuuugguacuuaucuaaucaugugugucagagagagagggaagauaauuuuaaaauucauucaucagucaagccacugagaucugagugugauuagccauuacaauaaacaguguggggccggagagacuucucuaguaguaaaguaccugcaaacagaugaagacuugaguuuggaucccucgcucccauguaaaggcugguuguuaccagggagguagaggccacaggauacuggagcuuaccacuaagauaauuuaguuaauuagugagcuccagguucaguggagaccuugucucaaaaauuaggcucgaagaagacaccugaugucaacuucuggucucuacaugcacaaagggugugcauaugcaucuacagacacacauacacacauguguaacacucacaaaaagcuaaagcaaggcuaauggaucuguuugaaacuagagaaaacaguacuuguagaaaucagaguggccucucuuuguagacuacuguucuccauaguagggagaacucaacaugucuggaagggaaguaaauuagagagucuuuaauuuuugaaaaguuuuauagugaugauuguuagucuauauucuuugguguggcucacuccaaggaaaaaaguagaucuuaaaaucacauagguugcuuguagaauacuagcugacaaagggagucugaggcagguaucgguguguguguguggaaccugcagaaguguagcugaaggugcuacucauuacuggcagucucuggaagaugugugugcauguguguuccucucuguccuuuuaaaauauagugcagugccuuguacuaaggaguugaaggaacacuuguuuucucucucucucucucucucucucucucucucucucucucucucacacacacacacacacacacacacacacacacauacacacacacauauguauguauauggagaugggauagggagaaacugaagaucauuugaggaaacaauuuucauggauuuuauaaauuuuauauucauaauauaaauacaauuauaaguucauacauuuuauuauuuucauugauauuauaaaaguuuuauuauuuucuaccuaagugauuaauuuguuguuaauccauaaacguauuucaguuuuuauaucugaaguguaauguagcuugacucucagguguuuuucauuagcuauaguuugauacuguuucucugcuuuuauguaccugagauuaaaaaaaaaagaacccuaguuauuuggucuuuuuuaagucuauaguuucugaauuuauuuuguuauuauuaaaaauauguguaugugucuauguacauacacaugaguguaggugccugcagagucuagacauaugcuaggaacugaacucagaucagucuaagugcacuagucacucuuaacugcagagccaucgcuccagccucauagguccacaguucuuuuuguuuguuuucgaggcaggguuucucuguauagcccugguuguccuggaacucacuuuguagaccaggcuggccucaaacucagaaaucugccugccucugccucccgggugcugggauuaaaagugugugccaccgcgcccggcuagguccacaguucuuaaugacacauuaaguacagucacauuuuguauaacuauuaccaccaccuuuuccauaaccuucuaacuuucccauaucaaaacucuauaaguaauggguuuugaauauauaacuuaugcccaauccugauugaauaaaugaaaucuuugauuuauguuuaagaauucauugggcuuccuuugcagagaagaaaaagaaacaaagaaaaaguauaauucauaaguguuaaaccuucuugguuucagcaccagauguacaugagggggcacaguaaagacacugccaacaugagugcuccauuauuaggggaaggauuuuauugugaauaggagagaaaagauaucuagaguuaucugguagaguucaggucagagagaaagauaaucagacuggacauggccagagcuaucugcgcaagagauacgagaacaagguagagcauaguggggugcguaguguagauagugagagagcaagagauagagaacagagcauagugagagaauagaucuauagaucuacguaucuguaucugucucugugcagcaucuaucauagcucucgcucucucaucuaucacucaucuguuuuucaucucucaucugccugucaucugucuuucaucuucucuaucugucugucuauguagauaggguuagacaauuauguggauuucaaggaggauggguagcuugggaaagggaaggaccaggaugcuagagugagcucugaaauguauaacagguacuuaagauacugcaggaucauggaggcugccgugggcuuugauauguugauaggugccauaggucccuucagccagagguaagagaaaugacuucuuuuggcagcugggaacugauuucacaaguuccugauuagugcuggcuuuuguuuaauagaagucccucuguaguccagcuucagcucauuucuggauauauggaguuccugaaacuuagcaguaugacaguuuuuuaauaaguggauugcuucuaauuuuaaagguggguuuucuaaacagaaaugaacuuaaacaaguucauuaaggaauauuuguuugggaguaaagaugggauauuuuuuauucucaaaguagucuuguugguugaagcaacuuucuuucuuugucucuuuggucuuuguauguaacagaaagauauauuuuuagaggcuggggagaugguuuggcaguuaaugauaccugcugcucaugcagaggacugaccugggaucagcuuccagaacccacaugguucaugacuguaacuuuaguaucuguaacuuuaguuucagggaaucugaccccaucuccugacaucugugagcacaugguaugaaugugguguacauacaucuauguaggcaaaacacuuauacacauaaagugaaaaggaauaaacuuucuaaaaaccuacauguuuagcuuuuuuuguuuuuguuuuuguuuuuguuuuuguuuuuguuuuguuuuguuuugagauagaauuucauagagauccccugccucugccuuacagugcugggauuaaaggugugugccaucacuccuggcuauagcuuagauucuauguaaaggcuuuaaagguugccaguuaagggcugguuugaaccaugaugaucuuagccuauuuuugagagcuguacugcccuucaggaugagaauuuuuuucuuucuuucuuuuuuuuaauuagguauuuccuucauuuacauuuccaaugcugucccaaaagucccccauacccuuccucccacuccucuacucacccacucucacuucuuggcccuggcuucccccuguacugaggcauauaaaguuugcaaguccaaugggccucucuuuccagugauggccgacuaggccaucuuuugauacauaugcagcuagagucaagagcuccgggcuacugguuaguucauaauguuguuccaccuauaggguugcagaucccuuuagcuccuuggguacuuucucuagcuccuccauugggggcccugugauccauccaauagcugacugugagcauccacuucuguguuugcuaggccccggcauagccucacaagagacagcuauaucaggguccuuucagcaaaaucuuguuaguguaugcaauggugucaguguuuggaggcugauuaugggaugggucccuagguauggcagucucuaggugguccaucuuuucgucucagcuccaaacuuugucucuguaacuccuucuauggguguuuuguucccaguuuuaagaaggggcaaaguguccacacuuuggucuucguucuucuugaguuucauguguuuuacaaauuguaacuuauaucuuggguauucuaaguuucugggcuaauauccacuuaucagugaguacaugucauuugaguucuuuugugauuggguuaccucacucaggaugaugcccuccagguccauccauuugccuaggaauuucauaaauucauccuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcgggauccuccaguaguacuauguccaauuuucugaggaaccgccagacugauuuccagagugauuguacaagcuugcaaucccaccaacaauggaggaguguuccccuuuccccacauucucaccagcaucugcugucaccugauuuuuugaucuuagccauucugacuggugugagguagaaucucaggguugcuuugauuugcauuucccugaugauuaaggaugcugaacauuuuuuucaggugcuucucagccauuugguauuccucagcugagaauucuuuguuuagcucugagcccuauuuuuuaauaagguuauuugauuuucuggaguccaccuccuugaguucuuuauauauauuggauauuaguacccuaucugauuuaggguagguaaagauucuuucccaaucuggugguggccuuuuugucuuauuaacggugucuuuugccuuacaauuuacagcuuugcaauuuuaugaggucccauuuguugauucucgauuuuacagcacaagccauugcuguuuuauucagaaauuuguccccugugcccauaucuuugaggcuuuuccucacuuucuccucuauaaguuucacugucucugguucaggaugagaauuuuaucugguguggcauaaucugagaaugaagggucucucucucucucucucucucucucucucucucucucucuuucuuucucucucucucucuuccuuccuuccuuucucucccuuucuuccuuccuuccuuccuuccuuccuuccuuccuuccuuccuuccuuccucuuucucucucucucucccucccucccucccucccucccucccucccucccucucucucucucucucucucucucucuuucuuucuuucuuucuuucuuucuuucuuucuuucuuucuuucuuucuuucacuacuacuucuuuuacuuagaguaaaaccuguuacuaauuuggaccuuucuucucuaaauagcucaccaagcaaugucaggaaacaguauagcuuucuucgccaaacagugaguucagcucuuugcaguuguuaaaaacgcagaucucccagaugccccacgaagaacaugaugaccugauuguuugucugcugcccucuuacuuucuuaguaaauccuuaaguaaucuguuccuuuaauauggcagaaggaagcaauaucuagcaguguccauggaauuucagggauauaaaccuuucaggaagcuauaaagucaugaacucucccuuuagaaaaccuaucauggacauaugcaauuuucaugugacauuugggaguuucuaugcuuucugaaauauauucaguuacauugugggaaccaucuagauguccacgaucuacuaucaagaucagaaucagugacauauucuaagauguuguuccuuuuuuuaguuuuuucaugauuugugaaaauaacauuguagaaaagauugaauaaaguuaugacugucucucaguucaguuuuauucacagcaucagugugucacaaacacauugacaaauagguucaagauguuuguaaacuuccaaguugcuuagugcagauaucagguagauagauaucugagaauaauuugagcacauugcauuuccuuuuauuuuauuuuuauuuuuugguugguaguggcaaacuuggaugaaauuauauucauaaauuuaggauuagcuauguuccuccgacccaauaauuuuuuucucacuguguaguuuagacuggcuuugaacuugugauucuccugauucagccaacuguguucuaagguuacauaugcaggucagcagaccuggcuauccuguaguuuugucucuuuguucuuuucucuccuuauuccuguugcacaguaguacagagggaauggaugacaaaggaaaaacaaaagaugacuuaauuuugaguugaaacugcuaaaggucauagacgagaacucuggugguuugaauaagaaugguccccuuagguucuuaugugugaaugcuuggucugcaguucguagaacuguuugggaaggauuaggagguauggacucauuggaggaggugugucacugggcguaggcuuugaguuuucaaaauauuuguuucauuuccaacaugcuaucuaccuccuacuuauggaucaagauaugaauuuacagcgauugcuccagaugccucuuagccaugccuucccucugcccccauagccucuuuuauaaaaugccuugaucaugguauugcgaucauagcacuuaaaacuuuagucuacuuaaauucuaauauuucucagugugaccuuaaaagggcauuuuacuuugaauaauuuauuuuuuuuuaggaagaaauugucccuuuuucuuuccucuuaaccauuguuauaaugaaaguuagggccucuaaguagggcugauggcuuugaacuuaugauucucuuugaauauauuucuuccuuacuguguguguccuccauucuucauggcuuguuaguccagucuugagugaggugauucauuccccagucggcauuguugcuucuagcuaugucucagcuaugucuuccuucugucaguucaucccucuucacucuucccuuauuuuucaacaugauuggugauuuuucccucacuucauaauaaguagaaagaauucagcaaauguuuugcugucugaaguuauguauuagcagucuuccucuaguguguguguccugcgaagucuaugucacacaugagagacaugaaaaauacuaguaucgguguauuucaucaauguuaguaaaguuuaguuuuuuucccuuacuuaacaugaaaaagaaguguuguauguacuaguagauuguuguuuccuaaagauugggcacaccaaaucgcuuuuagagaacuugagucuaaaugauggagaguagugaacugccauggcuuaugguccugcuauguaugauuagugucuacucugacgucugagucuuagagugcucuuuaauguaggagucuaggccagccuucacagacagaucaagcagcacaugaggcaaagcccauuugauugauuggucaugagagugauuuuaguuguggaagagguaggauggccacauguuucagagugcagaguauacauuuuagagaagugcauguuuuauuuucugucuaugcacguguguaaacacacaugcauacguacauauacuuugagguuuauauaaggggcuggugagauucugugcuucuuuuauuaacuuuucuuuuuccuuuuuaaaauuaucaguagcaaauuucuuuugacuucuauacacaaggaauaacuuuaagaguacuucaucuuguucuuaaauauauggcauuugcucuacuagucuugguaaaauccuccucaccguugcuauguggugauguguguguucucugaucugaguuucuuuuuccacugggccggcuuauugcaucagggggccucgcuuuuucugcauucacuacuggaaauccuucuaaauuuagugcacucuugcugcucuuaugccugugcuuucuuggggaucugaaacuaaagagaaugcuucuuccaugcagccaguaggauucacagauggucaaucugaaccccagagcauccagccuucuuuccuguuugaccccauaaccucuccucuguuuggcagugugcugguguugacaguucuuuugguucagccaaaggugaaagauaauugcuuguggaguagcagcugggaugguacguguuucugcagcacacaucuaaccccacccccaggcaaaacuuuggaucuggugcggauuucaaagcauguguuaaacuuuaugugauacugauuaaaauggagggcuccagggugaauuggcagccccacagcugcaucaaccagaugacauacggagaaauggcucaggacuaauggagggcugcagucugcuugucuuagcaccaugcaagccuauggaaggaaaggugauccucaagugccuugguguagcccaaggcacaucugacucuucgguagcuccuuuguuguggucuuuuucuuuucauuuuccuugucuuuagaaagcaacgagaagaaaagcuacuugugaguaauaauuugcaauuauuauuuccuuuaguucucaauuagugagagucuauaccaguagacacugagacucugaaguucaguuugcagguuguggagcugagaucuguaaagcuuauuauagaagaauacaagcuuucuugauagguucagguuuuggcucagaauauccuuuuagaaaaaguuauguauuugugacauaggcacagcucaacauuuccugaaaaucaaccuagaaacaguagugguguagauuaccuuuccugagaagucucugaccucaugacagguuaagauaaacagguuuuuagagggaguuaugauuuuuguuuguuuuuuguuuucuaagaaaacagaaagaucgagaaacuuagaggaguaaggaugaauauucuuaucaaaaacuccaaaccaggggcuggagagguggcuuagugguuaagaaugcacaccguucuuggcagaggagccugaguucaagucccagcacccauacugggcaauucacagcuaccuauaacuucaucucuagggggaccugauaccucugucucugagagcauuguacucaugugcaguauguguacauacacguacgcacacacagucaguucugcaacuugaggacucguaagaugauguuauuggcugggcuguauuugaaguaggaggugagugagacuucagcaauuccacaggcaaagaaaagccucauuggauacaguggauucucauugucaaaaguaaaagcuuuuauuagucacaauuuacuuuuacauaaaccuccuuucuaagucuucagcaugaggauccacucaagcucccggggaagauguuggugccuuuguguucccuguaucuuuuuguaccucagauggcuuccuuucuaccucuucugucuuccucucuguucucugguuuuuuaaaauggggcaaggaauauguuggaaauggaaagaggaaaagcuagcucuuuauaugacaucuuggaacuuuuauugaauuuuauacagcuucuauuuuacuaaaaagcauuuuuaauuuuuuuauuuuguuuuuuuugagacaggguuucucuguguagcccuggcuguccuagaacucacuuuguagaccaggcuggccucgaacucagaaaucugucugccucugccuccugagugcugggauuaaaggcgugcaccaccaugcccagcuaaaaagcauauuuuugacauacaaauuauaagcuacuaugugaguuugguuagauaggaccuggaccugucccgggauagaaguagugacuucauggauccuaggaucccacuuagcuuccucucccauagaauauucuguauguagagaagaauauaucuugaaugcagucagccacugaaucauagcaaaucuacuucuuucuaaggaucauuuuuaaagagugcuauguggguaguuuacccaaucaaagcuucaaauacugugagacagcuuuaauuaaagagagaggggaagauacugugcauuucuuuguguagugaaguuuauaaaagagaaauaaaauggaauuuggaacuugucaguaaccaugcuguauucuccuuauuuaacacugugaccgcgcuagccuguuuuaugcaugggagaguauccgaguuuaauuucucuuaguuugaagacaauauaaaugccuucacaaugucacgucuucauacauuaacacaaaucaucuugauuuugacuuuauucuuucagccaacaaaccuauuugaugauauauugagaacaagucauuauguuguauuggaugauaguguuugcuaaggaaacaaaguagcagaaaauuuaauguuugucuugcaaaguauucacuucuuuaauacauuagcuaaauacuuaaaaaguacaggugcugguauuuucuaguggcuauuuaauuggcucauguucauaaucuguucacaggcuaaauuucauagcacuuaaugcuucuuccucuuggguaggccacaucugaugagaaaugcccauuuauuaaguuaauaggcauauaauuuaauauuuacuuuugauguuuuucacaguaccuuugauuaguauagcaaauuacuaaauaguaugucuguaucuuugucuucaucucucuauauagauuuauuuccaucucuauauuucuauguuucuaaaucuaucuaaaucucuaugucugucuguauaucucuuuccacauauaucuguguaucucucucuauguauauaucuagucuuaucuccauauguauauauccaucuguauaucuacagcucuaauaccuauaucucuauaucuaucuugaucuccauuucuagcuaucuauaucuauauuucuaaaauauuucaaggcugggggauggcauaauugguaaagcacuuagaggaccugagcuuggaucucuagaacccacuuaaguugggaugccuuguuuugugccacuaugaucccagugaugggaagaugggagguagagacagccagauccuuggaaacccaggggccagcuagccugguuuaagugccaauauccaagucaauaaaaggccugauuucaaacauaauguggagggcuccugaaaacaccugaaguuguccuuugaccaucguuugugucauguguauuuguacacacguuaaauguguauacacaugcaugcacaugugugccugcauggacacaaacccagaauauuuacaacuucauuaucgaagguugugugcauuuuacauuuauucaugaaguaaagaagccggguuggauguuuuccuuauucuuggugcaguuagugucuuugagcaggcucuucucuacacagguagcugaggaauauagugucccauuauuuuguugcaggacuggaacaguuugaaaucauuuaguuucucuccuuccuuccuuccuuccuuccuuccuuccuuccuuccuuccuuccuucuuuccuucuuuccuucuuuccuuuccaucagaaaugcugcccccuccugguccccucucagaaucccucccccaauucccucuccccuuuuccucugagagaaugccccugccagaauuuccugagacccuggcacaucaggucucugcaggauuaggcacauccucucucacugaggccagacaaggcaggccuguuaggggaacagauuccacagucaggcuacuacuuuagggacagccaccacucuaguuguugggggagccacauggaaacccagcuucacaucugcuacauauguacuggggguggaugggguggggggcucggucuacccuguguaugcucuuugguuggugucucagucucuaacucccaaggguucagauuaguugacucuguuggucuuguggaguuccuuuacccuuuaggaucgucaguccuuccuucaacucuuccauaagagucccugaccucuguccaauguuugucuguggguaucugcaucuguuucaguuagcuacuggguagagccucucagagaacaguuugcuaggcuucugucugcaagcauagcagagugucauuaauagugucaggggucucaaguugaacccauuauuguuugguuguuccuuuaguaucugcuccaucauugucugugcauuucuuuuagacaggacaaauuuugggucaaaaguuuuguggguggguugguggccuuaucccuccacugggguacuaccugccuacaggagguggcuucuucagauuccaugucucuacuuguugaugacugcaucuugacuaaggucaccuucaauuauuccugggagccuucuccauccuaagccucugauauuuccuagagauccccccaggucccccaacuccaggcaccugcagauuuucauuaauucuccugacucauuuagucuuaguaauucuuaaaauugacuuauuuuaugguaguguguuuugaaguagauuuggcuaagcaucuguaaauauuuuuaaauuuuuucuuuauauuucuuuguuuauaacuuuucugaagccuuaaaucaaaggaguagaaacuguaggagaauacucaguuuccucaauuucuuaaggucccaucccuaaggaaggauguuaucuuuguguuucaugcuggagugugaaauuugcauggaaguugacagggacagaaaguguauaggaagugcugcugagaaacuagucagcauauauguguuugaacccacaaggauggauugaaaccauuuccauucuugcugccucugaucuugaggauaugcaaauacugcaggagaagcuggugcccuuaguaugacgcaggauuuaggggaagguaaaguaacugaaugucuggcugcugccucaugcuagagacuuaggaggugaacguguccucugggaacuacagaaugguucuuacuauccugugcucuccacaucugggacaggaaagucucuugaggaaugugucuggaaaggaauucugugaaauagaguucauauagccaaguugccacauugcaauuacaugccugugaacuccagacuuucuaguagggauugaaacuucagccugugggugaaaugucuguuuagagauauuuguaguuaaaauuuucuuuucuuuuuuuuuuuuuuaugugcgugaaguagaucaauaguuuugcugccuuuuaaaguagaagguaacuauguugagaauaagcaacuuauuugggcaggccggcuuuagaauuuuguugcuuaaguaguuugaacuuaagcuuuaauaacucuccucuguccugcugagaagagguccaccuuuauacauggcugaaacacacgcuggacggagaugcuaagcaacacugcacugaacgcuucagggaugcauuggguggaucguccuuaauuguccaagaaucucuucuucuaaaaugauuuuuaauuauggguuucuguguuugucugcuuuugggaggcaaugaaggcagaguuauaggugguugugagcugucugauaucggugcugagaaccuaacuugaaucuuuugcaagaagaguacuuuuucuuaauugcugagccauuuccccagugucucaaaauggguuaacaauucagguugguguaaaaaacaaaaaacaaaugcaaaaacccaaauggccuugcccaucagaucaaagcaagguacaguauauucugaggcacauagucuacuuuugaauucuuuguagaauuacauuuuuugcuaacauauucuauacugccuacuagucuuucauggggucuuuuaauaaauaaauucauuggacuccaauuuuacuuucagguucugugucuccugaaacuuaagagugucaacagcagugaaaaguuugacauacuuagucucuguacauacuuggcaauagaagugaguuuuuuaguggagccaagacaguauucuuacguuaccuuguauuguuacguuccugcccacagaaguuacuaccccauccucucccuuacccaaaggguuugcauaguuggccaucucuugggugaagucuccuuugucagugauuuuucuugacuuuuaggaacuagucaaauuauuccaggaaaaaaaaacguguggauuuuuuuuuuuuuuuugcuugccuccagcaucuuaaggauucuaagugggagaaaagaugaagaauuuauuucaucauucauguaaccuauuguuuuggauccucacuuucagaauugcacuccuugccucaguuauaccagacagccugcaucuaucuaucuaucuaucuaucuaucuaucuaucuaucuaucuaucuaucuaugaaucuaucuguccauccauccauccauccauccauccauccaucuaucuuccuucucugaagccuuuugcagugguaaaagaggagcaguugcuuggcugggagcaguuggcaggguucuagggcuuccucagcagaccaucagcuuagcucuuccaggcuccuguuucuaucucucagaguucuuacugcucccaguggaaugcugguccaguugccucuugacuuucucuguuacuugcuuuuucuuuuucuuuuuuuuucuuuuuuaguuuuuuaaaaauauuuuuauuagguauuuuccucauuuacauuuccaaugcuaucccaaaagucccccauacccacccacccccacuccccuacccaccagcucccacuuuuuggcccuggcguucaccuguacuggggcauauaaaguuugcaaguccaaugggccucucuuuccagugauggccgacuaggccaucuucugauacauaugcagcuagagucaagagcucugggguacugguuaguucauauuguuguuccaccuauaggguugcagaucccuuuagcuccuuggguacuuucucuagcuccuccauugggggcccugugauccauccaauagcugacugugagcauccacuucuguguuugcuaggccccggcauagccucacaagagacagcuauaucuggguccuuucagcaaaaucuuguuaguguaugcaaugguguuaguguuuggaggcugauuaugggauggauccccggguauggcagucucuaggugguccauccuuuugucucagcuccaaacuuugucucuguaacuccuuccauggguguuuuguucccaauucuaagaaggggcaaagugucuacacuuuggucuucguucuucuugaguuucauguguuuuccacauuuuuucuccauauuugcugccaugaguauuuuguucccccuucuaagaaggacugaagcauccacacuuuugucucccuucuugagcuucauguggucugugaauuguaucuuggguauucugaguuuuugggcuaauauccacuuaucagugagugcauauaucauguguguucuuucgugauguuaccucauucaggaugauauuuucaaguuccauccauuuguccaagaauuucaugaauucauuguuuuuaauagcugaguaguacucuauuguauaaauguaccaauuuucuguauccauuccucugcugagggacgucuggguucuuuccagcuucuggcuauuauaaauaaggcagcuaugaacauagugaagcauguguccuuguuauauguuggagugucuucuggguauaugcccaggagugguauagcuggcaauauguccaguuuucugaggaaccuccagacugauuuccagagugguuguaccagcuuguaaucccaucaacaauggaggaauguuccucuuucuccacauccuugccagcaucugcugucaccugaguuuuugaucuuagccagucugacuggugugagguggaaucucaaggcuguuuugauuugcauuucccuaaugacuaaggauuuugaacauuucuuuaggugcuucucagccauuugauauuccucagcugaaaauucuuuguuuagcuuugaaccccauuuuuuaauagggauauuugguucucaggaguuuuuuuuuuuuauauauugaauauucaaccaugauucuuuuacuugucuuauuucaaacacagaggcuuccuaaagaaauccacuucugcagauuucaggcuucauuucugauugaacucaaaagaaaaacuuuggguuaggcuagaauguugaaaaccaguuaagugguuuucucugucuggagaaaauuggaaaaaggaauuauuaaccccagcaaauguaguugauggaaaugcugacagaugggcucugcuuggugccacugucaggagaagucaguugauaucagaugugucaguagaacugcucugugcacaagugguaucuggucagccuugucacauuuaaauaaaccuuuuacaaaugcuaagugauuucaauaaaaaacauuuauucguccuucuuauuaaaccagauuuuuguuguuucuggcuuccuguacccaacaguuuuugauugucucaaaagguaaaacauguucuguguggaucacgcugcugaaaugccuucaggcguuguuuaugagucugcagucuuuauuuucagagagaaaggaauaccuuaaugucuuccauauuucauaaaucugucccauguugcaauucaaagcuguguguguuuucguuagaagcuacuucugguuguacuuagagcagaaaagcugccuaagaaugcuaaggacuguuuggguguugguagcagacuccccuaaaggggauuuagugaugguuaaaagugcuuuucauuuuuuuggcucaagaaagucagggaaggugcucugacagucagaaguaguauaaccauuccuugaugguuuugccccagugaguuuccugucuggcucauccuuagagaccagucuggccucuggguaugcuugcuaguuuaccauuucagacuccauugcuaaguagcauagagugugccugucugguggucaaagaagagggaaguugauuuuugucugccacaaaugagacucucccuggagauucagcaaaaguaaucugaguuggagaucaaaguuuacuauuuucuuccuuuuauuucauuuugaaaaauuuugaacauauggaaaauuguaugaucaauaugcacauuuauuuaccaccuacauucuauaauuaacaucuuauacuacuugcuuuauuuuagaucuauccaucuaucaacccauugcaucuuuuuguaugaauuucaaaguaaauuugagacaucuguacacuuuaccucuaagcacuuccgcaugcacagcauuagagcuuaguauuuguuugaucauuuuuuucuuuuaagauuaaauugaaaaccacaauauguacaaaucugaagugagcuuuugagaaauguauacaccugcuuaaccuaaaccuauauuaagacaucgaacuuaacccaucacucuggaaaguuuuucucuacaguucucuucccagaggcaacuaauguucugauuuucccccagcauagauuaguucugccuguuauagaacuucauauaaauggaacccaauggcuguguaugcuuuuauauaaggcuccuuucauccagcaguuagauguuugaaggguaucuuuguugcuagaggucuaaguaguuaauuccuuaacagugaaaaguagauuugcuuguaugaauuuaacauuuuaaaaacuccauucuucuauugacccacaccuacauugugcuggauucuggccauuuugaguauaucuucuuucaacauccaucaagacuuuuugugggcacaugauuuauuucuugaaaaaauauaugcagaaguaaaauucugaguuggaauucuaugagacacagugaaguaauuuuacaaaguguuugcagcauuuuucugcuucuucaguugguccccgggaacuuuaguugcuuggcuuucuugccaguaucauugcuauuuuaguuguuucagugacugagugcuuuucuuaugcuuaacuuuuuugguuuuguuuuguuuacuguggaaaaugaaugaaagccgaaagaaaccugaaaacaaaccucaguggcugaaauuguaaauuuucuguuugacuaucagguaaggcugaaguaaacaguaaaggaaacaaagucagggcaaauggaggaaggggcauaagacuuaagcacaggguaaacccagguugcagacaccaggcagggucagcuuuuacagccuuuaccuggugcuggauggaugggccaucaucucccagccccaguaucuguuucuuaagucugucauuuugacuggggugaggcagaaucucaguguaguuuuaauuuacaucucacagauggugaguaaggccaaauguuuuucuucauuuguuuuacugggcauuugcgguucaucuccugagaacuguguguucauuucauuagcccacuuuuuagauagaguuguuuguuuguuuuuguuauuagaguuuugaauuuuuuuguagauucuagauaccaaaccucugucuaauaaauacauagcaaagacuuucuccuguguuuguagguugcuucuuuacucaauuugcuguuugcuuugcuaugcagagccauuuaauuuuaugaaguccccauuugucauuuguugacauuucugagcagcuauaggucuagucagcaguccuuaccugugucucuaucuugaaguguuuuuccucuagcguuccagaguuaugaucuuacagugagauccuugaugaugaugauuuuguauaggugagagauagguaugugcugucauucuuuugcauauaaauccuuaguuuuucuaacaccauuuguugaagaagugucuuuucucuaguguguguguguauauauauauauuuuuuuuuuuuggucaaaaacugaaugcuuguagaugcauucauuuaugucugggucugcuagucacucuuguuagccuguauguuuuugugucaauccaugcuuacucucaaaacagcucuguccauuguaguugccucugucacacaucaacaucccaugggcaucacacuguaaccauugcauaguaguucucaaccuucauaacgcugugacccuaugaaguuccucauguguggugacucccauccagaaaauuauucucauugcuauuucauaacuaguuuugcuacuguuaugaauuguaauguaaauaucugaguuuuccaauggucuuaggugaccuuggugaaaggguaguuugaccaugaccccuaccuaccucccagcaggggucaugacacacagguugaguaccacuggcauaggcugucauacaaaauucauauuugucuuucaaaucuuugaauacagaauacaaaaucugagguauuacauacuuucaauuuaugaugaguaaauaaaucucuugacaagaaagccaugaugaguaccugcuuucaucauacucugacauauucccaaaauucuaauguguauacacacaggaucauugaauaaugaaugaaaacauuuaucagguggaaaggguuaaugucuaagauaacauuauauuuuugagcaaauuuauaaaauauaauuuaggacauuuaaucauuaaaaacaaagaaacagagaaacaaacaaacaaacaagcaaacaaacauacaucaauaaaaccuaguuucacgcuugagaauuuagaaauguaacuggggauauaguugacaaguagggaaauccccuagcuauguucauggcuuacuuaagacaccaaucacaacaguauuuugguuuucauuuguuaaaaagcaauaucagaacuaaaaauacaucuguugccagaggcuugcaucauauaaaaugacagcacucgguccauucucucuauuagccaugaaguaacaggccuaauuucaguucauaaagucauuucuaaacaggguauuaaaaaaaccuaguacagucugucugaaaaggcuuuuaaucuugcuagccaugguggcugguuaauuccuagaaucaaagucuugaccagaguccuuuuucccacuaagguuggacagaacacauggcaaauaaaaaaggugcuagcaaaaggccccgagccacauuaaacacaauggaaauaacauuugagaacagucaccuccccagcuggaugggaaguacugugguuccugccaucugcucuuccuuccuagauuccuuuuucacaaguggucagaaagaccucgauucuguccaagaaauaaaaucgugggaguugagacucacaauuuaaagaggauaaaacucauagacuguaguacuaccuaaaaauguacaaacaaguuggggugcucauuguuuguaaccuccacuucauuuucuaauuacagucccucccaugagaaggcuuagcaagaaacuucuggagagaaagcauguuuuaacugaauguuugaaagggaagaagauucacucagagaagaccaggauggucauagggaguacaaaggaaguauuaggagaaaagcagaacuaguuauuggaucaauaaguuuuaaaguuuucuggugacagaguugcuaagauuaauauuugaaccuauuugaaccuguucuacuuuaauaaacauaacuaagaauaccacaacagaaaaaaaacauucucacucuugcauguaaagaauaaccauagaugggcugguggugugcgccuuuaaucuuaguacaugggaagcagaggcaggcagaguucaggggcggccuggucaaccaagugaauuccaggacagccagggcuaagcagagagacuuuguuucucccuccucucccaaaagaugaacauuaugaagcuguucuaugacacugaaagacucuugcauguauuuauuuuguauguguguauaggcauguacaugcuguauuggacauguggaagucagaggauaaccugugggaggugcuuuuccacuguuggauuacagggauugaacucaggcggucaggcuuaguggcaaguaccuuuuaucuacagagccaucuggcuggucuuauucuaugguaugcuuuuauauacuaggucuaggacuucauauccuacugugagauuucauauaacuauugaaaaguauuuuuaaacuaauauucuuucaucaaacacuuaauauaguucucaugcaauucuaguguuccauagaaugacauuugaaaauaagaggaauguuuuucucuucccauuuauaacuaguuuauuuuucuuauuuuuagagacagggcaucucuguguagccuugguuauccuggagcucacuuuguauguaaaucaggcuggccucagagaucugccugccucugacuccuaagugcugggauuaaagguguguaccaccagcacccugccuguucuuagaauauuaaacucuauuaaaaugaguaauccuguauggugugguggcauaccccuuuaauuccagcacucaagaggcagccaucucuuugaguuugaagcuacuggagcaauagcuaagagcuuacauagcauccacaagaaggaggugcagggggggacagaacuugagggggacacauagagaggagagaccaaagacagaggcacacagagaaagaaaauagcagagauauagagacagacaagcagagagagggagacagagagauguggggcaaguggacugugcugccagccagaagaaccagaaagguugagugaguccaagccuccuaaaucucagaauugaggacugaaggaguggagcaaacucccuggcuaacucugucuggucuggaacauguaaccaggacacuccauuaagaggagcauggcagucagccauguagcauaaaaaccuggaguucucugugcuaaugagguaucuagauaggccccgaguguucagucagugagcuucccuuccugggcauuccuuucugcaaaagggauuuaauuccugaacugauagaaugucugucugucuuacccugaguaagguguaugcauccauaucugucaucaaauaaagcaguuugaacaagcaaguaccuuuucuucagcaaggauugcugcaggcacuacagcauugaggcacaacacagccugguagacagugagaaagugagagagacaaacacaugcugggccuaauguggggcuuuugaaaccucaaagcccacucacagugaaacagaaccuccaguagggccauaccucccaauucuuuccacaguuccaccaacuaggggcuaaguauucaaagagacuguggggcccauucucauucaaaccaccacacccacaacuauaguucuuauucaugcuuugacauuuuagguaauauuuucuguacuugaacauaauuuuggagacagauucuauuuuagucaggguucucuagaggaacagaacugauagaaugucugucuuucggucugucuaucuaucuaucuaucuaucuaucuaucuaucuaucuaucuaucuaucuaucugauuuauuagagugucuuacaggaugugguccagcuuguccaauaauagcugucuauuaaaagucuuaaauccuugaacuuguucaguaauccucauacugcucuauucccuggugaccuaggcauucaaauauaugagccugugggaugugauagccauuuucauucaaacugucacagagcccacacuuucacuauaguuuggaacaauuaauaaccccacacagucucaagaauugccuggcuauuuguuugcaucuuaugaagaguaauaucaucucccugccuuaugaaaucuuagcagggauaauacuaguaguuccuugcaaauuauaacaaaaugcacuuacugagaguucauguagcgcaucagucaguuuacuguguuuacuuauguacacuuguuaguaugucuguguccuaaauaaagcacacugcuuauguauuuuagucaccaaucuccgucaguagcuuaaucaauagugcuuuuuuuucugucuucuucuggaaaaugaagucagacuacauaguagcuucagcagcacuaaggcauugaaacagaaaccgauuacugcuacagauguccagcaagccacauuguaggcgugcacagcugagagugcuucaugguuucaccuuggagguuucagaggaagauaauucuuuaggagcugugauaggcagauuccuaaguuugaacuaguuucacaggacacuugaugaugcaaugaugacauaggguuuaugaugcaugaugcugcaggcuaucaggcauccuuggcaacuguguuaaggguauuguuucucucccucuguuccuucacuuuuuucuuuuaaaucuagguaauccuacuggaagcuagcaauuuaugucaguaaaagagcucuugauguagguucuccagugguugacuguccuuaugugagacaugcugacaguuauuaaaguaggcagcucucccauggauugcucaucaucuuauuuuuuuuuucugaauuuauguuuuuaagagacuucauuuuugccucuuaguguuuguagcgcucauguuccauuuugucuucacugugcucccgaggguagaguuaaaccuuauugaugagauuacuuuaagcuuaccugcuauaguguuuauuaucaaauugcacauccuuuuuuucuuuagcacuuaugaauuaaacuuacaaauaauaccucauuguuugacucauaggcucccugaaguaaaguguaaagucuuuuuaauuuauuuuauguauaugaguacacuguugcugucuucagacacaccagcagaaggcaucagauaccauuagaugguugugagcuaccaugugguuucugggaauugaacucaggaccucuggaagagcagucaguguucuuaacuggugagccaucucuccauuccaaguguagaguauuuuagagacaaucuggaugaaaguauuuaacaaaguuagaaguguggcguagacuugaaguugguggaugucugacacuggaaacuggggaaggauaggaaaggcucagcuucaccacaugagcagcuccuuuaugucaguguuucuguccugcauuccuuuccucucucgguuuaaccaaaggaagggaagugugggccuuauaucccgccuguugauagucucuccaguuagaagucaaggcaguguggauuuugaaacacagaaguguauucuaggaaccaggccugagauguagcuccaugguauaaugcauugacaguucuguuugauccccugaauuuucccaucccauccaaaaaaggugaacuguuuuuuuuuuuuuaaaucauaaaaaggaacagauuuucaaagaucugugacucaaauauugucuauauuuucuuacguauaggaaagacucacugagucuuugaacuugguacugauuccauguuuauaaugguauaauacaauuuaauuugcuaaaagauagaaaacaaaaauauaaacauaaaagcauaaaaacuaucuuuugaaguuuaaagguagcaauugcacaucauucauugugucugauggaauucaucagaaccuucuaaaagccucacauucaaagcucgccucccuagacaaggagcugccuguacaaaccaggucaaugcuugaauacuuuucuuguggaauuguuaugguucauggcauacucagagauuucaagcagcuaaaugcuuuagacaagcacgucaaacaucaaaaagaaacaaaauuuucuuugucuacccuaauacuacuuuaacauacuuacauaguacuguccuguauguuuuaauaucaccuccucccccauugcucguucuucuccuccucuccccucccccagggccuuuaagaagggaucugacaugacuaugcaaauuuaugaaccauugugugagcacucuauguuaguuuaaaaugauacaggcuuccagaacuagagggaaagucuguuuugcaacaagucuuacucuugagaauacaugggccauuugugucucuccauccagagcuucaaccuuugaaaggauuuuuuuuuuuuuaagauuccagugcuauaaagcaucugauguagugaaaagcacucuaaaugucucucaaagcacucccucuuggauuaaaaugucacagaaauguuguaaacacucccagccauauucaagaggacaauuuaaacaaacauuguuuugcucuuuugucuggaaaaguaauuucugaagcaaagagcugaaaacuuucaguccuacacacuauguaguaagaagaagaagggggaggaaacaucuuuuaagcaucagaagcagaauacacaacaggcuuugucucauugaacaaaagaacaugcuuuccucuuagaucacuuccagcuguaugaucugccuucaugggaucagaaauuaacagcauauggcaucuggcuaccugcacagacugcguauaaaucugaaaucuucaguaagauuaacggggcugaugguugaaaguggagagggagucaccaaauuccacuucuuauacagaggcaauaacccuggcuuaagaaggcaggagaaaccauccugccuaaucagaugucaacuguauuccugggaagugacucaaaucgcaagacugucccacccccuacacagcugcagagcacaccaucacugaugauagaauugguuuggaucccaaauaaagagggaaucccuacaaggaagcagggggaaaagaggaaaaaaguccugcuuuaaacauauuagaaugguguuggaucagacaagccagaaacaaagaaaauugaaaugacucauucuuauccuagaucuuaguucaagacugucuauuuucuuacauguaagaaggaagcuuaucgaauacauuuauagagcauugguuuuauggcugguaacugacaaaacuuucuagaagggcugggacucuggguuuauaagaauguagaagauagagaguaugaucauuuauaggagaugggacuuucuuaauuguggagacccacuugagagauuacagggguggugugauugaaggaaguugagagcaggugugaucugcugggcugguaguagagcauaaauauuauguauccuccagaugucuguacaugacaggcuguggaccuuuaggaccaggagucuuaggggucauuagaccaauggagccauacucuuaaaagauucuugagacccuaucccuuuccuuuaucuccccugcuucuuggguauugagaugguguacuuucucugcuccaugcucccaccauugccaucuggguccaaaacaccaggucuaccugaucuuggaucugaacugccacacuuuucuugguuaggauuuuauugcugugaugaaacaccaugacuauggcaacucuuauguaggaaaucauuuaaucgaggcuagcuuacaguucagaauuuuagucuguuauaauggugagaagcauaauggcauacaggcagacaugggaguucuacaucuggauuggcaggcuacaggaagagcaugugagccaguggaccugguuugagcuuuugaaaccucaaaguccaccccagugacaacucucuuccaacaaggccacacucgcuccaacaaacuuacaucuccuaauaguaccacucccugugagccuaugggggcuauuuucauucaaacugucauaacaucugugagcuagaaguaccuuuuuauucucuucaauaagugauaucucaggcauuucaucuuggugauauacagaaggacuaaccgggagaaaccgagagggggcagcucagacuucccagugaaacucacaugaaggaauuauagccacauaaagacaaauggauggcuggagaaacugugcaugauuaagggaacuagaguuugguacccagcgcuaucaccuguaccaccuauaucacuagcuccaggguauccagauaugccuucuccuggccuccacaggcaucuauacuuauacaucuaacauacauucguaucuaaaauaaagucuuaaaaaauaaauggaaaaggcaccuuuaaagucacaggcuuuguccuuucugccaaagcaaaaaucuccucuguauuauuucuaaugaaugcaaguuguguuaaaaaaagccuauuuguucccuuguaaacacuuuguuaucuaccacacaucagaaauugugcuauuaggaccagugauauagcucaauagacaaagaccacuuccauacaaaucugaugacuugaauuuaaucccuggauccacauaaagcugugaggagagaucugauucuguagcguuguccucugaccuccacauucauggcaccacacauaccucucaucaugaagacacauauauaauaaaaaaaauuauguguugcuaucuguacaguugugaagaaaguagauauagucccuuccuaaggauuugacuguucagcugaggguaaauagagagaacagagcaguuuaaaacuauuugaaagguaagcauagucaucccuuuguaaccccuguagacaucaaaacucaugauauuauuaaagucucuuguaugacaggcauaaaucuuacauacaaucuauacaauccuccuguuauguucaguaucuguagauuucuuaguauucccuauaccaugcaaaugguaugcaaauaauuauuauauguuauuguuuaagaaaagagucuguguauauucagaauagagucauucccugugaaagaauuuuuuccugucagcccugucaaaugucuauaaacaguagaagggcaugguuuguuuuaggaaggcuugauuguaagcuguguauagccugauuaaauuugagcacccuagccaguauaucacuguagaauuucaggggagaggcaauauaguccacuguacuuauugccaagcuacuuaaacccaauaaaguauauauuuuguaaugucccuuuuguaauccugaaauaaaguccaccagucauucauaacaguuaaaaaauaaucuaacucccuaacuguaguauagagagaaauaaaagaaaguaauuauaacacaauauuuuucuguguguuuuagcuaaaauagagguguguuugggcuugcugcacugugaccuaaccauaacaccauuacuaagaagcaucaauauuaaauuuccgagucagcaugcaacucuuuguaaaguucugaaccaacuacaaaguaaaauuuucuuuuagcuccuaugguuacuacuuuucugaaaguucacuuuacaguuuccuguuagucacagcuuugcugaucuauaaucagcuggcauuggcguggcuugauggucuuccugacauguccucaggucagcaguacucgaacucugugucauugcccuccguugucucccaucaucccaaggaaaagaaaugugggcgugguaggauacaguguuuuaagagugaggggaaagaagaacaucuaccucauuuuuacuauaguacauuguuaugaguuuacuuauuguuauaacuuauuguuauaaguuacuaccuuuuaaacuaauuguuguggcuaauuuuucaguuggucuuuauuaucuucacuuccccucuauacaccucccuaucucuauauaugaaaaguguguauagucauuauugcagaaagacauaggucaacaguggacugcauuuugauaguggucauaauauuacugcuuagugacauggcagcagucuguguaagucugugcuaggauguuuauacaaugacaggauuaccauaagguguuuguuagugugcauugccauagauauauugcgugacuuuguaaaguacuguacagucugguuucagacaucuccaaugguccugggauguauuuuccauuuugaagcugugcaaaaguuauuuguauauuaauaauaguauugaagauagauggauggcucauacaaauguuuucugggacaccagacacuugcaaaugauguagggcuguccacuguaugucauguugccuaccuuucuagcuugcugucaguaacugaucaucaugauaagcacaccucccccaacacaaacguugagauucccaucuugaggcaugcuugcaugcuugaucuguuucuguugcucacuauaaaaauggacuuugagaggaaauuucuggugaauucuaguuuuacauaaccucaugucuuuauuuuauuauuuaugaauagcaggaaaugauccugaugguuugguguaucccaaaucucuaccugccugccccaauuccuggcagucaguaauuuuguuuuauuuuuuacuaguuuuacuuuuucuuuaauauuuccuuaauauuuacagucacaauuaaauuauaacuaauauuuccuggaagcacaacuuacaauauauuaauauauuuacuauauuuaacaaaauuuuaaaaaauuaaaauuuauauguacggguguuuugucugaguguaugucuguuuaccacaugaaugccugguaccagcagaggccagaagaagguguuggaucccuuggaacggaguuacagaagguugugaggcacuaugugagugcauuaaggcauuaaguaaacacaguuguucucaauggagggggguuuuucucccuuggaaguuugguucuucucagcugugguuagugguuagggugacuuuggcuuagagacuggauauaggcuguguugagauggaggggugaggggaggagaaaagcagacauuuacauuuacauuccugcacugagcauuuggugauucgacacucacaccuuaaucuguaacuagaaggccagccuugagcuuccuuccuuauggagauuucuagugcauugaauucaggcugggugaugccgaaguagguaaaaggggguagguguugauggauggacagguaagucucacucaaucugcuacuguuuuguuuuuucugucuaaaguuuauagcuguguucacugauggagaaguguaaacguggugacuuggcauuaccauguguuucaugcuaggcguagaguugggcaggaucucuguauugcuuaaggacucacagugacaguuuguaguguugccaugguuauaauagagaaugugcugauaggcaugcuccuuggaggggaugccuuugcauguuccuccuugguaggcuccuccccuccuuccccuccccuccuuccccuccccuccuuccccuccccuccuuccccuccccuccuuccccuccccuccccaacuuucucuucuccuccucuccugugcccuuucccucccuucccuuccucuuuccccuucccuccucuccucaucuccucucaaggcagagucucucuguguagcccuggcuauucuagaauucacuaagguagaccaggcuggucucuaacucucaaauucugggauuaauggugugugcuaccacacauggcccuauucuguacuucaaaaaauuacuucagaaaaguagaaaauggccuauuuucuuaagaaacaaaguacuuucuuaguaccaauuuauaaaugucaguggaaauagauauaagaauuuauuuguuuuguuugucuugaacuaaaggcaacuuuugcuuauggacuagagguauacagugauuguggcauaauaaaauaauagugaauaauaacguuuaauauguguguagggaagaaaauagcuauaugugaugacacauacuuauuacaggccuugggaaguggaggaggggaaucuugaguuguaaguugacuugggcuauacuggaagauguuaucuaagacgagaaagaaagcaaacaaaauaaaacaucaauguguagagaaggaagauaaaaagagaauaugaguauacacauuuauaagcgauuauuuuuauuuauuuaucaagccucuugucucuggccaguuugccuucuaacaguuaaguagccaguuuuguggcaggccagggucgugauggcaaagccguagagggagggagacugugauuagaguccuugcucugucccaggucuguuauaacacuggaaagaaaaccugacuacacaugucaguugcugcuauagacaggaacaguugguacuguuugccaauggagaaauuucauuuuuggucuuguuaaugauugggcuuuuuguacuugaaaauuuucugcuuucacuacuguaguauacuugguuuuucucuuuccuucuacuccaguucagagucuguugaucuugugaaagucaaaggaguaacuguccaucuuuuaaaggauguuuucucucauccacagugugguuuuacgcauagauggauaguaaccuguucuuuguacuuuauuuccaacuucuguuguuuaaauuauacaguauuucuucaaaguaugaggcagacauauaagggauaaaaucuaggcaaaagaaaauaaagaauaaaugguauggaauguguagggcugacgaugaugcugcuucgguggcccuuagguucuguauugcacugugaacaguuuuuauggaaggaaaugcuccucacuaauuaugagaguucauauucacugggaauucucaggacagauucucuaagucuaauuaauggcugcauucuagaaaaucaucauagaaauaucauuuuuuucugcuuaacugucugucagugccaccucuggucuaugggacuaaguuuuggguguuaguuacagucuauucagcaggaggaugguuucaaaccauguacucuaaagggaaaagacauaguguugaacaguuauguaguauagcuaaguaauuaguaagauagauguugcuggccuauugcagacugaaguacaaaaauagguaacaggcaauacagugacaugcacauaugaucacaugugcacauagaaaugugugcacauguuaguaugggaguaggcaacuuaggguggugcuuuuaugcauuuuuagacuuuauuguguugaacauucuuuauuaaagaggauuuuggguuuuaucaauaaugaaugaguguggcuguuuagccacauuguuuauggccuuccacuuuauuuguuuaguuguuuguuuauuuguuguuauuguugagacggguuuuuauuguguaacccuggcuagccuggaacuugcuauguagagugggcugguuagccucucucauagagaccugccugccuuugucucuacucaaauuaaagugugugugugaggcucuuaaguuguacuuucuuuuucuuuuauuaaugaaaaggagagcuggauaucuuacuguuucgauuuguaauuuugugauuguuuuaucuuuguggguugcuuuucauugcccuuagacugauacauagagguuuuaguuuuauguaauaaagucuuuuugauuccuuuuuaauuuuguuuuuguuugaaaucauucucuguuuuaagcuuagauguuauucucuuuuauuuucuuacugcaugauuguuuuaguaugagaaguccuuuuccugcuuucacacaugauucucuugaauauggaauucuugugauaauacauuuuuucuuuaaauuguauuuugccucauugccuauuacauuuaugauacaaguugauuuugugguugcuuuuuccuuuuaaaaacaaaaauuaauaaaauuaguaaggaaaaaccuugaaaaucugaauaaaucuguuuguaguuauuccuaauauaguuuguaauuuuugaguuucauauuguguagcuguugacacaaaugaucaugguugaacguacucagaacauuuguauagaaagguuacugaaguccacuuggacuggguuuugacugaauagccaaugugugguuuguagaugugugguugaucugugagagaacugugcaggugcaucucaacgcgcuucuaccuacaccacaguuaaaaaagcauacuuaaagguacaaugaaugaguuaauucuuuacuaguauuuaugugugcuguuguuucaaauucauuccucuuuuuuuuccccagaaaauauuccagccuauguagaguguaaacucaagaaaauguuuucugcauaacaguuugacaaaagauggggaagagaagauagaguuuaauuguuauuggcugugggugggauguaacuuggggcagccauuaugggaaguagaauggaggguccucaugugauuccaguacucuccacuucuagauauuuuauuaaaacuaugauucuguguccugugaucugcaauucuaccucuggguauauauuucgaggaaaugagugauuuaugucagaaagacagcuguauaaucauguuaacuguggcauuagucaagagagccaagauauggacucaaccuaagugaacaguaagggaugaaucacuaaagaaaauaugauacacuaagucauguccccucccaacacacacacacacacacacacacacacacacacacacacacacacaccucuauuauauuguggaauauuuuuuuacaucaguuguccuuccuuccuucuuuccuuccuuccuuccucccucccucccucccucccucccucccucccucccucccuuccuuccuuccuuccuuccuuuuuuccuuccuuccuuucuuucucuuucuuucuuucuuucuuucuuucuuucuuucuuucuuucuuucuuucuuucuuucuuucuuucuuucucucucucuuucuugaagaaaagucccuuuuauuucaacauuuauucucauagcucuuugcagauaggacuuguucauguggaaaacuuacaaaaacucuacaguaagucuagugagaucacauuuguugagcaguuuuaaugccucuuacaaaacauuauauagagcuaaacaaaguauucaaagugauuauguuguuuuauuagauauuuucuucauuuaugcuauccucaaugcccccuauacccuccccccaguuguuucuuaccuuaaugauuuaaaguguaaguuuaaaaaauauuauuuauuuauuuauuauuagauauuuucuuuauuuacauuucaaauguuauccccuuuccuaguuuccccucugaaaaucccuuauccccucccccuuucccugcuccccaacccacccacucccauuccagguccuggcauuucccuauacuggggcauagaaccuucacaggaccuagggccucuccucccauugaugacuaacuaggccauccucugcuacauauacagcuagagcuacaaguuccaccauguguuuucuuugauuggugguuuaguuccaaggagcucugaggguacugguuaguucauauugauguuccuccuauggggcuucagaccccuuuagcuccuuggguacuuucucuagcucuuaaaguguaauuuagaauaaccuguacuuugagguugauaaugguucuaugguuguuggauaguuuuguuugugucuuagauaaguauaaguuauuguguugaaaaaacugggagaccaauuacuuaaucauaggauuuggguuuauauacagucagauaaccacauuguagaauuagagaacuaaugauaucuacagggcacauauuaguuguaagguuaugugaacccagugacuucuuaaaagacuuugcugugacuaaguagaauucaucauggaaucuaagucccagcauuuuaaaugaagauggugugguccaucauuaucaguauucagccacuagugaaauucauuuuagugcagugaaacaagaguguaaagugaauuauaccagcaaaacauuaucuuaacgugugagauaauauugcguacagaacaagaaaauuaaaagcaauuucaaugaauaagauagaugaacaagaacuaaaaauacacaaaauucaccaaaaauaauggcaucuaggacacauguuagagugaggaucauacaugaaaugugacucuagaauucacuuagcagaggaaguuuagucagaugcugaguaacgguguggacuuuuuguauucauuugugauuuggugcugagguauuaaauauauaaaguaacaagguauagcaaugacagaacaauaaacuagagcagggaguucauaaccucuaguauauauaagaaguugacauaagauaagcaaaaacacugcuuuuaaaauaaggaacagaaagaauaaagaguuuggugauguaaacugcauuaaagaaaaacguaaaaacacaucaguaucuacccacuaggcaguaugguuuauuguuucuuaaucuuggggccaguaaaaaucccaaagaaaaguguaacaaagacuggagaaauuugguuauuuugucauaagaguuaaaaacuggacagguuuaauguggugcagaccuuugaugccagcucuggguagguagaggcagggagauaucuuugaguuccaggauauucuggucuacaaauugaguuccagaacagccagggugguuacacagagaaacccuguuuugaaaaaacaaaccaaaaaaugaguaugucaguagggaacugcagacaaagacaacgaggagaugcugcaaugcaucucuuagaauaguggaugccuguagaacuaacaacuuaacaagguuggugaggagguacagcaaccaggcuugucaugggaacacagaaguauagacucuguaaaugacagaguggcauuuccuucauagcuaaacacaagguugcuucaguaguccucaaguugaaaacuaaaguccaaacacaagucuagacaggaauguucagagccacucuguguauaauuuucagauauugaaaacaaucaagaugccauucuucaagaauauacaugaaugaauugugacagcuaugcagggaaacauuauguaaugguaaaaagaaaugaaaagaucaacccaggaaaaacauggaggaauccuaaaugcauauuacuaagagaaagaaguuagucuuagaaggcuacauagaucugauuucaaccauauggacauucugaaugaugcagaacuauagugacaguacaaagauugccaggaggcuggagagagaccuuagugguuaaucuugcagaggaccugaguucaguucccaacaccaacaucaagcaguuguaaaguaccuguaauucuaccccagggaagcugacuccuccuuccuuagcaggcaucuauacacauauacagacagacacaaguacucauuagcauaaaaauaaaucuuuaacaauuaagagguucuuuaauuuuuacuguaaaaucuagacuuaugccuuugcuauucauuaaguuuucaguggccuucuuuccagauguucauugguuuuauggugguuuguguuaaauguguuuuaguucccuagcuauuugaauuuaaaaaaaauacuuccuuuaauuuuugagauuauaaguacaugauaaccucucucuuuccuuaucccaaacucuuucauauaucccucccuacucucuuucaaauuuauggccuuuauuuuuacuaauuguuauacuuuauauauauguguguacauacauauuccuaaauacacagguagaccucccucagucuguauguuauuacuuaaauguauauuuuuagggcugaccauuuggcauuguauaaucuauuggugugcuuuuucuuggggaagacugguuuuccuacacucugcauuucuuaguugucugucaugcuuuguauaagguggaggucucugggguuuuccucuguccuuuuuagcauguuuauugcugcugucuuuguucuucucauuuuggugagacuuuaugggguaccuuaugacauuacuaggagucauaaugucaugacaaacucccugaucuucuggcuuguaacuacuuucccacucacucuuuggcaauaaagugcgagccuugguggugggaguucuauccauugggucuggaaucuacaauaguagauuaauuagauuuuguuuuucuguaauggucuccaucaguuucaaaguguccuugaugaagggugauggcugcacuuagcaaccuagacccuugacaaggaucaugucugaauauuucccccucauucggucuaggguuggucuucuuccuucaugacugaucuggaucauucuuguuaacuuuagcauaaaucuuauuuccuuugaggagccuuuucuaagucuccccccaaucccuaucacauuccuauucuuaguuaaguucucuguguauccacuuggaauucuauauguuuuauuucauuuguauuuaaguuguguuguucauucaucuauauacccuggagcaggcauguccagucuuuugacagucacacaguugaguuauaaagccaaaaccaaaaccuucaugauauucuaaguaaacuuaccuauuuuuguugggauauauucuuagguauucuggguuguaugugggcugcagguuggguacaucuacugaaggguaugaaguaaugucuggccuagugguaacuucaggaagacuggcacugcugauaauuaaauaaugaauaguugaggaaugugaggaaaggaugugaacgugaaauguggcucccuuuguguggcuuaaguguaacucaugugaucugcucugcucccuuuaggucuuucuucuuccugguagagcuuugaaggguuucuguaauauuuacccuggugacuaagggaccuagaaaguagagcuagugagccaguuaacagagcugagaagauuacgagggucaccuuuaggguaacaggaugaucuaauaacuaguuuuuuaaguauauguggaugcaguuaaguuuugaagaauauugauuauuuuccaucauugaauggggagauauaauccuguugauucugcagcagaauuuagagucaauuugcauggagagaucuucaugacugcaaagaauucugcaguuguuuaugaaguaaggcaauaggaaaugcugauuuuuuuuguuuuaauauaggaagaugaugucaaccuuccugggaaaauaguuucugcuuuguaaguuaagaaauaugacgauaauagauaaaagcaauuuccgauaccuguuuugucagugaaaugcagguagcuguagggccucaguuacuugggauauaaccuacagucucuccuccaaagaacucaaacagaauugagcacugaugaggaagaacgcuuucagacuggcuucagcauuguccucucaaauuaaaaaaaagcuaauucauggagaaaacccuaaugucaggaucugcgauggugauaaucaauauaccaagagcuguuuuugguguaaugugagccuuacaguguugacuugaaugagcuauguauauccuacacaaucagcagaauguucagcucugcuuucugagcagcugcuggagacauacuuaauuaauacugaagcaauuaucuugacaaguaaaucaaacucaauuaguucucaauuagaaugcuuaacguuuucucaaauauugugugguugccagauggcuacgcuuguuuuuguagccuucuacuuuucuuuagaaggcuuacuuuccugcuacuguguguauuguuuauaaucacccaacuuuguuuuuuuuuuuaaguuuuugaauaaaugauuaaaauuuaauacauuuuuaaaauucucuugccuggauguauggauuuauuuuauagugcucugagaaaauuauaaacacauuuuaaaaauugauaacuuccagaauauaaaacaugcaucauuguggaagagacugucugaagauauugugaucaaccccuuuaagaggccagcuggauuccuucuagaucuguauguuuuugugcuaucuagaagcauacaucucugucgguuuuaugucaguacuccaaaaaaaccccugccauuuguucuuauuugauaauuuagaaaccacuguuauaucugggcauacuuacaguaacagugucuucagagguuuucuuuguaauugccuuuucaaaagacaacuaaauuaucaucaauuaaguuccccauugccucuacucagucuuaaauuaaauuuaccgcauuuuauuugguuguuaccuuacagaaaaagggaagaauguauuaaaucagggauuauuucugcaaccuuuguguucacacuauuugaguuuugagucuugaccauauaguuuccuaacaggccugcguguggacuguaacucuguaagccccaaguguaagauaacucucgacuuaucaggugauagauucaaacacauggaaagguucuuaauguaacucucggcaguaugcgcacacagauuuugcuuguuuuuuuguuuuuuuuguuuuuuuuuguuuuuuuuuuguuaccgcucauuugcucaguuuuaaguggucugcuucauuaaacugaauccugaaauuucaugaugccuuauuuuauugucuggcauauagcugaugacacaguuuccuaaguuauuucucuguauuucuuuacagggauggugacugaauccagggucucaugcuuaccaguaucuccuuacuuuuauuuacuuuaaaacuauguguuucuguguaucuguauguacacaugugcgcagguacuggugggauccuaaugaggccaugagauccccuggagcuagaguuccagaagguuguaagcugcccacuguaggugcugggaacugaacuuagguccucaguaagagaagcaaguguucuggaugguaccgucaccuuuagccccucccccuugcuuuuaguuuagucagccuucuaugcauuuuccaaaugcucuaugucaggucuugugccagagauuauguguaauuauuagacuuuaggguuugucgaugcaugcaauaucuaucaccuauuauuugucuuuaacuuuuauuuugaaaugauuacaaaucaauaaaauguugcaaagaauauagagagguuuguuauacuccaguuuccuccuggagcuuacuuucauuguuacagagugauauaaagaccaggagaccuacacugguacagugugcauaguuucuguugaagaauguuuacacugcuguugucugcaguggagaugcucaguuguaaccaugaagaauacccuuaugcuacugccccuuucccacuucacuaacuuguuucugucuguaaucuuguccuuccaagaaucuugugucaguagacuuuuggacauuggcuuguguuuuacuugcuuuucagauauccaaauuguuaaaagaauauguaauucauuucucuuuauuguugaauaaauaguauuucauguuguauuucauuuuauuuauuaacuugguaaagcuuuuugagagagagagagagagagagagagagagagagagagagagagagagagagagauugagagagaaagagaaagcagagacagacacacagagaggaaacauggacauccagaggucaguuuauggguguugguucuuuucuaccauguuuguccugggauggaagauggaagucaggcagucaguuaguuagacuuggugacgagugccuuuacccauuggucuugcuucucucagcagugucuuucgaaggucagaaauuuuaaauguguacuuuggggguccaaaaauucaccaagcuuugaagucccaagaauuuuuuucuaugccauuuucugagacauuuguaguuuuauguuuauacugauuuauuuaaauauauuuuacuuuaguauaugguauuauuauauaccauauuauuauaugguauuaagauuccuuaaaaaaaauucucccuaagguaaggaaauuauccuguggcagaggcuauuguuucuacauugagaugauuuuguacuuuggugagaaauggcucugccuggcuuuucuacaggcucuccuguucuagugcugugugucugucugucccuuuacugaguuucuuuaugguagcuuuauguuuugaaauuagguggacaucuucuuuccaaaucaaucaaccaaucuaucuaucugucugucugucugucuaucuaucuaucuaucuaucuaucuaucauauucuggucucuuaauugcuuuugcauguaguuuuuagaauauucuuguuuguaucuacagcuucucauugggcgguauaguguuagcugugauguucuuguccauaucuaauuuagaaaauuuucuacugauggccaagauauuagauuuugucagaugucuugcugcaucaauugguaugauaaugugauuuuccuucuuuagauauuuaguuuuguuagaauuauggaauacaguaguugauguuacaaguauugaauugcuuuuuuaucccugugauaaacucuuguuagucuuggcuuaagauuccuucugugaacugcuggauccuauuuaauaagauuugguuagucauauguaccgauuuuauauauguucaugccugauauuggccugcuauuuauagcauuguuuuucuuugauuuuuaacaauagggcuucaugagaugaguuugaagauauuucuucugcuuuuuggaaaaaguugauguuaauuuuuccucaaaugguugguuuaagaacuucuacugaaaucuuaaucggccucccuuuucagggaaauuguaagcagaaaauuuaguuuuauuuaauuaaauaagucuucauguuguguuuuaauauuggguaacaggucugugguuuuaaaggaguuggucacuuauucuguguuuucagauuuauacauagggagcugcaucaugucaguaucggucacucuucaccuguuugcacaaacuguggugacuguuguuucacucuuuauugguauaaaccauuuuuuacuguuaguauuacuggauguuaguuaguuuuauugauauuuuuaaagaaccauauuuuaguguuauugauuuuuuucuauuauuuucuuguuuuuuuguuuaaauuacucugauuuuuguucuaauuguucuuauuguuuuuucugauuauuuuagguuuauuuugcuccuuuuuugcuuucugggggugagagcuucuguuauaggcgugaaaccuucccuguguugucugugugcucacuuggagaaguuucagcccugugucccaugacucccucagauucacgcacuuucuuuucacuccguucccuucggcuugguuuaaaagauucugagauuuuguuuugauucauauuauuuagaaauguuuucaaauauauggggauuucaguauuuucaugggucauaccugugcugccagguguuuuggguuuguucuguugucugugguguuugaaugguaggggucuucauugugcugugguuguagggugcguucugugacugucagcuuagcuccuccuauccuuacugauugguugauuuuucagggcuguugaugcuuccacuuuugacuggggauuuuaguuucaucuugaaccuucugacugcucaauagacuguagacacuuauuuuuuuugccaacucuuacucaucuuuggaacuucacacauacucuuuuuuuccccaucuggauuauucuuguuuucacugcccuccaagagagcuauuuauuuaucuuuuuaguucugccuguauaucuguuucauguggaucuuucuugaccuuucagucaagcugaaucuguaucuuugcuacuuccugacccuccccucuuucauagagccaaucagaguaucuuccaaguuuguuagugcauuuuuuaaaaguuucuuuucauuuucauuggucuacagauucuuuaguggaagagccucuguuuuacucaggagagugcagccucaguguuucaguuuuuagcacagugccucacccccguggugaagggagugacuguugaguuaggucaggccgugguguggcuguaggugcuuuugucagcacuggagacuggucacagggcuuugugcaugccgggcagguggacugggacugaguguaggccgggucuauuacaggugcuuuacugcaguccuauauuugcuaagcuaauguuccuaaaaccugcaagacaaagguuguuauccuccuuuuagguaaugaugcugaggcuguaagagcagaaguaauuuccuaacaauuauaaagauccagaguccgaugguugcuugagucuaaauuccuguuauuuuaaugacacuguaucuucagcauguuuguggauuaaggauuucaagugauuaaaccagcaacagcagcaaccccaccccaguuccaagcucuucuguacugcugccuggguuuccccuaguuucuuggguaggguuacuucagggguggaugcgccagcaaaguggugcuuuuaaaagaauuucugcaucuccacuucaaguauuuuuuauuagaggcuuaguauuuggucagaaaagcaaagucuguaauuugcaaugagaagcuaugcaacagggaaaagaaaacccuguaauguaaaguuaaagcaaugccauuggacaugccuaagucagcagagcucagcuagcuggacagggacacacauuuccccagaucccaccucuuuauggggaaucaagacauagacuaagaagcuggucugaacuuauuuccugaaguccagucuagcagaugcagcagugggcccuaauaaucaaaaaagcucaguagaaugccagagagcacugcuacuaaauuuagucuguuuuuuuuuuuuuuuuuuccccauagaacucuuauaugucucaucuggcugcacuucuaauguagucuuaguuauaugguauaugacuuuucaucuucucucacaaguguuuucauauuauauuuuccauguaagcagauccuuuuuauuuuuauuuuauuuuuaaaagacaggguuuuagcagucuugguuuucacugaaucuguuuguagccaaggcugaguuugaauucuugguccuucugccuuuaucagagcuguguaccacuaucuccagcaugagccgaagucuaauauuuuaaacauuuauuuuuuuuuauuugugugugcuuuuauaaaguuguuaguaugauauguuagugaagaagucagaguuggucuuucuuccacuaugugggucucagggauugaacuuugguugccagguuuguggggcaaacaccaaacaucuuuaccugcugagccaucucuguggcucauaagcgucacuuugaaugaauuuuacaaauucaucagacaggugucuuaggguuucuguugcugugaugaagcacuucaacccaaaacaaggaaaggguuuauuuugcugacauuuacacaucacuguucaucaucaaaggaagucagggcaggaacucaaacagguaagaaaucuggaggcaggagcugcugcagagaccauggaggaggaguucucuuauagucuuacaacucaugacuugcucugccugcuguuuuauagcacacagaccaccagcccagaggucagcacccagaagucaaucaguaauuaauaaagugcccuucagccuuguuuacaucuuauggaggcaaugucucauugacguucccuucucaaagauaacucuaguuuagauuaaucugauauaaaaacuaggcaggacagcaaucaugaaugccaguuacauauuuuuagugagcaauaaucuugaaaucauccccagguacuaaaaauacuacaguaccaauugugugaguuuaacuuuuucuccauagaaggccacuaaggauugauugugaggaggggcauaccuagauuuagaaaccuaacuuaaguuucuuaucccauaucagauacuguuuuccaaaaugaguuuucauuuaccuuuuugcugcgacuuugagagcuuuccuggccguauguguuauuguguucuucaggugucaccugacuaaucauuaguaggacaaaacauuugaagguguuuauugagaacuguguuucucuuuugugcauuguguacauuucccuuguuccuucuguucuauugggaggaugagcuugguguuuuuaacuauuauuuguuuccacucgcauguaugucaucuaugccacuugaagaucuuuguuuucauguuggaauuguuguauuuuaaauauuuuuaguaguuugaaugauuuucccccuuagaucuguaagucauguagcguuuacguuaguguguguauggucuaaaaaccuaaguugcuugugagcuggcaucaccauguggggaugguccuuguuuugcacugugacccugugaugcugcaguguccaaggaugugugcauaggcuuuacagguuugcuuuccagacuugcacauugugaugggauggugagcagcaggcuccuguguaaugacagugagagaggaugacauagacucauuucaguggaaauugccuuguacauuuucacacauccauacuucucuacacgcaccuacccacccacccacaccauucccugacagugacacuaaggugacauauaagccugcucacagugucauacauccuauauaaucuggcuuaugcagaaagauguuuuugugcguguucuaauagugcugagucauggggugcacuguuagccguuuguuguuuaaggacaucacuaugggauuauuuaguucaguuuugugauuugaugcagcaccaguguuuguucuucagacggacuacuauggcuuugcauuguuacucacauugcugcuuccuccugagauuugcacuugagcauuagaauuuuuuccaguguaauaauguaguuaauaugcuuuaggcuggucuuuucucauauuuaauuguuuaauuaacccaagaguucuuuuuauuuaucuugagaggcagugccauauuuuuuaaauuuggaagcauuauuacuucaaaauuuucaagugauuuguuuauucaauuauguuagaaaaaauuccuguguauuguauaauacagaaggcuauggggaaguuuagugauauuagaacaagaaggccgaggcuacguuaggacagaugcugcguguucaggucauucugggcauuaacugggguauagaaauagaccuuauagacaagggacugggguauauacauagaccuuauagacaagggucugggguauagaaauagaccuuauagacaagggacugggguauauacauagacauacacauacauuuucuuuuaaaaauauugguagaaugccgcagacccucugggucccugggucugcguggaacgcgggugggcaaagcguggaugaaugacagacagacacacacacaggagaguuuguguggaaucugaauguaauuuuucaaaucgaacaucagacuuuuaugcagaagacaacaagguaguugggugacauacccgcaagguacaaaugagguaacuggaugcuuaaugacucuuacacagaacagaggaaaugaaaacgcaaagacuggcaggaacugggcaauaaaauaacugagacaaagucagcccuaucuaaggucagcuauagucucagaagccaggugugagaucuuuucacuccuagggcaagggcuuucacacccaagucaugguucuaacuagggagguccguucuagcuaaccaucucaugaauaaugcaauacucuaaaaccacagccugaucuacuuccuaaaccauuguaaauuccuguauauagguguaacucagcuauaauucuaaauaucuauucugguuucuccuacggucagaaacuucuuucuuccuuggugaugguaaauuccugugaagggcagugaccuaacuuuuacucaaagagauaguguaauaccaggggcaguaccgaauuccaagcccaaggucuugcuaaggacgaacuaggacuguuggaacacuggcggacggcuuuagcuaugucagaauucaaucuuaaaaggcacuuaugauaggaaaauauugaaagagagcacguggauccauacacuagacuaacaggggaauggaacucgggaaugaaaaauuacuguauggguagggaacgcuagacuccaggaggagagcuucguugaaacucuuuugccucaugagugacuuuuaagccucucggcuuguccaguugacucgaccagagagcguagcaguagaacauauguuuguguuccuuuuuuauuagauuuucuuuauuuauauuucaaauguuauucccuuuccuaguuuccccuccaaaagccccccucugcuccccuugcuuaccaacccacccacucccucuuccuggcccugacaguccccuaaacuggggcauauuaccuucccaggaccaagggccucuccucccauugauugccaacuaggccauccucugcuacauauucagcuggagccaugauuccuaccauguguuuucuuugguugaugguuuagucccagggaacucuggggguacuaguuaguucauauuguuguuccucuuauggggcugcaaaccucuucagguccauggguacuuucucuaguuccuucauuggggacccugugcucuauccaauggauggcugugagcauccacuucuauauuagucaggcacuggcagagccucucaggagacagcuauaucgagcuucggacagcaggcuuuuauuggcauccacaauagugucugguuuuggugguuguauaugggauguggucccagguggggcagucucuggauggucauuccuucagucucugcuucauacuuugucucuguaacuccuuccauggguauuuuguucccccuucuaagaaggaccaaaguauccacacuuuggucuuccuucuugaguuucauguguuuugugaauuguaucuuggguauuccgagcuucugggcuaauauccacuuaucagugagugcauaucauguguguucuuuugugauuggguuaccucacucaggaugauauccuccaaauccauccauuugucugagaauuucauaaauucauuguuuuuaauugcugaguaguaccccaguguguaaauguaccacauuuucuguauccauuccucuguugaaggacaucuggguucuuuccagcuuuuggcuauuauaaauaaggcugcuaugaacauaguggagcauguguccuuauuaccaguuggaacaucuucuggguauaugaccaggagagguauugcuggauccuccgguaguacuauguccaauuuucugaggaacugccaaacugacuuccagagugguuguaccagcuugcaaucccaccggcaauggagaaguguuccucuuccaacacauccucgccugcaucuguuguuaccugaguuuuugaucuuagccauauugacugguaugagguggaaucucaggguuguuuugauuugcauuucccugaugacuaaggaaguugaacauuuuuuuuuaaggugcuuuucagccauuugguauuccucaguugagaauccuuuguuuagcucugaaccccauuuguuaauaggguuauuugacguucuggagucuaacuucuugaguucuuuauauauauuggauauuagccuucuaucgaaugcaggauugauaaagaucuuuucccgaucuguugguugccuuuuuguccuagugacaguguccuuugacuuacagaagcuuugcaauuuuaugaggucccauuugucuauuguugaucuuagagcauaaaccauugguguucuguucaggaauuuuuuccacugugcccauauguucgaggcucuucuccacuuuuuccucuauaaguuucagugucucugguuuuauguggagguccuugauccacuuagacuugagcuuuguacaaggagauaagaaugggucagagaucuguuugccucugccuccugagugcugggauuaaaggugugcaucacagcacccgacuuagcguaaacacucacucuguguuuuaucccacuucugcgcugcccacccagggaugcugcaucagaguggacugagagccuuaugagcauccauugugcacuuuucacagcucugaaaguuggacauuuggaggucagggugacagcauuguuaggugugcucaguaccugcuucugggcugcagaauaacaucucauuuuuuuccucauguggaaaaggagcgagagcuuucucaugagaaguauagcuccuagagucugaucaacaugagaauuucauuguaaggaauuugagggugagaguuuauguagucuauaacaaauaaucuuuagugcaacaucucuuauagaauccuuauaacauguaauacuguaaagguuaguuuaaaacuaauuaaaaucuauccaaaauauauuuuuuccacuaaacugcuaaaauuuugcucauaucauguuuuccuaggaucauaucuagucugucauuugaaauguuuucuauauccucuuauuacuaaauguauuuggcauauucuacaucuuaguauuucuugugaaugaauuuuucaauuuugguauuuuccaaguaucaaggggauauacuauauugccuuuuuucuagagauugcuugcacuucauagaauaagacuucugaacauggacaaauuguacauggcaguugacauagucuaagaugaagcagcaaagacuguuuauugggaacacuacugauuuuuucuucaaauauggaaaacaauacuuucuacuuuaagcuuauuccauccaaaaaucuuuucuaucacaggaguuauuucuccugugaacagagcauggguugccuaaaagucuggguagcauugcuuguucuguugcagaggcucugcuguugaguggcaggugaucucauaggaggcagcggugugcauugugguacugggaaagggguaacaucuguuucagggccuuugguaaccugagaagcaagaugaagagaggaacauuuuuagcuaaagauaaauugacacugcuuacccauuuuccucacuaaagucugugaaguccauucuacugccugucucacaguagcucugaaagcagucucuccuuccucaucuacaaaccuuugguauuccuuugauacuauucuauucuguaaacuuuucuucuaguaacaaccuccucccccaguuaaccucauuagagaguuacacuuaaauuuaucagcuaccuaauaauacagagaccagaagcaccuucaaugaguucgucucccaaauaggcaucaaacuuuugcccacaguauaguuugagugucuguuagauugcuaacaaguguauuugaaaguaauauagauaaccauaguucccccucuccuauugaauagcucuguggauccugggaaaggagaagcacuuccucucauacaugggaaugcugaauuguacacgcacaucaugucaguuagaugccacaaauauuagcauugugagucgugucuauuacuucagccuacuugggaaagcacagcugauacucacagaaaugaacgugguaguguuuagggagcaaaggggccucacacaggggcuagugaagauggucaaggccaggagagcagugaggguggaaugguuaagaagagcccagugaggaccugaagcaccucacagauuuaaggggcuccaccauaacucaccugauaaucuauagaaggauuaagucaucuaaauuugggccuuaaaucuuuggaugaagcuuaaaaauucuucaguuuuggucuaggaguuaaugucggauauuuauuauuguuaggugaguucuaaacucuuuuucugucccuuucauuacuuuuauuuauuuguuuauuuuguauguguguguugaaagagaagcagagagauagacagacagggagaauugacagagagagacagagagacagucagacagacagacagacagggacagauacucacuucuguggagguuaggagcuuuaaggagucacuucugacuuucuaccauguggguucugaggacuugguccuaggguuguuaggcuugguggccggcgccucuccuuguugagcuguuucacuuggccuguucucuuguuacaaaugcagccaaaugaaggcuggacgugccauucauuucuacugcugaaugaguuuaucuacaagaaggaauuagaaugaguuuguguaaaaauguguuuuagguuuuguuauuguuuuuguauagguugaguggaguuucuggaagaugagaaucuugcuuuaaaugauugcuuucuucaguaguucugauguggaaaaggaaggacuguuccagucugaggggguaaaacagaagucagggaucgcuuguagaaacuuugaaggacagccaguacagagaccguuagucucuucaaaaccauggaaaaguuacaguuuuauuaaaaccacaguaaauucaguucauaacccucaguguaaauggugaccaaaugugcacuggaggugaggcugcgccuaagcgaggccugugacggaucugcugugguggucuuguaacuauggaggaaaggaguauccucuaauguucauucaauucagaagaacacuagcagccucuggagaauguguggcauuugggaucuugaacagaguguaggaauuuggaaguaauugguauagccuggagccuuucuuggcauuuguuagcaaauuuugggggaaaaggaguuuuguuuccagauguguuacaugggagcuuuucucaggagcugcuggaaggacaauaggggaaacgagaaccugauguuuccuugccuuccucacaugcaggagggggcuggccuaucuccagccuggcagacauuccguguaagagaugacugacggcugugugcugcagugcugucagucagggauggacauauauuugacuguggacuugcaggcagauaagagacuauuucaguuucguuugaaauuuuauaagugagcaaaugucaaacaaccuugagauuccuuuuauguuucuuuuuauuuaaaagaaaaauaauucuucuauccacucuugaguacugaggaggagguacacacugcuagaccaccagacucuugucacugaucaggacgggaggguggauucuguccaagagacugugugaccuuguaacauggaaugccuguggguucccagccaggcuucccugacacuccuuuccuggagagagagagagagagagagagagagagagagagagagaaccuucucucugcccccaugcagccuuuacagacacugugggagcacacuuugguuacuacuaaaggacgacgagugguucacucucuugcuuguccucuucuggcgcaucucuuuucaaccuuguucuggagauuugauguuccggguacucuuauaucacgcguuucuuacucucagugacaccacagagaaggccucaguucucagcacagacccagcagcacagugcucagcuguuuccaguggaaacaaggugaagugugcauuguuuugcaugguauuuggcagucaaaagcuugucuuacuagguugccccuuuccuagcccuuggcuugggaggagucuuuuccuauaacuuguuauuuuuuuccugccuguuugccccuuuuucaucugcucuuggguacaagaggcaaaaacaaacaaacaaacaaacaaaaaacccaaaacagccauaaaguuaaaaaaggagguccuuacugucauguuuuuugguuuuccacagccuuagcccuccuggauuuaucucuacccuccagaaccuucuaucugauuuauauauaauggguaggauuuuaacucugcuuaguuggaggaacagggaaaacuucauuuuauauuauuuaacuauuuaaaaacuacaugcuaaucccagcacucaggaggcagaggcagaggcagaggcagguggauuucugaguucaaggccagccugguuuacaaagugaguuccaggacagccaaggcuauacagagaaacccugucucaaaaaaaaccccaaccaaccaaccaaccaaccacccccccaaacaaacaaacaaacaaacaaacaaacaaacaaacaacaaaacuacaugguauguaugugccuucucacuugguccugguguggguauuaucagcuacauuuaaagucagguucagauacuaaacauuuaagaacagacacaggaucagaaaccuagcaagguuuugccaggcuuuccucugaguuguucuaaucuguagucaaccuuuucucugcaucaguagagucuuaguaggggcuucuaguuggaacuuauuuuuucauaguguugucuugacucugaaaugacauuuuaaauucuuggaugagugguuggacucugguuauucuuucaccuuuggcuaguugugcaauaugauuuaaguguuuagaacucugccugugaucuguuccugggucucuccacauugcuucugcagauuggcucagucuguguuugggaaaagaagcaugcuggcccucacugagaaggaaaguuggaaggaccaaaagaugucuauggaagggacugggauggacagaagugucuuccugcugugucaccuucaauuuccuguuuugucuuccugauaucaguguuguguggcguggcgcucucguugucuugugcugcgcuccuguuuauagcugcugcgauccucuuccuuuucauugccguuuucaguuuccccaauuuuugugaaguuuuagugcuucaagguauucuguaaucuccuugguucugggaaauuugguggugauuuuuauuucccuaaaacccuaccccccaaaauuuagaagugcuuuguuccauuuuuaaugucuaaacucuguuguuggacauuguuuuuguuucuacuuaaaauuuucugcuugaagaaacaccaacauuuuuaggauuucagcuacuuccugugucucaccuaguccucagugguuuccugcucuguccaauuccacucccucauugauugccagugcaacugccuuucucaggcagcagcugcacugaguacagccauucacaccaaccacucagggacugccugucacuugcucucccgcacccuccagccugacucugcugcugccucugcauagcugacaagcagcuguugaggaaucacugcuuucuguugaacuuuuuauauguguugaccuauuuaguuccuauagcaugucuuucaguggcuuacugcuguuuuuucugcuuuauucaugaagaacuggaagcacuaagaaauuauauggcccaacuucccauagcuagaucauggaacugccuguuaaguuuugaccgucuguggaagauauuuagaaauuugucucuaugcaucucuacuuuagacacccuaguuuaaauacugcauuuccagggugggcugacagccuccuggcccucuugcuuuucuuuuaaguagucacuggaguaacagugcuaaaggacaccuuuucuucucucaguaacaguaacaguaacuuccaagcaccuagaacuaacaucccagcuaguuauaacucugccaagggugucuguugcucaguucaugccuggccuucagguuuccagugucugugagcucagugcuuucugaagucauucacucuagaagcugcucuguggacacuuucccaaguuccuaucuuguauucuuuucccucccucccucccucccucccucccucuccuccuuuuuaaaauuuuauuuagagggugggagcaacaaugcuagaaguugagcccaaucagcucacacaugccaggcaagugcuuucccacuggacuauauuuuuagcauuuuaucuuuaaaaacaucucuugggaauguuuagccuauguuuuuugaugauucuuuuuauuuuguaaagacaacaacuuuuucuguugcucuuuuguuaauuuccuaccucugcaucacaucaagacuuuuuuuuuuugguguggucuaguaacacuccuaauguguccugccaaauucugugcuuuccaacucuuugaguuuguuugaauaguauguacuucauuguuuuagccucuguauuuuguuguuuuugacauugaggucccccccauucuacacuuuauguauuauuacacaagugugauccucugauguucuaaguacuucacauugacuauuaaucccagugauuucuuuauuauauugagccggauaggagaaauguuuagauuaacucauguucuacuuuucucuuugaugcuguaauaaaacauuaaccaaaacuaguuuggagguugaaaaaauuuacaugguauauacuuccaaguugggaagacagagcagaaacucaaggcaggaaccuugaaacaggaacugaagcagaaaccauagaggaaugcugcucacuggcuugcucuccuggcuuaucuuacuuuauuaugaaacccaggacuaucugaccgcaguaaucuggacccucccacucaauuaagaaaacauccuauagauuugccuacaggucagucaguugaaauuuugucuucccaggugauucuauuuuauagcaguucacgagaaauaacugugauaucuaaauuuauagauuaaaaaaugcuuuuagcagcucuuugagugaauauguagauuuuuaccauaucaguccauuuuuauuuacuaucauuuccguuuucauucaucguggaauuuguugacauuauacauaucagagaggaugaguaaguuccagcagcuugcuagcacuggcgugugaacaguuguguagguacacagugaggaccacaucaagaccacuguucaacccugagacuaaggaguauugauguaaaguauuggugugaacuguuccuuguauacauccauaccugugauaaaauguauuguaaaguaaguacagaagcugggucugcugcuacauagcuugcagucccagcacuugggaggcaaaguggggaggacugcuguaaguugaggccacccugagcuacuuaaugaguacuagacugugagucucccuuuuccccgggguuguuggccaccagcucacacagacgaaggcuggcccguguguaugaucagaaaugaugacacagucugggaucagcuuuguggagagagaucaaauuuaaucgggaugagucaagggucauaugguuuugggguagcagcuaagguaccgagaugccucauuagcauggggaggcaucuacaugacauucugcagauagaggggauggggguuuccugagcuccauagacaaggucagagaaggaaaagcccugcugguaaagggaguccaccauuuugcaccgaguccaggguaauuucagaucuugaccuuaaauuagcagagcaacacuagacuagccagggcuaaacaacaaccaagacuuagucuuacaagaacuaaagauaaguaaaugagcaacugaauaagacaaacagcaacaacaauaucauauuagaauaaccauaacaccuuuucuauaagaguuacuaugugagugaggccuaucuaugacaugauuggauagaguguguguaucaaggcaugaccuguaaugauguccuugcccuuacacaucuguuggccauagcuccugcaauuguccuugacauuuugcaaugcaauuccaugucauuuuucuuccuccugauuuaaugaugaagauuuacuucuaucauagauuuuggcaaauucacaucuauuuuuuucccuuuuaauacauugagaauuuucaucuuucagcuuaaugaugaugguuauguugcagcacagaucgaaauuaugggcacugauggcagagucggcagcugugaaaguggaaaugcuuguuaaaccuccaggaagaaugaggacacaacugcccucuguuuauuuaacagacucuggcggaggccuaggcucggaggccuaggcucgcuuuuuacccagaguuacauuugcacauuuccugcucauugcucacaccucacuuucguuuucuaaaguaaaacuauauuacuuuuuuauaaaugcuaaaagguacaaugaacaaauguacaugaucccauaucacucagaaugagaugauuaacaguuuaauaauuauugccacuuuuauucaagaugauguguaaauucacaauuuauuaaaaacaacagcaccaucaguacagagggacuguuagaaguaguuuaauauuuguauuuuuucauuuauucuaauacuuaauacauucaaauaaauaacauacguaaaagauaaaacaagaaaugaaauuagucuuugccuugcuguccagauagacaucaguagcuguaagcccuucuccuuugcuucaucuucaucaugucccugcuuccucccucaccccugggagaugaccaggagaccacaccccugggagaugaccaggagaccacacucugcauuaaacuucuugaagaaagacuuauuauuuuuuuuuuugauguaucuggguuuuugcucuguguguguguaccacaaugugggcagugcugccccuugguaguuggaucuggguaguauaagaaauuaaauuaaauuaauugguagcaagccaguaagcaacauugguuuguaguuucugcuucaugauucugcauugcgguccugccaagggauuucuuugauaguggaugguaacguauaagcuaaaaaacaaaacaaaacaaaacaaaacaaaacacccccuuuucuaaccacguuguuuuuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccaccuauaggguugcaguucccuuuagcuccuuggguaauuucucuagcuccuccauugggagcccugugauccauccauuagcugacugugagcauccacuucuguguuugcuaggccccggcauagucucagaagagacagcuacaucuggguccuuucgauaaaaucuuguuaguguaugcaauggugucagcguuuggaugcugauucugggguggaucccuggauauggcagucucuacaugguccauccuuucaucucagcuccaaacuuugucucuguaacuccuuccauggguguuuuguucccaauucuaaggaggggcauaguguccacacuucagucuucauucuucuugaguuucaugaguuuagcaaauuguaucuuauaucuuggguauccuagguuuggaccacguuguuuuuaauggguguuuuaucauagcaauagaaaccuaacuaggacauuuaucuuuguacuuuuugagccauuuucucaauuucugacaccauuaaauacuccaagcaugacuguugguuuaccugucccagccuaggaaacagccauuuucuauccuacauggcaguggagucuauauaguacugaaaaauauucagaacccaagaucuggcuggcgggagugcucauuacuccuuacugcuucuaggcccucucucugagcagagugagguuugucucccguuaaacauucauuuccuaauguuauugugauaguaucagauuuuuaaaagauuacuguuuacauugucauucuuaauacuuauuugugccuaugaugacuuugagcagagaugagguuaaauguagcaggaagagauggaaaacuaaagaauuaagacuucuuuuaauuauucgggccagugauuucugauuccugucucugccaucuugccauccuguuugauucuuuucuuugcugaaaaugaaaauaaucacuauugguagccuagaaaauaaguugaauuaaugcagaaugugaacaucugagguaccuuucuuuugcucuuggauuaaucccacuuauggccuuuagagggcaguacaugcauugcaaauaagguuuugugguuuuaguuuucagaugaagguuuuuguuuuuguuuuuguaauuguuuuaucuaauuacaaauaaggcgaaauggguuaugcguucuuagauauauucaauauagguuauaaguaucaagauugcuaucuucagugauguuggguuaagauaaaauauaguuaugaaacuaaaauccauuuaauaacuuucccucaguuuuuuucugagaaccgaagaguagaaauuuacuugcuuguguauuuucaugcugacugguugauugagaaguauuggggagugaacugaaggccuugcaggugccaggcaagagcucuaacacuacagauauagccauagccccuggaugguuucuguuagaagauaugaacuagcuagccuucccgagagucguuuacuugggguaugauacacuccauaccuuacugucuuagccuggaugcuacagaagugcuuuucuuacucagcaaacaaaaggagaacaacauuucuucuuauccuggauguucucugaccuuaaaaugcaagaaagggagguuguuugacgcacauuguuuuugacauguguuguuaugauacauucauuuuagcaaaaauuuauaaaaugcuuuuucuuuagauuaagaggacaguuaagcaaguaagaaugggcagagaugugucuggaaguugugacaucuccagaguguuuagugcuccuuuguguaaauuggggagucuuaacuguaaccuuuacaaguagugcuuuacuuucagauuuuaugggauucauuggugaauaaaagaugcuugaauuuuauguuuauuauugaauaauuaaguaagagagcuuucuguuuuaauggucugucucagaaaugagagggguacgugaauuaacaauugauucugaauaauuuaugcaaagguggccuuuguaggaaauguauuaacuagggaugccuacccaggauuguuuuaaaguauuucuuucacuuuuugguacacaccuguaguccuggcacuugggaagcugaggcugaaggaacaacuugauccugguacuuugaaaucaagcuagacaacacaguaaaaucuaucauaucuauucucaacacacaggcacacaggcacacaggcacacacacacacacacacacacacacacacacacacacacacacacauacucuacacccuagaucucccccaaugcacauuccagaauucaguaauuuuaauguaggauggcagucgaucuuuauaugcuaauuuauuuuucucuaauguggugaaaguaacaaaaguaucuccauaacagauaggcuuagacuuaagucaaauaaugcaguuuacucugccaggcgcauggagcccaggcauaguugucuucauugucaucgcgguggaauucuguuuuugcaguguucugaaggacucugaaggauucaaugauuucccuaauuuuaagagagaggaaaaacauuuuuguaagugucuuugaggauuugaaaccagaguuuagucacaguuuguuauguuuuuguucguuuguuuguuuguuuuguuuuuagugguguugagacuaugaauaacaccagcuuucgggagaaccuccaggcucucugggauuuauuuuauugucaccaacuucggauuuuguguuacccuucuuccuaagaugguuaaagccaguaaaucauuugaggagucucagaagaucauugugacagcaguuuucaucagcgucaagugaccagggacuaaucaauaaaaguuuuuuuucccccuuggcacgguuaguaaucauuuagaaaugauuuugaugggauauauaagugaaaagcauucaaacagauuaggccugauacuaaaugagagagagugaguguugaaaauguggcauguggggagaccuugaaaaguuguuaacuugaggaagggaaauaucaauaucucuguggucuuuuaggaacaaaaaacaucuuuugcugagagccuagaguuugagccaaaauauaaagugaccuuggaggcuggcuggcucaccuuccaguuuccuagggagagucagucacugccucugccugaucauggccagcagagcauuuagcagugggaaguaaggaaaugauggccagagcgaggaaugacuguuguuucucagcagcagauaggcacacagcuccuggugaaaugauucagcaguuuagagcugagagcugagagaccuugguuaacacgcggggagucggggcccaggaggggccgcucugauggaauccuucuggggccacucuauucccuuugcucugaaucacaaauggcugcucuugccagugcucacucugaauccuacccucagagguccugugcuauuuggaagguuuuagacagcagcugguugaaaauguaggcgccucggugugggaagcggagagggcagcgguugcuucaucugccgcaucaguaugaaaggcaccuccgucgguuaaagcugcugagguuauucguuuccacuuucauuccuggacaaaaacaggccucuugucuggaucuuuucuuuuuaaugauuuccaugaaaaggcuuuuauccaggcucugacaugacugucagaauacacauuucaaugugagagugcuuaaaaggcuauugauauucccccguggaaaagaaaaguacuuaaaaaaaauccaucuauccuuauacaaguuaacccuaucaccuccuuucuuuucucuccuccccucucuuccuucucccccaccuucuuccucauucccuuucuuuucucauucucuuucagguuaaagccacagucuuagucugagccgugcaugucccccaucucccaugagcugucacuuugauacauugauggcucugaugaguuuagaaucgaggauacugaguaaggaggagauaagcuuacuuuuaccugauguuacuguugagcuuccgcaaacaggcuguugcuuuggaaucuuagguucauuucucuuuccucuggguguaucuuggcuaugugagcagaguaaauggucgguaucuuagaaaugcuagagacaacaggaguggcaugaagccuucaugaacugaagcaguuugccaugagcuuaugagguguuaguggggacucagguucaaguuagauugcuaugcuauguaaucaaaaggguucugaagcaaggaaggaauuugauaagguuuugauuaauuuauaggugugugaacauggcuugucagcuuaguagauuugcuauuguggugggaaaagguuguaucugcuaacuccucucucuucauugcuuucuuguucccuuaagugugaugguuuuacucaaggggaagagcacaagcagugacauccguggcagcaauggaaggaagcuuucaggaugagugacacuguuggccuuuguuucuccacugugguggugaugcuccugucacuccccacccuccccauuuaccuccagcuuucagcagaaucucggagugauggaggucaucagaacagcuuucucagauuccuuuuguuuuucucagccucccucccuguacucacucucccuuuccuauuucagaggaagaaauauguggcuugcuuaauguaauuaauagcuauaaacuuuaaaaacacuacucuuguucuagaauuuucuaaaaauuuaguucccuuaguuuuauucuucuugauuggccuuuagacuucuuccucaggccacacauagucuuauacuuuaaaauaaaaacaauagaaauuauuagcuuggauauauuuucuuauaugaaauuuuaccuucauuaaaaaauuaguuuuggaguucuuuaguucuuuacuauuaguaccuuuuguuaguacagguggucccaccagccugcuuucagggaccuagcaacugcuuacaucaucaucugcacaguuuccauaugugcucucuguucucuagucauacuuucuccugacuucccccaucuccugugugugugugugugugugugugugugugugugcgcacacgugugcaucucaaaucucagucuucagguauggugagcauaugcuggccuguugaguuacaugcagcccuuacuuaguguagugucuuacauuagugaggcauaguaguuauaacugguaguuaucaccaacuuaaguugauaauuucuguuagaauguaccuuguccaguauuggggguguggaucugcucagugccauauguccaucauuguagcacugugaagaauaguucacuuacugaaaucucguguucuuuacuugggcauacucauaaccucuaauaaccaguguauuuggccucuguugcuuugcuucuuccagauugucauauagugugaagcccuucacaguugccccgacucaacagugugcguguaugacuccucuguggcccccacucagcagugugcguguaugacuccucuguauuuguucuuguuuguuugucuuuauuuugaagaauaguuuauuucaugaauguucuguaguuugucauuuugguugcuucagaguuuuggcagaaaauauuagagggacuguagacauuugugcacaggaguuuuguauguauucauauuuccaaaucauuuuaguaaaagcuuaauagcugugucuuaggguuucauugcugugaagagacacuaugaccaugacaauucuuuauaaaggaaaacaguuuaauugaggcauacaguuuuaaugguguauuccauuaucauggcaggaaacauguuagcauucagauaguuauggugcuggagaaggaguugagaguucuacaucuugaucugcaagcagcauagucucacucugggcauagccugagcaucuaugaccucaaaucuuaccuccagugacacacuuccuccaacaaggccacaccuacaccaacaaggcuacaccuucuaauagugccccucacuagggccacacauucgaacauaugagucugugggggccuuacccacucaaaccacuacagcacaauuguugaguacacuugggccauauuuaacuuuguacaagcccgccagccuucucacagguggcuauauugagucauacgcauaccuacagugugccagcuccuuguacgacaucagcagcagcauuuuccugucaucacuggcuuuuuggauuucagucauaaagguuuggaauaccuccuuucuguuuuaacuagugauuccauuaugacucaugguucugccuucuuuucuucaguugccauuuaucuucucuuaugugauguuuguucaggucuuuuguccguuuuguaaggguacuguuccuuuguacuguuuuguucuacacccaggguguggguugucuuuuaauucucucaacagugucuuuuaaagaaaagauuucauugauuuuaauaaauuccaaucuagcacuuuuuucuuuuucucuuaaccuuuuuuuuucaugcuuuuugugguaguccuaaaaauguuacugaaucaaggcuacccagauuuucuauauuaucuuuuaaaauuugguuucauauauaggcuuggaauccauuuaaguugaucauuuuugugaaugacauuaaauuugcauauugauacauuuuauuguguagcugucuauuaauacuauugaaaucauucuacuuuuucuauugaacuaucuuaauuuuccuuucaaagauuagcugauuauauguauagagucugauuauagauuccugucugucuuucugucuguugaugaccccccaucccauauugacuugauuacuauagcuuuaguguaagcccuagagcugagcauccuucucuccucacuccugucucuuaccccuucuguauuucauugacuauuacaugccauuuuuucuuuucauggaagcguugagaucaacuugucauuguucacugaauaaacuuaaaauauaucuccauuuacauauauuuuucuugauaucuuucaugggaguuuuuauguuuuugucuuuuuucuuuuuugugauuggauauuuucuuuauuuacauuucaaauguuuucccuuuuucaagucucccauuuggaaaccccuaucccauccccacucccccugccucuaggagggugcuagggcaucaggcacccucaggcccaagggccucuccuucauggaaggcuuuuuucuuuuuuaagauuuauuuauuuuauauaugugaguacacuguagcugucuucagacacaccagaagagggcaucagaucccauuacauacgguugugagccaccacaugguugcugggaauugaacucaggaccucuggaagagcagucagugcuuuuaacugcugaggcaucucuccaggcucucaugggaguuuuguaucauugaucuuauaccucucuuuuagauuuguaacuaauuuguaauuaauuaauuaauugugucauguuuauguguaucaugugcuuacauuugugugugcauaagugugcacauggguauagaggagagagguugauguuuaguguucuucuugauugcuccucacuuuauuuauugagacagugccuuuugcugacauuagagcuugcugauuauaccagcuugcugcagcaagccuccccaccucccaguccuggaaauuacaggcugauuuucauguaggacuuuuauguagguguuggggauucaaacucugguucucauguuccuaugcuagcagguacuuaacccauuuagccauuucucuagccucuaacagaaaugacaacaaaccaaaacacuuuuguuuauucuuuggaaauuuuuacaugcuuauuggcuguauauguuuguucuuccucuguacuguuauauuuucucuguauacaugccugucugucacaacggcacauaguauauagucuucuggacuuuuacagugaguuucaaaaucaaguuguguagaaacuccugcuuuauucuugugcaaaauuguuuguuuguuuaacacaucuugcaucucuauacauuuuaaaaugaacuuuccaguuucugcagaaguguugcugggucucagguccucauguuuguacugcaagcauuccuaucuauggaauucucucuccagccccuaguuuuaauuuuuggagggauggguuugcuauauagucuaggauauucuuggauucuuccuggucagauuaagauuauucuuaaacucucuguccuccuguuucagcuuucuaagugcuagaauuacagggguguaccauaacaccugacuuauuaauccaaaggguuuuaaggcaugcugugccaggaucuaggaguaaaacacuauaauaaaagacaacacuguuacuucuaucauucaggaaguuacaagggauauaaaaauuuugugucagcugcuaaugaggaugaccaaguagguaggguuuuguuuguuugcuuguuuuuaaaaaucauaacauaguagcauuucaaaauuguguuuaggauccuuuuaaaaaucuaagauuaugguguauauucuugagaaaguagcauuuuaaguauauguuuugcaguucuuggaauugaauauaggcucuuacauaugcuauacuacugagauauauccccagcucucauguuuauuuuucugaggauugauucaacagaaggaugcuggagggcgcuaggucuuuaugaccaaccuagcaucagcccuucaugguccagacuuguccugcucguccuuucaguugcucuuaccucucucccaaaccagggcucugccaaauucauuccuguuugucauaacuugauuuuuuuguuuguuuuuuaguuuuuuuguuguuccaaaaagagacauuuagccacuccuuaucuugucaaauaagcuacaaaugaaaaaaggcagaaagaaaaagagaaaaagaaagucugucaacacacguccuuuuuucucaugcaucaggcauuuuugaaccuucccuggugaguuuucaccaucuucuaaauuuugucugguaccuuaaagauuacagauauuuuguuuauuuuugaaaucuaaauuauguagacauucuuuacaauuccuuaugcuuguauuugcuuaauuaaaauuugaucacauaauauauaaauuauauuuugauuuuuaaaaaguuaauauaauaaguauauucuccauacuauuucaagacaugaguuuuuaaauaaauugaauaauacuucuugauauuuauguuguauaaauuaauucuuaauuaggugacacuuaucauuccuacuuuuauuuacuacauuaugauaguucuagagucaaaauuauuuacaggcccuauucuguauacacuuaggaguguaaauuuggucauucuugguagucuagauacccgcugugauaauaaaauuaaguuuuaguuagaggaugaauagaagccuucaacauauuguacaacaccuggcuuuaaguuaaaacuggaaacagaagcuugugugccuguauaguuuuacaccuagcaagaagaaagcauauguccuucugaucuuagagagauuuuauaaguuucaaaugggucucuggccccaagccaugcuugcugucauauuuuauuaguuuaguccuuuucuuuguauggaaagccugcauuuuuguaacauuauuuuugaagaauauaacaccauucaaguggauauugcaaucaaugucuuaaaguuuugccugaguucaugcaaaggacucagaaagcaucacaacagaaaaugugcaguaagcagucaggcaaagaggacaguggcugcucuuuagcuguuuguaaucacuccagcuccugagaacacaauaaacgaauuugguuuucuuuuugaaacagguuuuacuaguguuuuuuuuuuuuuuuuuuccuuuuuuuucuuuuuuccuuucuugguaacagacaggcaauucaaacuggaaauuucagugacuuuauuuugauugaaccuuucagucuacccuuuaauuuuuaugagauauuugugucagcagccuuauucauucuuuuauaaguuagacuauuuguaaagccugauguuucagaucagccucauuguacuuuuuucuguucuuuucuccuaugguacucuuuaaaagacguagauacugcauauaggucccauguucucuaacacuuuuucugcuauuguucaucaaauuucaauuuuugugggaaauuuggaucagacauuuuauucacuuugguuauucuacuaggcuuuucauagguugacuaaauugcaaagauggcauugcauuuuccauggcugccuaaguuuuggggguaguagagauuugaucucugugucaugauguucuucuguccaagcgugugcuguccaugaguggauagggcucggggcggggggacguucaguguuaauggaggcuguugauaaaacaaggaaacacuggauugugagggacuuuuuggacaugacguguucugugucacuugguacuagguccucucacagagugaugucaugaaauaaaugagugauuuauuuuauuuuauguucacuauguucacggauguuuugccuuaauguaugucuaugugagugugucagauccccugaaacugaaguuacagacaggugugagcugccaugcaggugcuaggaauugaauccagguccucuggaagaacagucagugcucuuaacugcagagccaucucucuagagcuuauuuuaauuuuuuuuuuaaacaaauguauguagagucuuacuugacgccaugacucugcccccugcuguucaagcuccgccauuacauaugugcacuacuacauuucugccauuacauaugugcacugcuacacuugguuugaccuuuugacucuuugguagaaauucuuaaugugaucaaauucaaacuuugggauucucaucuuucacaguguuuucuuuuuuacuuaagcuguuucaggagguggagucaagccuagcauagcaguucacauuguuuucucauugguauuucuucagugcagguuggauauuauuagaaccuuucucuaaacacugugucuuagaaucuagauauaaguuuuauauuuucaucacuucucauauuuacaagcuauaauguuauccauguuauguguguguguguguguguguguauuuguagauuugauuuaucaguaacuuuuacaguggaagacuaagccaugauauaguuuucuccacagaaguugccuuuuauguauugaauucccuaucuuugauuucaguaguaacuuacauggccaauggcauauuccauaacuugguuggaauuccagcaucaugccacaaugucaagguaauucucaggauauacauguguccuagacuuucuagucagccacacuaaaggugcaugcuuucucuaccacaaagggguuuucaucaucauucccccuugucagagggcagcuuaguuauugcucuucacuuugauguggucuuugaauuuuuucucauuggacuuccuacagaagccuuuaugugaaacagaauguuuaaaucacgauauggcuuucuuucacaucauuuuuucauucaaugcuaugucuaguaagguauguagauauguuauaucauuuuuaaugugaauauaugaggaggggaagaggggagaggacauugcugguggcucauugcuccugcaacaacuuguuuucagacuucuuuucaguuugcuacagaaugcugcaugucacauucuacacauagagcuuauagucuugauuaaaugguccacgaugagaaaacaagugugauuauuuuguucucuagagaaacuguuuguuugcucugggaucugccuugaguuuuuauauuugacuuuuuugaaguuuaaugcuuaaguguggcgguuuuagcuuuauauuaccuguugaauaacaugggguuugguguccuugaaugugugguuugguguggggcaucagucuguggagacucagucacgccuuuccauugcucgugcuuucccuggucuccucuuccucugcuauuccucucauguggguuuuaucuuuuguuuuugccucccagaucuugauguuuucuuuuuggauauucggauauauauuaguuuuaaauuuuuuguucuucuaucucuggcucagagaucuuguucucugcuuguguacugucugcuaaggagcccaucaaaggcauucuuguuugccuugaguuuuugauuucuggcauuucugcuuugguuauuucuuagaauuuucuucugucugcuuacuuuagcuuuuuguucauguuuguuaugugcuuuucaguuaaagcucuuaacacggcaguuauagguuugaaauguuucaagccaucguuucuguuguauucaguucugggccugcugugcuucuucauucucuuugaacugcacuauagccuuguaauuuguuauuguaucaugccagaagauuuccuuaauuuuuaaguuagcauuacauuauuguuguuaucuaucauacuucuuuagugacuaucacugucaucuuuaucccuugguauuugcgguaucucugugauccugauaaacucuuucccacagcuccuucugcugguccuuacuuugaggagcugcagugcuguucgagaugaugucuuuuugcagcuuuuuuugguuuauauuuccgcagucauugucauauugauuauuuuucucacugaugugacauagugccugauaagaaccauucaaaaaagaaauuacucauuuuggcucuugguuuuagaguuuucucucuuuauugugggguugauguggaggagcagagaucuucacaacaugaugucuaggaagcaggaaaagaaaguauagggcuggcguuaggcuuguugguauuuagaaucugaggguaugccucaaugacuuuugguccucuagccaggcuucuuuuuuaccuucaucacauaauaaauuuaucuaggcauaaauccauucauuaggaaagagcacuuaggauuuaguccucuuuggaaauacugucagauacaccccuagauguuugcuguacuagucuuuuaaucaccucuuaauucaaucaagcuguuagucaagauuacccagcauaaguaaugauuucagcuucuuucacaugcuugcuuagagaaguuuuuauucaaguccuuuguucauuuuuauuauuuuguuguuguuguuguuguuguuguuguuguuguuguugucgucgagucacaggacuuucuuaaauugugguuguuaaucccuuugaggugcacagauuauaguuauguugccuacuuucugcauuaccuuugaauuccauuagugcuuucuuugauguuuagugacuaauuuuaaaguggauagugagcaccuuucguaauaaaaaaagaaaagugccaaggcauuauaaucauacuuuuuuucuccuauggauggacauccuuuguaaucaguguaaucuuaccaaaaauggcuuuagauaugacauaauagcacacuucugugcagaguccaugaaaguagcuuuuugugaucuugcaauaccuuuuucucucuuuugauuacuguucuauuuucccaucuuuuuguuugacuaugacguuggagaugccaaauuccagaugaaguucacugcuuugcaguccuuucauggaagaucuuucucugucucugugucucugccucucugucucugucugucugucugucugucugucugucucucucucuuucucucucuuucucucuugcaucaccuguccuuuaggcuuuagacucagaauaggcuaauaaucgcauuucaguguuuauuucuuugaaggaaugaggagucugauaugagauuuaucauccagcaauagaucuagagagucaggaauaaagguuagggcugaaaagagagccgaggagucaguguauggucuaguucuuggaggucuggguccuuaguuugucaggcuuucugaggaguuuuguggaaccagcuacugcagcaaccagucagggauaucuuuaccuguccugugugaggguugcuguuauuucuuauggaguuaggaaagcccugggguugacaguugaaugucuucugagucccugagguuguguucauuuucuucuggauuuguagcccagauuucugauaaagccagaaugagggaugaggcuuagggggucgguaguagugucuuguguguaugcauugugcuugcugcugauacugaugcagugcugggguucuaauguguugcagcagcaggugcuccagggacugcauccgagcagugcuagggagcucaugcuuccacaguccacaguggcguagguuccugucauuguuagaggaaggcagccaggguauuuuguuuuguuucaguucaaggucuuucauuugcacuuguucaaucuugcugauacuacuagguauauuugauuguugguuguuacuagaugagacuauugcaagagaagcaaagcaaacaugcuuugguuauggaaucaguaaauuucaagguuuggaugagaaagauuucuuauaucacaaaaauuugaaaaaucccaaacccuguuccucccccccucccccauuacuacucagccuuugcacuccucaguuucugaggucguuugugaacucugaaccacuagaggucaguguugugucaauaaaugcaggugccuuuggguuuugcguguucuuuuuuuuuuuuaaaggcauuaggcauuuuuuuucuuguuauaaaucuuccucuuuuauuucuuuucaauuuuuauuauauauuuucuucauuuacauuucaaaugcuaucccaaaaguccccuauacucuccccccacccugcuccccuacccacccacuccuacuucuuggcccuggcguuccccuguacuggugcauauaaaguuugcaagaccaagugccucuccucccagugauggccgacuaggccaucuuaugcuacauaugcagcuagagauacgaggucugggaguacugguuaguucauauuauuguuccaccuauaggguugcaaaccccuucagcuccuugugugcuuucucuagcuucuccauuaggggcccuguguucaaucuuacagaugacugugagcauccacuucuguauuugccaggcauuggcauagccucacaagagagagucuuccuuuugaacucugaaucuuacugcaaggugucuuggagcugagaggugcauuccacaagaagccuuugcuuaauggugugcguaggaugcuucauagguaccgacacuugacaguggcaguucacauuagguaaugcuauggcuaugugcaacccccugccucuuucugguagguuauccuguaauuuuaggggccagaucacauucucauacagacuccauuugucaucugcugcauucauguagaaacuuguaucucacuuguucucucucucucucucucucucucucucucucucucucuguguguguguguguguuaggugucuggaaugaggcuuccugcagugggaaagaauuucuuuuuuucaauuugagagaaucauuguuuaguguuuuuuuaaaauauuuuuuuauuaguauuuuccucaauuacauuuccaaugcuaucccaaaagucccccauacccuccccccccacuucccuagacccauucccauuuuuuguuuguuuaguguuuuuaugccauuuuuaccuguguauccagcagguucaugguaucaccuuaaugauucuucauuuagcccauaauuuucauggucucuguucugaagguagcuucacugucuagcuaucaagaccagaauacuuugaguuguucucauuucauuucuucucuaucauguucagcucgcaaauugacaaaucaguugucucccgugugcacuaguaccacacuugguucucaucauuauuugaguuguuacaaugaucuguuacuuuuccugcuuuuaguauauuugaccagaguugacuacucuguguuacaaagcugacacugcugggcuugguggcgcacuugggaggcagaggcaggagaauuucugaguucgaggccagccuggucuacaaagugaguuccaggacagccagggcuacacagagaaacccugucucaaaaaaaccaaaacaaaaaacaaacaaacaaaaaaccaccucccccccaaaaaaagcugacccuauaauucucacuuugguguucugaaagaaaguagaaaaagaagggaacaagcagccacuuugcaauugaaaaucugcuuuuuggaauaggaaggcguggagaucccaauuccugaguccuugguguguggucuguaguaggugcagugcugucucacugagagguguagaaagaaugcuguacuuaaccugagaucaugaaugcucgccuuuuguauagaccugaauuguuugugaaugcuugcucuaguuuaguuuguuacugaaggcauggauuugauguaagugaacccagaaugucaauggauaauaugcagagaaacaaguuugugcauugauucaaaucucuggaauguagauucuuuuuuacuuuguuuugguugaaacuagcucacauaguucuaguuuuucuggccuguuauaguuguuucauuugaccagagucuuaacuaacuucuaauaugaagauuuaucuugaauuccuuaaucucauuuagauucagugacacuuauuuucucaugaacuaauuucagcuuggcauggaagagaaauauauugauuuauaagaagucaugagcuucaaaucuugcaccuuggcaugguacagaaagccuagguuuuauggagaaauguuucuggaauacuaugggcuuaaacagauuacgcaaguuguuguuguuauuguuguuucuucuuuuccuccuccuucuccucuuccuccuccucuucuucuuccuccuccucucccuccuucuccuuucuucuuccuccuccucucccuccuucuccuucuccuccuccucucccuccucuuccuccuccucuuccuuucuuucucucccucugccucucuuccuucuuccuuaccucccucccucucucucuaaucucucucucuaaucucucucucucucucucucucucucucucucucucucucucucucucucucucucucucccucucucucucucucccuccagguuucucaguguagaccugguuguccuggaacuugcuuuguagaccaggcuggccucaaucucacagagaucaguuugccccgaccuccaagugcugggaaaaaaggcaugugcuaccaccaucuggcuacccaaguuucuuaaagacaguaucauuaccuauuuuuucuuucucuuuuacauuuuuucaugugugugguauguauguauguauguauguauguaugcauguauguauguuuacuugugccuguggaggaucuuuauugauguuggguuuucuuugauuauuuuucauugcauuuauuggucagaguuucucacuugaaccuagagcuugcugccuuggcugaucucacuugcaauauugcuccaggaaucuccugucucugcuucucaaggauauacaaaaugcauugugucuguugauauggccacagaacccuuguuuuggaaaauauuugcccgguucuugggcuguugguauagugaaggaugacugucuguaccuuaagagaucauccuucgagcuucuucuuacuacucacugguguugugacuuggagcaaacccuuugcaauacaaauuuucugagaguggcuaaguugacuuguagcugcacuuggugguuagagauuuuauuguugacacuggauuggguauucucuuaauuaauuuugcuagguagguguauuuuaaauuuuaaagaguaaguccuuuaaaaucccuuucaauaggcuaccuuugcuaguccagaauacuuccugagaaaauauauuuucagauaauuuauuaucuugauuauauuuauuggauucauauucaaaaacuccuauacuuaaaguuaucacaguuaauuccaagugauugucuaucuucuaucauuuuuauuucaauauuucuuuucuuuguaagagaaaacugcuagacauuuguaccaugcccuugguacaugcaugguaggugaauaugggauggguagaguuauuacugguugcuuagcaaauacuuaaaaugacccaugauaauaucauugaauuaucuuuuuucugcaaugacuuugaaaagagcuaauacaggaaggcuucagggcaaaggaguguauguuaaccugaauuugcggguguagaccaggaaucccaauacugggaagugacgcuaggaggauuaggguucaaggcauuccuccaugccauagcaaaugugaagccaguucgggcuacauaagacuccauuucagacaacauguaugcauuacuguguuuaauuuuacucaggucuaaaaauguauacaugagacuaugccagggccuagcaaacacagaaguggaugaucacagucagcuauuggaugggucacacggcccccaauggaggagcuagagaaaguacccaaggagcuaaagggaucugcaacccuauagauggaacaacaauaugaacuaaccaguacccgggagcucuugucuuuagcugcauauguaucaaaagauggccuagucggccaucacugcaaagagaggcccauuggacuugcaaacuuuauaugccccaguacaggggaacgcaagggccaaaaagggggaguggguggguaggggauuggggggauggguaugggggacuuuugggauagcauugaaaauguaaacgaggaaaauaccuaauuaaaaaaaacugagaaaaaaagaaaggaaaaaaagaaaucuuucuuucccuacaauuacaguuacugauuugcuuaaaauuaguuuauuggaaacuuggggaucuuuucuucuauuuuucauuauuuucuguauuuucuuuauauucuaggcccaacagcaaagaaaccuggauaacauugucuugcaacagccuagaauagguagcaaaaggaaaucuaagaaagauguuuauacaaucuuugaugcagagguggagagcacaaguccaaagucggaacaggauucgggaauucuggauguggaagacgaggaagaugaugaagagguaagaaauauuuaaguuggugaaaugaggcaaguuuuugauguuugaaauaugcuuauucacuuaauagcuaugugauuuucagaacauuaugugguguuaaaguuuauuuaucccugauuuaaagaaauugaagcugcacaaagguaauuuauauuaaaaauuuuaaaaaucccuauuuuugauuccuacugauaggauacuccauccagggauggaaagggguguuggccugacucagggcccagggaguaagcagauuucucugagucugaggcggucucuugagaucaacaaaagauaguacuuacuuuucuuuucuuuuucuccuucccucuauucauuguagaaauugauagcauucuuuauggcauuuuccuaggagcguauucaguauguuuucuauacuuuguucaugcucagccucucauuuuugucuuuugucccuaacucccuucauuggugccuucuuccucaaagguccccugauaauuuugaucuuaccuauguguauguuuuaaagucugaaugcuacagaugacagaaaacauuuauuuuuuucuaaaguuaguuuuauuuugcuuaacaugauaaucuuauuuaugagcgccacauuuuugguuuaaaauuuuuuauauuuacauaagauauagucaacaaaugacaguuuuugucuuguuuucauuacuuuucguugacagcuucauuguggaauuaucauuauuccuuauaggcuuaagagaaucaaguuggccuguuuaauuguuuuggaugaaaaaugcauagucaagucaucuauaaaauaauagcauugaaguuuuuucuuaaugacuuagggaccaucaugaguaaaaguacuuuuacauuauuuuucauauuuaacugauuguagucaucacuuuuacuuaaaauguauacucuguuaggguauguuuaucauguaaacaguuacaccaauaacggaacuguuugaaagcaacaaggcuugguggcaaagaugagauuucugcuacuaggaugauugaaguaggaggaucucaaagucagggcuucuuuuuugugugugcagaguuaguuccaggccauuuuggaaagcuuagugaggcccugucugaguagagcaggcuggcauaauagcugcacggcagugcuuacagacuaugcaugaggugcucaaucccgagaaugccaaagaagcuuaaguuucacucauaucucuguuguacauagauagcaaggugucuuaguaaguauaccguugcaauaaaguuuauucaguguuuguuuugagauuauaauguaauuacaacauauuuuucuuuucuuccuucccuucaaaccugcucauauguuccuccauguucucuuucaaaaucguguccucuuuuuucucuaauuguuauuguaggaccugcucagucuguauuauguuacuuguauacauguuuucaaaguugaccauuugacccuggacuucugguuugugugcucuucccugguaaagaccaccucuuucccgccucgcuuuccucuguugcuguaguucuugguguaggguugaggcuucaugggcuuugcuguguucacugguuuucuccuccuucagaucauauucggguugucauguuggugagacuucaccgguacaacuucugauguuaguaggagacaaucucacaacaaaaucccggauccucuuucucuuacagucucucauacccauccuccuuaaauguucucugagccuuagguguggcaguuuuuguagauguauccacugggacugggcuucacaacuuuggauuuugauaguugugguuuucuguauuguuuucagucuguuacaaagagaaguuuccuugaugagggaugaagacuacacuuaccuagggauaaauggccagauauuuacagauuaugcuaguuuaacaaaaauacugguuguauauuuucuuccaauaaccaugacuucauuagcacuguguaguuaucaagauuucuaguacuaguugugguuuccuucuuguuaaguggggcuuaagucuaauuagagaguuguuggcuacugcucaaggccaacaaaagagcuguugguuaccaucuagguauguaugccacuacugcauccuucagguaaucagucauaccaugcuguuagaugaugugguucauagguaucagaauuggguaggacuguuaauugccucccuccuuugaaagcuugcauggugccuucugguaccauggcuacuuacucccuagagagacauucaguuuaguuacagcuuagagaucucugcaccuuguuucugaggugcauggcaucuucagcaauagagguuuacuuucuaccucuugguggcaaccaaggguagcagugaauaugacugaacaagaaucuguggaguccgaugucaaguucuuuggcuauauaccaaggaguuguuauauugcuaggucacaugguagauucauuucuuuaaaaaauaccuuuauuucuauuguaugaauauuuugccuucauguauaucuguuugccauguguaugccuggguccuuuguaggucagaaaagggcaucagauccccuugaacuggaguuaucggcagcugugagcugccauguucagcugggaacugaauucaggucuuuugaaagaguuaguagugcucuuaaccacugagaugucucuccagcuccuagcuuauuuuuauuucuuuugagaaaucuccauaccuguuuccauaguggauguaccaguuugcagucccaccaagaguaauaaggauguccuuucucccauaucccuucuagaauuugaugucaguuauuuuguugaucuuugccauucuggcacggauaagaagaaaucucaaaguuguuuuuguuuguauuucccuaauuacaagggauaaugaacauuuuuuuuuuuuucgagacaggguuucucuguauagcccuggcuguccuggaacucacuuuguagaccaggcuggccuugagcucagaaaucugcuuagccauuuauuuuuuucuucuuuugagaacucccuguucaggugccaaggccauuuuucuaaugggucuuuuuuuguuuuuuguuuuuuuauuuguuuuugacucuguuuucugacuucuuuuucuguucuggauauuaaucguuuguuaguuggagagcugguagagauacucugcauucuauagaauucuucuucaccccguugauuauuccuuuagcuguguggaagcuuuuuagcuuuaugaagucuuacuuuucaauuguugaccuuaauuuuuggacaaauggaguucuaguaagaguguccucuccuacacuuuuaucauguagggcacuguguauguuuucuucuagcaguucuaguguuccauguuucauguuuacaucuuugaucaguuuggaauuaguuuuugugcaaggcgauagauacagguauaugaguguaacuucauuguucugccugaagacauuuccagcacuguuugcugaaguugcuuucuuuucuucagaguauguguuaggugucuuugucaaauacuaagugguugagguuacauggacucuuguuugggucuuagauuuuauuugauuaguguguauaugucugguuuuauucugguaccagaauguucuuauuauuauggcucuguaauguguuuuaacacuaacauuguaauucccacagcauuguucuuucuuugaauuguucugacuacuaggguuuuuuugugguuugcaugaauuuuaggauaguuuuuuugcuauuucugugaggaaugagaggaggauuuugauuggaauugcaaugaaucuguaaauaacuuuugguagaauggucauuucuuucuaauaucugggcuacuuagguagugagaaaucuuacuagguaucuaccuacuucccauugcaaaaaguuuuuugagugcuauuuagugggucauuuaaaaagacuuuaccacuuaccugauaagauugaacguguuagaguggacuugauccucuaaaacuuacuagccuuuucuucuguugcaugcaguaucuuuuugugaggguguagauccacacuggacauagaaacagcuaucagacucuucacaaaugcgcaggaauccagcauacugcccucucaaggaagaugaauuaggcugaagaggugguucagugauguaaagugcuugcuguuuuugcagaggccaagaauuugcuucccagcacccacauucaguagucggggugugggugugggaugaggagcauguuacagcugacucuaacuucagcaugcacacacauggggauaaaguugagguaauccuuuuuaauauuuugcauguccaaaacauuuggauguuuaauguuuaauggagugaaguuugcacugugguuuauggaaacagaagcuagucacagucuaaacccuuagagaauauauacccaaaauacugacuggaggggaaaagcagaaaauaaaauauauacccaguucugauguaucaacugugguucuucuguguaggagucagucuucauuacuaauucccugacauucccaagguugucccuuugagucugugggccauguuccuuugcuuuauccagugagguucagagagaaugaaaacaguggaggaaaugaaauauauuggcaggagccucauaaaagaaguauuagaagaauguacuaagaagguaauauuuuaauugaccccacagcucagucagacaccaguccacauuagagaugugcugacugagcucuuagaacaagaauucagcacuucacuuucuaauggcauccuaucuuuaaaaaaaaaaaaaucccuaccuuauauuuauuuacuucucaguuugaaucuucuucaagugcacauucuuaaucucaaaccucauguagagaauuauuuguuuagaugucuccaaacuggcuucuuggcauaguucuugcauguugugaauaaauuccugugauaaggucuuucgugaccuacugugacguucugaccuucauucuugucguucuucagcagaccucauugagagcagcauaguuuuugaaguaacuuggaacccaaaagcaggguaacuauggcauagacuccuacagggcaagguucuuagucuauuaguggucacauauuaccuugaaagcuugauacaaacauucagugugucuuccuaggauguguguauuugugugagaauguaaguucaaggauuugggaaaugcauugucccuaggagccaaaugaaaaauuucuaauguagagaggcucuucuugaacuuaugugugcuuaggccucccugggacucacauuaagauauagauucugggcauuacauuaagaugcagguagagaugaaccugggagagccuauguucuuaccaagguucccugugaagguggugucuuuggucucugaguauacuuugagauagaacgcugaauagaaccuugaggaaaccuuucaaaaugcaugaguagaagcuugucacaaaaugcuugaguuucauuuugaauuuucuauugaaauguuuuaaaguauuuuguggaaguaaauacaguauuuagccaugugcauguuucuaucuguaaccucaacauuugggagauggcaacagccagaucucaaguugaaggcuagccuuagcucuauagugaguuuggggccagccugggguaugggacacuuucuucagaaccccaaaaaaacuaacuaaccaaaacaaauaaacaaaugcaccaaaagaaaauaagggaaaaaauuaaaaugcaguacucaaaggagaauuauauuuuacuuuuaaaacucuauaacuuauacuaucaagaauguaauacaauuaucuaguucuaacuuaguaaguuuaugaaucuuauuuuuucuccugugguuggcaucugggguacauaugcauauguguacaugugaagccagaaguugcuaaggugccuuccucagcuucuucccauuguauuuuuguagacagucuuucugugaaccuggagaucacuuacccugcuuucgcuagucuaguuggccaccaagcccuaggggucccuuugucucugcuuccccauccuuaggaucauaggcaugcaucacuuucgcacuuuaccaacagaaccaucucccaaacuucuuuccuaugcuuuuaaugggcacaucuuuaauauauucuuugaauaauggcauuuuaggguguuuacuauaucuuuaccuuaaugauggccugauuagaaaccagggaaugaggucaguaggaaaacccaaacauuuacaacauagccauucauacacaaaacagauaguuaauagaucauuaaaguuaauuuugggcuagggauggaagaagcugaauagcuugggggaauugaagaaugaaaucaagccuugaguuugucauuguggguggaaacuaguccucauguuaaagcagauagcauagucucacucuccucaacuuauugccuugugauggacuuagccucuuaucacugagcacgguugcaaagaaaauuauuugcugguaacaguucuuugugcuuuuuaaauuuuuggugaagguaaugaaugggacauaaucaugaugcauuuuccauagcuagucauaucuggcauuuaaccauuucuauggacacuuaauuacauugcuuuuuauuuuuuuagugaaacuaugugugauauagagagauugcuuuauaugaaccugcaauagaccaucauauaucugauauuuucucuaacugcccauuugaaacuucuuuaaaaaauugagaauauuuuuuaauugcauauuuaucagcaauaccauuuugggaucacuugaagauaaaaugcaaagaagcuugaagcugauaugcuuauauagagguagacuaugaugucacuugagaguggggcugcugugagcauaacauggcauccaaugccacucucauguaaugguuacagcaauguaauuaugugcuuuuaaaaaaauaaaugugagcucuaaguagacauccuuuuugguaacuuguguuugcaugaacuuaaaacccuaagacuuuucugaaauagggaagcagugugcguggaguagcuugaaagagcaagguguguguaugauuuccucuuuauucuugcgucucaagagcuucugcaaucucagaaugcuuuguuagugccacauauagcaccuacuucauauucuagucuauagcucuuguaauuuguacauaaacaguuaaggauaaugguuaucaugacauccacaccaacugggguaaaagcauccagaauacaucacucaggagguagaagcaguuggaucucugugaguucaaggccagccuugucuacugagugaguuccaggacagccaaggcuacauagagaaaccuugucuuaaaaaaacaaaacaaaaaacaacaacaacaaaaaaagcagcagaguuagcaagaacugcaaauucccuuacaaacuguaugcaguuagaaccuuuaggaauuuucugacuguggugagugguagguuguuaacacagucauggccuaaggauuaacagcuagacauuaaccuuuccaagugaaaaaccaaaguuucuguagcuugcuucuccuaagccucucuuugucuuuuggaaaccuugagcaguauccucacguugcuuuucauuuuguauguuucuuccugccugugucucuuucccuuuuuuguaaggacaccaucaugacuuaaaucccauuuguuuuuaaaagccaugucuccaaauagucguauuaggaaauagagcuucaacauaggaguugcuggggagacacaguucucccaggucaaguuaauacagguggaguggaaaguguacaaauaauacauauuuaggaaguauaaguucuguuaccuuugugcuuuugcagaaaaggauacaaauuuauccugucuuccauuaaaaaugaugcuacuccagugccaacauaauuauuguaaagcacauuggcaggugguugaagaaaaugggcaucauuugucagaacguuagagugagauacagggcacuuccuguucauuaaucaaaugagcagcugugaaccuguucuuggccagcacaaugcuuuaaaaauguuuaaauugccaggugguagugguucacucuuuuaaucccaguacugaguucgaggccagccuggucuacagagugaguuccagaacagcuacagcuacacagaaaaccugucucaaaaaacaaaacaaacaaaaauaaauuaaauuaguagcuguguuaguguacuaauuugacaaacuauuuugauagacauuuuauaaggaugucgucuuuaucuugaauuacaccuguggcugauugucucuuacuuuggggcugugauaaaaugguacaugguaugggguagcgugugguagaacacuacugcuccucaucagagagagggagggagagggaaggaggcuagagagagagugcacauuaauucaagaggccagagucuuaauauccucuugaauggcauaucuuuaaugauuaacauccuuuuaugcuucauagccuaaauacucuacuaccaacagugccauaggccaguggcuaaguuguuagcaugcagacuuuugaagaucauaaaagauuguaccauagcaguugucauguuuaaauuuaaaaauaauuuaaagaauaauguuuuuauugggcuggagagaugggaaucuuuucuuuuuucuuuuauucauuaguuaauuuauucacuuuaaauccuaauuacagccucccuuccuccccuccucccccucccacccuucuuuucagagaaggggagucguguugccccuccucccauccuguaucaaccuauccuggcccaucaaaucucaucaggaccaaguccauucuuucccacugaggccagucaaggcagucauccaggggaagagauccaaaggcaggcaacagagucuaagucagagacugcuccacucuaguuguugggaacuagcaugaagaccaagcugcauaucuacuacauauguguagggggccuaggaccaguccauacauggcguagucucugugagcgcccauggcccuaggugaguuagcucuguagguuuucuugugguguccuagacccuucuagcucccucagucuuuccccuaacucuuucacaagacucccugagcucugccuaauguuugguugugggucucugcauuuguuuccaucaguugcuggaugaagccucucagaucauagcugugcuaggcuccugucugcaaacauaggagaguaucauuaauagugucagggguugguucucucccauggguugggucugaaguugagccagucauuguuuggccauucccucaaucucugauuucaagcuaagcuauagaguaguaauaacuacaugauauugguauagaaacagacagauugaucaguggaaucgaauugaagacccagaaaugaaauaaacccacauaccuacagacacuugauuuuugacaaagaagccaaaagccauacaguggagaaaagaaauaaucuucaauaaauggugcugucuaacugaaugucuacauguagaagaauacaaaaagauucauauuuaucaccuguacaaaacugaaguuaaaguauaucugaguccgaaacauaaaacuggaugcacuaagucuaauagaagagaaagugggggaauagccuuggacguaucgguucaggagacaacugcagcucaggcacuaagaccaagaauuacuccaugggaccucauggcucauuuguuuuuacagaagcccauggucacucauaacugucuguuaacucuuauuccagacggucugagacacucuucugguuuucucaggcacugcaugcaugugaugcacagacauacaugcaggcaaaauaccuauacacauaaaauaaaaauaaauacauaauuuauaaaauaauguuuuagucauuauguugagaauuucauacaauauuugaucauauuuaucccuccuccagcucuucucagauaauguucuccaucuuccuuugcacucaauuuuauuuuguuuuucugucuaaaaauaugaaacaaaacagaaagacaaugaacaauaaacaaaagcccauagaguucaauuuggacuggcugccuacuccugagcaggggcaggugucacuuccuaagcgaauuuacauaaaagucaggacuuuucuacuugagacucuuccucaucauaggaaguaguagacugaaccccagcagcacgguggcagacucuccguggacugccugccugcaagcaguagcugccagucauugccuuacccucuuucugagggaaauaugauauugucuauauuagcucuucauccaaaaaugagggaugagaagauaguguuuuaucauacugauuagcagcccuagguauuucuuuugugauaucuuuugauuagcagaguacacugugaaaugauagcagccuuucucaugugcucccaacauuauauaugcuuauaguuagauguaaagcagguguuuguacacauaaccaggugacaaaaggagcauuagaagggugaauggaaacuuuagagcauaaaaaguuuuuguuuuuguuuuuguuuuucgagacaggguuucucuguguagcccuggcuguccuggcacucacuuuguagaccaggcuggccucaaacucagaaaucugccugccucugccucccgagugcugggauuaaaggugugcgccaccacgcccggcuagagcauauuuuaaacaucuuauuuacguucuuccagacacaucacuuagaauauauguguugcuuaucuccuuucugugaaaucauuauugaaagaccuggccacguauguuuccucucccugaacggagcugcugaggagaaaauggcaaaggccauauuguuucuugagaauggcauuccuugauuucauugcaacauagugaucguauucagaaacucaucuuugaacagugcugcuaccgaauaagcagcccacaugcagaucccccaguuauguccuccaucacagguuauucuugcaauguuccuguaucuucaggcaggcgugcaugucacauucuaguuaauuuuuauguggguuaaaucugucuaauaguauuuuaggcucccuccaaccuuagcaguuaaaauuuuugaguauaaaccugcuucaaaaggcagaguuacaugagaaguuguauugugugaaaucccuucuccauccccauccuuugcccccuucugcuuagccucugcauugccagcauuauuagugcauauaugugucuuuuauuauucauaauguuauauagcauaauacauauuuuuucaugugaaaauauucucugaagaccauguugguucauggaaacucuucucauucuaacuucacuacugaauaggaaggguuccuuuuuguauguaguguaguuuaguuuaguucagugggucaguccauacauggaagcauagugauuucuaacauuuucuuauaaaaauguuguuucaacuucacaccuauuacaguagguauauuaaaaguauaccagcaaaaacaguacuggcaagacugucauaugucacugugucaugagacacugguguggauauguaaaauaagccaguuguucuggaagacaccuugcacauuuauccugaaguuguuguauccugucuggucuugagauccuacguaaggauccuacacucacaucuauuuacuauuuaccuuaacagagauuaaaaaaaauauaucuuuucaguuuuuuucuaagaugguuucuuuucaguuuuuuuucccacuuucacaggaagaguggcaucuugguauagguuucguuuuuaucccuggaauggugggugaaguugccucaugucuuuucauuuuuaaaaugauuuuuaaacuagagccgaccugugaaaguguuguaucucuuuuuguuaccuacuauucugcuuuuugcuuuuccucuuucuaccccauucucuucccuuuuuuucccaccacccccuucaauaugcagauuuuuaggacuauguuauggggacaaggaccuuauauauagagugcuguagcaguuguuucugcacauuuuuuuucacccugauuucuucagccuuuuguguucaguaucgaguuuacuguuaaccuaccccgucccuaaugauuuugaguaucuacaugaacuggacucuaguuaaauaaagacuguugagguuuucagaccgaagcugagaaucuugaagagauuauccuuugguuuuagccacagagguuuuacagugucucaauaagggaaaaauguucauuuuuuuuaaacuucuuauguuuaggacaaauacuugaacaacuuaaauguuagcccuuuuagggauuucucauaaagguuccuaauuauuuuagagcaacuuuauaagggaauucuaacuuuucaggacugagcucuggucaaagcuuagagcaucauuuuacuuacaugacuucugcuuccuccugguuuguuagucugugaugucuagucuucuuuaugagagccuauggucaaaugaauuuuaucuuaauuuucucugaacuucuggaagcaaaguaguuuagaaagcauccuggugaaaaaugucugcagguauuuccuggcuuccaaacguaaugugggcagcuucaguugaauuucugaaugcaaaggccuauucuaucuagcuaaucauuuauuguuugcucccugaagagaaugccugguagaguuaaugacuucagauccaucuaaugcuuagaaauaagcccugguuccugcacucauuuaccaauaccaagaaauugcuuuguguguaguggcaaucagaaggauuuugaagguggaaaauggcucaaauaauuagugagaaacauaccuaaauuccuuugagccuccuuuuguucaguccaucuacuuugaaagguuucuuaagagaaaaauaacugaggaaugugcacaagggugaggagagcagauauuugugugcuugucuucugaggcaaagugugaacggcaaaguuagaguggacuaauguucuguguuuaugagcagugcaggggaaccauaauccauuuguugcuuugggaugcagagaagaaaggaacucucucuuguauuuaguuucccuuguauaagacuacacuuauucagcaacaaagcaggaacauuuaucagguuagauaaguuuguguacagauuuuuguuuuugagacaagauuuugggauguagucuagguugguuucaaacuccagguccuucugccuuagccuccuggccuugccaggacacccaaccuuaacuagcuuugcuuaguaaguguguaaaacagagguaguuacuuaccaagacucuuucugggaagugaugacuagggaaguauuaagugaaacauuagcugaagcuugaguggcaucgcuaacuuuaagucagaaaucuuccuuuauguguaauagugccuccuuaugcuugaugagacuuuccaccacccauucuccauucuccuuuuaccugaagcaagaucuauuaaagaaggaaaagauagcauauaaauccauccucuccuggccuuucucaaacaguuuuaugaucggagauguuaauucuuuucuucuugacugugugauaguccacauuuacucuaaaucuucaaaucuucaagaaauaauaucuuuguagauacaagaucauuuucagguuuuauuaauuccauuuauacauuugcuuuucuuauccuguauucucuuuugcccuugagucauuuugguccuuuauagaguagcuugugugcuggauacuggggcaugcacaucauauguaagugauguucaacaaguacucagacaacaguuggaaaguauuggcuuaguugaaacuguuauugucuguauaauugugaaauggaacuaacaugaaguaauuguuucccuguuugcuccuguguucaguugcucuaacaucccuuuuaauagcuauuauuuguauuguuaaaaaugcuuguuucuuaacuuauaugacauucucuggggguacaaaucauagcuacaacaucuaaaaucuuaccaaugguuccuuuuuuuuagaaaauccuaaguauuuggcuggugggaggcauuuacugcuccuagaacuguucaggcaguuagacagcugcuguccuuggugaugaagugauuucauauaaguucuuagcaauagauacaaugcauggcugugcccuguguacuguuuguggucacugcugguaucuuccuaggucuauuugaacuucuagaaaaauacagacuccagggucuuaaugucuugaguuccugacugccaggcacaggaaauguuuaacuauuuuaaucauguuuuuguagccccaaagaaagucuuuauaauaggaaaugacagggucccaccacaaaguuaucucuuaucaguuccagucuccguggauaaugauuugucaaauuuggacauguguaaaaugcaagggcccuguuauuuacuuuggaaaggaaaaauuagaugacgcugauaaaagagucauggcuuuuguuaggagacagaaaccauuagaggcagucauuguuagcuuaggaaaguguccuuggaccccucccugaugaaaccuaaaucugcuugaaucauuccuugcaacuccaggggaggggaggugaaggaaggagggaggaagaaccugugaacuagagcagcuuagaggccagacaagcugcugcuagugcaccaggcaguugcuugucccagagcucuccuccaccgguguuuuuagauuuuggaaagcacauuccaucuugcagaagggugacauuccuucacgcagugcuuguugcucuucccucuucccuucuguagauguaagugauucuuuuucauuagcagaagcagagaaaacacauccagcucaaagcagcaugagucagugcauacuugacaugccucuauccucacagcacucucugacucuucacagugcucacuccuagugugcucucagaggggagcaggggggaaaggcuuucuaaauacugggcuguuuguggaggagggagagcaggagccucuuuuuguuccuuuacuuuuugccuagcguucucucucucucucucucucucucucucucucucucucucucucucucucucuuucucucucucucucucucucugucucgagcuuuccaaacggacagguaugcauguacuuaggauaauuucuauauguucguuucaggaccaugaaauauuagaucaaauaccuauaguucuggacacuauaaacagacagaaaacagauuugcugcagaugacaggauagaacuuugccaucuuguaugagguagcuuuuagaaaacaugcguggagauagaccaguccuaaccauuagcaacaauguccuuuuuugcuaaaaggccugcaagcuuauuuuucgugguucucuagggaacugccccuuacuauugcuguucauucuguaaggauggcacugacaggucaauggccaagguccugccugagaauggcuuccuguggguuccuuuuuugggagaaacugguucucugacaaagugaaccuaaauaaacaaacuguaugaagacccugugaaacaaggcuguggcagaaggugcugcucagaauuaggcaagaaaauucucauccuuuuauauauaucauaagugaccacauuguucuaaauaaacaauucauuucuuguauaccauuuuuacucuguguauuuucuuugucuuuuuucauguccauacauuauuuuuauguaguuuaaauuuuguuauaaaucuucaguuuuuucuuuugauguuguguuuaccuaguguuuagcuccuuuuuuuuuuuucuggcaagauaaauuuccuuaaaguuuccaugcugcuauuauauagaggugaguggucacuugaaauaagagaucccauggcagagccucuuggcucucacagcagaagcuucauuagguaugggauaccuaagauuugccugguggaguggagcagaagguagagugccaggugaccagccagcgagcauugcaguugcuguauagagcaaggccauuugauuaugagaaaaguccugguuagagaaguugugcucugaggaagagauaguguuugcuuuaggaaagaaagggagccagcucugcaaccaugagccagccuaacucagcuuagauguaucuguucucuuuuugugcuggugauguaccuaguuaccauugccacaggaaaaaccagccaggucuuuauuguaauuacuuauggaccuuuuccacuuucucucccuuuucguuucauuuuguuuaguauguauuuucaggucccuguuuauucuuauugaaucuguguaugacaaaugacagcuuccuuccuuaguugaggaacuguagaucacaguuagcucugaccggcuucuugucaggccaccaacaaacucugaauccugagaguugauuucaguucucacucaauucuuacuuuuuauuuuaauguguaccaguuuggucaacauaucauucauuauucacguuaaaauccucaaguaacuucuugguuuggcuuuuccacaugucaccucauuuuuaauaaggugucuccuccuuucuguguuacuucuuuauuuugaugaaauauagaacuuaagaauuuuaauacuuguacccuuuaauaacuggccauuuuaaaacauccaucuugaguagcaaguuuggcuuugaccacugaaacuuggcuuuauauaaacuccaugcacuuugggagaauugggucacuaaagucacaguuccaucuucgcacuuucccugguggcccuuggcucacaugugucucugaagguagaggcaacagguuugccaucucaucucuguuggacucugccaccuguacucugucagcaagguuauuagucuugugacuaggggaaaagaacuaagauuuuggggaucucucucucucucucucucucucucucucucucucucucucauauuuugagacagaauuucauguaccuaaaaugaccuugaauucaugacccuccugcauccucccaaguacuaagauuacaagugugcuuccuacuugagaacaugauuuuaagguuuauuuauuuuuuauuuauguguauguaugucucuguacgugugugccaacuauguauggguacucauggaggccagaagaggguguuguagauccuggaacuguaguugcuggugguuaugaauuauauuauauagguguugagaacuaaauucaggucuucugaaagagcagcaagcacucuuaauuggggagucaucucuucagccugauaacaugauucuuuugaaucuuccacuuauagaguuggcuuggaaaacaaaucacugcuugaguaguaaaaauaaagugagcgcaguuuuccccauaauaacuuuaugugauauuuuuguaauuguauguuucuagguaccuggggcucaagacuugguggauuucucuccuguguaucggugucuacacauauauucuguccuggugagucuuuaccugagcauccuaauaaauacguauuaaaucucaaauucugaguuguuauuauuauuacuuuauuuuugagcaaaguauuguuuagcgaguauuaacuaauuccucugcucuugcuugagucuuguuuauauuugccuuguaaaauucaaacauagcugaugagauuucaaagagucaucaacagauugguagguuaugaguaaaaauguauucagauuucucuguuucaaauguaacauauuuaaccuagaauaaccugcuuuuuauauauaguaaaggauuuaugaaaaguauuuacauguuuugacaaucaucccuuuuguucuguaaagcaccaguaaaagggcaauaauguggugucacuagacuguggaguugauacugagaguguaggauauugcaaacaucccuccaguuugucucuguacugcaaacuguguuucaugcuuauugaaaugaacaucuucaauuuugagauaaucaggcccauuaguuuuuaacuuauagguuauaauguuugaauguucauuuaaaaaaaaaaaaccuaaaauaagccugaacagacacacaaacaaguaacuauucucccaaccucagaccaucuuccuccaaagccuccugcuccaagaugacaacauucccugacagcaucucuagaguuuuauuauucacacugugcugauggaaaugguaguauccguuuacaguuuuuaauacuucucuaauuucucuaguguaugaaauggauuggaauaugugugggugucuagguaagugaggguuuaugcuguaaaucacugccgugcaccaggauggaagugcauuuccacgaugacgguaccauggcagugcuguuuacugccaggugcugccuuuuauaagcuuuucuacguuuuuaugaaaacagaacaaauuugccucaagugagaauucuaacagagcaguaaaacauuuuacuugcauauuuacugccuguguguauuaggguagccuagcgcuaugcuuacguguguaugaaaugggaaaauaauuuccugcuacuguaguuauugacagugaaauaaugucaacucaguccuuggcaaaugagugacauguaguaaauggcaguugucuggugagauguugucauaugcugauccauacauagauuuucagaagcaugcacuaugaaguauagacauguagucaggaggucuagauucuuauuaucaaauaaauugucaauuaaaauuuauuucuuaauuuacuaugaauauauagauuuaacauuuugaaaacuacagucuguugguuuagaaaugaucaaauuagaaaacuaucuaauggaacaggauucuaugcuaauuugaagugugaaauauuugauacugacaaauuuucuguaacagucuuuaaaccauuuuuaccugaacugcacagguuuuaggaccauucguaguguugcuaagguuuggaaauucacagcugaugauagguguuuuguaauauauauuuauaauuuagacauucuuagucuagacuuauggggauucugaguaaaaccuaacaucaauuuuacuaaaggaugcuaauagcauacauaacuuggugcugaauuuauagaccugaggauguauucuugucacucgcaaagcuguguugaugucagaugugcacauuacuucaugguaaaguacagcuugucacaguauuaaugagcauauuuaaaaauguuuaaucaauauaaauauuuauuauaauguucccauuuucuaauauaguaaacauuaaucuuaggccuucagcaaaagaaaauuuggguacugaagaauggagaauaaacaucaaccauauagcacugcuuccuucuauuccaauauuuguuucucuucccucuucucaccuuucugaguguguguucugcugcaccuugaccuuacugaucaguuuuaucucucagccucuuagucuauuuucucccuuuuauagcaugguuuucuuccucucugcuagccucucucucuuauuaaaaaauuuauaguaagccuuuaucagcauuaaaucugggcagauaucucucucugugcucuuagaaucuacuuuccuaugaacaacucccagugacuacuuacucggcucucucuguacugcucuuaacuccagcuggccagcccucauggccaugacuuuaagauucuuauccuauggugucuucuccucucuccaccucuuuuuucuccucauggucuccucacaccccaagccuaugucucuucugcccagcuacuggcugucuacuggcaucuuuauuuaaccauuugcugccugcuuugguguuugucagcucaucuuugugcccuucacuauucccagaguucugcuugugcuacugcucuguuucuugcuagaggugcaugcucuagaucugggcaugggcucagcaguagaguaugugcuuagcauugagugaggaucuggguucugucuccccuaaugacgacagcaacaagcaaacaaacaaagaaaaccacugcacucaacuuuauggagauuucuacaggugguggaaacuuagcaucaaugugucucuuacacuucacuggcccugcaggcuucugaauaaaauuaagaaagccauauuuuuuuucuuaucaccaguuagaaaucuacacuguuauuggguuuuccugaguaucauaucuugaccuguagauguugugaauauaauugaauuuuauuaucauaggccauugccuucauucacauauuaaucauagcugguuaaacacucacuuuauuucucuacccuaauagugaaaacaguauucccucuaccaucagggagcuccugccaugucuagcauggacuaccugcuucauuuuacugaccaucuaucuuguaagacacugaaaugucgaagaacaaagccagucauggcucuuuagaggucuuccacauuuccuauugcuuaucaucuugccuuuaguuucugaagcaugcugugguugucauccuuucugcacauuagcccuucuaucagucacuacucucauuucauugaguuuuaaaaauuuuguuucacuuuaauuucacauuucuuacuuauuucauaccuaucuuccagcaaauuuuuccuaauauugcagacugaaaucagcagaucuguucuccacauuuauguagggccugguguguaacucuguguuuauuguaccagucaucauagucuaguggauucuucaucaauagggcagguacaauguuaauuuaaucugguauuuuuguuuuugccuuacuaauuaauauuagaaauauauaauagucaguguuuguuuaugauuguaagagauaaccacccuuuuuuugauccuuaagcaaauccaauauuuucaucucaggacauauuauucacugccagggcagggacuuacguaguggggguuggggcagcucuguugcuguccaacggaaggaucauaacacaaguaacaaaaaguucuaauauuuugucauuuacaauaguguuuaucugaacuuuuggccuggagcauaacaaggcacacuuugaauaaacauggcaauauuuauuauuuuuagugaaaccgaccuuccauucaccccccuuuaugguugugcugcuuauaaauucccaaaggauuauuugaaaaauccuacuuauaucugccagccuuaucaguagggcagaaguucauguauuguaacaggaggucagauuucggucauggucuuauagauggggccaagcaccuguaacucuuccucuggugacugaagugaaguacaauaucaaacaggcagugagacuuuucuaggaagugcugaacuuugacaggaaggacaaaguuugguggguggaggggagggaagaaagugaacaagggucagauaaugguggagacuugggccuugauguaaucauacaaucgaagugugugggagcaaagguagauguauuguguagaauuguuuuaaacaauugauaugguuuaaaucuucaauuuacagcuuaaaaacauauaguuuaaagaucggcaggugagaaaauaaaacaucagagucauuagagaaaaaaaacauuuuuuuuuuaaaggaaaaaacaaucucaaaguucuccuguuaaggaagugauggauaauaacgggguucuuguacauugugcauuguuccuguaaagauggauggacugucugucuagugaauacauaaaugagucugccuagcauauuuuaugaaaccuuuagugacccaagguuaucugccauauuuauggguugcagccuucaaaucaacuucaguccaguagggauuugcauaaacuuuaagcuccuuuauauaccgaagcaucuuucuaaguuaucuugagguuaaccaugccaauccaucuuaugcacagcauauaacaagaugcuuagguauuaugguuucacagaagagcaagccugugaauaaagccagagccucuauuucuuggguuucacuuauaaucuuccuuccuaguggcauuguggucuccaguuaucuauaugauaugaucuauaacaauuuaaauucccauauuaaaaauguugacaaaauguacaccuuugauuuaugauuuuuaugcauguguguuauaauaaaaagcguucuuucuagauuucugacaucuuugguuagcaauuuuagcaguaauccagauguuucuuaauguacaacaccaaccccuuauuauuacuugaaucuugagaacugcaguucuguucuucaguagccuaaggagacuguagagaaguauaggaaagaguggaguguuucucuguauuauuacagaggcagcaaucugcugaguacacaucugugccccagaauagcuaaugccaggucuacuugaguacccauuguguuaaggccccugagagcaucuugccaucuugauuuuucuguuguuuuagaagccuuaccuagucuaaauguaagauguauuugaaaaggagucuguugccuugucauaaaucucuauucuccaggcagccuuucuuuaugacaagcugaugaccugcuuuuuuucuuaagaauaugauauccucugcaagugagcuaauagcuguuuuaugaccacauauauuagcaauauccagcacagaacuguuagaaagaaaauguguuaaguuucagcucauauucauucucucucucucucucucucucucucucucucucagacucaguuguaguuagaagugaaucaguaucaggccuagaauuuaucucauuucuaccccagugguagccaagauagcaugggguggggaggaaccuucuuggaacauguuucccccacuuuuuuucuuccccaccaggggucaagauaguaugugaccucccaauguuaaucugcagauuuacccugguguggccuucagcgguagcuggggaaagugacaaccaugaucuuagagcagcaggcaacaggaggaaagaauccggaaacuagaaauagguaugagcagcucugagugacgcaucuuagugaauguuaaauuucuuauuaaaauuuguuaaugaacuuugauagaaguugacuauuaacuaaaauguuuuggaaaauaaauaguugaaaaguuugugacccuauuggaguuguaaauucaacaaaaugauuagcuuuagcagucuuacuuauucucaacuucuugauucuguaaagacugaaagacagcagcgaguguuagaugauggcucagcucccaacucgucauuuacacugucacaucugaagcuagcauguaaaagcuugaagaaggguagugaaaucccauccuuuagacacaacaaaaccgugcagucguggacucaaagcagcugcaauuccuuguacugguccuccacaagacaaggccccugagcagucagcugugaauaggggaguggcucaugggacccuaccucuacugcuaaacuguaggcuacugggcggauucugggacaggggaacuacugucuuuaguuuuguaugcuuugucauacccaccacuuuccaaugcauucuuccaacuucaaggccacacagaaggcccuaaucaaaaucagaggaacacaaacacaaagauaugaaugugggaaagaaauuagcaggacagguguugagaggguggggccugagggggcuggggggacugggaugagagccaucagaauauguaugaaauuaucacacaagaaguuuacuuaaagagaggcccauuggacacgcaaacauuauaugccccaguacaggggaacaccagggccaaaaagugggaauggguggguaggggaguggggagaggguaugggggacuuuugggauagcauuggaaauguaauugaggaaaauacguaauaaaaaauauuuaaauaaaaaagaaaaaauguugauuccucagguaguuggaauaaaauguuuacaaacuaaaaaaaaaaaaaaaaaaucugcuccuaaaguuauguuuuuuaaagcuaucauauguggccgauuaugcugaaagauacaagauaaucagaacaacuuuucaauaagcucauaauuuaguuuaucuagagauaagcugcuuuguaagagacccagagaguuguuucuaaaacguccugggagcaggaauagaaggggaagugggugcucucugcagaucuagaauagcguuguucaugucugauuaucuauuggaacuuuauuuuuaagaacucuaggugauucuauaugcuuuaggccagauuccacuugccccacguuguaauuguuuuauucuaauuuucauggauuuuauuuucccucuuaaaacauucuuguauauucccacaguaucuaagacacauaguuauaccuuuaaggaaccaacuuagacagaaaagagccagacacauucuacuuucuucccauggugaucuggaauacauuuaaguaguaagagcacauuuuauguauuuucuuuagagauuuuucuuugaagugugaacaguuuuguccugaaguguuuagcagcuaagagucuauucugacacuuugcagauuccugccacuuuccuacugugucgcagggccucagagagccacugaccaccagugccuggugagguuagauaggaguaaacacuguguagaucacagagaaggagcugagggcaaauacuuugugcacugcauugauaaggacacaggaagagcauuucuccugauaaccuuccugcaacguagacuaacgggcucugguuuguucuaauugucauaaugcucguuuaaccccgugaccuuauuacccaugggcauauauaucacuugucucugaauaaaacaacagaaaaaaagaaagagagaaagauaaaugaguaaaaccaaagcuuauuugcagauaacugaacuucucgugugugcuuagcugcguguuuucauguaugcuaagcaacgaugucacguagacaauuuuacacacagcauaugaugacuucaggcuccaacaaaggaagcaagacaguuacauaugacacugagugaugguaaauacaguuuaaucucaaucguaauauaaauugaaacuguguuguuucuaauuauuugcugaauaaaguaacuuuugugccugguauaaguaauuugcguuggacucucgccuuaucucucccuauaucucugcauuuuccuuccgguuguucaugguguauucugcuagccagugugcucucccgugauggguuccagaugguuguuguuguuguuuuuaaucuauugauuuguguguguguauguguguguguguguguguguguguguguguguguguguguguguguuuagugagguuuggguauguacacaggugcaugcagguguacaugcacauggaggucagaggcugaaauuugaugucuuccuccacuguuguuuaccuuuugauacaggcucucuuaaugaaccuggaacucauugcuuuggcuaggcuggccggucagaucucuggggauucaccugucacugcuuccccuaugcugggauugaccauaugccccuguggcagaugugugcguguguguguguguguguguguguguguguguguguguguguaugcaagucugugcucauggacucagauccauccugugagacagguacuuugcaggcugagucauccacccagccccaccuucuuccuuuagacagcgcuuggaaaauuguacuaucuuuauauuuccuccaucucagguagccagugagacauagcugacaugauuuuuucuucuccuuuauauuuuauauuauguuccuauaaucuauuuuguuucugucauauuucuuugaaaacagaaaauuuuuuguuauguuuaccauaccuaaguugucuucuuucuggauacuguuuuaauauauuagguaguuuuaauaucaugugugaggggcaucagugacuguagccaaugccugugacuuagcacacaagaucacacauaagacaaaggaccuuccuuuuguucuuggggugggguuaguuuauuggagcaguuauguaauuaacaugcauaccaaugauccucuuaacagaagcagauuucauagcugaaguucaugcaugguuuugguucuuaauagcaggugucaugaagagugcuucuuaaacuuacagguagaaugggcuuauuuuacauuuugggagcauguaaagucuaaguuuugaacuugguggauucuguacuuucuugaauuucuauagcucaaacaagccaugguuuaaagcagugauucucaaucuuucuaaugcuguaacccuuuauaaacuucucauguuguggugacucccaaucaaaaaauuauuuuuguugcuaccuuauaacuaauuuugcuacuauuaugaauuuuaauguaaagaucuauguuuuccaauggucuucagugaccccugugaaaggauuguuuaaccccuaaaggaauugcgagccaaauauugagaaacacuagucgagagguggucauuuaggacuugacacuggaguggaugaucuguuuacugaauccagacuuccccaguaaaagcaugguuccuguucucauaacucaucuuauuuagagcuucuauauuuuuccauauugugagauaaacuaauaaacagcuguagaagaacugagugaguaagauguaggauaccccaagaaggcacugcuugaaaaagcccaaggaccacacaaggugcuugaaaccaaccagcagcuaacaugacugggcuauuuuagguugagguucucauaguucauugaccuguuugauuucccacugagccucaaauaaaacacaauagguauuaaguuacugugcuuuuuaaaaaaauguuuguuugagauaugaaauauaggccauaggcugggcaugguggcacacacuuauaacccuggcauuggugaaaaagucaggaggaaccagagucuaaaggcaauuugaacuacgcaccaaaacuaucucaaaaauuuuaaagugugcuuauuuaugaaauucauagcuguucagauuguauuugaauucauguacgaaaaacugucuuaauuauuuaaacuguggauuuuguuguuguuuguuuauuugcuuuuuugacauuuauugaguaugaaaguuccagauauccagcauggauaaaaugucagauaaccagccagguaucugguaccacuauucucucaaguuccacggggucagcuuuuccuauucuacauguagugagaucagguaguacuggcacauuguuccaggcuuguuuucauuuaauguaaugaucuucauguccacccauguaaaaaugugauagcauuucauuuacuuuuauggaaggauaguuuuccauuguuuaucuauacuaaacaaucuuuucauuaauuaaugagcauguagauuacuauaauuucccagcuguuguuuauagugcuacaaagcaguuggagaacagacaaccagucaacauucuggcuucaucuccuuugguaaugaaucucaguaaugggauugcugaauauucugauaguuucuuuuuuugaaaaaccuacuuccuuccuuccuuccuuccuuccuuccuuccuuccuuccuuccuuccuuccuuccuuccuuccucccucccucccucccucccucccuuccuucuuuccuuccuuccuuuucuuuccuccuuccucccucccuuccuccuucccucccucccuccuucccucccucccuccuugccucacucccuccuuuccuuccuucuuuauuuuuagacuacccuuguaaaacauuucauuuuugaagaguugccucuggugcagacuuuagcccaauuggccacagucuguuuuauguagggcaaaauaaugugccacuguggagggaaagaccuacuuuucuuucucauccuagaccauaagaucaguuucuuuuggcuucucccacugguuaaaaagaagacauuagcauacucaugccauuaaaaccacuguuguacagcacucagcagauccccaacagccauaccacaggcugcaucugaucgcuugcuucagucauccucauagucugauggugaguuuaauucuuuaguauugcuauauuuuuaggagggccuugagcacacucuccagugcuaucuuccuuguuuggaacuucagaauuauuuucucuuuccauuaaauaaugaaauagcuugguuuuauggauuguaauggacuguacagagaagagauauucauaguagugaaaguuuuguuggaaaagaauaugaaacauuggguuggagagauggcuuaaugguuaaagaacacuuacugcucuucaagaggagcaaugaguacaugucagcucauagcuaucuguaacuccaauuucaggagauccaauuuccucuucuggccucugcaggcaccagaaaugcacauggugcacaaauauacaugcaggcaaaaacauuuauauacauaaaaugaaaaaauauuuuuaaaaagaauaggaaauuugugaguguauuacuaauaagcagucauaugaauaaagugguaaaucuuuguucaugugcauacaggcaucuguaaacugggauggagggcagaauuuuucuuacacuggacugguaaauguugagagaguaccucauggguaaccugcauuggugugcaucucuguaaacagaggcacugagucuaucuagauaauuuuugcauggguguuuguaaaaccaacagcuuuuauauagaaauaauaacucagaaacagcaguuuguacuacuagccuggggcaugauuucuauggauaaaaggaguuuggguucucuauauucagggauguuuauccucaguaugguuugcuguguagacagaugugaccugaacugcuuuuacgcuguccuaaugucccaaggcucuggaaaccaaagcaaguaaugacugauuuucuggcuucuugucgugauaugacuaauaaagucauuugucuuagauucaggaauguugugcauuuuguuagcuuucuagaaacugaaauuuauuaagguaaaggugggaaaaucuuagaugcuucaugacuauuccuuuuccaguuaucacaauggggguuuauuuagguaggagugugagcagacaguuaaucuggggaacauuaagaaagaaggggguguuugucuuaaaaugguucccaaagauugcuuauucucaaaagagaaaugcaguaauugguggaacaugugcauaauggaguaggcucuguacaugugugcaggaguggucagggcaggaaguuaugaggugcagcuuuguaggugccagaggguugggggcaggaagguauauggggacaggaggaauucugaugucuuuauauuugccucuuaaaugugcuuugaacuuaaacuucucaaaaaaagaaucuuaaauugggcauguugauauacaucuguaaucccaacugcucagguugagauaggaaaauugugaguuuuaggccucuguagguaauagaacaagacuucuguuuaauagccaaugagugaaugaaugaaugaaugaaugaauaauaaauaaauaaauacucuuaagguaauuguauagcaguuuuaccaagugcucaaaauucacaucacaggugaugggcugcugacaucauaagcuaccauguccuaguuugcucucuguugcugagauaaacacuaugaagaaaacaacuugguguggguguguuauuucauccuauaaguuacagucuauuaguaagggaaaccagaacaggagguuaaggcagaaacugaagcagaaaccauggaggaaaacugcuuacugguuuguuuagcuuacuuuccuuuaucugcccagggguggacugccagaaguggguuuggguuuggugucacccacauugaucauuaauggaaugguugaaaaaaaauauauaugcauacuugugcgugucaguaacuaaaaagaggcuaugaauuugcaaggaaaugggagggguuggagaaaaagagggaagguaaaauaauuacauuuuaauuagaaaugaaaagaggggcuggagagauagcucagcgauuaagauuacuggcuuuucuuccagaggaccuggguucaauucccagcacccacauggcagcauacaauuauuugcaacuccaguuucgaggauaugacaccuuuacagagauauacaugcagacaaaacauaagugcacguuaaaaaauaaauuauuuaaaaauaauuuagagacacucuucccaggaggcucuaguuuguaucaaguugaugaaaaccaugcugcucauucagagggagauguuuugaaagggagcaagcauugcuuuuauaucaucacaucuagaaugcauugcuuuaauuuaauuuugaggagauagcuuucaaaauucauugcugguuaguuuuugucagauugauugacaugggagggcacaauucauuguggacaguaccaccccuaggcugauacuccuggguuguauaagaaagcuggcuugaacaacccauaaggagcaagccaguaagcuguggucuucugugaucuguucuuuaguuccugccugccuguuccugccaugacuuuccucagugacaguuaugagcugacauaaaaccucugcacucuaaguggcuuuuggucaugguaauuuuucacagcaauagaaucucuaagacaaaucccaacauaguauuacaguagcugagaaaagugccuuuuuccuuaaaagauaaagaaaaacugggggaguauuuuucagauggcaagaagcuaaagagacaugacagcugagcucaggcauugccuagacccaugauuagcacuucauugugaagacuggcuaggaacuguguuagauguuucuuggccaugaguacuuaugacaaccacccucccuucacugcuuuacuugaggagccugcagacccaguacauaaaugaguaaguaggcagggggaaggacugacccuuguucaaggcugauuccccuacuuuaggggaaauauacaagaaaagauacuaacaaaauuggaauauggcaaauagcuuagaaaaaugucaaauuucugacuuugguauuaguuugugaugauagaagacauccuauucacagaaagugagcaaugacauacuagagguuauauacuuugauguuauauacaugauuuaaagcaauucuagucugugcacaguugacccuugaagucuguggauuccaaauauguggauucagccaauuauaaaucaagaaaauauacuaaauguuacauuuauauugaaggugucuagacuccuuuaguguccucauuccauaaacaguuccauauaacagugguuaacaaugcauuauguuuuaugaguaaugaagugaugauuuaaaguauauaauagauugcgcacagguucuacacacaugcugcuuugguaucuauaaagaacuggagaagcuguggguuuugguccuccauaaaugucuuagaauaaaucaucugucauacuggacaaugacuauguaggaacacuaaacagcaggcuaauauggauaaaggguacacaggagguuuguaccauacuuaggguccuuucccauaagcucuguagguugaaauuauuuccaaguaaaauguguauugauuuaaaaugugaauuuugauguaaauuaguaacaacucagaaggaaauguuuuuuuuuuaugauuuugcagcucuaucuuuuaauagaugccuaaaaacuaaaaagagaaaugaacuaaaagagugaaaacgaaaaagugaugagugcaauaggggaugccugcagacaucauccuuggccugaucugaaucacuuagcuaacaagaagcuagaguccaggagcuggaaguuccagugcggucuggaaaugagguugggagccacauuuuccaggcuaggaaacacaggguaccuuguuuagucagcacaguuuaggucaaacgugguuaugaaaaacagaugaauucuggugaucaaguuguacuuugacaaauaucccauuguuucaacaugcaguaauuucugaaaaugugaagcagcccacguuacugagauugaacacucuccuuacucuccugcccgcucacagaggucuugucaucauggggaguagaaaucauagcagagaaguguguuaggugcucgcuccacucccccuucucuuuuguucccuuuacuuggcucuucuggcaaaccaguuuugggcaagcuguuuagucagcuggaggccuuuuaguacccugcacucugggcacagcucuugagucuuaguucuguggauggguagcaauguguucucaugaauuagauaauuucaguucauccuauuaguagaaaaauggcacuugagaucaacaaguuacuguuauuuuaacuggcuccucuggucauggucugagucaugcuuuuagcuucugccuuuucaguucccaccauaaguggcucaggccuagacuucugcuauaaacuuuagaacuacagucauagacuaggagaccagagguacuuccuaguggccagaccacuuaacauugauccaaccuguucuguaugaagaugaagcucuuuauguauuuauugguguugugcuguuuuuguuguuucagaaaucuguguuaucuacuuuguucacuuaacuauuaaacuuugaucgcacauuuacagucuauauacuccugaauccaugcuuggugccuuugggugaaauuucuuucugggaaguuuagcccuuugcucuccauuuuguggucacuagccacacagggcuuggaugauuugacacagaaauggcaugacuugaaauacacuauaggaggcacaugagaugccaacucuguaucauugucugugaaguauauuuaaugcauuauuuuuauauaaguuacuuauuaagugauaguauuuuacuauaucagguaaauaaaaucuuauuaaguuuaguguuacucauuugcaauuucuuucuucuuuuucugugguuccucaaaaccuuaaaccugcacuggugauggacuaugcuuuguggcuuauaggcgugucugauaaauacugcugccuaucaaguacaaauuaauagcuuagagacacuuggccuucugcugaugaaguaacuucccagucauuucucuaauuaagauguugauuauuuccauaaaauuguauuauaugggucccugguacauuuuuauuuuuuuugaauuuugaugauagugaguacguaaaaaauacuaucauuucauguuauuuuaucauaucaguucuggauaacuuagagccuuugugacuaucucuggaucaugagguuagucagcaguaagcuggcaucacuaugauggcuuuguuucugucaguugaacuaggauuuucacauacauuacugacaccuuauguaaagucuuuguaaggcaauuuucuuguuaacuacagacagaugaggucauauccauugcaugauacaguggauucagaaauaggaaagaauuaagaacucaucuugaucauuuagucccuugugauuggugggugcccuaauaaugaguauauauuuuauucuuacuuguaaaggcgaucuucacuuguggaaucuacagugcauucuacucagaggacagguuugggaacauuauagguuucuuugcugugucuucuggaaauguugguuuuuagcucugagcauauuaccaagaguuucagauugguacccugaagauugcuucauucuuuagaagcuugaaauaaaaucuucaucauucuaguuccaugaguuagauuuaaguuguucuuuuaggcaggucauaugugguauugggaacaugcaugaacuuuggcauuuucauggguguuuuaaaguuuuuuaugguguggguauuuucuuacuguaagacuucagucauuuuggacccugucaggagcaguccuaguccuaggaggaauaagguaucaacagccuuaagaggagggagaggaagacaaagacucuugaaauagauaggcuuaaauaggagcuaaaagcaugaguucuuguuuggacgaaguuacauguacuggacaauucccguuccaugagagcaauccugagugggaaauauccccuccauuccuucuccuuccuucucuuccuacccugucucuuuaggagcagacuaccuguagcucaggcuggcuucuuaucucugccuccugaguucuaggguugaagccuugaaugggucaugccugacauguuuguuauuuuuuuuauuacuuaguucucaaauugcuuggcaguagauuuauuaagaaaaaaaccagucagucugagaaaguugauuuuucuacuaugucuuuuauacauuuaagagagauaaugaauuugucauauucuuauacuaaaaauugacauagguucugagauggcuaccacgaugaauagaaguuuaucauugcauuguuagguuucauuaugacacuuauauacauaugugucauuauauuuuguccucauuuguucucuuuccucauaccugcuuucuguucccuucuuucccuauauaaucccguuaucuuuuucaauugcauuuaucuguaauuuuuuuauuucuuacugugauaaggauaucuguggaauauccacaacgaauuccauacuugauaagauaacugaacuucagaauaauucccagcaaagucauaaaggugacagagacagaagcuaggagaagcacgcccaugcagauccucauccccaaagacuuacgaugaggaacauggaagagaagggagguugaggaaauacauggcgccaugguaugggauaugugcagguuggagauugauuccuaaugcuagccuuugaucauuucuucaccuuauuuuuugagcuauggcucucacugugaccugaaccuugcuaauuugcuagggaggguggcaagcaagccucaauggaaccucucaucucuaaaauuacaggugugugucauaucacccauuucuuuugugauugguguggaucaaacucacguccucaugcuuauguggugagcacuuuaccaauugagccagcuccccagccccuaaauaaaucaucuuuaagagaaaauuguacuaugugcuuuuaaaaaaaugaagcccacguugcuucaacuuuucauccucucacucacuucaguauaauugaaaauacuuguuuucuguggccucugugaaauacuccuuguuuagcaucaagcacagaccuuuuaguguaugcuuuaguuuuauaucuguguccccaguucucaaaacuaugaaauaaguaagaaccaaguauauuccuggugaaaaagagcaguacuuuuaucuuaccuugauuucagaguguuaguuauagcucuagauuuuacggucagcauccaacauggcugugccugcucacacuuagcagcucugugauuuucaguagcacuuucgcacaugguuguucccaaaggagcgagaaccauggcaccagccugggagcugaccuugagagcugagaggauuggggguuaguaaaaucagcugugcugccuagagagucacagccuuaguaacuggccaaacuggggcccaagccugaacucaggaguuacauuugacacauucuuucacucuguguaucauugauguuuccauuguaguuagaaugcuguaagggcgauaagaaaggcuuuucuauagucauacuuccugggcuguccugaaaaauuaguccauguuauuauucuguauuaauucuugucuuuggagucuggggaaccuauuuguaaaaguuauagaauuggggggggggggcaggaguguggcaauggcuggacuguaaaaaaaauaaaaguaauaaaaaauuacuaguuuguggaaagacuacacugaaaauagcagucguauccuaccuuugcucauuggcaaugacuugaaagucagauguauagaacuggagaaaggcagucuaguaaaguacauuggucuuggcguagaacagugacuggcuagagggagugcugagcagacagaauauguugaguuauuuucuccacagguugggagggcugccugaugaggacucuaauaaugugcuaguguuaaaguagcuuugggcuugucaggaugauuuuugauugaaauuuagcuuucucucugcugcucucuaggucugguuugggaaaaucaggcggggagugucaggugcuauuuuaagaggaucauugccagccuaguuaaucagggcuagagucauucuggacuacucuuaggguagaucauccuuccauagcuugccaaauggcuuuuaauuaugccagauuagugugcaguuuguuccacgaucugacuucaagugggcccucccauucagaaaagagcaaaaauuucccuucuuuccaggcauaacuguuauuuuuaguggaaccuuuuaguuauuugaccaauucagccauucaugugcuaaaagauucugcagugcaccacuuagugaucauagacuugugccuuugauacauucuggugaggguauugcuagauagccagcuacugugcagugauaagugggaguugaucucaagguuaccaaagugucuaggacaguagguucuguuccugcauccagcucugcuaacuccagcccuggcuagcaggcuguauuauuuaaauccucaaaauagcauaauuuuacaaccccgacacuauaucuggauuuucucauuguacaugugauacaauugaggcauuuuugacauauugaauagauugcuuaauauccuguaacuaaggguuaaaccaggguuuuaccucauaagguaagaaccugaacucaaauuuguuuagcuauggguauuuuagauuuuuuuccuugacugcuuucgaauacuuaguuuuuauuacuaaaggcaauuaaaagauauguacauuuaaagcuaucucacauguaaccucccaaaaagggagauaauuauuaggcauuccuuaaaaaaaagaaucuuugaaaacaguuauuuauucccagaaguucuggguuagaguuaauauuguauuguuuucauuugcuaaauugauuggaaaaauugcaccuuaugaauuucacaugcacuuuugaaauaacugcugcaugcacuuuuuguauauguagggcagguuuauacuuauugacgcaaauauuuuuugguugggaugcaugcuuagcaaaucaugccuguugcugcaugucucaauaauuugcuucuuuuuaucuuucugaacagugagggacauugggcuguuuccaguuuaaagcuucagugucauucauuauuaacggaccuagauauuacuuccuuuugguguaauacuuagaauuaugauauucuacuuaacuguuuguuaauguuacuauugauucauauauuucuacuaaaauuacauaaaugccauguauuucaaauuugaaauucauggaaauuuucuuuauggaugagcacuuaguagaauuugcuaaggcuuuaaaaagauaugcagucuccacauuucccugaaauuggcaaauggccagugugcuaaguaccaguaaccugugcuauguacaaauuauguacuaucagauucuggcaaauauucugguggggauuaaacaacagagccacucuggaaaucagugcaguguuucuccaaacuuauguauaaccaaaggcacucgugggcauuuauccuuucgguucaaucuguacaagaauacguaugacagcauucuucauaauuguuucacacuaggugaacgguuagauuaaugguacuuuauuccucagcaauagaaagaaagcacauugacaugucaacagccuggugaauaaaccaauccuagaaugcacaucucauaauuucauuaaaaagacauuccaguuuugugggauguggcuauauguagugugcgugcucauguguauguguguucauguguguggaugggccuaugugugagaguggaggcccaggcugacaccagaagccuuccaggaucguucucuacuuauucgguguggcaggaucucugacuugaauccagagcuuguuuugcuagucuagcuagucaucuagccccagagauucucugucucugccucccaaauuugugaaauuacaggugagccauuuuuguggguucuggggauucagcccucauacuugcauggcggugucaucuuccuaacccauaauguaacauucugaaaauuacaaauuuauagaauggagguaaccaagaacuauguaauugacauggucagagugaacuugggaucagggggcagucagagcuguaaaagagauuuuuguacuuuuaaaagugugcaucaugauucuguaaauguccguacaugaugcgauauuucuguaugauguuugcuguugggggaacaggugacgcgugcuuugucucuuguugcaguaguauggaaauucuccugcuaggaaguucagccaagagugccagaggaacacgcugaucagcuauuacccucuccuuucucuuacuucuauauuauuuaccaacuauaaaccuaguauuucuacuuuguuuacuuuuacucagaaugacucauuuuuuaaaagagcaauugaaucucagucugacagaucauauauucuuaaauucuaaauuuuucuguuuguauacaaaaauuuuuucucuguuaaucaggaauaagaguuauuuguauaaaauaacuuacaaguaacucacuuacaaguauacaaauucuauuuguguguguguaugaugugauuuaaaauuucaggaggcaccauguaucuuuuaaaaagcacccuuuauauacaucugugcauaauaauaauaauguguguaauucaguugauaaaucugagcuucagauuuugggcugcuucuggcacugacuuucuguggagugucucugauucuuucuguauaaaauguuuacacugcaucuuuacguuaaacuuuucauugugagaacuguugcaaaucucucauuaccuuaaucuaaaaaagaugggauugauuuacuuauacuuuuaaaccccauacuuugcuguuaguucuuaagcagaggcucuauucauucuugacaaaugaaaccgguuaggagauguguuuggggaagcuucaacuuccaaauuguaaaacaccucaacauuuuaucagaugaacacaaaugagucagguuauaagagacuuuccuuaaaaauuacacuaggaaauuggguguuuguuuagucccucuagaugauugccaauuuugagauaauuucuuggagugaaugcagaaaugccccauuuucuucuuucugaugggaagaaugacuaucccugcuuauuguguauuggaaauccucucggacauauuuugcaucucaugguuggucaggcaguuuggcuuccuccuccuuacauauccuugauugucccugguaugucagaggccauggacuauaaaggugggauuugaagguggcagcaacguaacucauaucacacugcuuuuaaaaguguauaguuuagguaggacuuuaauaaaucacuuaaagaaauauagguaaaaccuaaaacuuagguuuucguuguuccauauugaauuacaucauguauuaaauuuucuuuuuaauugucccgaacuugauuggaucuuauucuuuaaguaauuaguccauaaggugcacaguuacgcacugauuauucaggcuagggguucuguagcaaaaaguccacuuaucuuaaaagugaaacuccaaucuuuugccugauggauuacucuaaugacagaggaagucugcaguuuuccucuggccagguaaggagguuguaauucuaagcaguuugcuuuccuacacaugauuaagacacccuucccuuugagguuuacccuuucacucuaagguacaacuguuuaucaucuuaggucaaagguuauaaaaagcagucaucaauuagagcuuuauugguuguaauugguaaugcucugaaaggagccagcugaacugaaucugauaauaaaagacucuuugugaaaauauuuaauaaauuaacacucuguccuggaccgggaagcuaauuauaaaggcugagauuguuaaucaugauguuuacuuucuucaaaagcacagacucugcuccguaaucguuagaccucagguuucuuucuuuucuguguuuaaaccccagaggggaugcucuucugugccuccugccuggguauugcugcaggaggaaaugccaagacaaacacagguuauauaggcaucugaaaaauaaacaggacucugccagaacgucagacugcuucugcucuuuuuuagaagggucagaaguuuauguagauucuuuuuguaggcuucugaauauucugaauaaaauaaaaaauggaggccuuugaaaauagugauauuuuuaaugauaaaaaucauuaccagagcaauuacccuuucuucauagcuuauuuucugagauguuuugacauuguuguggcuuuugaaaugcaggcauuuuucugaccccuaaaguagguucccagaauugugugacacauacgcuccugacuccugagugaccuugccggggggaacacucugaauggauuuuuacaucugggaaaggaauguuucuagauuuaagcaauagggggcaucgugggguuguucuuuacacauguuccugcagucugaucuuuagggcaguucuaaugaaagaaacccugcuuugggccugcugugcaaauuagccaucuggugaaguguaauaucccgcugaacaucauuauggggcccuaggaagagugcuccccuuuacagauggacacaaauuaaaaucucccuuuaagguuuuuuuuuccccuuuaaaaaaaaccucugaauaaaccugucuacacuugguugcugugacaguuaaaagaguguuccagcugcaggcaggauggugaaauuacaggcuuugcccaaauggaaauauugcuuccuauagacaggccggaagaacaacgguguggauuuccugucuuccauucaauuccuuuguucuucaucugagugucuuucuguuucucaaucugaggguuauuuucuguuacagugauuaguaaaaaaguuucuuucauauaccauuaccauagaaagaacuggucuguugucauuaugucaugaagaagauauagggucugcccuccuuagcauacuguguauucacauugaccacguguggaggcuuccugauguuauucuucccccuucucuaacacuacacaaacauuauacuauaguuuaagacaugaggaccaguaacuacaugaaauaggugucugugcaugguuguuccuuaagguucauggagccuugucccugccccucugucaaaaauaauguguguagcuuugccuguuaccugcgaauauccuucagacaguauagaucaccuccagauuaaucaugaugucucaaacaaugaaaaucuguauuauuacacuuacuguuuagggacuagugaccaggaaaauagucuauauauguucagugaguuuauuaauauuuaaaggaaauaucuuugcuccccccccacccaagugugugcauacaugccacagugaugugugcuggucucaggacaguuuggcaaucggugcucuucuuccaccaugugggacucuagggaugguacccuggucaucaggcuugaugauaaccagauccaucucaccagccucuuuuccauuuuggaauauuuuugacccauaguuaguugaaacuacagaugcagaacucacauauauggauggcuaguuagcugugguaugcauuuuaucuauauaaagaaggacauccauagaaagguuuucauuugaucuuucuucacaugaucccaacuguccaaugguacauauuuguaaccuguaucugcagaaugugucuuucgaaccugguaaaucugauuuuucugcuccuacauaucuaaacacaaagccucacucauuuguccacauuggauagcaguguuuguguuucuccucugucuaggcaaguauuugaacaccugaagaauucaagcuuuuuaccugugcuuuuauuuuaauuuucaaacauuuauucagugauucugacauuagugugguuggagaauauguauuugagggaagcaaguaggaauaguuuuuggauaaagaugcugaaaguuguuuuccaugagaguucaguaaaauaagcauauacaguacacugcuacuuccuuggagaaguguguguguaugugugugugugugugauauacagguuuccaaaaggacauauuuagaggggagcacaccaaccagugcagaguaacuacauaguuaccaccuguugugacuggauggcuuuuguauucacauuguccauuuuguguuucuuaaguuuucuaaaagucacguuuuacuuuuguaauuaguaacaauuuaaaacaugcuacuguguaaaacacaaauagcaaaaauauuuuuaaaagaagaacaccagcaaaaaguaucaaagugcauuacuuccuagcaaauucuaauguuaaggcugaugauuuguuuuagaggacaaucucaucucuggguauaauguaauacaaaauauuuaaguggaguuugacuuuaguaaguagaauaacaagagaggugaggagcuuaagaguuugagacuguguuccacaaguagcaucauacagacugaauauauuuacauuacauguuacacuuaggaacauauuuauauacaagcaauuaucaucaguaaauaaaaaagaccaugaauuugaaggagaaaagaaaaguauuuaugggagguuuuggagagagggaaggaaggggagagauguugaacucaaauuauaauucuaaacuuauaaacaagauuguacauauuaauaaaagcaaaaauaaacaaaaggaagguaaaaauggaaaaaaaaagaguuugagacugugagagacaaugugggcaggggaucagugagaccuuggucuuagggaaauggccuauuaguuccugggggcuccugucacauuguuaccaguugaucacauucuuucuaaguuauuuauuuacuuuaagauguuucuuuauuuagcucuguuguaucuuagggaguagcugucaguucagggccaucuucaucuacauagugaguucuaggucaggcuagacaacaggagagcuucuguccaaaccacauccucucucuaccccauccaccccucaaaaacgaagagauaucuuacuuaacauacuguuggcuuauuagccaacaacauuauaaugaagcuuuucuaaaacacacgcuuucucuuuaccuuacgucacaagccuucaugagcuuaggaacacuggacaguauuuuaaugcuauagguaagggccauuuuaaagagcagaaucaugaacaaaaagcacaaaaauguagagaaugugacauugaauaggcuaugaaagugauacuuguuuacaguaugaaacugaaacaaaaggcugcauuuugccuuguuugaccuuaacuaggaacauguguauuggacaauuuuaaguuuuagaaauucuaaacauaguugugaaugucuaugaacgaacuaugaguauugauuuuggaguucagcuaacuuuuaacaaguggugaauuugcaaguacagaguucuuacauaaugaagauggacuguauucuuuucccuguguucccugucuguaaaugagaugccaucaaacuacugaccuagguuagagaugcugugugagcuccuucuguuuuuaucaccauuuccacuguccgcuuguucaugugucuucuaaaugcuucucaggauaucugcaccccucaacacuuaccccuuguuggaagcacaggaucuugccauguagcccagcuuggccuugagcucaugauuguccugccugucaggcuucccagugcugggacagcaggccucugugcuguguucugacucaccucuuggaaucccauuuuuccauucuucauucuagucucuagacuuggacuucuaaacuguaaggaauucuuacugucauuacagcuguugacaaagaacuuucuuuguaaacaaggaaauucaccaauugcugcagcuuugucucuauccuuguaccucaucauggagaagagcuucuuuagauucugagaaugugugaugggcuauuuucuuugagucucaguguuacuucuaggaauaguuuuuucucuuuaccuggcucuuccuuuucucacuaguuuuuuuuuuuuuuuuuuuuugauuaguauaaugguuagguaccccucagauguuuucuagcaauaaacuagcuuccccccuugcccucccucaaaccugcagaucuauuagcuguucugaguugggaguugaaaugaagcucucuugguucaccuaguggccuguuucugagcaaggagguacuucaccaguuacccagaguagacuggucaaaugccuacuucuugaauccugccuuuuguuaccaaguugacaaaauuggcagaaggaauaaaauuauuaaaggugaguuaauuaauagcuacuagggaaaauccaacucauuuuuguaaacugggaagccagacuuauuaguuuaguugguccccuuucuguuaaaggaauauuagaaaggaaauuuauaugauuuuuauauagaauuuuauuauauauauucucuaucauuuacuacaaagaaaucaaguuagugccugauagucuaauuagaauggagguuuuccuuaaauuuacaguuaaguguaucuuggcuuuuaagcauguugaauauguaaugucacacuagaauaauaaaggucucucaaggcuauuaaccuuaaaaugaaaagcccuucuguggguauagcacguaguugacauuuaacagcaccacuguccuaugaguuggugacaaguagggaauaacuucggaagaauaauggcagcccccacuuguuacuuaauaauuugaauaauuucuguccucauucacuaguggaugaaaaaagugcugaaauaaccauucuaauauuuaauuucauucuauagauaggaaauacuuguagagagugguaaucacuuuagcaggugaagcuuuuuuuuuguuuguuuuuuguuuuuuuuuuuuuaaauuuuuuuaaggacacaggguuuaauagacaugacccaaaggcaaaguuaaccuugcuauuaucuauauagcuugugaacugaaacugaguuuaacauuuuuaacauuaaaaaaaaguaguauuucaucacaggugaaauuuauauuaauuuguuucaguuucuccaaggaagguuuuggguauaugccacguuucuuuauggauugucuacagcugcuuugacauugcagugggguagguuuuucaguuccagaucagccugaaggagcaauuguaauccucuuuacagaagguauaguuugcccacccccagcuacauuguguuuguguaguugcgauuuacauuaauuuucccaguuugguucaguguagaugauaauauaacaaagaaaucacauggaagagacuucuucagcuuuuuaggaagugggagaaauuguccuagauagaccauugcagugcuuucucuucauugccuaguuuauguuauuuauuuuuuaaaaguaagcacuuauauaaauucuuguuauugacuagacacuguuuuaagagcuuuauagcucguaaguccauguagcugcacaagguugacguguucacaaacgagaaagacacugcacaagcacaggugacagguggagauagauggugagacuucacauacagcagggagacagagcaguuacauugguaggaguggagccacuguugggauguagccaccugggucuaaacccagugcccuggaucucucugggaucucugugcuuguuuaagaagaacauuuuuuacaauggaacaugguauuacaaaacuguaauacaauaaauacaaauauauaaagaaauaauacaaacuuguauuauuuuccuagagcugcuauaauaaaauaccacaaaguauauggcuuauaacaacagaaaauuuguccuuuccugauucuggaagcuugaacuacaaauuuaaagcaucucagagaccacacucccuuuaagacgacaugaagagccaggcagugguggcacaugccuuuaaucccagcacuugggaggcagaggcagguggauuucugaguucgaggacagccagggcuacacagagaaaccuugccucaaaaaacugagagagagaggggggggagagggagggagggagagagagagagagagagagagacugacuacaugaagaguuuauuucuugcuggaaucugugggucccagcaauucuuggugcucugugcuugcaucugcauugacccagcugugcuucugugagcacaugccauucccccugccugugucuuucugaaucuucucuuuugggaauaccagccauagaaaacucaagcucauccuccagcgggcauggucacacaguuggacucaucacaucagaaugauugcuaguuccaucuacagcuucuuccagagguucugggaaagucauagguuugggggaaauacuguucaacccagaacagaacucgugaguguagagcucaugagcgagguauugugagcaccacucauguaugucucccaugagagcugugaauggggcuaaacacaucugucaugucacaguaucgaaagguuggaaacuccugcaugcauuaaacuggaaauugacuacaggaacauugagggauugucucuuuuguuuuuguucugucccuucuugguaaguuucuaucugagaaaaggauuugccaacaucuucucuuaccuuucccacuuucaguugacccucugaucaugaaugauuugaaagcuggcuuucaucugggcauuuuuucuucuggaaugcucuauuuguuuuugaagagacauuuucuugcuuacuauaacauuuuaagguuguuuuuucuucauuuuugugaaguugugguuuuugacucagaaaccagccuuggugugcuauagcuucauuucugaccguguaguaaaggucaccucugucugccuuuuagaguuuugugauuagguucaauaauggucauaguuauuaucuuuucuuugauuaucaucauuaucacuauaguaggcuuugacauauauggaguucuucaaauuccacaccuggagucuauuccaaucuuuucaauuucaaggauaauugguccaauuacauuauuuccucuugcuuauuuuacagggugcccgugaaacauuugagaauuacuaccgaaaacagaggcgaaaacaggcucguuugguacuccagccuccgucuaauaugguaggcucgcuaccugcacucucucuacuuuucccuuuuucuuccugguagcugaguguaugugugaaugcaugcacgcaugcuugccugucuguaugucucucugugucucuguauguauaugccuguacaccugccugcaugugcuugcugucauucugacaaaauuuugaguggaugugccuugaaguaagaauggcagugaacauuucaugacuguugugugacauccauuauucuaaacacuagguauguauccggugaguucauuuccauuauuaacauguggggucaguggcaacaucauuauguuuaccucauauucuaugggauuaagcuuccccagauaaguaacugauuuuuacaucuuaacguaauaacacagaaacaguaauuuugcuuugcuuuguugcagcaugaaacuuuagauggcuacaggaaguauuucaaucaaauuguaggguagguaccuauuuaagauucuauucuugauuuauaagacuuauaaaagauacaccucuccuuggaaaacuuucucuuucccuuuugcuaaauuuuaaagaaaagauguaaaggaacaucuuccugggcaugguaggacacaccugugagccagugcuugaggaggguggcacgggagggccauccugggcuacagagaaauggugucucaaacagacaagaaaggaugaaagggacagcuucauaguuucagcauuauguucucgaaggauacuuuuguacuaaagaguugaauggacuuguagcauuauuauacuugcuauucuguuuuucuauucuuuguuccaucagagagggagauaauuagccauauugacagaauuuuuauagacauuaaaauauuuuaggccuaucaaaauauaggaacuuugucaacuuugugacagucugaaggcagcuguaugauucaguaaucugugaguaaaacuauguuauauuaaaacaaccuuuauugagccgggcgugguggcgcacgccuuuaaucccagcacuugggaggcagaggcaggcggauuucugaguucgaggccagccuggucuacagagugaguuccaggacagccagggcuacagaaaaacccugucucgaaaaaccaaaaaaaaaaaaaaaaccaacaacaaccuuuauuaacagguugcugccagacuaauucaacagcaugcauggcuguucucacuuagaguagacauaguagugugaaguuagguuacuuaauaaagaccuucauauacaagcugcuucauauacaagcagcuuguuccaacuauaugaugacaacuaugguuaaaaaaaauggcaauagaauuugguuguucaauacaccuugccugcacacauccaccuccuuuucuucuuccuucacuuccucucuagauuccccgcucuucuccucccuugcuuucuuucuucagauuuauauugcuuugauguaaagaauaaccucuauuaugcauaucacugaguguugaaggauuuagcuacugcuagaaugcucaccuagcaugcauggguuugauauucaucacugcauaaaaccagguaugguaguacacauauaaucccagcgccgggaaugagggaacuagaggaucaauaguuuaagauuaccuuaggcuacauaggcaguuuauggccagccugagcuucauaagacaugagaucuuguuguguuugauuuuuuuuuugauaauuuaaaaauuccuuaauaaagggaaucuuguuuugauuaaauuuuuuaaaaucuauaauuuuaguguuuauuauaugugucagauuuguuaguuucuugagauguauuguauuuuaaaauauguuuaaaauauacucuauuagcuuuauauaauuucuuuucaauuguuggauuaugugguugacauuaaaagugaaacuucagucuugguaauguaccuaugaagguauuaauaugauuugagacauguuuucaaucucugaaguaauuucauuuaugauaaugaauagcuuuccucacagaaaaaguaacauuccauuugaguuagaugcuagcuguuaaugucaaagcuuaguggucaugauagcaacugugaucucugacaucucuguuuucuuuucuuuucaaucucagcuuuuuugugguugaagaucacauuuugcauacaacccagggcuuagugaauagagccuacauugaugaacugugggaaauggcccuuucaaagaccaucgcagcauugcguacccacucgguaugugggaugccccaagugcuuacuuacagcugacuaucugcauacugucugguguugcacugaauucaagucgacauauauguuuuuggcaacccccauuuggagauuguagaagaaguucauuuagguuucucuguaucacuuagcuuaccuuguuaaacauaucuacaauaagaaacagucacucauaucuguccaugauucucauuguguccagaaguauucuauguauuuccuauaucgguguuacuucauccuaacuuaguacaaagucauguauuaucacugauguauuuuuauguguuucauauucauucauucauucauucauucauucaauuauagcucaugugcuguacacauuuauacauauagauaaaggauugcugucaugaauguuacacucuuugcuucuaguucuacaaucagcccuuccucucggcuuacuuaaauucagaugucuaagcuuuugcuggcuaacugccugcuaagcuuagcuaguaagagacauuagaggcaauauaguagauacauuugcuaaaacuuuuaagaugucauauugucauguuguuggcugcugucauuccuuguccaugauaauccuucacuguucugucccuuauuccaggaauacuacuucauugauacuugcauaacacaagacuucuuuauucuacaaguuuaauuuagugccaauaacaugucucacgaguuuguuacuggcagggcaguuaucuuaaaaucgaacauaaauauuuucaacaacagcaaguaagagcacagaaacucuaaagcucuaaagagaaagucuaucuacuaaaaacuacaagugaaaagcaaggaaagagauggaaaugauugucauugaaaucauaauauuuuuccugaguggcagugaggagguucuggugagcauauccaagaaguucuuggaagcagcuaguacucccugggaaugguacaacugcaguuacagccauugccuguuuugcauaugcucucuucauagcaugaaagaaaauaauggaaagacaccccucaaaaagcugaauccaagauaaaaaugauuccuuggaaauuuaugagcaccagauagagaaauuuaauccaaagaugaagacugugugccauuucaugguugagaagauaaagucaaagucagaaguuuaucuuacagucacaaagaaauggaaaauaugagcagaauagcuaagaaacauggauaguaauggagaccuugucauauagcugacugagauugagaaaaugcauuguccaucaaggugccuauaguuauagagugggaaagugggaaggagucacguagugacagcaagggaacugacagcaaauccugacagacagacauacggacucuucaucaugucuaucacauuaauuaguccuguaaaagguggcuuucauucagaaaguauuuaauggacacaagaauauuuuaaguuucuggcuuuaauauccacugcaaaggaauuaaaugaucauauccaacaaaacaugugaaagaggacauuugggaaaauuagaaacauaacuagaaaacuuaaaacaaggcagcuugaguagguccacuuacguuagcaacccagggaguauaggaaagcuagaucauuacagugcuuugggcaguuuguccauaaggagaagcagucuagaaaacacaaucuuuaaacaagaagauuggggccauuuugcauaaauaucaguuuugacaccaacaaagguccuuauaagagacauuauacauauaguaauaauagaaucugaaaugcaucaucauuauggagaaacugagcauacugccaucagacccugagagguuacaugaagaacaaauaaaguuauuauugaggaaacuagaauaucagaugugauaaaauuuuaaauuaauagcauauauucuuuaauccuccuguggaaacugucuuccaggccaaucaaguaaucagacauuuguaggcgaggccauauauggugcuuauuugaaauuuuuguuuccugcuuauuuuauaucccuuauauuguuuaaugauauuuucuuuauuguauagucagacuuaccuaagaugccuaucucauugaucccauguuuaucuguuuuaagugaucaaaucgucauuccuuuuccaucaccaguuugucacuuuuagcucucuucauuucauuuauuacaugaauaugguuauuuggugucauuugugcaguguuuagucagguuauuuucagucuuguuuuuccggauguuugcacauaaagauauaaauaacauaaaaaauaauaaaauaacauaaaguuauuuugaaaauggcauuagacacauaucauaaauuuugguacaaaguauuuuauuauugcucuuuaaaaaauaaucuuugcauuucaguuuuuaauuuuuuuguauuuuaguuuauuuguuauugugucugcuuaugaugggggcaugcauguguguauguggggaggucagaggacaacuuugcaaccaguucauguguguucaggggauuauauucaagucuucugguuuguguuguugggcaacacauaccuuugacugcugagcuaucuugcuggccccauuuuguauucuucuuuaaccaaagaauuucacaguguguuuccacauguuaaggauauguagaucguucuacugagccccauuuccuuaguucucugauugagccuuugcuaccuugugcuaggaaaugguuagguuccuuuuuagaaaugccuuuacuagcuggugcauuagacaauuuaauaaguaaaacgugauuuuuuuucaugagcuauuuucucccugucucccauuuccuuuaguccuacuguucugauccaaaccucguguuagauuugaagaaccucauuguacucuuugcggacacacuucagguacgugcauuguuaacacccgacuuucuggcguagguccaucagcuuugauucagugugcucuccccugagccuggcuugcuuuguugaguuuuuacuauuuauucuuuuuccuagagcuagaucuuuuuacuucuuuauagcacaugccaugcuuuaucuugaaccuuuaugcucccauauguaagugguccuaccguuuuguuuuguuuuuuucucucagagaaaaaugucuugaaccauuuguagaauuagacauuuaagugauuguaauugcuccauggcacccaugugccuuguaguguguuccacuaccaucuuuauccuugugguuuguuuggaccauguuagagaagcaugagguauuaguguguugguagaggcugcacuuucucucuguucuuggagaauugcugugggcgguaaguuaccauggggagaacucagcugacauuacuauguugcuuuuuauuuugcucauuuccuuuuaugaccuaccuagaaguuuugauaugugucuuugaauuuuuugagaguaagcacuucauauuagguagaaaugaacaauucugcuucaccuuuucauuguuguuuaaauaaugaaauagauuuuagcaccuaaucuuauuuguuuauuugaaaagucucuuuugaaaacaaaucuguuuuccuucagguguaugguuuuccugugaaucagcuuuuugauauguuguuagaaaucagagaccaguacagcgagacucuauugaagaagugggcagggguuuucagguaaggagcugcaguugugcccguguuccuggcuuccccugcccuaugcguaugcuccuuuguggacuucacagauauaaugagcaccaaaagcacauggcuuguaguucuuuuacaugcuccaguuuauaauucagaauucuaaugaaucaaagugacuugcaaaaugaucuuccaaguuuuccuguuucaacauuagugcccgcucugauuggcaagccccacagccuguuugguuuguuugguuuauuuccuuggguaaauggcagauuuauugauucacaccacccagauuaucuugugucuaauuacucuauuuuauaguuuuuggguuuuccugaagaucguacuugguagugggaguuaagccaucaugaauauuagcaccuuaggagaauguuuuauuuuacuggaagucucuugugucacagacugaccuugagcuucugaucucuagcauggaauaggugcagcauucugugcuuucuguggguuucugucugcauuuucauaggaaaguuucugcuuuuggagaacucuuaauguacucaaagagagaauuuauuccuggaaaacauuugcgauugguaaagaagagaaauaacauagcuuagauuauugcuagaaguuauuuuucaucucugacaguuccuaaguuagaauacacugucuagcauacaguuaaaguugugauuaugaucuaauauaucuuaauaaaaugaucagcuccaauagucuuuucucauuuucuucccacuugccuuuaauuuucuucccauuuguaaaucacagacacuagaagucauguuuauaguuuuccaccuuuuucagagcuuaguuucucucugauuucuuuuaaaaaugcccaaaccaaauggcugaauuauggaaaggguguaguaaggacugggcaguguugaugugaggcugaggcaaacauaaucgucaggcugucucagaaacaucucugugucuuaaucacccccuguucucucuuccuguuucuucauuuuuauagaaauauacuugauucugacaacuacagucccauaccaguaacaagugaagagacauauaaaaaagucguaggacaauucccguuucaagauauagaacuggaaaagguaagggacacuuuaaauuaaagcucucuuucugucuuucauuagauuaauuuuucugaaacugagaaauuugaguucaauagauuuuaaaacaccuuuagagaauuccuucugggucuuagagguacagaauugcucauugggaaucgguaaaagacuuugagguucuagcacaucuuuagaauuugucagaucacugggauaauacaauuugauuaaaauuuuaaauucuuaauuuuguuguacuguccaaauaguuucuuuuaaaaccagacauuuaaauaugcuguuugguuauauaauccuauuguuuugauggugcauugagugguuucuccccaccacagguacagugaaaguccuuucuacccaaguccuaugcugcaccugucuagacuuguguuauugucuuuuguuguucacagagucacagacacuuggaaucauauaauuccagggcacagucaucacugagggaagucaggucaggaacucagaguaggaaccuagagguaggagcugauauaguacagcuuacuggcuuacucauucaugauuuguucaacaugcucucuuacccaacccagcaucaccuucucuuacacuacugacacugagcuaggcuugcccacaucagucaucaaucaagaaaaugcccuacauauuugccuauaggccaauuuuauugaugcauuuuucuauuaagauuacuucuugccauaugacccuaguuggcaucaaguugaccuaaaaacuagccaguauaguugacccauuauucuaacuuacaacucuuaugucacacuacaucuuuuagagaagucagggagggaacucaagucaagaauauggaggcugguacugaagcagaagccauggaggacugguuuuuacuggcuuacuuguuauaguuugcuuagccugcuuuuuuauaccuucccacagugagcugggccugaccacaacaaucaugaaccaagaaaugccuugucaacacacuuguccacacacuugucuuauucuuuuuaguaucagaaaucucuuggagacagcuuuuuacauuugauacucuuaagucaauacuuuacaggguaggacaaaggguuuuuugcuguaaggacccagauauagcugucucuugugagacuaugccggggccuagcaaacacagaaguggaugcucacagucagcuauuggaugggucacacggcccccaauggaggagcuagagaaaguacccaaggagcuaaagagaacugcaacccuauauguggaacaacaauaugaacuaaccaguaccccggacggagcucuugucucuaguugcauauguaucaaaagauggccuagucagccaucacuggaaagagaggcccuuuagacuugcaaacuuuauaugccccaguacaggggaacgccagggccaaaaaggggaaguggguggguaggggauuggggggguggguaugggggacuuuugggauagcauuggaaauguaaaugaggaaaauaccuaauuaaaaaaauuaaaaauuaaacacaccacaaaaaaaauaauuuuaagugucuacaauggauuuagugaccugcuuucauuaauuucuugcauuuacagcagccauuucccaaaaaguuuccuuucucugaauuugugccaaaaguuuacaaccagauuaaagaauuuaucuacgccugccugaaguuuucagaagaucuucaucuaagguaugagaccucccagugcugagauuguuacucucuaaauacauacucuggaaagucuuugcuaugaguuuggaacuuuggaauaggcuuucacuguuaugguaaaagggaaacgcuuuugaaugacauaaguauauauuacauuuuaaacaguaucagcgaaaaguuacuggaaauuauaguuuaaccuacucacuuuaccauuccauucuacgugaugaaaguuuacagugagaaugggguaguaacagucuuuggaaucaguauuguugcucugcucugugucugucuuaagcacagacuucuuugugugcucauuuguugcuuuagucuacauguauuuucgaaaauguguaguugggugcuccuuaguaguaaagacauuaagaagcuaaaaggaaggccuuuaucuuccugaggacgcagacagcuggaggucagugcugcagaaauucaggguaugcacagcagccacacugcucagacuaacagugccugaagaggcucaacgcuauaucugaacuugcaccugauaaaguuacaaaaagaaucagugaacagaaucuauugugugucaagccuuucugaaaaugaguccaguuaggagugggguugagucacuucuuuauugacuaccauagcuugagcauaggucuuccagugugcuaggcaagugcccucccacugagcuacuccccagcccugguuacuuucagauggggagacaagaucuugcauaguugcucagcauagcuuugagucucaucuguagccuccacaggccuugaaguuucuaucuucuuacauuggucuccugcauaguugucaauuaauuaucuuucuucuuguuaaaauuauaaaucuugggaugguacaauuaauuuucccaucuaaaaccaagauuaauuuuauagaaaaguccuuuugaaaucagauuacuuuugaaaggcaaacaccaauacauuguuuuccuuagcuuccacuccauguuugaaugcucauagccuccccugccacacacagcauaauggucagauaaccucaugucagaggucagucuguaaggucuuauuauguuugcuacugccaggaaaugauuucaagccaauugcaaaauggccucuacucauuuacuuuuauuuugguggggagguaauauugggauaaugugggaaaauuacuuagauagguuucuucuuauuugaaucuuaaguuuuugaaugaaacuuuuuucuuacuuaauguaagaguguucuuucuguuucugucucugucucucucucuguuuuuguuuugcaaguugaucuguguuuauuaaguuuuugaucccaaacuuccuuugguggguuucauuuugauaguuuaaaugaaauauuuccucaacuugagggagguuuuucacuugccuuuuauuacuggguugauauugccuucuaccucagaauauauuuaucuugugacuuggagucaaagauuacuucuucuauuagagcugucucagaauagacauauuugucaagaagguaauguguauaacaauaguucucucaaacaaaguaucacauagucagagaaauguuagcuggagauuucuuaugcaacuuuaaaaauaauauuuuuuuuuucugaaugaauaguuugucucgcagcagacaauguugaaagaccuguagcuauuuugaaaguucuuaucaauagcagggucuccuauaauaaaaugauacucugauauuuaaguaaaaguucagugcacacauagauuuuauuuuucuacacauugugaaaaauaaaucuuuguaaagaauuuuggauuguuuuugcuuucuaagcuuuaaaaaaaaagaaagaaaagaguuuggaggcuauauugcuggguaaguuccucaauugcugaauauuucuuaggcaacuuagaaaacagagagaaaaaguaucuuaagagaaauuaaaguuacugugaaauaaccccuuaccucagucuaaauagcaaucacugagaaauccagcaauaaauguuggagaagauugcuggugggguguaaauuaauauagccauuaugaacaucaauuugaaguugcaucaaaaaguuaaaaauaaagcuaccaugugaccuuuauuuaugcuggagaacuuaucucugugauaagauuguuacagagauauuuauacacccguguucauuguggcucuguucacuauugcaagagaauggaaccagcuuaaaugccagucaaugcaugaauuguuaauaaagaccuaguacauaugaaauagaauacuauuaagcucuagggaaaaauaaaaucucuaaauugccaaaaauggaucuauuuagaauacuuaauuuuuuauugguuauuuuauuuauuuacauuucaaagcaaggucacucaaucucagaaauaaaaaucccuuauguuuucccuuauauacagauuauagccuguaacguuacauucauaauuugcaaauaaauacauguguguaguuuaacauguagaagauagacuaagcagauaguuuuagaugaugauguagaugaaccaaugcaguuaaagagaauagguguauguguguauuggauaaguccauaaaaauauaauugauacugaaaguauaaaaucuaacaugacauuccacaguuucagaauggcuccuuuucugaaauaguacaaguuugccugcacuucuuaaaguauucaaaugugaacaaauaaucuaggcagaguucuauugauaguuuguuuuaaaugaaagaagcaucauaaacuuuuaacagaucagagugcuaagguguuaaaacacuuggaauacgucuugucauguaguacguauuagguacugcuccuuucaccacugccucugcugcugcuaauccucuacaacuguuacuccugcaagacugcuggugucugcucauuugccagcucuaguuucccaggcuguaacugggcucaucauuuacauuucagcuccacugaagucgaugacaugauccguaagucuacaaacuuguugcugaccaggacucugagcaacucucugcagaacgucauuaagaggaagaacauuggccuuacugagguaaaguagcucuuacugaaggugaccaugccacauguccugcucaugcacuuugccugccuccauuauuggugccaggggucuuagcacuuguguuccuuggcccauguuagucuuccuuggcuuuuauugguuucaaugccuucugaauaugauugguaaauugcucuaucacuauguuacuuguuuagcaaaagccuagugauugguguuugaggcuggaaagaggaagguaauggcuuccugcuucuccuaguaaagggagagauuuccuuccacucaguuguggcauauuauauacugaagguuugacuuacugauagcuaguccuaaaauucagaaauuuaugagacucucuuuuuuuggaauuaagaauuucauggucacaucucaccuuacauucacugaagauauuguguccaaagugaguuuagguuagggaaaguuuuucuucaggaggaagacugaaggcugaguuccuuguagagcuaauguagauucacuguuagcuccucuaagaauaaagaacguuucuaacugcauaaagccgaggaugauggugaaauucagcaaaugguuaaugguaccaauccauaccaaagacaacuguaaggcagaugaacauuggcauggagacuuccauucucugcacugagauaaagagcacuaugaaauauggcauggugauuaugggauuauccuuguaauguuuguaagaguugaaaguccauauagcuuuaggguucuuuuuuauucuucuguguuugcuuucuauugcuuggaauagcauuggcauggauugacuuucuucaucugaaaauggccuagcuuuuugccuuaaccagguagccuccaaacaaggauaaccgggaguaggagucagcaacucuuccacugucauuagauuguauuguuuucuuucugaaucucaauugggaaaguuuauacuugucaacucugucuucauagugauucuuuucccagaaucaguugauuuaauuaucuuguuccaacauuuuuaguucugguuaggacuggguugguguuauagaacacucaagugacaagaacauauugaaaauauacaacucagcguccuccuucagcaugucaaucaaucagaguuuaaaacuccacauaagcuauacucaccagucugccuuaucuugcuuuuggacaacaugauacugcuccuguccguccuuaugcucuuuuccuguucucuuuucucucuggaccugcuugcugcuuucauggcaucuuugaugccacuuguugcauacuaccauuuagcuguagcuccugcuagcccuugcugucucagagccugggugauaccuaguuggcucggcaggugugugaccugcugcuuucaagucuuuugaaaaagcaacugauggcugugcaugcgcgccuuuacccagacuuccuggcuucuagugcugccccucugcuuaauagugucuuccuaggaaauggcugaguuuuauguuuaaauggggacaauggcaucgcauguuucauuggguuguuucaggauuaagugagcauaguguuugggccauagagaauagcaguacauguugguuguuguuacuaaucauucugggcaugcaaacagugcuagucaggucuaguggguuguuugucuguuuguuuuaauugggagaaaccaaaagauuugaacaagauguccuacuaugacuuaucaaauguguugauaucaagauuuauucucaguuacugaguacauauuauaaauaguacaguacuauuuauuauuuggaauguacuguauuuuguguccauauugagcuuaauaucucuguuuuaagcuaguggauaaagcuuuuugagccuguagggaugagagagauaaaaucccuuauagucuuagguuaauucauucuuaugaaugagacuaguguugcuguugcuuuuuguuuuuuggcacguuacagauuuugcagcugggagccaucaaacuaugugacuuuucaccuuauagcuuugggucaacucaagaaauuucagggugguaaauucucugcuucuagaaacaagacaaaagcaaauuuaagagaaauagaugcauauaguaauuuauaguugagaacuaaaacccguuuaacuguagggcugaugcuauuuaagaugauggccacauuucuuuucugaaguuguacagaauagaguaccugacauaguaccuuggguggcuuggggauauauaggaagaucuggggcagugguccccacagggcucucugacugcgugacugugguccccacagggcacucucucacacuuauucucauaccagcaaggauaaauggaaaaacuucuugcuccuagugggauuugauuuguuuauuuauuuucuuugaguaaaguuuuuuuguuguuggugguggguuuuuguuuguuuuuuguuuuguuuguuuguuuuuggagauagggccuugcaauguuaucaaagcuagacccaaagucucagguuucaugcuucaggcuccugauugacuauuacuaaagugacuucugucauuuuguuuuaagaguugcuguuuacacuguauuauuuuucuuugcuagauugcuugcauaggacuucauaucagcaguaaugaaugucuagucuauuguuaauucuguguccuugaaacagugucuagggaaguuuggcaugugaguuggguuuaaugaugccauggaaggagcucagacucugaugauagucuguaucucagcugcucguuucaucguucaaagugagucuccaaagccucucccuuacgaggguuuugauacuguuguucaggaguggagcucaucagaccucguuaacaggcaguauuuccucugaaaaugacauggcauguguuauaauccuggaauguuuuaauagucuauucuaugcuuggcagugaaacacuugaggagugacugacagcccacucaugcaauucauggugaucucuuguguugacagaucuuuuuaaagucgugauaaauuacuacugugcccagcguaaccgccuccuuuuacauuuuuuuaaacugccaaaauccugcaaaacagaacaauuuucuuuuugacugccacuguuuuuuuuuuuuuaauuucuaccacaugacaugauuccucuuauuauuagaauuucuuuugaucgacagaauguguuccuuauagguaaugcugauuuuaaaauggaagucucuaguucuccaauuuaacucccuuccauuucugacuuuuacaucaagacaaccuugccaccauccaccuuucaucccuuucaucccuccugaaggacauuuggaagcuaauguuuuucaggggaggggugccauuuucuuuaguuauauaaauaccaauaaguugcccuugcuccagcuccucccacguaaccugguaagaaauacuaauuaaacucaguggguaaaggaaaagauguggaagugggugguuaggagcuucuuggaaggaagggguccaguuaaagaaggggauggugggauugaaggagugaaaauuccuaagauauguaauuaugugaaauucaaacaacuuacuaagauuuuuagaggaaagauuugauuuagauuuauuuuauuuuauuuuuauuauuauauguaaguacacuguagcugucuucagauagaccagaagagggugucaugucucacuacagaugguugugaaccaccauguguuugcugggaauugaacucaggaccuucggaagagcagucaaugcucuuacccacugagccaucucaccagcccuagaugguuuuuauguuagugugauuuuuguucuuuaaaagagagcaggauuccaagcauauauaucccccaccacugagccacaccuguagcuccagagugagacucuguuuaaggaucuuuuguauaagaagagggaaacucuaauaauaacaaaguauguaaugaucauagugacuuucuggcuuagaaguuauuauguacauuuuguaucugagcaaacagacugagaacauugggaaaacuuuugucaagaccaaggauuuuguuuucucugccuucuuuguucaaguucuuucucuuaggaacuaagggagcuucaccaucaaggcuaacauguccauguuccucagaccuaauucuaaaauuaucuccugcuuuuuccacuaugcuuuuuguuuuacugaauguugacccauuugauucauuugauaaucauguuucuuuugucgggccuaugauuuagacugggagcuuugguuuuguuuuguuuuguuuucagauaggccuugucuguguagcccucucucuuuauaccaggcuggccuccaacucacagguccaccugccucugccuccgagugcuggcuuaaaggugugugccaccaccacuugaguuuagucuuuuuuaaaauaaaugaauauauuuacaagugucacuuuaaaugggagaaauagauguuccuggagguuugggguauuuuuuuuggggggggggggcuuccuguaagauagccuagacagcaaccugcugacagcucagguacauucugagccaucaccccugggugaauuccugaaugagcaaugugugugcuuacuguuuuguagcuuguccagauuaucaucaauacaacacacuuggagaaguccuguaaauaccuggaggaauucaucaccaauaucacuaauguccuuccagagacgguccauaccaccaagcuuuaugguaccacaacuuucaaggugagaacacaucagcauagaggggguacccagugacagugcauggacacagucugggcaguuucaucaguggcuuuguuucaauaggaugauuugugaaaguauuuuggaguaaggaagaguuugguuuggucuccauuuuucuagaaaacacgagggugauauguguguguucaaaauaaccacgauauuucaacaacauuaucaggauagugugguuauagcugacaugaauuuuaacuguaauguuuauuugguaacucuucuuuccaugucuugcuuuuuaaaaaauguuugagugacagauccuuacucccaauaguuagauauuuuuuuuaauuuuaagcccacagcacuauuuauuacugucagagaaaaacaacaucuuuauagaacaaaggaaagauuagugguagauaaguuucugaagcauaaacacucacucuuaaaggaauuucaugagucuuaauaaaauccuguacauuaauuaucaugugaaaauuuucauggauauuaaucagaaaaauauugcaguuuuaaacaaaaaagagugaauuugauauauaaaugaaccucaguggagacaaggcuggguguguagcucuggcuugucugaaauucuguauagaccaagcuggcuucaaacucacagagauucugcuugccuccucuuucugaauagcuggguguuaaaggacagcaccgcacaccaggcaugguuugaauuuuguuguuauguuauugcuguaguuuuuagacauguucugugacagucaaaaaucuaaaaauggugacaacuagacacaugaguagaguuuuaaccaugacuuaugucccuugguguuuccuuuuuccuauccuuuauccuuucuguuuguggugccaucucuuaaaaauaaccaccaaagaagaaaccagauuugauccauuuggugauuacagugugugaaagagaggcuuuuagaagagcuuaacuguaagaaauauauguaauguuaugggcagcugguuucaguccucacagguaaucuacauacauccucccagaaacuuagaucaucuguauuacuuacagcacuuugacaauguaagugaugguaucaccacacuguauugcuuauggaauaauggcaagacuguaauuaugcacaacuucaguaugagcccuguuuuuuauuuugaauaguuucaaacuacuuuugguugaauucagacauaaggaaucuagagaagcauaacacugccgacauuaauacugaugcguuuuuagagaagauucagcuaauaaagaggccuccagagggaguguggaaaugugauaagcucucagagcuucagaguaacccaggcauuauaguaagaaucaaaaacuguucuuacauguuugccaggccccggcauagccucacaagagacagcuguaucaggguccuuuaugccaaaucuugcugguguaugcaauggugucagaguuuggaggcugauuaugggauggaucccugaggauggcagucucuagaugguccauccuuucgucucaacuccaaacucuguaacuccuuccgugaguguuuuguucccaauuuuaagaaggggcaaaguguccacacuuuggucuucguucuucuugacuuucauguguuuugcaaauuguaucuuguguauucuaagucucugggcuaauauccacuuaucaaugaguacauaucaugugaguucuuuacagaaguggaugcucacagucagcuauuggauggaacauggggcccccaauggaggagcuagagaaaguacccaaggagcuaaaggggucugcaacccuauagguggaacaacaauaugaacuaaccaguacccccggagcucgugucucuagcugcauauguaucagaagauugccuagucagccaucauugggaagagacgccccuuggucuugcaaacuuuauauuccucaguacgggggaaugccagggccaggaagugggaguggguggguaggggagcgggugggggagggucugggggacuuuugggauagcauuugaaauauaaaugaagaaaauaccuaauuaaaaaguaaauuaaaaaauuuguucuuacaugguaguauucuuagaauguggauagugaugucacuggaaaaagguguuuuugcucuauuguaaaaacuaaaauuuguuucaauacacgaguaacuaucauucaguguuagacagagaauaagguauugcuaaauuacauuaugagauucaguagacugucuuccagagggagaauaugcuggaucaacuaauucucucucuuuaaccugucucauuuguaaaaucucccacuauguuuugaaauuuguuuuuaaguauccaugguacuguguuguucugggauuuagaaaggaaguuuugauuuguuuuugagauagugucucauaugcuaacccagguuauccuaaaacucacuaugguaaguccaggcuggccucagauuguaggccuggaugcuaccuucugaaugcugggaguacauaugugagcucccauggccagcuugcucuagcauuuagaaugcugaggggaauggagggcaggcugaaagccugggugcugagcagccagccucuuagauucugagcagaggagcagcacaggggacacuaaaggucauguuugauuuugauaggaaacauugauuccucaaagcaugcugaaagcuucucuuuaccagggcaagccaacccagaauucagaguaaacagggcagcuaggcaagcuccauguuguguguuuuccuaagcuacuguuuccugaaaccuuucccuugcagauggaaaccuuuaugcuggaaaagaggcagacacauucagaaggucuucaagguguuuucugacagaguucccucuuguuucuucugccaugagugacauaauccagcuggcauguuuggcuuucccugcucauaagguuccucugucuuuuuaaaaauagaguccaaagcuauuuaguaauucacuucaucauaaguacuguuucuauaucuauugugugacaaucugauaugacagagaaagaaggggagugcccuagaugaugucaauccauugucuagcuagcagauuuuaauaaagcagguguguaucugguagucuuuuaagacugaacaaaauaagucucucuugguuuuauggagcuuauauacuaaugaacugauagcugauaagaagauuugcuagagccaugaacuggggugggggacuggggugaugaccccgaaaucauauucaaacccagaaucauuuagauuucuguagaugugcauucccacuaaagaggauaauaagacaguggacuugugcacauucaggugugguaaggggucuccuuagcaguguugucaguguccgccccuguaggacauaaugcuguaguucuuauucugaaguuugauacgaaguuuuuaauauggggcuguggcauggugcucugauuuaucuuugaauguaauaaugguuguccugucacuguaaauuaguacuuguggaaggugguaugguaguuagguuggaggccauggaaauauccaggugaacaguaaugcucauguggaguaguagacuuagaaguagagaaauggcuugaagacagaaagggcagguuuuuaaaagaaagaaaguaaccaaagguaauucuaagauuuuugaacugagugaacucuugaaugguaguaauagucgccgagaaaggggauaucauuuaaaaauuaaaaaaaaaacagauuuuuuaauuagguauuuucuucauuuacauuucaaaugcuaccccaaaaguccccuauauucucccucugcccugcuccccaacccacccacuccugcuuucuggcuguggcauuccccuguacuggggcauauauucuuugcaagaccaauaggccucucuucccaaugauggcugacuaggccauccucugcuacauaugcagcuagagacaugagcucaaggggguacugguuaguucauauuguuguuccuccucuaggguuacagcuccuuggguacuuucucuagcuccuccauugggggcccuguguuccauccaauaaaugacugugagcauccacuucuguauuugccaggcacuggcauagccucacuagagacagcuauaucagggucaugucagcaaaaucuugcuguccuauuaaaauuuuaaugaaaauauaauuauaucauuucaccuccacuuuccuuccuccuguuucucccaugugcaucccacccccaaauucauguccucuucuucuuuagcuauuauuguacacacacacacacacacacacacacacacacacacacacacacacacacacaaaugcuuaucaugccgauucuguuaguguugccuaccuguuucuagggcugacugcuugguuuuugauaaccacuuagaaggcucaucccuagggaagacuaauucugccuuagcaguuacuaguugcuuguuggucuuagaguuagggguugggcccaugaaauuuccccccaaagcagugggaugccagcuagucuuagaauuauucaggucuuguuuaggcagccauuuuguugagauaucauggauguaccuucccugccauaagaggaaggcacauaaguccccagcagaguuccuggucuucugguucuuagaaucuuuuugccccccacucccaaagcuuuagcaggacuugggguuggggacucuauggucaguucucugcauuuugacuaguugcggacuucuguaauggucuacuauuguaaaaaacaagcuuuuuugaugaggaaugugagcuauacuuaucuguagguauaggaauauguauuuaggaugcaguuauggauuaauaguaguuuaguaaaaucguaguaguauuaaguucucauccaagauuuauaaacauacuagucacguauaguuggccauguucacaguaccacgcaugauugcgcuccuguuuagugggccuaaauccaauuagauuguuguuaguuaccggcaauauuucaucuuuagggagaccuugccaucuugaauauagcuuugguucauagaugucauugcuggguagguacugauugcuuccauaucauccucugauacuaugaaacaccagagaacaucuuuuguuucuacagagaagagaauaagaguuuugaggaaugaugaguuuaaaaugcauacuugacuagugcuagaaaauuacuuaaaauuaucucuugcuuucaaguagcuaaugagagagauguaaguauuuggagagauuaugaaugaauauuuucuguguagauaucaguuuauaguaaauucguauuuguaaguuagaaguucaggaaacagaaauaaguauggcuaccauugaacucaaugacacaaucaaccagcugauaacuaacauuuauagggaauguugucuagcaggaccagagcacuaauuacucccaaguucugucugucugucugucugucugucugucugucugucugucuauaugcaugugaaugcacguauucucauaggccagaagagagcacuggaaucccuggagcuggaguuacagaucuuccuggcaugguucuuagaaugaacucucguucucaugaaaaguagcaagugcuccuaaccacugagucaucucccacugccaaaagagguuuauuucagcuuaucauuugggagguuucaguccuuaauccauuggcauaagugcuuuggccuuguggccuggcaugacacauauauagagugcaagaauuuggggaagaggcucaguguggccagaacgaaaauaauagauggugcaggaaggauccauggucuucauaucgucuucaaaauauaugcauccaaugauguaauuucuucucaguaauuccaucuccucaagauuuugccuuucugccgccauauccucaagaucaaggaccaaacauuuaacaugaggcuuggagaagauuuguguuaugaauggucuaucauuacucauauuuggcuaaguagauaaucugaauaucuuuaccucuuccagaaacuggguaaauaauugauagccuuauaauauugaacauagcugggugaaaugggcucauuggugaauucugugaaaaauuaagcaugauauuauacccauuuuuucuaauguuuuucuagaaaguuauagcagagaauccuaucaguuucauuuuaugagauccaguuguuauggauaugaacaaaaccuuccuaaaccagcaaguguguuguggcuaagggugacuucuuguaguuccacaaaucuggaucagcacuuagacagcauguggugagagucaucauauaaaacagacccaaaaaaagagcuauaguaguaggugaagaaaaagccauuuaagcuaaauucucaacaaaccaaaaucaaaacagagauggggacacuuccucaaccuuauuaaaaauaucuauaaaacucccacagauaucagcacauuuaauggugagaaaccagauguuuuacugcuaagacuaugagcaagaaagcagagauucccucuuuuaccacuucucugcagcaucuguuaacacaagaugagaacuguguggagaggaaaagaagaaauaaagcuguuucuaaauaacaugagcaacuguagaaaaucuuagggaacuaacagaauaaugaaaagaacugauuacauuaagguucaggauauaggcuagcauaaaagccagcucccuuucuucauauuuguagugaccaacuagaauuugaaaaacaacagucacaauucuauuuauauuaauaaucagaaguaaaacuauaguacauaauuauuaguauaacaaaauagaauuucuauauguugaaaacuauaaaacucugaugaaagauacaggugaucuaaguauuuucuauuuaugacugagaggacaaugcuauccaucuugguuuuuguuaaaaaauauuuauuuacuccauucuguuucagaaucucagcaaauuauuuugugggucuuuaauguaaauguggaaagacaaaacacacagaauagcuaacaguguuguaaauaacaguguuguaacagaauaagacuaacauaaaacuacuaaauuuagaggacugaguauuugaauuaaugccuuacuguaaaugaagaugcagaaauauaauuuuagucagaaacagucaaguagaucgauaaaguagacuucuuacucagaaacuaggcauguacauagguauucaacugaucaguuagaaagauaaaagacaauguaacagagaauggaguagaguuuccuuuucaccaaaugaugcugggcaucugugaaaacagcaaaaacucaugaaucucagaugcuaaauuuacaucuaucauuuacauuaauugaacauguaaaguccgaacauaaaaugcacaauucccuuugcagagagcuuaagacaaagcauggaugucuuugcauuuggcaguggcuuuuuuucuuacaguuuuauuuuaauuauuuuuauuuauaagugugugugugugugugugugugugugugugugcgcgcgcgcauguguguguguaucucacugugugaguguguugcugugugagugaaugccacacagcuguauacaccuuugggggcuagaauugagugucaggugcccaagagcugggguuaaagaugguuguggauacugcaaaccaacucauauccucuggacaaucagccaguacaaagccuucuuugcagucccauguuuaaugacuuucuagauacaauaaagauaaauuagauuucauuaauaaugaaaccuuuuuagcuggauuuacaagugcaugaguauaaucccagcauuccagaagccagugcuuugagcuucaggccuucuuggguuccaucaugauugugagacugccuuuauauuccuaccaucucaaauaagacuaacauaaaacuaguaaagguaugcucugagaaagacacuguuuagagaaaaaggcaacacaaauucuuaauaaagaacuuguaucuaaaguacagaaauaaugaaacaauuuuacuugagacuuuaguaaacuaguguguaaaugugucuugugcacagggcaacacaaauacaugugaccuaggaaguguuuagugcguuuugacauccuuuuuaggauugugcuguacauaacauaucuuauggcacaaguguauuagccuugagcaagccuuaugauggagacagcauagggcuuggcagucaccagugagagcuuauuaagcuauaaggugggcauauuuaccagcagcugaaggaacuggaggauguaggaagcuugggaauguagaaaggagccuuuuggagucacacagagagucaaaagggaaucagauucuuagagucaauuuacuuuuuaauagaaaugagaaaauaaaaggaaauaggcuacagggugugugugugugugugugugugugugugugugugugugugugaauagauuuuccuuauuugguaaagaaaaagaauagcaauagcuuuuccugaagaucauucaaccuuccccucaaaagauggagggagacagugaucacauuuuaaaaaauugauuaggaaagguuccuuugugcuuuguaaaagagaagugauccuggaagcugaugccauucaacagucagagcuguguuccuaagugggcauagaugugugguggcucuaugacauacguguuugccuuuuucaccccagccauaucaauguguuuuuaaauuuaaauaucauuucccaggaugcuagacaugcagcugaagaagagauauauacaaaccuaaaucagaagauugaccaguuucugcagcuggcugacuacgacuggaugacuggagaccuagacaacaaagccagugauuaccugguagaccucauugccuuccuccggagcaccuuugcuguguucacacaccuuccuguaagugauaguucuucuauucuucccuucaaaguaggaaauccaugccuuacacuauagcuuuacuaaaguucucauuucugauuuaaguugccagcaaccucuuuaauguccaaaaagcaccugcuggcuauauaaaucccuacauggauuuugaggccucccauaucauuuguuuucaaagauuucugcaguuugucuauagucuuaggucuuccuucaaaguucaaagucauuaguauuggccaugacagauaccuuguaaagaguauaaagagacuugccaguuaacauuuaaagucuguuucuuuuaguuuuagaacaucuuuugauuuuuuuuaugaguugaaauucuuugaucaaccuuccuaucuuuuuaucuaguuuguaguuguuuucuugauuauauuagucacaauuauuucagguuaugucuauuuaacuuauuauuuauguaccuauugauggauuugauuuuuuagugaaauguucauguuucuuucuaguauuuuuguuuguuagacauuguauuuaaacugcauagauucugaugucuaaugaaauccuucuuucuaguuauauucgcucuuuaucuuaaugaguaaguauguggggugaucaguuguauuugggcuaauccuuagucauaggugauuagguuguaauuguuaaguacuuuuaaucaucccuguugcuaguuaagauaccauaggacauugauuagaguaggccuaucauugucuucagcaccaaagauaacuguagaaauuucugccuuuuagucuucuaccuucuucagauagauagagaagcaguguuagcaguaggcugauuuaaaaaaaaaaaaaaaaaaaaaaacuuaaaaucuacaacaaaaaccaaaaaaaucggccuguaagcuguaggugucuguguaacacuccccagccuuuuagcuuguccuaucuucugaguguuuguauauaccucgaauucuuauguuggaccuaauuaccccugugauggcaggaaauggccccugaaggugauggccuugggcaggggcuuucaugaauaaaucuagagaucuuucuguuucuucugccauaauaaaaugccucaggaguacaucuauuccaaaguugcaaaugagccccugaccaacaccaaaccuguuaucaacggcaucuuguauuucccagguuccauuacuggcagagauaacauucuguuguucaugagcuuccuggucaugccauucuugcuauugggaaacuaccuggucuguguuguuuucauacccuaacucaaauggauuuaaaaagcagccuacgagagauucauacacauuuguccucugcugagucucuaugucugagccacugugagacuuuggagaaaccucacucugucuuucaaagguuuggcauaaaccuuuauuuuccugaguggcuaagcuuuagaauucaacagaugcuguaauggaaagcuugguucucagaucucuaauuuuaacacucuagcccuuugaaauaaagaaaaauugucuuagcucuguaauaacuauccucuuccuuggaccccgagaccugauucugguucucucuuuauugccuaugcugggguuuggccagcgcugccaaggacagcuggugacccucagaugacuuuuaaaagguucugccuuuucuauaauuuuacuccuuuuaguugucuuuguucauagucuucugauaucuuuaaagaaaaaaaaaaaaaccugugguuuuuacuucuaguugugcuuaguaggaggauugaguugcagaaaauuauacuguuuuaucacacuucgcucuaauaacaagacaaggcaaagcuaccacaguaacacaaacaagccaaauacaccagcacuggagagcugggagguggcucagagcacgcgcugccccugcagagcaccuggguuugcuuccuagugcccacauguugcuuuacaaccaucugugcuagcuucuggcuucugugcccuaggaacacauguaaugcacuuacaugcaugcaggcaaagcacuuguaaacauagcauauaaauaaguaaaucuuuaaaaaauacaaagccagcucacaauuauggguaaaaauugaugacaauugaaagucaauuauaaguguuguaagaaagaaaccuagugaguacuauauaggauuuauuauagaaaugcaaggaugguuccagauuuuaaaaaaaaaaaucucuuaauauuugaccuucucaauagcuguaaaugaaagaaaacuaucuuggaguauuuuauaaagacauuauauaacauacacucuccauuccugauuuaaaaacaaaauucaguaaaauauaaguaaaauacuguuuuaauaauaggauuaaacauacuuauuuaaaauuuagcagguacuauaaauuuaacaggguuauacuaaacaccugaauuuauauuaacaucagguuacaaauucuuauuaucaucauuuauuuauuuaaaaaguuuuauuaaauaaguaaaguuuccuaagaacaaauuauaauuguaguaauuggacauguuuccucauuauuuuuauacugcuguaacauaucugaguaaauugugagaggcagacauuucuuucuauguacacuuauuaaauaguuaguagagauaaugugaagaaccccucauagaguagcauacaaguauaccaggaugggaauauuuugaaguuuugagaaccuuuucaagacuaaucaaauuaguaugaaugccaggugaauuucauaagaaaauguauuaauuaaguaauucuaaaaucaacacuaaagcaaaauuagacacuauuuacuaaaaauguaaaaauuaaguauugucuuuaccuacuagauccaaaauucuuuuuuuuaauuuauuacauauuuuccucaauuacauuuccaaugcuaucccaaaagucccccauacccucccccccacuucccuacccacccauucccauuuuuuuggcccuggcguuccccuguacuggggcauauaaaguuuauguguccaaugggccucucuuuccagugauggcugacuaggccaucuuuugauacauauguagcuagagucaagagcuccgggguacugguuaguucauaauguuguuccaucuauaggguugaaggucccuuuagcuccuuggguacuuucucuagcuccuccauugggggcccugugauccauccaauagcugacugugagcauccacuucuguguuugcuaggccccggcauagucucacaagagacagcuauaucuggguccuuucaacaaaaucuugcuaguguaugcaauggugucaucguuuggaagcugauuaugggguggaucccuggauauggcagucucuagaugguccauccuuuugucacagcuccaaacuuugucucuguaacuccuuccauggguguuuuguuccuauuucuaagaaggggcacaguguccacacuuuggucuucauucuucuagaguuucaugcauuuggcaaauuguaucuuauaucuuggguauccuaaguuuugggcuaauauccacuuaucagugauauugugugaguuccuuugugauuggguuaccucacucaggaugaugcccuccagguccauccauuugccuaggaauuucauaaauucauucauuuuaauagcugaguaguacuccauuguguaaauguaccacauuuucuguauccauuccucuguugaggggcaucuggguucuuuccagcuucugacuauuauaaauaaggcugcuaugaacauaguggagcauguguccuucuuacugguuggcacaucuuuuggauauaugcccagaagagcuauugcuggauccuccaguaguacuauguccaauuuucugaggaaccgccagacugauuuccagagugguuguacaagcuugcaaucccaccaacaauggaggaguguuucucuuucuccacauccucgccagcaucuucugucaccugaauuuuuuucuuagccauucugacuggugugagguagaaucucaggguuguuuugauuugcauuucccuguugauuaaggauguugaacauuuuuucagguguuucucugccauucgguauuccucaggugagaauucuuuguucaauucugagccccauuuuuuaaugggguuauuugauuuucuggaguccacccucuucaguucuuuauauauauuggauauuaguccccuaucugauuuaggauagguaaagauccuuucccaaucuguugguggucuuuuugucuuauugacaguaucuuuugccuugcagaagcuuuggaguuucauuaggucccauuugucaauucucgaucuuacagcacaagccauugcuguucuauucaggaauuuuuccccuaugcaagucauuugauguccuuuuaauguuggugcuguagguagguaauacuuagaaauacauuuaucuccagaauuuucugucuuuuagagguaauuuuauauuuauuuaacacuuuauuaaaaaugaauuacaaauagaauuaaauauaaaaaauagcacuuuauugaaaauagauuuuuuaaaguguacuuuauauucuuuguuccuuuggcuuuguguggugauggaugugaguggauuguacaguggaucuuccauaaggaagaggugcagagucaaaggucuuugaagaugugcaaggauugcucugcuauauaaguacugcucacacucauccccugccuggaaagcaguucuccaggugcucugccagguacuguguggcacagugagccgcgcccugacaccagcucccguagcugcucaucaugcugcacuagguuuauuguaacuuccaggacagucguuuaacccaaaaugcauuauuuuagcacugauaucaugauuguucguaaguuacccccuuauugucaauucuaagaaagguuuuuguaaacguuguguaccaucucauuguguguugaucugauuguaaauuucagguuacugcuucauuuuaccauguauuguccagaaucaagguaggauaggauuuaaaaauauccuaaacccucaggauugugaccauaaauaucauauaucugucuugucuaaaauaaauaaauaaauaaagauugcuucuaaucugcauauauuaacucauauaauaagcuucagugugacauuuuuauacuagcugcauuauaagauaaugucuuugagagguguguguguaugugugugcaguuggguaacacacagugugacuaauuauacucauauauacucaaaaaugcauuauaugaauuuuugagauguuuaaggcugugccuacacauaucauaacuauuacuagauuuuuuuuucuugaagucuucgugaccaauguaccuugccaguuuucaugagauauucugaaugaccaucauaguguuuuccaggucauaguauuuaccuauuaucauguaccuuugggacuggauuacuuuaggaugauauucuuaaguuccaucaauuugccugaaaauuucaugaugucuugguuuuuaauagcugacuccuauuccauugauguaaucauagauguaccacauuuucuuuauccauucuucaguugagggacugcuaugaacauaguugaacaagugucuuugugagauguuggugcaucuuuuggguauaugcccaggagauccauauuuaucacccuguacaaaacucaaguccaggagaaucaaggaucucaacaugaaaccagauacacuaaaucucauagaagaaaaaaugagaaauguccuugaacauauugguacaggagacaaguuccugaacaaaacaccaacggcucaggcucuaagauccacaauagauaaaugggaucucaugaaacugcaaagcuuuuguaaggcaauggacacugucaguaugacaaauugguugaccacagauuggaaaaguaucaucaccaaccugacaaaacgcuaauauccaaaguuuaaaaagaacucaagaaauuagagaccaacaauccaaauaacccaaauuuacaaaugaguuagaguugaauggagaguucucaagaaaggaaucuugaauggccaaggagcaauuaaagaaauguucuuuguaucugaauuguaacaauuaacaaaccacaugaaauucaagaagaaggaaaaccaaaguguacauacuaagauccuucuuagaagagggaacaaaauacccauggaaggaguuacagagaaaaaguguggagcagagacugaaggaaugaccauccagagacugccccaccuggggauccaucccauauauaauaaccaaauucagacacuauuguggaagccaacaagagauugcugacaggagacugauauagcugucuccugagaggcucugccagugccugacaaauacagaaguggauucucacagucauccauuggacagagcacagagucuccaaucaaggaucuagagaaaguacccaaggagcuguagggguuugcagccccauaggaggaacaacaauaugaacuaaccaguacccccagagcucccagggacuaaaccaccauccaaagaauauacaugguaggacucauggcuccaacugcauauguagcagaggauggccuaguugguaaucaguggguggagaggcccuugguccugugaaggcuuuaagccccaguguaggggaaugccaaggcaagaaaguaggagugagugguuuggugagcaggggaagagaggaggggauggggguuuucauggguaaaccaggaaaggggauaacauuugaaauguauauaaagaaaauauuuaauaauaauaaaaaaggaauguucaaaguccuuaguccucaggaaaaugcaaaucaacugugagguuucaucauauaucaaucagaauggcuaagaucaaaaacuccagaaauagcacaugcugaugaggauguggagcauggggaacaugcuuccauuguuggugggagugcagacuuguaugaccacuuuggaaaucaauuaggcauuuucucagaaaauucagcguaguacuaccucaagauccagcuauaccccuucuguucuugacucugaagcuguaaccauguggcugaagcugcuggguucugcugcuuccuggggcuggaauauggcaccccuuguucuauuacaucuucaccagcuuucuguuuucaaggauuucauucacugccuaaguuuggcuauccugaaacuugcucuguagaccgaccuuaagcuuggagaucuguauggcuuugucuccuaaaugcuuggauuagcuuuucucuacuuggaacuuguauuuugucuguaacaggcuggccucgaauucagauaucugcuucccucugugcccggggauuaaaggugggccuaagcuuuucauggccacuauucuucaagauccacauaaaaagcuuguguauuacaaccucaagaucuauaugacaauugugcucuucauuuuuguaguguaguucauuucccaucaaaaguccaauggaaacaauauucaagucccuuguucaacuacaaaagcauaaacaauaagcuuagcagggugggaucuugguucaaggucaucacuccuuuaaucugauuauuucuagaauauuggauucagcuccacucuauuuccuggugccccuuuauucuuugaaccauacauuuuguauuuuuccuuucuaagcucuauauacuucaucagaaucuucuucaugagaguaaaccagagcacaaaguaaauguugggcuucucugagacuuucucuguucaugcaauuaauugaaaucucuuuaccuuugccacaggaauacucuuuagacaaggacaaaaagcagccacauucuuccucaaaauauuauaagaacagccuuuagaacgcauaauaaaauucuucuccaaaaucuuucagccagcagacuuacacaguucaauucacccuuggcgccacugucuuccauauuccuacuaggauggcccauuaagccccacuuaaagcauuucacugcuuucugaauuccacauuccuccaaccaaaaucauguucaggccuaucacagcaauacccgagucccugguaccaacuuuagucuuuguuaggguuucauugaugugaagaaacaccaugaccauggcaacucuuauaaggcgcagaauuucauugggucugacuuacaacuucagagcuugaguccauuaucaaagugggaacauggcagcauccagacaugcuuggugauggaggagcugugaguucuacaucuacaucagaaggcaggcaaaagacuggcauccuuaggcaacuagaaggaagcucucucaaaaccuacuuucagaaugacacacuuccuccaagaaggucacaccuccuaauagugccacucccugggccaagcauauucaaaccaccacaagauuguaauuuaacuauaauuuuucucucuuuccuuucuuccccccaaacauuccccuacauuccucccauucuuuuuuaaacuuuuuuucaagcuuuuuuuuucauuguuacugcaagcauauauguuuucuauaccaauauuuuggugguuugaauaaaaauggccauuugaauaaaaauaggccauuugaaugcuuagucaccagggguugcaauauuugaaugggguaggauuaggaaguauggccuuauuggaguacaucacugggggugggcuuugaguuuucaaaaucccaugccaagcuuagaguuucucuuuucuuggccuacaaguuaggauauaguucucauuuacugcuccaguacucugccugccugccaccaugcucccuagcauggugauaaugcccuaaccuugggaacuguaagcaagugcucaauuaacuguuuuguuauauaagaguuacuguggucaugaugucucuucacagcaauagaacagugacuuacacagaaauugauaucagugagcaggacaugacugugauaggcccggccauaccuuuuauuaggagaaucugggcuuugauacuuuugauuaggaaaccaguugaaucuucagaggagccuaaugaggcauauuaguagggacauggaagacagugguccuuagagcagugcagcuuaugauagccuaaagguuuuuuuuuuaaauuuuuuauuagauuuuucuugauuuacauuucaaaugcuuuccccaaaguucccuauacccuccuccugcccugcuccccuacccacccacucccacuuucuggcccugguauuccccuguacuggagcauauaaaguuugcaauaucaaggggccucucuucccaaugauggccgacuaggccaucuucugauacauaugcagcuagagcucuggggguacugguuaguugauauuguuguuccuccuaucggguugcaaaccccuucagcuccuuggguacuuucucuagcuccuccauuggggggcccuguguuccaucuaauaggugacugugagcauccacuucuguauuugccaggcacugcauagccucacaagagacagcuauaucaguguccuuucaggaaagucuugcaggcauaugcuauagugucuggguuugguggcugauuaugggauggacccccggguggggcagucucuggaugguccauccuuuuaucucagcuccaaacuuugucucuguaacuccuuccauggauauuuuguucacuauucuaaggaggaaugaaguauccacacauuggucuuccuucuucuugauuuucuuguguuuuugcaaauuguauguuggguauucuacauuucugggcuaauaucuacuuaucauuaaguacauaucaaaugaguucuuuugugauugggugacuucacucagaauaauauccuccagauacauccuuuugccaaagaauuucauaaauucauuguuuuuaauagcugaguaguacuccauuguguaaauguaccacauuuucuguauccauuccucucuugaguagccuaaagguuuaagagaagaagaauauuaguaagucaccgagaggccauucuugugauauuuuggcaaagaguauugcugcauuuuacccuaucccaaaaugaugaugaugccaccaccaaaggcuaaauugaaguauuuuggauuaaaguguuugguggaaucaccaugccugaccuaaaagcuuuacuacagagcaauugugauaaaaacugcaugguacugguauagagacagacaaguagaccaauggaauagaauugaauacccagaaaugaacccacacaccuauggucacuugaucuucgacaagggagcuaaaaccauccaguggaagaaaaacagcauuuucaacaaauggugcuggcacaacugguuguuaucguguagaagaaugcgaaucgauccauaccuaucuccuuguacuaaggucaaaucuaaguggaucaaggaacuucacauaaaaccagagacacugaaacuuauagaggagaaaguggggaagagccuugaagauaugggcacaggggaaaaauuccugaauagaacagcaauggcuugugcuguaagaucgagaauugacaaaugggaccucaugaaacuccaaagcuucugcaaggcaaaagacacugucaauaagacaaaaagaccaccaacagauugggaaaggaucuuuaccuauucuaaaucagauaggggacuauuauccaacauauauaaagaacucaagaagguggacuucagaaaaucaaauaaccccauuaaaaaauggggcucagagcugaacaaagaauucucaccugaggaauaccgaauggcagagaagcaccugaaaaaauguucaacauccuuaaucaacagggaaaugcaaaucaaaacaacccugagauuccaccucacaccagucagaauggcuaagaaaaaaauucaggugacagaagaugcuggcgaggauguggagaaagaggaacacuccuccauuguuggugggauugcaagcuuguacaaccacucuggaaaucagucuggcgguuccucagaaaauuggacauaguacuacuggaggauccagcaauacaucuccuggacauauauccaaaagaugucccaaccgguaagaagaacacaugcuccacuauguucauagcagccuuauuuauaauagucagaagcuggaaagaacccagaugccccucaacagaggaauggauacagaaaaugugguacauuuacacaauggaguacuacugagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuugcuacacacaugaaacucaagaagaaugaagacugaaguguggacacuaugccccuccuuagaauugggaacaaaauacccauggaaggaguuacagagacaaaguuuggagcugagacgaaaggauggaccaucuagagacugccauauacagggauccaccccauaaucagcuuccaaacgcugacaccauaucauacacuagcaagauuuuaucgaaaggacccagauguagcugucucuugugagacuaugccggggccuagcaaacacagaaguggaugcucacagucagcuauuggauggaucacagggcccccaauggaggagcuagagaaaguauccaaggagcuaaacugcaacccuaucgguggaacaacauuaugaacuaaccaguaccccggagcucuugacucuagcugcauauguaucaaaagauggccuaguuguauaugccccaguacaggggaacgccagggccaaaaaaaugggaauggguggguagggaagugggggggaggauaugggggacuuuugggauagcauuggaaauguaauugaggaaaauauguaauaaaaaauauuuaaaaaaauaucuaauaaaaauaaaaguaaaaauaaauaaaaaagaaagaaagaaaaaaaaauaaaauauuuggcacaggagauuucaagacagcauaauacagacuguguuguguaguuauuaauaauuacucuuaacacagaucuauaauguaaagcagcaagcugaaaaaagagaaauacaaaauguacaguuuaaagagaaaaggagcaaugggaauuguaaauggagcuaaguccaaaggacauggcuaccucagggcaagauccuguuccuuguacuaguggaggaguguuccccuugcucuacaucuucgccaacacaugcugucucuugaguuuuugaucuuagccauuccaauggguguaagguagaaucucagagucguuuugauuugcauuucccuuauaacuaaggauauuaaaucauuucuuuauguguuucuggccuacuagauauuccucuguuuagaauucucuguuuagcucuguacuccaguuuuuaauuggguuauuuugguuguuggugucuaacuucuugaguucuucauauguuucagauauuagcccucugucagauguaggguuggugaaggccuuucccauucugcaggcuuccauuuuauccuauugacaguguccuguccauuacagaagcuuuucaauuuaaugaggucccauuaauuguugaucauagugccuggcccacuaguguucuguucaggaaauuuucuccugugucagugcauucaaggccauuccacacuuucacucccuuuauauguaguguaucuaguuuuauguuaggucuuugaucuacuuagguuugaguuauguacaggaugauaaauauggaucuauuucuauucuucuaugugcagauguccaguuaaaucaguaagauuuauugaauaugauuucuauuuuucauuguaugcuuuuggcuucuuuuucaaaaaccaaguguccauagauauguagacuuauuucuggaucuuugacucaauuccuuugauaaaccugucuaauucuauaccaauaccaugcaguuuugauggugauaccucuagaaauucuuuuauuguucaggacuguuuuaucuauccuagauguuuguuuuuacauaugaaguuuaaaguuguacuuucaagguuuguaaagaauuuuguuggaguuuugauggaaauugcauugaaucuuuauauuauuuuugguaagauggccauuuuuccuauguuaacauuauugaucuaugagcauuggaaaucuuuacaucuucugguaucuucuucaauuacuuucuucagagaccugaaguucuugucauuuucccauguuuccacaagcaaaaaauguuauuuucaaaugauagguuguuuuguugguaaaaugucuuccacccagguauuacuuuauguuauuuauacucuauuuaccuuauauuaucuuauauggcuucuuaaaacaaccuguuugauacauggacaauggaugucaaauggagaaacuaaaggcuaaagugaucuugcccagguuuaacuaguacucuuuuaucuugcacaauagugacuaucuauauuugagaauauaccagauaccaagucuucaauaaaggaccuccucauaccuaucucuguaccaccucacagcuaucuauguagaacauuaggcuguguugaacagagccaucauuuauuuuuaauauuaguacaaaauauauuagucaguaugacccaaauauuucucaggauugaaacuaaauuacaaugcuacuauaaaguaggaacucaguccggcaaugggacaggaaaauauguauguauauauacauacauauguguauauuacauauguauauauaauguauauaaugcauacacacauauaugcauguguauguauaaauauauguauaauauaaugcauauauuauauacuguacaugagagguacuuguuagcaagguacucauuucuaacugcuguaacucuuauuugacacauuauguggaaagucucucaucugguaaugauugucuaaguggauccauucccuauggcuuucucuggaacaaaauagggaaaguuccaggguccucgggagacaagcaggccucagagccuucaagauacaauaacauuuuuucuucaaauuaauuacauguauagaacaaaugucaaaagaauuuucuuuucuuugaaggagauauauaacagauuugcucaagauaucuauccuaccaggaaauugaucuauguuucauuuugcacuuuuaaccuuuaguaccucaaguacauugaucaacagguuagccccuuguuagugugacagugggcuuacaaguuuaaucaccuaaguccuuuagagguuuguguuucuucaccgaggcuuauguguacuggccuauuacuuagcauuuuucucccaagaaaaugcuugucaccagcaguacuuuuuguguuucuggcagugugcagccaauagucuuuagccucuaaugauacugacuuuuaaauaauauucuugucuuauaauucauaaacaauucugacaugacauaggaagcauacuauaauccugacguuggugaugagauaaggcagaaagucaacggaauguggaguuuuaaggaauggaauccuacagcuguaacuuugugucagagaagcagcuucagugagcuggucuccugaguauaccacugaugcuguuaagcucagucacuuuaguaucaccgcugacuggagacccugggcuguuccucguggugcugagguucuagggucuggguauuauuugaggacagaucagucauaucaacauuacuuauaaaaguuaaguaauuaaaauccuuaaauauguagguauaugcacaugggucuauauuucuauaacacuauuagucaaaauauauacauuugugaaucuacuuuuaggacuuugacauuaaauccuuagaaauauuuuaagcugauaucaaaaagacagaacaagauuuuauaaacagauuauauguguuaaaaccucucaagguguauuauaguugggaaaucucuauaacauaaaguauaaaaaggcaaacaguugugauguugguuuugagaccagguuuuacugugucguccuagcuggcuucaacuugaagauacccaucucccucugcuagaauguaccacaaaaccuggcuuauauuuuuauucuuggcauuuaaauauuuacauauucacauuuuaaaaaguaauagauuuuaaagucucucuuauuccauauuuuuugaucauauauuauuugaguaagaggggaaaauaccuaucuuuugauucugccaggugccagccucucauuuaucagcaucuauaaaguaaguccauguugguacaacagguuuaggcauagauggauaaaacauugcuuaugauaauguaagcauuguauguggaaaugggauucaaaagaggccuucugguuacuguggaugcaaaguccauuaucuuuuuuuauauggcaggcaaauugcuuuucacuaaaauuuaaaggccugaaagaagauguuucaagccuuuauagugaugugggauugaggucuccuaagagagucuuagacugaagggccucauaagaggaagguagaauuucagaggaggaaguacaagguagaguagaggucugugaugaugcauggaaugcuggcagccccuagaaacugaaagagaaaaaagaaaaaggagagaagaaaaggagagaaaagaaaagaaguaccuuuccccuccacaaaauccuugaaaggaauacagcuauugacuauuguucuaugggacucaucuugacuucugaccccuaacuguaagauaguacauccagauuguuuuaaaccucugaguuaauuaauuuauuuuguccaaaaaaccucagguaagccuagcuguccuaagaauugagacuccuuguucaugugguucagagauuacugagaacuccgagacuuacuuguucugaaggcaacuguugauguuuacccuaugggacaaugaaaguaauagaauaucaaaaugcauauuuauauaaauggugacaugaauguauuguucaaaagcaguaacuauauuugcaacuaaaguaauucuugagaauauuggcauuauuuuauauuuugguaugcaauuuugaugucugcaucaaaaucacccugaugccauaugcuguuuugguuagaauacaugagaaaauuuagcuuccuagauaaauagguagcauaagaagugcuucaauggccuuacaaauacuuguugauauuauuauccugccuccagguuccugcccugauuuucuucaggaauagacuacgauauggaaguguaagccaaauuuaaauuuuucaucccugacuuacuuuugaucaugguauuucaucauaucaacuguaacccuaaggaggauagcaguugguaucagaaguggggagauacuuuugaugugacagaccugaccauauuuuugguggauuguggaaggauuuuagagcuuugggcuacaaaaaccauugaguauuaaaaucuuggugagcuguuuugugggcgcuuggaagauaaaaguauuaagagaaaugcaaagauagaagccagggcuuauaaaguuacagaggcaaggagucacuuaaagacuguugaguucauugcauuuuuaguuaagaaugguugacuguaugguuuuaaugagcuggagcugaagaagaagcuaugguuaacaagguaccagaaccaguaaagugaaaccuuuguuuuguggggcaguuuugcuuauuaaagcugagaaauuaguggugaauaagaagagaccagcaucauugaggugaaauauucuguuaauuguuuuuucagaaccagcacacagagcagugcuccagaucuggucauaccuugugcugaaagcugaaccuggauaguucauauaagaguuacccagauggcacugguuuugaaggcaugaaaugguccauggagaguaucugagucuuggcacuauguggcagggcugcagucccugaagagaguguaggagaggcuauuggugaaaguacagcccaguucaucaaggauccugagcauuuuagagaugcuaagauugucauaggaaugauaagaccugcacaagccauggaauggagcuacacugagcuuaggagaaaaucugugaggguguuguauaggguggagucugaaaagugacccaggcagauuagaggggccuagaucuugaagguaucccagacauuggauacugaguuauuuacacaguuggaguuugguuuugcuuuaauuugauugugacugugcccuuguucuucccucuugaaauaagaaacuauuuaauuuauuuuugauuuuuauaggagcccaugguugaaagacuucaaauuuuaaaagcaacuuuaaaauuuuuaaggagacugaacuucuaaaauauuugaauuugccagacugcgggacuuuuaaaguuuuaaacguacuuuguauuuauaucaauauuagugggugaucuugagggaugaaaaggaaaggaaagguuguggcuuaaccguaauguguuucugugucaaguugugaaugagucaguugugcugucuaguuuuauugcagcuugacacaagcuagagucauuguaaaggaggaaucugcaauagagaaaauguuuucauaagauugagcaguaggcaagucuuuagggcauuuucuuaauuacugacuaauggcugggccaaccuuugggcuagugauccuagauuguauaagaaagcagaacaagagcaagccaguaagcaacaccucaccauaguuucugcaucaauuccuagcuucagguucccgcucuaacuucauuuaaugguggacuauaauguggaaguguagauaaauaaacccuuuccucccucccuugcuuuuggucaugguguucaucaugacaauagugacccuaacuaggcagcuuuuguacuucauuaccucagacauuuauucaucuauguuuucacuuguuaacauuuaaagaguaucuguauuuauuuggugcugggugauguuccuauaccuauguguuaugugguaugguuugaaauggguaagcauagcuagcuccacaagcauuaucaguucuuuauuguaagaauauuucaaauucuuacucuaaugugacuccagauaacagugucuuaaaaacuuuuagaaaucaggccaacacaaucggcagauuuaucuggaaaaacaaaaaaccuaggauagcaaaaacucuucucaaggguaaaagaaccucugguggaaucaccaugccugaccuaaagcuguacuacagagcaauugugauaaaaacuccaugguacugguauagcaacagacaaguagaccaauggaauagaauugaagacccagagaugaacccacacaccuauggucacuugaucuuugacaagggagcuaaaaccauccaguggaaaaaaagcauuuucaacaaauggugcuggcacaacuggcuguuaucauguagaagaaugcgaauugauccauuccuaucuccuuguacuaaggucaaaucuaaguggauuaaggaacuccacauaaaaccagagacacugaaacuuauagaggagaaaguagggaaaagccucgaagauauggguacaggggaaaaaauuccugaauagaacagcaauggcuugugcuguaagaucgagaaucgauaaaugggaccucauaaaauugcaaagcuucugcaaggcaaaagacaccaucaauaagacaaaaaggccaccaccagauugggaaaggaucuuuaccuacccuaaaucagauaggguacuaauauccauucaauauauauaaagaacucaaggagguggacuccagaaaaucaaauaaccccuuuaaaaaaugggucucaaagcuaaacaaagaauucucaacugaggaauacugaaugguaaagaagcaccugaaaaaauguucaacauccuuaaucaucagggaaauacaaaucaaaacaacccugagauuccaccucacaccagucagaauggcuaagaugaaaaauucaggugagagcagaugcugacgaggauguggagaaagaggaacacuccuccauuguuggugggauugcaagcuuguacaaccacucuggaaaucagucuggcgguuccucagaaaauuggacauaguacuacuggaggauccagcgauacaucuccugggcauauauccagaagauguuccaaccgguaagaaggacacaugcuccacuauguucauagcagccuuauuuauaauagccagaaguuggaaagaacccagaugccucucaacagaggaauggauacagaaaaugugguacuuuuacacaauggaguacuacucagcuauuaaaaaggaugaauuuaugaaauuccuaggcaaauggauggaccuggagggcaucauccugagugagguaacccaaucacaaaagaacucacaugauauguacucacugauaaguggauauuaguccagaaacuuagaauacccaagauauaagauacaauuugcuaaaugcaugaaacucuagaagaaugaagaccaaaguguggacacuuugccccuucuuagaauugggaacaaaacacccauggaaggaguuacagaaacaaaguuuggagcugugaugaaaggauggaccaucuagagacuaccauauccagggauccaucccauaaucagcuuccaaacgcuggcaccauugcauacacuagcaagauuuugcugaaagaauccagauauagcugucucuuaugagacuaugcuggggccuagcaaacacagaaguggaugcucacagucagcuauuggauggaucauagggcccccaauggaggagcuagagaaaguacccaaggagcuaaagggaucugcaauccuauagguagaacaacaauaugaacuaaccaguacuccccuagagcucgugucucuagcugcaugugaaucagaaaauggccuagucggccaucaguggaaagagaggcccauuagucgugcaaacuuuauaugccucaguacaggagaacaacagggccaagaagugggagugggugggugggggagcaagugggggacuuuugggauagcauuggaaauguaaaugaaauaaauacccaauaaaaaauaccaaaaaaaaaaaaaaaaagaaaucaggccaacaguaauuuuacucaguaggcucuguguguguguguguguguguguguguguguaugugugugugugugugugagagagagagagagagagagagagagggagagagagagagagagagagagagagagugagagagagaggaauaacuauagaauaauuggucaugaauuucaaacaauaagccaagugauaaugcuucguaucaucuaguaggaauuuguguauuaccugucauacauaacauucaauuaaauaacuguggugguuugaauaugcuugacccaggagugacacuauuaagagguauggccuuguuggaggaagugugucauugaggguguuagcuuuaagacccucuuccuagcuuccugaaagccagucuucuccuaguggccuucagauaaagauguagaacucucagcuccuccuccaccaugccugccuggacagugccauguuucugccucaaugauaauggacugaauuucugaacauauaaaucaccccuguuaaauauuauccuuaugagaguugccuuggucuguucacagcaguaaaacccuaagacaauaauagauaucauuaaaacaaaaauuugaccugugaguguaauuuagugguaaagugccucucaagcauauuugauuugaucccuaacacuauaaaaugcagucauacaaauuucagaguguucuauaaauuauauagaagaagaagcagaagcagaagcagcagcagcagcagcagcagcagcagaagaagaagcagcagcagcagcagcagcagcagccgccgccgccgcagcagcagcagcagcagcagcagcagcagcagcagcagcagcagcagcagcagaagaagaagaagaagaagaagaagaagaagaagaagaagaagaaaaagaaaaagaagacaucaguuacuugagauuguuaaaggaacuguaauuacaauacauuacacccugcagaugaaauauuagcuccugggugucauuucauuaugcuuuuuuguucuuuuuaggguuucuuuuuccuuuagcagugaauggcccaugaggaucuuucuccauugcucauagucuucucauuuaccuuuuaguaaaaccuaucuccuagauguggugcaggcuauaagucuaauggccauacacaacaugguucaauagcacacagaccuuugucuuuuugguagaugaaggccucccuuuacugccaguguaugaaaagucuuacucguucuguugcaggaaaauuacuagaccuaauacacuuggauugcugauacuaacuagaaaaucaggaagaacugugucuucuugucuaaucacacgugucucucucuuuuuuugggggggguggguucagcgaacuuuauugaagguauucaagagaguagggagggcucccuaggccccuccuguuauuaugggggucugggauggaaauugugagggagaugcucaguguugggggccgaguugggauagggacuccucagcaaccgagggccucucuuuugcucucaguguccuugcuggggugggugguccaggguuucuuacuccuugcaggccacguaggccaugaggcccaccacccuguugcuguagccguauucauugucauaccaggaaaugagcuugacaaaauugucauugagagcaaugccagccccagcaucgaagguggaagagugggaguugcuguugaagucgcaugagacaaccugguccuaaguguagcccaagaugcccuucagugggcccucagaugccugcuucaccaccuucuugaugucaucauacuuggcagguuucuccaggcggcacgucagauccacgacggacacauuggggguaggaacacagaaggccgugucagugagcuucccguucagcucugggaugaccuuccccacagccuuggcagcaccaguggaugcaggguugauguucugugcagccccacaaccaucacgccacagcuuuccagaggggccauccacagucuucuggguggcagugauggcauggaccauggucaugagcccuuccacaaugccaaaguugccauggaugaccuuggccaggggggcuaagcuguugguggugcaggaugcauuucugacaaucuugagugaguugucguauuucuugugguucacacccaucacaaacaugggggcaucagcagaaggggcagagaugaugacccuuuuggcuccacccuucaagugggccccggccuucuccaugguggugaagacaccaguagacuccaccacauacucagcaacggccucaccccauuugauauuggcgaggucucgcuccuggaagauggugaugggcuucccauugaugacaagcuucccauucucggccuugaaugugcuguugaauuugcuguggguagagucauacuggaacauguagaccauguaguuaaggucaaugaaggggucauugauggcaacaaucuccacuuugccauguggagagcagauggcagcccuggugaccaggugcccaauacggccaaauccguucacaccgaccuucaccauuuugucuacaggacgaggcaggcacugcacaagaagaugcggcugucucuggaacagggaggagcagagagccacacaugucucucuuauuagugcuuguaguucuugauuuuucauuuaauagcaaaucaccacuguuccaaauauaagccaauacaucuuucaguaguuuauguauucugcuaucucuugacucaccaugacccugguuuucugaguugggaagugaccccucucacucuuuaauucauuugcucaaaaagacaauaacauuguugaagcaugugacuaugaacacugguguucaagugcaucccagccucuucucaucagagaacaaaucuguccagggaagcauauguccuguugagaaaaaaauucucaguuauaauucuuuuuuuccuguauacuuauaauugaagacaucaaauacagaacaacugguagcacugaaauccccuuaagcaguaguuaugagagcugcugugcucauugaggugacugagaguauacacagagagaugagcuuuuuugcuaaugauuauauuuaaauauacuuacuuaaaaauauaauugacuauuuuguggugguuuaacgagaauggcucccauaggcagauaugauuauauucuugaucugcaguugaugggaacaguuugggaaggauuaggauuuggggucuugaaggauacuagucauuuccaguguuuucucuguccugucuucugcuugcuaauccaaaaaagaacugucagcuccucugguuaccauguuucugcucugccgucauggaaucugacccacuaaaaguauaagccaaauuaauuguuuucuuuuauaaguugcaggguuuuaauagagaguccacuucauggaggccuccuauuagcuguucccaucggagugagcaacauuucuguuggggacaacuuaccuuccaacaguucccaagagcacagugcuuuuacuuugcucuguuuucuuuccuuccuguuacagcaauaggggcccaggaugggggaguuuguaagacacuuguagauacaaacacuugggucugaugugggacagucauauccuaguacucgagacagcgucugugugagucaaggguacaugauaauuuaccagcagaaugucuguacaaaagaucuacuuuccuguuuaacagaagauaagcaagccaugacuuuucuccuaaaggauuagagaagaggaggaauccaguggagugggcuggaaaaagauguuccuuuuuuuuccccuuuauuagauauuuucuuuauacacauuucaaaugcuauccggaaaguucccuauacccucccccugcccugcuucccuacccacccccucccacuucuuggcccuggcauuccccuguacugggacauauaaaguuugcaauaccaaggggccucuccucccagugauggccgacuaggccaucuucugauacauaugcagcuagagacacgagcucuggggguacugauuaguucauauuguuguuccaccuauaggguugcagacuccuucagcuccuuggaugcuuuaucuagccucuccauuggagguccuguguuccaucuuauagaugacugugaacauccacuucuguauuugccaggcacuagccuagccucacacgagacagcuauaucagugucccuucagcaaaaucuugcuggcauaugcaauagugucuggguuugguggcugauuauggaauggaucucugggugggguagucucucgauaguccauucuuucuucuucacuccaaacuuugucucuguaacuccuuucguggguauuuuguucccuauucuaaggaggaauaaaguauucaccuguuggucuucccucuucuugauuuucuucuguuuugcaaauuguaucuuggguguucuauguuucugagcuaauauccacuuaaaagugagugcaugucuaaugacuucuuuugugauuggguuaccucacuaaggaugauauccuccagauacauccauuugucuaagaauuucauaaauucauuguuuuuaauagcugaguaguacuccauuguguaaauguaccacauuuucuguauccauuccucuguugagggacaucuggguucuuuccagcuucuggcuacuaugaacauaauggagcauguguucuuauuaccaguuggaacuucuucuggguauaugcucaggagagguauugcuggaucuuccaguaguacuauguccaauuuucugaggaaccgacagacugauuuccagagugguuguacaagcuugcaaucccaccaacaauggaggaguguuccucuuucuccacauccuugcaagcaucugcugucaccugaauuuuugauuuuagcgauucugacuggugugaacuggaaucucaggguuguuuugauuugcauuucccugaugauuaaggauguugaacauuuuuucaggugcuucucugccauucgguauuccucaguugagaauucuuuguuuagcucugugccccauuuuuuaaugggguuauuugguuuucuggaguccagcuucuuaagcucuuuguauauauuggcuauuagucccugaucagauuucggauugguaaaaauccuuucccaaucuguugguggccuuuuugucuuauugacagugucuuuuugucuuuugccuuacagaagcuuugcaauuuuaugaggucccauuugucaauucuuuaucuuacagcgcaagccauugcgguucuguuuaggaauuuuucccuuguacccauaucuucgaggcuuuuccccauuuucuccucuauuaauuucagugucucugguuuuauguggaggucuuugauccucuuagacuugagcuuuguacaaggagauaagaauggaucaauucacauucuucuacaugauaacugccaggugugucaacaccauuuguugaaaaugcugucuuuuuuccacuggaugguuuuagcucccuugucaaagaucaagugaccauagguguguggauucauuucugggucuucaauucuauuccauugaucuaccugucugucgcuguaccaguaccaugcaguuuuuuaucacaauuuuucuguaguauagcuuaaugucaggcaugguuauuccaccagagguucuuucauuguugagaauagauuuugcuauccuagguuuuuuauuauuccagaugaauuugcaaauugcucuuucuaucucagugaagaauuuaagauguucuugaguccagugauggacccagaauauuuagaagaaguagacaaaaagugugaugugaccucaaagugagugggccucagagugauguggggaagagaauauucuauguucgcuagagaaggagcuagccuggagaugcugggcagagagacaagcacuggaccuguggagcuggcaucucuagugaaacaccugaggaggcugcauauggcuggguggacucuauauuucuuuuagaauccaguagaaauguuuuagaaagcuggaggagguuugguauuuaaucauggaggucuugucugccauaggaaauguauuggccuugauacauggugucuuaguguucuaucacugugaagacauagcaugaccaugguaaucuuauaaggaaagcauuucuuucgggcaugcuugcaauuuaagagguuuaguccauuaucagcaugguaggaagcauggcagcaagcagacagacagacaugguacugaagaguucccagaucuacaucuggauucucagguagcagaaagagagaggcacuugggcuuggauugggcuucugaaaccccaaacuccacuccagugauacacuuccucccaaaaguccacaccuacucccaacaagaccacaccuccuaaucccucucaaguggugccacauucuaaugaccaagcauucaaauaucugagcuguuggaagccauuccuagucaacccacugcaccuggaaauacaggcaccaaguuaacaucacauacguguagaacaagacuguccaaggguccuuggaaggcaaacugaguggugcccacuauagugguaguguuuguuaaguuaaguagguccagaaaagggagagagcucagacaaaugucuuugugcacuaguuuacauucuggaaauggauagcccagugagcaucagagcaaauagugaaccggaguccaggagaucucagaagcuuaucagggugcagggagggaagaagagaauuugguauuugguaagggcaagagcccagagaauagggcaucagaaugcuaagagcaggggugaaagcucagugaggagcaguaggguacagagcagaggggcccccugaaccccggcagcauugcacugcucuguccuuucugucuuuucucugcugugaaggugugauucuccacaucacauuccuccuccaaacaugagugggggugaugugucgugcaugaaguaaguguuuugcacucugucacacaggcuugggacuguuugucacucagugugccugcugagucaucacagcuuaaauucugugacgucuagaaucucuauagaugaguuuccagaguaucuucaguacgcgggccuugcucaugacgaugcaaagcaagaucauggugacuggacacgguugcauagguaccauauuggcaccacacacuaacaucuucauugcuuuguaacaaacuugaagccaguuugaaacuuccauuuuugcuauuauuuguauuaguuagggaauacagugcuuugccaguuuacuggcauuugcacugacacgguuaaaucuagggaguuugggucuuaauucugcuccucaguuucuggacacaguuguugucaaaaaguuuguacaguagcuuccagauauuucauauuacucugcugaugaauuuuuuaaguuucaggaugauguucaagcuuaaguuucugggauuuauuuuuguuucaaacuaguaagaccuuacucugccuuugucacccuuuuucucuggcuacuuguaucuaacuuacaaugggcacauuuuuuagauuguaaacucagcacauuuccuuugagaaagucuguccuuuaguuucagaacucaaguuauguuugguagauuuugacccuuuuuuuuguuuuguuuuguuuuuuguuuuuugcuuguucguuucauucaauguagaucuucaagucuuguuauuuuuuucugauuggaaauuucagauguuguuccaggguuuuaaggauuucuugugauugucauaacauaaaaauuuuaaaggagaaugauauuaaaacacagcaugcucauaucuuuucucacacauauuuuuguccuauuuaaaacagaagaauaauuagcugugguaaugcacauucuuuuaagucaguuaagagaacagaaacaaaacgucaugugaguuacacugcaaucuagucguugucuuguccugaugaucugcuaucauagcauccugaacuuggaugagugugagcacaguugcaggcuguaugccugggguguaucuucagucugucaggcugacugaaauugcacuuugguccccgagaaguuggcacacauacacacaaaagacugggcaaagcucucgagggccauugcuuucuaauguuugguugaaacugagugugucuaucuucugaaagacuacuuccucagcauauuaauauauuugcauagaguggcucuguccacacucuguagagauggcaggauucuuuguugucuugucucuuuggcuagcuggagucaaacacucagacuugauacuaauuccugucugguuguggauaaauaguuacaaucuuuuuuauggaucucauuaauuggacaauuaugcagaguauucauacccaugagaagagccacugguuauuugucaagaguguuuuuggaaagcaucauguagcugacucacucccugcuuuguuuucuucuccuuagcucuuuacuguugguaagggauuuuagaaaauaauuuguagaauacuccauacagagccuuucucuuagugucagggcagugaucccaguggaucucaggaaguagcugacuucuaaaaaggcuaguugggggugggacuccauuugucuuaugaauugaaacuaaaauaugaagaauaauauauuccauuuuacauaugacuuugauuaauuauuuacuacuuacaacauuuuuauugaucucaauguguucagaaaagaaaauguugaguacguaauuaaaaucaauaguuccuuuauuuaaaaaaaguacuggagaacuuaaauugacuaaguuccaguuuaaucaagaagugauugucuaauuaggaagcuaaggcaucuuagaucaagguaaauaacauuagacuaucuaucuaauagcuuucuaaggacagccucuggaucccugauggguuugccuuaggugcauagggcugccugugauuugauguaagagcuggauguagcggcacgugcugucagcccagcacucaggaguucacugcugcucuagcacaguauucuucugagccucucagguguuugcuccuauugaacagugugaagagaagcacagaauuacagaggaaaauucuccggcauagaaguuacuagaaacuaaaucaaugagaauauuugggagaaauugucuauaaaaugaauucuauauuauuuggaagaaauuuugcuugauuuacuauagaaggaaaaccguaaagucuaacccuauaauugucuuucacuugaaagcugucuuagcuucugugugacaggaggauuaugugcugugauucacugucauuccuuacaggugucugugucaagccauggcuguccucuuugugaaagugacaaggucacucaugugugcuauuucaaggcugccacccaaaggcuauccaacagccagagugaauucagaaguuaugucacgcuugcuuguuaccuagaacccuguucccacagcugugugaaccaucuuugucugcaaauguuuguuacaucugucucaguucuuauuagcagaaaggguucugaacucuucuucagguuccuuuaguuucuuuaggaugcuguuuuauuuucuccagccauuuuauguucccuguuaguuuuacugguuauacuucuguagacaauguuuuucuuucuuguuacuuuuaugucuuuauauuucuuucucauauucuggauaauucuccagcacucucucccucuuagcccgcucuauuguaucugauccauuggaaugcuuuauuuucuuuauuguuuauuugggguuuuuuuuuguuuguuuguuucuuuuguuuuuaauguaagugcucacucugaagcccaggccagccuggagcuucuuuguagcccagacuuuuuucaaaccuauacuggucuuccugucucggccuugggguagcuugaaccagcaucccagugcugucaccauuuauuuucaguaucagcaacaauaucuggaagcugccgucuuccuugccgugguuuauuauuucacuaugauguauguaucuuuuauguuaccauauaaacauguauuuauugucccuuuaaaaauguuucuuuuuaaucucagguuucuguacuccuuauuuucuuugcaaagauauuuuuccccuccuaagcaguuguuuauuuaagcagauuuaauuuuugauuuuuugcugaucuuuaaugggagcaaccucacacccaauguaaacucccacuucucagaugaagcaucaccacagauacuuuacccucaguguugguucugucccggugucucaccagucuaggaccagucuguacucagaguguagcuuagggauuccuguacuguauagccaucaugaauuccaacaccaaacugauacuugcaaucaauuuccucuuaguaagccaauuuuccucuaccaccagcuguauguaggagacaaagauccaugucaccuguguccugaucaccuuucagugaaaacacagcuugucaggcuccuuauuaucuaggcccuagaacuguauuaauguuaaaauuugcuaugcagcuguuagacaauucugacagcaugcccuucuagaucugacacaagucaauuuaggcagugauuucuuuggcuuuuaguuucuugcucauuucuacaaaccaaagagugccuuucuuuugaacaugcuuuuauuauguuuguguguggauguauguauuuaaaauaauguaucuaauucauaauuucuguguuuuagaucagcucggugugucacaugucccaagauagaauuucaauuaaacuuuguauuuuaagugguacuacccaucuauguauaaauaugaaguaggcacaaauacauuauaaaacauauauuucauauaauaauauaaauuauauauauaguaaguauauacucauauaauuauaaaacuauaacaaauguaaacauuuauagccaauaaaauugaaauaagcaacauuggcauaauaguuucaguaugauuguuuugcuaacuaaauugcuauaucuagcauggaucuuauacugaauuucaugaugguggugugauuuucuuuauauguagccuccuuugaggauugucuuuguacuaugugguauacuaauuugacuuuaacuucauuacaguuacacagaaauuucuauauaugugguagcuugcuugugcuaaaauggucuugauacauccuaacuguaaacacaaaggcaaguugaagugcugguaucguauaagcauuaugauaagguggauagccuuauuuuaugaucuuaggggauuacaaaaaaagaaaaugauauuuuagaaacgucccaucaagaaucuugugaccugucucuggaaaugaaauugagacucuguguucuaugacauacaccaccaaccuauauauucaugggagacugguuccagcuccuuuuccccucagagccaugagacucuggcucaagcaccugaccauaagugguuuccuauuugcauauaacuuugcguagcugcuguauaaccuaaauuggguuggagcagaguuuuuuuuuuuauuuauuuaaaaaaaauuuauuagauauuuucuucauuuacauuucaaaugcuauccccaaaguccccuauacccucccccacccugcuccccaaaccacccacucccgcuuccuggccccagcauuccccuguacuggggcauauaaucuuuguaagaccaagggccucucuucccaaugaugggcaacuaggccaucuucugcugcauaugcagcuagagacaugagcucuggggguacugguuaguucacauuguuguuccuccuauaguguugcagaccccuucagcuccuuggguacuuucucuagccucuccauugagggcccuguguuccauccaauagcugacugugagcauccacuucuguauuugccagacacuggcauagccucacaagagacagcuauaucagaguccugucugcaaaaucuugcuggcauaugcaguagugucugggcuuuguggcugauuaugggauggaucccuggguggggcagucucuggauaguccuuucuuccaucucagcuucaaacuuugucucuguaacuccuuccauggguauuuugucccccguucuaaggaggaacaaaguauccacacuuuggucuuucuuaaucuugaguuucauguguuuugcaaauuauaucuuggguauucuaaguuucugggcuaauacccacuuaccagugaguucuuuugugauuggguuaccucacuaaggaugauauccuccacauauauccauuugccuaagaauuucauaaauucauuguuuuuaauagcugaguaguacuccauuguguaaauguaucacauuuucuguauccauuccucuguugaggggcaucuggguucuuuccagcuucugacuauuauaaauaaggcugcugugaacauaguagagcauguguccuuauuaccaguuggaacaucuucuggguauauguccaggagaggaauugcuggcucuucuggugguacuauguccaaauuucugaggaacauccagacugauuuccagagugacuguacaagcuugcaaucccaccaacaauggaggaguguuccucuuucuccacauccucgccagcaucugcugucaucugaauuuuugaucuuagccauucugacuggugugaggugaaaucucaagguuguuuugauuugcauuucccugaugauuaaggauguugaacauuuuuucaggugcuucucagccauuagguauuucucaggugagaauucuuuguuuagcucugugccccauuuuuuaauaggauuauuugauuuucuggaguacagcuucuugaguucuuuguauauauuggauauuaguccccuaucagauuuaggauugguaaaaauccuuucccaaucuguuaguggccuuuuugucuuauugacggugucuuuugccuuacagaagcuuugcaauuuuaugaggucccauuuguagauucuugauccuacagcacaagccauuccccugugcccauaucuuugagguuuucccccacuuucuccucaauaaguuuuagugucucugguuuuauguggaguuccuugauccacuuagacuugaacuuuguacaaggagauaagaauagaucaauucgcauucuucuauaugauaacugccaguugugucaguaccauuuguugaaaauggggcagaauuucuuaauauaguacaaugccauacauacagugugaccauagcuuaagaaauuguguucagcugggcguggugguacacgccuuuaaucccagcacucgggaggcaaaggcaggugaaugucugaguucgaggccagccuggucuacagagugaguuccaggacagccagagcuagacagagaaacccugucucgaaaaccaaaaaaaaaaaaaaaaaaaaagaaagaaagaaagaaagaaaaaaaagaaauuguguucaguguaaaguuccuggacacauggaaauuaggugcaguuucaguuuuuuacaaauauuucuuuauaaauaaugcacugucuguagaaacugugagucuggccuacugacucuauuugucccaugacugcuggaauuuagaagagugacuucuggaaauguuguuugccucgcuguagccucccggcaaguaugggccacaucgucugccccuguugacuuauuuauuguuuguuuuuugagugucauguaauccaggcuggccuguaucuuacaggguggcugagauuuaacuugaacuccugauccucuugccucgaccucccgaguuccaggaucacaggugugccacacacugcuguccuguuguguuucuuugguuuuggucuuucaucuauauguccauauagaugugaaucuuugacaaaauauguuuuagguguauuaguacacuuuaaaaugauuuuccucauuugcuaucuuuuauuacuuaauuaauuuugagguagagucauagauaucccauguuggccuggaacucugcuuauaaacccagcuuccaggauuaugggcacccaccacauuaacuguuuuauauucauuauuccauuaaauuggggggucaugguguauaguuuucuaugugaucuuauaacuaacaucuggguuccauuuauuuuuauuuuuauucuguaucaaaaauaaguuuguucaauuuucagaaauugacagauuuucugaaaggugcuguaguguuaaauauccccggaaagaucacacuagagaagcaacucuagauaguucuugccagccuuuauuuugccugucugucugucugccuguaucugugucucugugugugaaugugcauauguaauuuagucuaaggcauauuucaagacuauacauugguguuucaaaugaguguuuucuuuuaaucuccucaacacuugauugugaugagcauuaccgaguucuccacauuuaauuauagucuucugucauaugcccccucacuuuaaaguguauuauauuuuugguauuuggucuuugucuuggauugguuuugguuuuugguuuuuguuugucauuguugcugaguuauaaaauuaauggcauauucuuauuuagucuagcuucuuuaugccucuuuuuauuuuucuuagcuagaucauuauuaacagaaggcauucuauuagguuccacauaucaauuuugaauuuagucauuaggauauguauacuauaagaaaugucuccuuacuauuuacuacaaccgguaaagcuuuuuucuauaauuuuuguaaauuuacaguucugaccuuguucauaucuaugauuacauaaaaaccuucuuuuaugguaugucaaaauuguuagguucauguuuaguucuauggauaucuucuuguucaccugcuuauggugagagggacggacacauaucugauucaaguacaaugaaacagaaguaugaagauguuauaaugaaacccauugcuuaauuaauuaaaagggagaaaugcuaauguuagaguccuuugggcuucacaauauugccuuugccauuucuaggguguuuauccuaacuaaccaucaggcagcaucuagggcauaucuguguauuuaccucacuuccguauuuuucuauuccacucuccauuaugcuugaugugucagucuuagugcauucuguaauggucuguugcuaucuauuccuucuuguguuuucaaacaugauuuaguggauuguuuuguuucauuugaugaucuuuggagcugggaguguuauauuuuagaaugcuuauaggaagugauacucauguguuaggugugaagauauuucuuauuaauauaugacaauucucuuucuucucuuauauuauuacccaggauuuuaugugcaaguucuaccacuuagcuuugugguuugccuuugacuuuggucaaggcuaucucaacaagauacaguuagcuacuuaguuucaucuacguaucaaaaguauuauguuuuaauggaaauguuuauuuuccauuucuauucacauuuacuuuaccuguguuggucucauauuuuagaucaagaacacucuuauucaaacguuauuuucuuagcucauguguuuuccucaauaguuacuagcaucuacauuuauuuuagguaguugguaaacuuaucccccucuuguucacugccucccacaauccuccccccuucuccucuccuucucugcuggguaucccccauccaccacccccagcuguuuccucucucaccaaggccagacaaggccgcccagcuaguagaacauaugccauauacaggcaacagcuuuugggacagccccugcuccaguuguucaggacccacaugaaagucaagcugcacaucugcuacguaugugugggaaggccuagguccaccccguguauguuuuuugacuggugguucaggcucugagagccucaaggguccagguuaguuaaaucuuuuggucugccuaugaauuucuauccuuuucuggacccacaauucuccuauucuuccauuugaauuccauccacuauuuggcugugugugccuguaucuguauaggaugugcaaaucaaauucucgggaagucaccuuuuaguuucccuucuccagaaaugcagugauagacagaccaggagcuucacuguuaagcuccuggguacuucugcauuuggucagguugguggucaaggucauccagcacacccccuucccugaccacagauggguaagaucuucacugacuuauuccaaguagaaucucuuggcaaugaugcuuagcuugauuugcccuucaccuuucaacucugcauguuuagauaagaaagaagccuaguagauggaaaucaaugaaacaauccuaugaugaaagaggagaaagugcgaaguauauagaccugccaugcuucugauuauugggaucauccagaacuguguaugaauaguagagugcuuuuugaagcaugucucuuguuccauauucagaauucugggcaaacuuucuuccacugagcuucuggcuuugucucugguuucguuggucuucauuuugaagcuuuuuguccuuuucugggucucugcuuuuggaaguacuggaggaaaggugcuuugaagacuauuagccagauagauggcagguuaguguugauuucauuggcuguuggcuucauuacacuuuaccuaguugugugguaucacauuccuagugaacaaggcagucuuuuggcuuucuacucucuaacuuuugacauguucugaagccuuuguaccaggcccaaaggagccccucuuuauagcucccuccucaagcuauucagaggggaaaugagaggaguggagagaauauacguguuuauuugagauauaaaugacuuaugaauauuuuucuucccaaacagugugauuuuugcauuucuguuuccuauaaucuaaugaacucaagaaugaauuuuuuagugccagaagauuauugaugagcugaguucaugcugacauuuuauguuguauuuuucuauaccuauguuuuaaugagauguggaguauuuaauucugccugggaaacucaagcaauuucacuuuaaauuuuccuuaaacugugggugauuauuauuuaaguuguaagagugucuuguaacaaaguagcugucccaucccccuguugcaggcugagcagcucuggauuccguuuucauucauacacacagucaagacuggaauuauuaucccuguuuacuugugaggaagcuguguccaaccagauuaacuagugcuauuaugguuaugcgagugaauggccaagauuugauccaagguugaugugaaccagacagagucuagcuucuccucaggccugucuuauuuuacuacugauucucauaaauggacaugcuguucauguacuuuucucccaaauuaauuaaaaaucugauuaaauucacauaaggguuuuuaaacgaguuuccugugagagucuucucaagguuuuagguguucugaaaugaagcauuuguuacuggcagagaauaagaagcagaacaccuacaggaugcauuagcucaagaaagcaagaaggcaaggcagcuaaugagguguuugggagggacaguacucuuacuuagggacugacaguuaggaacugaguaauaagucugcauuggaauuaaagggacuggcuggcagacaggcaggcgucggcaccauuguauuuuguaaacuuucuccuauggcuguaguguguuuuuuccaaacccacuuaauuuuuuaugagguuuguaaaggucuugaauaaacaauugggauuauacagguuuuccuggaagcuuugguuaauauuuuaauaugcucugcuuugucacuuuauuaaauagcuuauuggaaaguuugaaagagggguuuccuuuuuccuccccuuucccauguccuaguaguuaaaaaucaaauuucaaaaucagauuuggguuuagagggucucccuuuuauuuggaacucuuauaucugcugauuacccuuggguugcugucuggcaucugggaguccuccacuuaaaacacacuuuaagugaaauuacaguccagagggugugucuugaaaaugagcccaugauuguaaguguauggagaaaaaggcaugaagaaagggcagggggaauuggauagggucagagaacaggaaccaguagaaccucggagauuaccucaucaugaccuuuugcucauuaauauuugagucugauuuguugacaucuagguugccaucuggugaaauggacagagacugaauaccuucaaacacauuucuguguuaaugggcaggcugaaugaaauugcccuguaaccugaacaggaguuauggcgagagaaaggaaguuuuuguguuuugcugggaggacucauucugugggagccggagugcaggaauuguugcucuuuguagaauacugugugguccuuucauuuugacucgugagucagugaagacgauguccauuugcugugcugggacugugcuuaggcucgcccagcuccccaccacuccugggaagcuucuguaacuaguuuagccuuguaacccuuucuucuaaaaucagauagggcuuagcguuuacucugcucaauuuagcauuuaauugcuugcuuccccugauuugcuucagaaggaagugcucucucacuguuucccccacagacagaauuacuugguuuaaaaguagaaauucaugugacccuguagaagacaugagcaauaaaauauuuugaauccauaaaacauuuuaagcacauauaccuagugcuauauuuagcaccacaggaauaauaauuauaaauguauugcacuugcugagcacuuagugcaagugaggaacugugcuggaaguagcauugauuuuuuuuuuuaacccgaccauuaaaguaaucuuguuugcacaugguaaaauagagaagacggcuaaagccaguguucuagcacauguuuauauaugugcacucauuagugguucacuuuucauauuuuauugucaauuuuaguuuaaaagacacauaguauuuuuaugaaagcauaaauguuugccaaguggugauggaaaguacugacugcuuccuacucagaaacaggaaaguguuaacuaggaagacuuucucuaaaugacgccuacacaccugucucccacccuugauuugauauaaacugauccauuuaaaagauucugaaucaaauguguugccacaugcuguaaugccaacaagcaggagacugaaggaagaggcugaucaguuggcggccagucugggcuguguagggagacagugcugucuaguuagacccuguguaaugcugugcaccugcgauccuacugcccagaaggcugaggcagaaaccuugggggaaauuugaggccagcuugggcuacugaguaagaaucugucuuuaaaaaacaaacaaacaaacaagaaccaaaaaauacugaacauuuuuaaaagaaaaacaaugauucuuuuaagguacuggcuguguagcacugauguuggacuuaucaucuaauuacagauauuguaaauuuuuugagaaaauaugaacuucaggcaaaguguuggaauaucaguaggcuuaugauuaaauaagcagaauaccaaagaagugagaaaagaggaagaacuguccaagaaacucuucauuuacuuacucuuggucauuggcuaguuguuaagcuacaacaggcagauagacaguauggggacuuggaagcaaaacccugcuggaggcagaaaacugacagauauuccagaaguugacagacagauacacagaggauuaugucccuggagagcugguaaccacuaugcuguuuagcugaaaugccagcagggccaugcacagaaacuauuaacaaggcccuaagacuaaaggcaggaugagcauagauccacaguaauaaaguuuaaaaacaagucuaaaugaccaagacaaucuaccuaucuagcugcuugcuagaacaaauuuccaaacucuguugaggcugagaaguuaaucuagagacuguuuaacaucucaccugcagagcacauguacaaaccaagauuuucuaaaaugcuaauaagaaggaaaagcuaacuuccagugaaagcucacauaauuaguaggcauagguccugaaaagacucacauuaacaaacaaaaagcaaagaaacuaacaaaaauaacaacccuucauaguagggaaaauggaaaaauagcaaaaaagaauggaauguuugaguaggauuaauauuuauuguuuauucuaaaauagcaaaaucgacaauugaauacacauauggacugagcaugaggaaggggguguuuuauaccagacuggcuucaaccccuggacuucucccauuugaguguuacaauuccagauguacacugcugcaacugguuuuauuauaggggguuuaaaagguacauuaaguacauuaaacaauggacucaaaacugaguucaggaugaguaaucccaagaucaaauccguggaaagcucccagauuagcugagugugguagugcuacuugguagucagaagugggaauucagauuugagcuaaccuugacauaucacaaggucuuguuugaaccagaaagaguaggaagaaaaagaaacagaaagggucuccucccucccauccccaaacucacagagagaaaaaggaaauuuguagagaauaguugaaaaaucuaagauguguuuuuuucacccgaugagaacuuccuaacaaacuuauccaaagugaacaacaggaguugacaauucauguaacacauugaacaccaguucagcauagcaugcuauuggcucuugauguccucuaucugugcauagccauugucacugcuaucacaauuccuuaggaagaacaagauuucaacuaugguuucuauugagugcaucaaagaaaaaacccaacaugcaacugacccagucugcaugggccugucugcucucagugucccaggagaggaaagagagauggcaguacaaaagcaucacucaaggaaggugguacucaaagugccucugugguagagaugauucugccagcuccuugagacauguguagugcauugaaagaccuguuuuuuuagguaaauaguagugagguugcugauguuaaauguagagaaaaagaaaucuuaauggaguugggauguagcucaguugguagaauggucaccuaauaugcaucaagcccuggguucauuucuggcacugccuaaagugugguauauuacaugccuuugaucccaauauuuagacaauagagacaugaagaucaagaguucaagaccacuccucagcuucauagcuaguuugaggucagccuagucuacaugaaucccuguguuuuaaaaccugguaaagaacaaagucacauugaguggauaguaagaauaauaguagauuucuuauagaugugauaggacuggaggacagcagcugaaauuuuagaaauuuuagaauaaaaacaagguuaucccuacauaguuaucaauauauacuuagcauaaauauaacacagaaaaaaaguugcuuguuguuagccaugaugauguaacuaguaccagccuagaccuuguguucuggacugaaugcuuucuguuagacagccaagagugcaggguggugaucccagagaaauuagguaauuagaacccuacaaucuccugcuggagaaccuggaagaauggcacugcuguuggccuaggaagaccguggcuagagauuagaacaaagugacugcuguguucaugaaagugguuuaguguugaagaugccaucuugagcaauagagugagaagugagcacagagauuccuggcaagcuaugccucauuuuuuucacaugugaauuggaauauaugagaucaggcaaaaaaauaauauaaguagacacaaagcagccaacgugcagaagauaagcacuuaccaggauucacaaagaggcgaggucuucagacucaacuuuccucaaaaccuucaguaaaaacaccuaaagaguaguagcaaguuagggccuaaguuaagccugggccuaaggugcuucuguaucagagaugauuccagccuucauacucaugugcugugaaaaaggagaggugauaacuuccuguuuaaggagagaacuuaaacguauaguccaauagaaucacauuccaugacagcuuugacuggacccauaacuaggaaguaugguguagggauggccaagguuggcacacagaggaagcccgauguuucugcuccugcacuugucuuuucuuuucuuuuuuuucuuuuucuuuuucuuuuuucucauuguggugcuggacauggaucccaaggccucaaacgccauuagacaaguggucuaucacucagccauaccccagccccacagaacagaguuuauaguguacaaaagaguaaacuaauacuaauaauggccacuuuugaugcaaaguaggacaguaacuagugaugucauccaggagcauaaacuguguuuuuaauauuagugaauauauaagugcuuuggauguuuuuauaaagauagcuaaauauuaauuuaaaaucuauuuuuaaauuaguuuagaauauauuuauaaaucucaauguuuuguaauaaaacaaaauccacauuuauaaugacauuucagaggucuuuuuuugcuuugaguuuacugacaugucauagagcaauaaguacugguuuguaucuagagacuauugcuaaaauuuauaaaaaucuuaauuuuuucauauuuauuuccucuuaauauucuuucucaguuuacuuaacauuuuggaauauuauaucucuacuguuaauuuuaaaauaauaugccucuuagcuccauagucgagcuuugugaauauagcuuacuguuuuaauuaccauaacugguaggauuaaaccaguauuuaauguaauugcuguuaaccuauguauucuuucaaggcuauaagaugugaaaguaucaugauagagaaccuuaaagaaauccuaguugaaaaauagaauaaguuauuuaaacucauaucuagggauguccacaagguacagugcuugcuuagcauacaccucagguugaccccaguaccacauaacuuaggcaugguagugcccaccuacaacauccacauuuuggagguugagacaguaagaugaaggcuacucguggcuauauagcaagucugaagccauccugggauagugugauucuguuguaaauacauaaaauaaacaaauaauaaauagauuuagguagcauuugguuuuaacccaucaacuuucugguuuacauguuuguauuucagggaaagguggcucagacagcauguaugucagcuugcaagcauuuagccacauccuugaugcaacuuuugcuagaagcggaaguacggcagcucacuuugggagcauugcagcaguucaaccuggaugucagagaaugugaacguaagucugugaaccaucuuugcuuauuuguuuuauaaacuugcauugucuuugaugugaaagaaacacugaacacuuuuaggccuguugaaucaguguuccucauagaaucagaaaauaucuggaugggaaauuuaucuugcaggacauuuuauuuuuauuuuuauauugauguuuaaaaauauguuuuaauugauauauaauuauaucuccuuucccuuuccuuuucuuccuccagccccucccauuugccuuccauucaaccccuccaaugacaccugcaacuuacaaguugauagccucuuuuuaaauuauuguauauauauauauauauauauauauauauacacacacacacacacacacacacacacacacacaaauguguguguguguguguguguguguguguauaaauacaaucugcuguguguauauuuuuguuggugguauuuauaugguuucagagcuucccauacuguacuggccaauaagggagcucaccccuaggagaggcuaauucuucucccaacaaucacuguggccuguaguucacuauauagaagugugauuccaugaguuguuccccauuccuucuuaauguggccauuugauauuaccauuguuuuugccuuguuuagcuaucucuaggagaaaauuucacagcagaccccuugguauucugccucuggcuauccuucugcuccuucuccuccauguucccugaggcagagauguauaaacaguauuauagguguaucccuuuuggcugugcugccaugaucuguugaucauuauaugcaguuaugguugucugcgauggucuccauuugcuguauaagagaagcuucuugaagaggacuggcagaucccguuaucugaaguuuaaggauaagauuuagagugucguaugcuggucuaacaaagaagcagcaaggcuuucucuucuaaggucauugaccuuacugagcagguuacuuaucuccuuugacauauagaacauuuuaauaauugcuauucaaauaguuccuaugucuacauguuuuucagcauuauuccuugguuaauuuuucccucugguuccgagcuacauuuuuuaaugcuuugcaucuuuaucauuauuuacugaauuccugagauuuuaaauuucaccuuguuugguauuuuaauuuaaaagauuaaaauuacauguaagucacauggaauuggucguauacagucaagaggugcucauucauacagucuguagcagccuuuuaucucagcccccuaagcgcaauuccaaagcaaaucccuuugaagggcugaguccaaccugcuagagaguggaaggcuuucucuccugcuuguuggaaacaguaggugcaacuggaccuacacaaauuauugugucuaaucgugcuugcucuuuucuccacuugggaaauuccuuucaauaaacauguaauuugugcuuuuuauggcuuuaaucugaaauguccaccacaaacucguuuuauucuuccucagauggugaugcuauccuuugaggcacugaacuugaugcuuguagaucacuaggggcaggcuuuaaagauuuuagggugacuguugauuucaguauuguucugcauucuggucuccucugagcugaggagucucuccacaugcuucuguuguugugaaugcuaccaugcguuucccaauaggcaggauggaaauggaaaccucagauaaauuauaucucccuuaaauugguugagucagauguuuuggucacaacaguacaucaccaaguauccagugagacauuugugauuuucagcaucuacucuguuuuauuuuguuuuucugucuagugacuugaauuuccaccacuguuuuguuuuguuuuguuuaaaugaagguuaaaauccuugacuauugauuauauuuccucaaguggugauuuggaacccagugucuugccuaugguaggcaagugcuguaguacuaagcuagccccaucucucaagccuuuaauuacuuuaugugcuuuagauucccuaaacauuuuuuguaauaaagauauauguaucauuuguauaaugaaaaaaauuaccucuaaaaaucuuggagagauauuuauaugagucugcuacuauauacaccauagauuaaugggcagaagaacacucauuccaauguuauuaaaaagaagcuagacaaaacagacaucuagagaauggagugagaaacuagaaaagagacaguuccugaagaacugucauccucagagaaagaucuauaagaacuuacuaaggacagacagauuccaggucauucugugaagcaauaaaagaaagggcaccuacacaagugugguugucuugcuaaguugaaaacauacaaacuaauccaguccaggaggaggcauggccaugggucuugaaaacucagagaugguuuaguggauaaaguauuuaccaugcaaguaugaggacccaauuugaacccuugcaaccaaaguaaaagccaggcacagcaccauggaucuguaauuccaggucuccuacagcaaaauugaaaucagaaacaggagaacccucagaaucugggaaccgguuacuuuggcauaugcaguggucaggagaccccaucucaaaaagcauuagaaagugagaacugacaccugaaguuguccuuugaccuccacauauacacccugguacacaugugacuacacuuacacaugaauguguguguguuuguguguguguguguguguguaucauacaaucucuuaaaaguaaaaccauuacuuucuuacauuucagaaacagguauaauucugaagauuucauacaaguaugcuaauacucaguaguaaaaaacucuuccuagaagguaccuaggagauguuuuucuaauuggccaaaauucauucaccuaauucaugucuuaaccaguuauuugcuagaaggauagaagcauacccacuggcuagauuaaucauaauugauuacugaagccaagaacaaagccauccucuugaguugaagaaagagggaggguucuuuguguuaggaggaaaagagggaagaggcuuaaguuagaccucugucaguuucacagggagggaaggcaugaugagugauaggcagugauugauggacucugucauuguguuuccauagagcuacgaggcacagcagauggagggagaaacaguggaguguaagacugggaagaggagaaauguuccggcaagaauagugcagagugaaaaaaaugucacauuuagaaccuuauccucaaguaguuuguauuuagaugaauuaaagacauuuugugguaucuucaggugagccaacuccucaguguaggggcaauucuccauuaagaguaagaaugcagagaucauccucuuaagaggugggagcacacugguguguuaacuauguccaagaaguuuccaguucucaagagccaguauuuuggcaggaaggccaugucauauuggaguagcuucagaguuaauugaagugcaggaccugacuguccugcuaauaaaacuagcaucaacauucaacuugacuucuugugaguguuugaaugagaauuaucaccauaggcugaugguugaauauuugguccccauuugguggaacuguuugggaaugauuaggagguauggcauuguuggaggaaguaugugucuuggggugaguuuagaaguuucaaaaccccaugccauucccauuuagcccucccuaccuggugauugaggaucaagauauaaacagucagacacuggcccagcaccaugccugccugccugccugccauauuuuuagccaucauguucauggacucuaguuaaccuuuggaaacugaaagucccaaguaaguucuuucuucuauaaguuacguugguuauauugucuuaccacaccaauaggaaaguaaccaagacacuauugaagggccugacaguuuuacugaaacuuaguaucagcacuuaccuggagacuaaccauugcauggucugacacccuacuaauaaacccagcauccgucaugaaagucucuucuauauauugaagagccccugagcuucacugacugaggauuuaacauuucauuucugacuggcaguaauuuaucugucaagaaaacuuuccauggacauuuauuucaguuaaaaagaaauucuauucugugccuuucccuauaccacccccuucauuuuuuacuuuggaugcucaauggucuauaaaaaaaucuuaaagaauugauacauaaaauucaaauaguuagacagaggcguauaaaagcagcccagugacaaguuaauuagcacuuacaucuuccuacccacugguuuaugugagagauaguuucugcuuuuugucugugaaucuuuggaggaagugucuaaguucugaaagaaaauguggacaugauggaaugugagugugcacugaaggacucuuaaggccugugcugccauuuucguagauccagagcacagagaguaguuggucaugcuaguaugagcugagauacucugcuaggauaguguuaucuuaguaagcuugacaaaauagauacacuuuaucucuuucuuuuagauugcacacuggcaaauuguuuagugcuuuacaaucuuauuuauaaaaugagaauaaugccuaauauuauagggaugaagcuaggguuaaauaaacuaauacaugaaggggcuuauuucacuggaugguaaaugcuguguuaccucaguuaucaucuucagaucaggaguagcaguaagccuagauccugucauuuggaaagucuucugcagauggugugaauguuaucuagaguuugagacucauauaaaugugaaguugcuauuuaguuuaauauaaaaauuaccuuaugcuucuugguaauugucuucaaaacuucuuggguuguucuggaaguuaugauccauaacugaugacuaucuugaugguucccagcuugauggcuuuguaagaaaucacccaguagcuucacuguuuccuuaaaguaguaaccacugccgagguugucaaccucugaaaggugugauacugaagugauucauacuggcaggccauccaaccaaguaccugcaauguagaguuauuaagaaugcaugacuguacuuuuuuuuaaaauuuaagauauauuauauauaauauuuuauuaauuaaaauaauauuauuuuauuucuguaguuuuagauuuuaauagugacuuccggguuuuucuaauguguacagauuucaucuugcauuucuguauuaguuacuuuccauuuugagcucaucaaauaccugauacgaagcaacuaaguagaggaaaggcuuauuuugacuuacaguuugacgugauauaguccauaguaggggaagguauggcagcacgaguguaaggcuucuggccacauugugucagaaguaggaagcagagggauagauggaugucaggccaggcuaucagaucucaagccuccucccauucccagaaacucacuguuuccugcaaggcuucauggcuuuccuuaucagugcuccaacagagagccacaacagucuccagcacugugaucugagaugugguguuagaaguuaauucaguaaccuguccauuuauucaacaaaauguauguggagcuccagcucugcaaaguacugugcuggacacuggcugagagcagauguuguagacuucagagacgaugguuaauugauuagauuuguguuuccaggaggaacuuugauguuccaagaaguugaaaguaguccaaaggcuauuuuaacuccuaguggaggggauuugggucugaaccaauagcuuauuuaaccucccuaagcaguauccuggaaauaaaaaauuccuguauguucucauacaaagucaaguggauggauguaaaacuauugaagugauuugguuuuucucuuuuacaaugaucauuuccuuaucuauaugucuauauauuuuauuuuccauuuuucuguuguguauucaauuuccuaaauuauuuaaugauuuaaaacaucaaaaacaccaaauaaugaaaccaaauguauguuacauaacuaucauuuuacuguaacccacuauuucccauaaacuuuuccauaugauuaucugaacaagaaguuaacaaaaucaauacauuacugugaauuaucuuagugugcuuguuuguuuugcuuuguuauuuugauuuucgaugccuggcuaagcuuggcuuuggcuuacugcugaaaaaacacaaggucccauagucuuccacaucaucacucuuacacuaauaauccuuaaucugcaauccagggugucaguguggagacucuuccuaaccucaaaaggcaacauuuaaacaaauuuaagaucucagugaaccucuugugauauaagaacaacagaaaacuacuugucauuucugcacucuaauggaaagaugaaauuucuuucuaacuuccuaaacaauucauuugguugcaguaucagucaccaggagcuccuacaaaguuuuaccuauuuucaucucuucuuauguauccacuaaauuaauguguacaagucuuugucucaagugaaauagucacugugugcuaguuaggcagacuuuaaugagccugcuuauuucuggucauucuacuggauguuagggaucauggguccuuuguagagagauccuucugaacuucaggcacuuagcccaaauaugugcugacugcuguaacugugcccauuuuaaguuuucuccacuacauguauauagcuacccguggcuuguuucucuucagucacucuucccaagagugucugagcuugacuuauuuaugaccuaacuuguauauuccuaaugugaggaaguggagagagagaaccucggagaaccuagcagaugcagggaaagcaugaauguugugaagagaguuccuuaaaucacagcugugccagaucuagggccaaaucugccucagucaaccaagcaaacaaggaaagugacuauuagcuuguaccacgcaucaagccuguacaguuggauguucuacaguaauuaaguugucaaucaaaaugauguuaagucaugcagaaugcauaaguacccaguuuccccuguuuucugcucugguucccaagacaacacauauuuccuucaagauauauucuuucuuacuuugcuuauuaucccaaagcacuucaguuuggauccuggucacaggauaaaaugucuaagagacaguaaagaagaacagugcuucucuucucuggcaaggacaacacaaggcaaaaaaaaccuuguuggggaggccaaaaguucaagaagccaugguagcucagucccugugcauuggucaagagaacauggcaaguuuguaaagguagcucaagcucgguucuucacuucaugcucuuggguuuuagcuuacucugcuaguuagcugcaggccaucauggggcuccuuagauguugcugucauaauucucuuuaguuucuucauguagacauuucuuuuugguuuuuuugagacaggguuucucuguauagccuagccuggcuguucuggaacucacucuauagaccaggcuggccucgaacucaaaaauccuucugccucuaccucugccucccaagugcugggauuaaaggcgugcgccaccacugcucagcuaguguagacauuucuagaaagagccaagauuuacuguuuugauuauaagcuguccuguaauauuaaaagcaaccacaugacucacauuccucugccguuugcaauccauagacagcaacauaauuucaguccuccaguuuuccuuccuccauggaaauguguucccaugugacccaagauaauacuuuggggugugagcuuggcuaccacauuucacaacuuaguguucagcggcagcuuugucugccaucacuacuagccaacuucagauacucuacuuucucuuuuguuugguaccucauuccccaaucacaaugucuuugauguauuauuagauauacuuauuaauaaguguuauuagucacugugcugugaugccaaaagaccugaauaguguauaaagcacaauaauguguauaagauuccugagcauugaaggucaagaucaagaugccaaaagguuugauucugcuuccagcauggcuaggaagagccuccccaguguucucugguccauugguggggucauugaucccaugccuaaggacuaaacccucagcuucaugcuuuugcucuauggcuuagucucagugaauaugcaggcacacaguagggagcugcacagcaaggagcccacuugaauuuggggcaguuccagauuagaggaguguaugcuuuaccauauaaauuucauagaggucaggaaaauagcaggcuguacauuauguaagcuaaggauccuguuuguccucuccauccuggcucuuuuguaccuaguauagugccugauacuuaguacuugaaggauaacugauuguugaauuugcuaaaacugauacagguaacaacuacacuuucuagcucacuucuuccugcugcaagauuggaggugaacagagauaaguagucccuguucaccccaacauuaugugaugugaagagagggacaaggaggacauggcuugaauaccaaguucuauaaguuggugggugguacuuuuagugcccaugcccugacacucucccuuguggguuaaaaggccaccuuucucuuaacaggcaguucucaauaugccagcuacacugugcuugagaauuagaauucggccauacagaacagauugucuuugauucuuaggugugcaguucaguagguaggucauacucauuccucuagacccaaagugauccuuugugagagugacugagugauucccauucuagaagguagccuucacauuguuccugccuucauccucacugagaggccugggcugaaacccauucgauucaguuuugcuaccaacuagcuauguggucuuggguauccaucacuuauguuuggacuuugggcucuacuuuuacaggaugggaaauucacauuagauuauuuccaagauagauuuauuaugagggaaaauuauguggauuuuuaaaaauuucugcaaagaaauguaaguauuagguaagaugaggggugugaaguauuuuguagaucauguacauaaauauuucuaauuacuaaauauuuaauauguugauaaaauuuugguauagauacacgugaugcccuacccuguaggagacauccaucuaagaauagaguuagaaagccagcuuccagugauccuggaacaguuuuaaguucaguggccaguggcacaaggucagaauuuuuuguuuguuuuuuccuuuccucaugagaaaccuuacauguaauuuuuuaagaagggaaaauuugcuuuauauuguuugucuuuggauaaugaugggucagagcagucaaaucaucaacauggcuguacuuuauacccugguggaggugucuguguugugggugagaucagaauugacauaaagacauguugguuaagcaguccugaaucucagaugacacuacagagcugauuuucuuaggacacuuaggguucaguacaugcauggagagaaacagauuuaaaaauaugaaguuugcuuucugugaaauuaaguaaaucuuggaaaugcucauuuccucuagcugacagcgucacuucgugcgaugagcaguugcuucuagacacagucugcuuucacccuuccuccagaagcugcuuuggaaaucacugcugaagugucuuuccuucuucaccuauuaaaauagaguaagguuugcaaagagccaaguggcuaaaauuuacacccaguucauauuuaacccucauuuaccagguuaguaauaguuaagagaggccccuucuauuaaagaaagagcuuggagaugcaaaaucugugcaguagccugcugggauauccaguguguuucaguaccauuaauuccaaucccguuagcugcuauccucagcaucaccaugcaaauuauaauucagaaaugcacauucucuuucugcccucuuccaucagagaaauaugaaggucagaagauugacgaugaucuucaaguuuguaugcagagagauaaacuuguuuuucuaauuugcuaugugcugcacaugugaagaucuaaggguaauuaguuguuauugcuuuaacaugaugaagacaauaacuucuccauaagaaaagcuccaugguuaauaaauuuugucucugguugauugacugguuaauggaaucaggaaaguauuuuaugucugugcuuuacaauucugcuucacucacucccuacuaggaagguuuauagcuggucuuuguuuugauuuuuaucauuuguucccccccccuuccucgguuuauucuguauuauuucuaauucucacuuuaauuaguacaugugcagaaacuuaaaaaguggagcaaaccaugaggcuggcgaugguguuuauauacaaccuguaucaguucagguucucugucacucccuguguugugguuuuacauuggcuguuuuaugucaaaaucagaacuuuuaauguaagugcaguggaaaugcacaauagagugaaaaugguucuaauacugacaucaguuuucuuagcuguguaauuuuuaaucagcugcugcaagcacuucuuuggaaaccugggcuguuuggcucccaccugccucaugagguccugcuggaagccuuuguuugccuuuauggcuugcuccugcaguacuuuuaugguuuaucuuucuuagccaugugagcccaaauagaaggccuucuugccuuuaaaauggcuaugucauuucucuuugacugugggugauggaccccgugcccucuggcaaggcccggcucagacaugggucacugaguagugcccacucagcacuuauuuugguuuugggaugaaguuccuugaauuccaggagauaaggccgucuuuguuucucugaguccacugccagacacccagccacuugaucguagaugcuggcaaccugagcagugggggcaggcggccuguucucccucagcauggccugaggugccauccugucaagaaaauggagauggauuguccugcucuaaccucaucauaugucacugucaagcaugcugcugccuuccaaagaugggccagcauagacaaaguaccuuuucugguggcagauguuaccuuggauugcuugugggauauuagugaugaaggaguacaaagggccggagcgugaaaggucuuaauuuccccaguaaguuuuuuaugugugggcucuccacggaccugcauguuuggcuggcuauugggccucugugucaucaucucaucucugaagguaguugcugguuccucugugaaauuguuuagauauuuucuucuuguuuucaugaaaggcuucaagaggaagacagauaguggcagugcagagucacuuaggccacugagaggugccaggcagccaucuuccugcuuuauggucugaagaaagaugggcagaauuuuaaaagguugucauucuggucuugauguuacuucuuuuauucuuugcaucucuuagcuaagcacucucaguuuucaguccucaguuuuucucaaauuugagacuguuuauacuuugaacaugucagauauuagacaguuuacaacaugccauuucaaaaaagagauagcaggcacauuacguuuguggccacuuuccuaucaugugguccugcauuggcuaaagcacauuggcuuauauuuuggagauuauauaaugauaaucaauuucucaauacuuuccacuauuuuuuaaauaaauuaaaaguaauuacuuaaaaauguuauaaauguagcuggaaagcagccaagaguuuucacuaaaaugccauugaacaguagcgcaucugagccaucuuagccaggaugccugccuggucgcgagagagcccagggacuccuggucagacuuccuguuugcugaagcugucucugcuuggcgcuuguagccuuccaccaagccauguguaacuucuuccucaggccagaauugucuuguguggagcagaccacucccccaagaaugucuggugugucccuguucuuauugucucccugggauuauguggcaguuuaugcuguguguguuuucuuuggcuucacacgauguuguuagggcuaauaccaaccauuacuuauuuuaauugggcuguuuuauaaugggagaacauauuaaauaccagaucuuuuuaaaaaauaucacuuuaauuauagaaacuguguguguguguguguguguguguguguguguguguguguguuugguuguuuuauuuuguuucauuuguuguuuuuuauuuugucuuuggaacuaggaaacuaacuuaagaccuagguuuaccaggcaaaugcucuaguaauguuacaaucugucuguggcuuuucaggggaccaauaccgcguuuugcagcaauguaugcauguguaagauaguggguguagaauuuguaagagauuuuuaaaaggaaauauuuuccugccuuucuacuguucuaggucucagcauuuaaugaucuccuuucaggucugcugugucauugcaucaucagguuccccucuggugucccuuaaaugguuucucucugugugucucucugucugucuguaagucugucugucugccugccucuaucuaucuaucuaucuaucuaucuaucuaucuaucuaucuaucuaucaccuaucucuaucucccuguguguaguaaacuaccuugggauuuucuuuuuuauauucuuagauuagaaguuauacaauauuaagaaaauaucaucacuaaguuuuuuacuuagaaaagugaaauuuccacacauaaaucauuguguagaacuuuuggaguacugcccauaauguuucauaguagugcguaaccuggauuuugcuacuauuuucuacugcucuccuggucagaagaaguaggaauaguaggaucgcugguuagaucaguauaucauuugccuguguuguuucuuugguuuuuguuuuguuucguuuuuuguuuuguuuuucuuauuuuuaucuuugucuccaagaggauggucccauccccacccaccaugcccuucaggccaacccagugccuggggccucaagucuaucucucccuguuuuguuuuguuuuguuuuguuuuguuuuguuuuguuuuguuuuguuuuguuuuguuuuuugagaaagggcuucucuguauaguccuggcuguccuggaacucacucuguagaccaggcuggccucgaacucagaaauccaccugccucugccucccgagugcugagauuaaaggcaugugccaccacacccagcagaccucaagucuucucccacuaaggccagaauaggcagaccucugcuguuauuugucaggggccuuagacuagcucauguaugcugccugguugguagcucagugucugagagaucccgggggaggggagucccagguuacuugagacugcugguccuccuaugaggucaccauccucuaagcuucuuccagccuuucccucaauucaaccacaggggucucuggcuucuguccuuuggcugggaguaaguaucugcaucugauucuuucagcugcuuguugggccucuuggagggcagccaugcuaggcuccugucuguaagcacaccacagcaucaguaacacugucaggccuuggaguuuccccuugagauggauccuaaguugggccagucacuggaccucuuuuuccucaguaucuucuccauuuuugucccugccguucuuuuagacaggaaugauucuggguuuaaucauugaguaucuggugaauuuuuaagucuccgucucugccuuagaccuucuauuaacuuagugcucugcaugggcugggauagaauguguaguuauacuagaugacugucguuauccguuuaccuagaaggagguucuuuggggaauuugaugggcaaaagacugaugggcagugguaugaacaaacugagaggaaaauaaaagcuuacuauauuagacaaguuuguuauagcuacaagaugacuaaaaugaagucagguagcuggaggaggugauacaacccuuaguuauuauaaaucuuguaagacuuaguaugaacuggguacuggauucuaagacacugagaacugucacuuuacauaugagauugacaugacaguauuucaguuuucaaauaccacugugaaaauuaagaaaaaugcagaagugaguguuggaccugaaacagagcuaguuauaaguaggguuaucaguuaaagccaacaggccaucugggucaaguuugaauuucaaauaaacaacaaguauuuuuucuaguauaaguuguaaguaucuccuggaccagaaagaacuguuucugguuuuaguguugaagugcuuguaauaugaugaucuguuuuaggagugagagcuaagucuaaacacaauauugauuuguuucaugggcaccuuauguagaagcuaaaggaaucuuuauacaguauuuuuugaugcagccaaauuuuaacuuaagcuaucaugugaagacacauguauacucuuucacuaaauuauuagcaaacagaaacauucaaauuucugaagauaccagauuuccucuguucuaguuaggaacauuuugcaugaauguauccgaaaugaugaagaauccuuacacagguucugaggccugcaacacacuggauuagcgaggagggccccgaagacuuaagaaugagcauguucugcagucucauuauagaaaccagaguuccucgaguugguugaauacaugcaccauaaagaaacugaguagguaaauguccucaggccuuugugaccccagacuguugguggccaugcuguccucccuuacauuauaaauaacaccaaguauuuuauauaagggaccaagcacaaagaaagcauucuucacuuuucuguagcaucaauaaaauguguguaaugcccugacauccuuucuguccucucauucugaauaaugcacuuuuuaaggaaauguagcucccuaguguuguguuuaccuaaucccagcaaucagacugccugaggccugcccuucccucugacucacuggagucucagucagaugucuccugucaauggauggaaacaagauguagcuuaauccccuguucuggcaacuaaccaggaagaagggcgagguucuccacucuccccuacaaaagcauuuuugagggcuuuuucagcaaggaccauuuuaaagacagaagugccuuuaauacuugaauugcucauucaucuccuaugcuuccuacuacuuaagguuguccuuaaaaaggaccagucuguugugggaagaaauugcuuguauaccuuuuucuucaacccuaaaugcuuccuaagugcuauugccucuuccaggagugucugaagagcuaaugucucccaccucuccagggcaccugcacugcucagccaccucuggccccucacuaaaagcuuccagcccagaacauuuggauugcuggcagagauuuuuaucuucuugucgguguuuuuauguuguucuuuauuuauuuguuuuuauuugccugauguaggaaggaaaaaagagaaaaaaauaaacugucaucucaaaugaagcccugugcuaguuucaugcucaaaugcagcaccugacuucuaaaaauaaacuuacuagccauggaugaggagggggcccagugccccacuuagagcauuuaacaugggugugggucauuguaguaauaccugacauucaaauucuccccaacuaaucuacucucaaucccaacuaauucuaaaacaaugcaugaaaugaagagugagaauuaaaaggcaugaggaaacacuaaguuccuuuaggaaagacagagacccacuuccuguaacaucucaaaaaugaucucuggcagcgaaaucuuuaagcauuuucguucguuggaggaaaugcuguugucugcuuguuuccaagucuguuuucauauugcuuuugcuagaagaacugugguuacaaucucaauguuaaacaugaacaugguauccaaauguucugugccuaaucgggauaguaucuguguucuaacaagaaaucucuuaaugaagcuggguggcucaccaggaagugcaauuuagcagaaguuaacacacacccuagacagcagcaagaguuaacacacagcuguaaaagcuaacacacaccccacagaccaaggacaauuuuucaggacugccuggcuuuacacucuaguaguaagucaguccucccgcauucacccaugcuccuuccagcugaccacaauugcaaggauucccugaaagccucccaaguuuaauaagcucuuggaacacacuggaaguucuguacugcuuagaauuacagcuuucucauagagacuacaacuuagaaguaggccaacagagaaaguacaaagaccugauuaggugaagguguguguagcucuuccuuggacuugcuuuauggagcuagcucuuccuucagcauucaauguuuuacuagcuaggaagccacacugaaccucagaguccauaauuccucuuuggguuucccugcauaggcacauguguuuuaaaaaauuaaccacaugauugaagucaaccuauaguccuguuuuuucucccuagaacucuggggaggacugaaagcacacuggaaaaucaaguggucuuuugacauagacaaugcuccacuuaaaacucaccaagagcacaugagucauggcuuuggguuuuguuuguuuguuuguuuguucuuuguuuguuuguuuguuuuugcacaaacucaauugcuaucaaaaugaacucauuuugaaugacaaaagacacuacuaucacuagaaaaaaaagagcuuugaaucucuauauuguagaaauuggggucaaaggcaaguuugauguuacugcuaugauaugagauccaagaacuucauuggcuagcaagggcaggaagcccaguuaccuucaaugauaaaguuuauguguuugggcaugaauuagagaaugcagucuguggacuuucacauaucuaugaaagguaaaucaaagaagcacuaucugcuuccuuuguggaaagagcugugcugauuucuucuaaacuuucuguucaaacacagggagcaucccaagaaaaacccaccuuaauuauuucucugguguccaacuuuuccuaugaggugggcuugccauuuuuuaaauucuucucucauauacuacaucccaaacacaguuuccccucccuccacucuucccaguuuccccucuaccuccucucuuccccagauuuacuccuccauuucccuucagagaacagcaccuccagagauaucugcugaacauggcauaacaagaugcaauaagacuagguacaaacccucauaucagaguugggcaaggcaacccaguaggaggaaagaggccucaaaagcagacaaaagaauuagagauaccccauucccacuguuaggaguccuaaaaguaccaagcuagcaaccauggcauauaugcagcggaccuagcacagacccacaugggcuuccuaacugcugcuuacucagcauuggucacuaacuuuucuuaaguguguugucgcuaccauaaacuaccugggaauaaucaaccuaaaggauaaaggguuuauguuggcucaugguuucagaaguuugagaguauggccauaugauuccauugcuuucaggcgugugacaagccagggucaucauggaaauuauaugaugaaggaaaacuguucacuucguagcagccaugaagaaggcaagaggagggaggaugggccuaggggcaaggcauauccuuaauggucuauccccaguaacacgcuuccuucugcuaggcccuacauucuaauagacaguucagguaugaaauaaucaauagaaaaucaacugaagaggucaaugcccucaugaucuaacuaccuauuaguauaucuguuugcuagaaacacagauuucaacaaauaagacuuucuggcuaguuguuucauauucacuuacaaugauacuauuuuugagacuucuuuccuccuucuccuucccauaagauauuacuguuuaucucacacugucuugaacucugcgagccuuggcuggccugaaagugaucuagucuaucaagugucgggauugcaggugugagcgcccaugaccaacuugagauucucagugaucauccuuuaucuuauauuauuuuccuguggaacacuuugcaguuauagcucaaaguaguuacuuggguugaaaacaaaggcaaagagcuugguuuagaaguaugugucauucaaaaaucaucacuguugcuuuccaaaagcaauuucugaucauuuucaguguuuucauagaaaaauauaaacuauguacagaaagccaaaguaaaauggagcgagaagaaccuaggaacguguagagaggaagggcuggagagagcuaacguaaguuuuccuacagacacauggaagaauaaaccauguaucucagucaugaucuaacagugcaaauuuacagcuccauauucugagagaaauuccuucuucuggaaacugaauagaucugucagccaugcucugaauguuugccgucuccaacuucauacauaaaaauccuaacccaaaggaauuagaaaguggaaccucaagccugccauugggacauaaggauggauaggcacagagagaucaagguuucccagcaguguccccagagagcuccuuugcccuuucauccugcaagugcaugguaagaaggcugucuguuccacagggcaggccccugcuguauccugagucugccgaggccuggugugggacuagccagcuucuagaacugcuucuauugcccuaucucuacacuuuaugaacuuugucacauuggcauguguguaguugggacagaagcagacgucaguuuugcgaggcuuucaccccagcucuggagccaggcuaaugcagaagcuguucuguugcucugccguuuugcugggcugcucuccugccucacugucuggucauugugcaugcgcuucauucuguuugcauuuguuacaguuagggucuagagcugcgucgcccaguauugcagcucccagcauaagugggaacaucaaaccagggcuagucagagaugacaaguacugaagguaucaaauaccaaauuugaaaaacauaaagaucucaauuuggaaaaguacugauuucauuauaaauugcauuacauacauugaauuagacuagauucauucuuuauuuuaaaaauuaguuuuauugcauucuuuuucuaaugaaucuacuagacaaaauuaguaggagcucagauuucuauuuauugauuuucuguagaaucaauuuuacuauuauguuaaauggucuacagaaucccucuuacuguuaaauuuuagagggucguggguuugggaauguguucauacagcaaaauaaucagcccugagcaaacacauggcugagauuaaguccuuaagagcacaguuaaaaauaucaaggauauaaaguuacgacuuaaacgcagucucucucaucucucaggaagccuacccuuuucauggccgaccuucaacuucucuaagaucauacacagaagcacuguugauuacucauuuacaaaggccucuuuucacccuaauuuagaaagguccaaugugaaauuugcccacauuucaucaaaucaugaagcauuaagaaacugcagaagaaaaugacuaucuucucuagauuugugauuucuuuuucuuuuuuuuuuuuuaaagauuuuccuugcuacucguguaaaugagaaagaauauacaguauguauaaaaggaacagauaacaugaacauuugucguuagacauuccagggugggagauacauguugaaauaauagagggguuggauuuuaaugguuucccugacuuaaccuucuuuuuuuuuuuuuuuuuuuuuuuuccauuuuuuauuagguauuuagcucauuuacauuuccaaugcuauaccaaaagucccccauacccacccacccccacuccccuaccugcccacucccccuuuuuggcccuggcguuccccuguucuggggcauauaaaguuuguguguccaaugggccucucuuuccagugauggccgacuaggccaucuuuugauacauaugcagcuagagucaagagcuccgggguacugguuaguucauaauguugauccaccuauaggguugcagaucccuuuagcuccuuggguacuuucucuagcucauccauugggagcccugugauccauccauuagcugacugugggcauccacuucuguguuugcuaggccccggcauagucucacaagagacagcuacaucuggguccuuucgauaaaaucuugcuaguguaugcaauggugucagcguuuggaugcugauuaugggguggaucccuggauaaggcagucucuacaugguccacccuuuaaucucagcuccaaacuuugucucuguaacuccuuccaagggugauuuguucccacuucuaaggaggggcauaguguccacacuucagucuucauuuuucuugaguuucaugucuuuaggaaauuguaacuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacggauuuccagagugguuguacaagccugcaaucccaccaacaauggaggaguguuccucuuucuccacauccucgccagcaucugcugucaccugaauuuuugaucuuagacauucugacuggugugagguggaaucuuaggguuguuuugauuugcauuucccugaugauuaaggauguugaacauuuuuucaggugcuucucugccauucgguauuccucaggugagaauucuuuguucaguucugagccccauuuuuuaaugggguuguuugauuuucugaaguccaccuucuugaguucuuuauauauguuggauauuaguccccuaucugauuuaggauagguaaagauccuuucccaaucuguugguggucucuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguucuuugauccauuuagauuugaccuuaguacaaggagauaaguauggaucgauucgcauucuucuacaugauaacaaccaguugugccagcaccauuuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaccacaauugcucuguaguaaagcuuuagguccggcauggugauuccaccagagguucuuuuauccuugagaagaguuuuugcuauccuagguuuuuuguuauuccagaugaauuugcaaauugcuccuucuaauucguugaagaauugaguuggaauuuugauggggauugcauugaaucuguagauugcuuuuggcaagauagccauuuuuacaauauugauccugccaauccaugagcaugggagaucuuuccaucuucugagaucuucuuuaauuucuuucuucagagacuugaaguuuuuaucauacagaucuuucacuuccuuaguuagagucacgccgagauauuuuauauuauuugugacuauugagaaggguguuguuucccuaauuucuuucucagccuguuuauucuuuguguagagaaaggccauugacuuguuugaguuaauuuuauauccagcuacuucacugaagcuguuuaucagguuuaggaguccucugguggaauuuuuagggucacuuauauauacuaucauaucaucugcaaaaagugauauuuugacuuccuccuuuccaauuuguauccccuugaucuccuuuuguugucgaauugcucuggcuaauacuucaaguacuauguugaaaagguacggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccagaacuuuuaucaugaauggguguuggaucuugucaaaugcuuuuucugcauccaacgagaugaucaugugguuuuugucuuugaguuuguuuauauaguggauuacauugauggauuuucguauauuaaaccaucccugcauuccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguacuuucuacuucuaucuugugaaaaaguuugugcagaacuggaauuagaucuucuuugaaggucugauagaacucugcacuaaacccgucugguccugggcuuuuuuuggcugggagacuauuuauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucaguucugauuuuguuaauuaggauuuugucucugugcccucuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuucuucauggagacacucagagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccacgugaguguuggcuuucuguuauuuuuuuuguuauugaagaucagccuuagugcauggugaucugauaggauacaugggacaauuucaauauuuuugaaucuguugaggccuguuuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggugcaaugugugcuuugagcuuuauuaaaguuucuuuaaugaauguggcugcccuuguauuuggcgcauagauauucagaauugagaguuccucuuggaggauuuuaccuuugaugagaacaaagugccccuccuugucuuuuuugaugacuuuggguuggaagucaaucuuaucagauauuaggauggcuacuccagcuuguuucuucaguccauuugcuuggaaaauuguuuuccagccuuuuauucugagguagugucuaucuuuuucucugagaugugucuccuguaaacagcaaaauguugggucuuguuuguguagccaguuuguuagucuaugucuuuuuauuggggaguugagaccauugauguuaagagauauuaaggaaaaguaauuguugcuuccuguuauuuuuguuguuaaaguuggcauucuguucuuguggcugucuucuuuuagguuuguugagggauuaccuucuuguuuuuucuagggcauuguucccguucuuguauugguuuuuuucuguuauuacccuuugaagggcuggauucguggagagauaaugugagaauuugguuuugucguggaauacuuugguuucuccaucuaugguaauugagaguuuggcuggguauaguagccugggcuggaauuuguguucuuuuagugucuguauaacaucuguccaggcucuucuggcuuucauagucucuggugaaaaaucugguguaauucugauaggcuugccuuuguauguuacuugaccuuuuucccuuaccgcuuuuaguauucuaucuuuauuuagugcauuuguuguucugauuauuaugugucgggaggaauuucuuuucugguccagucuauuuggaguucuguaggcuucuuguauguucauagguaucucuuucuuuauauuugggaaguuuucuucaauaauuuuguugaagauguuugcugguccuuugaguugaaaaucuucauucucauccacuccuauuauccguagguuuggucuucucauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucuccaguguugccucacuuugaguuuucuuuauuguuucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuggcaguguucuccuguauuucuuuaagugauuuauuaaaguccuucuugauguccucuaccaucaucaugagauaugcuuuuaaaucuaggucuagguuuucggguguguuggggugcccuggacugggcgaagugggaguacuggguucugaugauggugaguggucuugguuccuguuaguaggauuccuacguuuaccuuucgccaucugguaaucucuggaguuaguaguuauaguugacucuguuuagagauuguucuucuggugauucuguuaccgucucucagcagaccugggagacagauucucuccucugaguuucagugcucagagcacucucugcuggcaagcucucuuacagagaaggugcgcagauaucuuguuuuuggaccuccuccuggucgaagaaaaaggcccaaaacagggccucucucagaagcuguguugcuuuggcaguucccagaagcugucagcuucuguggugcagacucucaccugugcagacuaaaauccuaaguuccagggaguccuggaaccaagauggugaccgcugcuccugaggccaaggccgucucccgagccaggcggacaccuguccucugguccggaugguggccgguuaucugcggcccgcccaggcugcugccucagcggcucugugcuucugcccgucccagaagcuguccgguucucuggcgcacccucuaaccuguucagacuaauuuccuaggucccgcggagucccggaacccagauggcgaccgcugcugcugaggcugaggucgccucccaagccaggcggauaccuguccucugguccggaugguggccgguuaucugcggcccgcccaggcugcugccucaguggcucugugcuuccgcccgucccagaagcuguccgguucucuggcgcacccucucaccuguucagacuaauuuccuaaguucugcugagucccggaaccaagauggcgaccgcugcugcugaggcugaggucgccucccaagccagguggacaccuguccucugguccggaugguggccgguugucugcggcccgcccaggcugcugccucagcggcucugugcuucugcccgucccagaagcuguccgguucucuggcgcacccucuaaccuguucagacuaauuuccuaggucccgcggagucccggaacccagauggcgaccgcugcugcugaggcugaggucgccucccaagccaggcggacaccuguccucugguccggaugguggccgguugucugcggcccgcccaggcugcugccucagcggcucugugcuucugcccgucccagaagcuguccgguucucuggcgcacccucuaaccuguucagacuaauuuccuaggucccgcggagucccggaacccagauggcgaccgcugcugcugaggcugagcugacuuaaccuucuuggccucaguuuuucaucugugggaaguucucagccauuacacggacuccuuucaucuuuccagauuucaggguuguaaguuuaagaccuaggacaucaccaguaauccugaguguuauuugucuauggacuauuaagggcaaauccagcaccauguaauauggcaugcauggucauagccuuccuuaauccacauuccuuuauaagagccgaucaaauacaaaauuuauuaaguuaacuuuagugguguuuccucuaggaaaggauagcacuuaaucucuguuaugguacccaguugccuggacucuaagaucugaaaagaacuuggcaucuccuuccuuuacaucuuaaaacaaaauuguucuaguuugcuuuaugagagcuaaucuaugaauuuccuuauguuuuccugauuauucuguauuucauaaggcaugaaguuggcuucuccauuuuuuccgaauugguuccuguugggauggucuauguacaagagugaaagugccgucggccucaugcuucuguagcauccugaaugcagcuuggcugaaugaagccuguugauuaagcaccuacaugaaaggcccuucaugcugaggcuaugucuaauuuauagagguuaauagcuaauuaacuaaaaggcugugucuaucuguccuaguacucauuuauuguuuacaacaaaugaaguugagaaaauugaacuucacuuuugaaucuauuuggagaacugguuuggaguuuccuaucaguuuuaaucauauuuccuucagaggaacacuggggguaaauuauaauuaaucuuacuguccuccguuguuaaaaauaaaagguauagauuuuauuguuucaagcaguuauagaugaucagcaaaaucuauugggcaucauagaaagcacaccuugugccccaccaaggagacccucugcauuguuaaugcuguacagcauauuaacauucgcuguaacuaguguacccacacauccuuaccaccugaaaucuguauuugacauuuggggucauccuugggguuauagauucuguguugggauaaaugcauaacaaccuguaucuaccauugucaugucaggagcaguuugccuucuggagguucucuaucuuucaccuaugcaucccuccuauccuccugucuggcaucacuuuucccuuguccaaaaugucauggaguuagaagcauucagcacacacccucugaagauugauuucuuucaugcaguagcaugcauguaagguuccaccauguuuuguuuuuacuuguuugacuuuucaagacagcauuucucuauauagcccuggcuguccuggaacucacucuguagaccaggcuggccucaaacucagaaauccgccucccucugccucccaagugcugggauuaaaggcuugugccaccacugcccaacugauaacccauuucuuuuaacccuaaauagcaauccauuguuuaaauauaacaguucaucuauuuacccgcugaagagcauugugguuauugccaaacuuuagcggucuuaaaguauacugcucuaagcaucuaacuucugauuuuuguauaaauaacagcuucaauucauucgaugucucgagcgcgcccccaacucgccagcaagaacgacgcugcuacaggauccuucugcacacguuuauucaguccuguuucuucuuucucuauauuucccuuguuuauaucucccuuguuuuuauaucucccuuguuuauaucucccaauaauaacaauccucucucgaauaauaauccucccucuaacccgggccucucacucuuauauacucucaguucacauccacgcacagcaggccacgccaccucaccaggcacacagcuucagcuaaucagggcagcaggggcauaucuccaucaaaauggauucaccaguauccugguacaccugugcagcucucaagauguuuguggcuuauaugaggaagucaggugcaagucauaagacuuagcugcagugccuggcacuuuugggacugccgccacaccugcuccccacaauucccccuuuuuucuuuuuuggcagagagaaugucuguagauagccccccgcagccaugccccuuacccguccuugggugacaaacagcauugguuugaucccugucuuaguuuggugacaugcccagggagucuuaucacugacuaccucucaaucaugccaagccacuccuggggagauuguguuuugcuuguggcaggugcaucaaaaggccaggauguuacuuaaccuauggccagaucuuaauugcugcaagcaagccucaugggugaagguagaggucugauccccagugugcaagcauaggggcccuacacaaaaccaucccuuaggcucaucacccagagaggucuuggccagcuccugugucguuuuuccugggggaagggaacuaggacacugaaccuucaugcaaucagacgugccuuccacaggaugccaacagcaagcuauccucugugcagugcuuagccucgcaccccacggcauaacgcagcauaauuucuuuuagagcggcaaaccgaaucugaggagauugucccgccuucacugcagcaaaagccuaugcuaccauggcgaaagugcgggccacacacucugcaccuaacacaugugccaaacacaaaaaacacacacacuauaacaagcauacaucccagggcucucauccccgcucaucuucccugaagcaagggauagauagccagagaggcuaucucuuuaaggggaauucagggaucaaaaaggcauggaaaaauuugaaugucaugucgagcugguaucggcuucuggaauaccgaaaggaucucccaucucggcuccauuguuugugcuugugggaauauccaccacauccacaggggcaacuggaucaggagccucauucuugcagcgucucaccaaucucuccggcacccaaagagguuccaucugguccuguggaaacacacaaacagacccucucgcccaugucaacacugaaucugguugauccucuccaaaucuccggacagaagguccaccuacagguggaugcugaggaggcauagggaggcggcacaaaagcuaauucgccuuccuccuccaccucggcucuuuuauuuuguccuuucuguccaccugauaacacugugucuccuuucuuuuuccuuuuucuuuuuaagcccuucuccucuuccgacauacuuucuuguugcucuguaaggauuuucugaccugucuugacugccucuacacacaguuucaaacaguaacagaguccauauaucagaacaaacaagaccaaaacuaucagaccuacccacaaagggucaauggaagaaaaaagcauaacuacacagcgaggaucuauugaucacuacacugagguuaucauaguuccuuaacuuguccccaaaccaggaaccuuaacuuaucccaaaaccgggaaccuuaucuuuacuuugugccugcuuccuggcaacuuuauacuugccucuauuuuauccgagguccuucccaaacuccuggguuacuuugugccuacuuccuggcaaauuuaugcucaccucuauuuuauccgagguccuucccaaacuccuggggucgcaaguuucacucaccgugaacuuacccugcuggcaaccacugacugcugaaaguucugaacucggugggggagucgguuccccguacaggccaccaauugucgcgcccgcucucgaccagcaagaacgaugcgaccaccaguccuucuaacagcaguuuauucagucuucaucuuucuucuuucucuucaucaguaccguuccccagcugaagaguucugaauccacgccggauccuucucaacagucuguuuuaagggaacacuuuauuaaccgcuucuuccccguuaugcaguucugaauccucccuguagcagggggucuucgcucuugccugaagauguuucuuguccuggguuucggcaccacuucucgagcgcgcccccaacucgccagcaagaacgacgcugcuacaggauccuucugcacacguuuauucaguccuguuucuucuuucucuauauuucccuuguuuauaucucccuuguuuuuauaucucccuuguuuauaucucccuuguuuauaucucccaauaauaacaauccucucucgaauaauaauccucccucuaacccgggccucucacucuuauauacucucaguucacauccacgcacagcaggccacgccaccucaccaggcacacagcuucagcuaaucagggcagcaggggcauaucuccaucaaaauggauucaccaguauccugauacaccugugcagcucucaagauguuuguggcuuauaugaggaagucaggugcaagucauaagacuuagcugcagugccuggcacuuuugggacugccgccacaccugcuccccacacgaugaaacacuagcuuauauaucgcaguuucauuuuuguuguguggugaguaugagcagaagcaacuuaaggaggguuuuuuuuuuuuucacacagcuagauguucucauuagugaggaagguaugauggcaaugacaggauacugagagaucuuuauacacaugcaggaaacaagaacuagucguuggguaaaggcucuaaacuuaaagucuacuccagugauggaagugauguacugucuucaccaaggcuucacucuuagagguuccacacccuccccaaacagugccauuaccuggugacuaauuguucaaguaauuucauuucauauucaggcaaccacagcauacaauuucuaggucaucucauacaaauagauuuagaugguguaggaagcaacaucaaucugucuccuuacuuaaaaagaguggcaaaccagucuguuguguuucugagcucuacagucuuuuugggcacccaggcuguaccugaacacugugguuaauuuucaucaguuuauuuuuaacuuaauagcaacuuccaucuccaguucacagcccaaaggcaggcagccaugagcuuuuucucauaccgguuagcuguuuggagccagagcaaaggugcugcuacaguaguauugugcuuugaugcaaagauucagagcagagcuauggccauuguaaguuucucuuagucuugugaaguaauguuuccauaagauuuaauagauugguguguuuucuuuaguucaauuuuguuuucuuuuuacacuuuuggaaucaaagaucaaagaagagaucucaucuguaaucccaucuuuauccacauauaggaaacaagaucuagaaguuggaugagacuauaagcuaauagacuuugguauuggaacaaacauuaaggaaauggccauuuaaauggauggaacacagggccccuaaugaaggagcuagagaaaguacccaaggagcuaaagggucugcaacccuauaggaggaacagcgauaugaacuaaucaguacccccagagcugugucucuaguugcauauguagcagaggauggccuagucggccaucaaugggaggagaggcccuugguauugcgaagauucuaugucccaguacaggggaaugccagggccaggaaguuggaguggguggguuggggagcagggcgaggggaggguauagggggcuuuggggauagcauuugaaauguaaaugaagaaaauaucuaauuuuuaaaaaaaagaagaaaaauguaacuacguaauugggggaagacagaaaguaaccagguagcccagaaaaagcacagaguugccaaaacagaggucugauuaacauaucaguuaacucuugaccccaaaauuaacaaaacagaaaaaaauaucaaaaagaauaaugaagaauugccaauuuuagcaaugugagaaaucaacauucuucaguuaccaucuuguuagguuccagugucuagagucagaaacuguaagguaugaagaaacaagcacaggagcccucagcaagaagcagacucaguaggagcuacuucucaaaggccugauccagacacacgugcucagucaggccuuaaaacacuugcuccagagaugugcagagaaacauaaaggcaauagugugagcaaaaugcaguuaccaguacagagagaaagcaagagaaaaaacugaguuugauagcaaaaaaaaaaaaaaaaaaaaaaaagaaagagagagagagaaaaaaaaagaaaaaacuaaccaaaacagaaaauucacugcaaagaagucagcagaaguaugaaaggacugguaaccaugaagauagaacagaaagaaguaauugaagaagagugagcagagcccaggagggucuauccauagaagucucccgaagagggguguguccacagaagucucccaaagagggguguguccacagaaguuuccugguucuuuugccucucaguguccucuguacuguuugcuguuuuguuaacgauuuuuauuuucacucucuccuccaacuuuagcuaaggguuuaauuuucuuuaucuugaaaaaaaucuuauguuuuauccaucucuuaaaauuauuuucuccuauuuauuucuaaguuucauuuccucuuuucuucuaguuuugauucuguuguccuguuucuaguuucuguaggugcagcuuauucagugaggugauucuuuuuugucugauagcaggaccucuccuggccaccagacacggaauauccuuuucaucucuuuagucuguucaucuugaaaagcuaaagugaaucucuaacacccagcacguugguuccuuugucuuugauugccaaguuuaaucuguuuacauauuaaguaaucuugccauauaaguacugccuuagccauucuuguguggauuuauuguuuuacaauucauggguuuaucucuuuuguuuugcugugccccuugcugauuuguucugauguuuuccuuugagcacaugacucuucuuaaugauuuuuguguuuugaggcaggguuucauguaacucagguuggccuugaacucccuaugcaguagagggcaaccuugaaauuguacagcugacccacuuacucccaucugaguguuguucugggauuaaaggccacacaugcaucauuaauuucaaguggaaccugcuaguugguuuuauuuugagguugccauaaaacauuuuguaguugugguguucugucucagagugcuaacaacuucaaucucauauaaauacuuuuacuucucuacuccuuuuguuuuucugugacuuucacucauuuuuauaguucuguauucacugauagauaaccgaagguauaacaauuaugcuuguaacuuuuacaucagauuugugcauaccucagucacagccucagggccugaacucuuguucuacuugguagugaguuccacaucuuguauucuucaugcuguuuguuaaugcuucuuguuccucagaauuuucuuagacagauaucauguugauugacuccuucucucuuuguaugggaacaucguuuuuuauuucugaagaacacuuuuccaaaauuuuggauuuucaauugauguuuuuaucuucuguuuuaccuuugagcacagugagugaguauaucucccuccugauucuuggcuuguaaggguuuguugaaaaaguccauuuugacuacuagcuuuuaugugaccaggcucucaaaucugaucuugccuuuuuuaaaaaaaaaaaaagaauauuuaaaaaaauacuuuauuuaugugcauggguguuuuaccugcauugauauccauacaccauguguauauacugcccguggauaccaaaaaagggcuuuguauccacuguaacugaaguuacagacaguggugagcugucucauguagguggcugggacuagaacccagguucucuggaagaacagccugugcuucuagccacugagccaucucuccagcccugaucuuggcauuugaucuuccucuugaacuggucugagguaguguuuguguuccauacuucuggauauccauaugcuuccuaagauauaaacguuuuggacaguauuucuuuaaccucucugaccauuucccccuuuuugugacucuuguacuuuguucauuuuccuuaauuuuuuucuuuuaucccucugucuggccagauuagauguuacauuucucugucuccuuaucuuguucuuucauaguccacccugcaggugauggcuccugaguuguucauuucugcccuguuggucuucagucuccauccucuuacuuaguucuuuuugguucucuuuauguuuucaauuuuuuaauuaauuuucuccuuuuccugguguauuguuuuucuaauucuaucuaguuuuauaucugucucugccuaucauuuagcuuuuuaaagaugauugaguucuuuugcaagcaguuugaagaccuccauuguguggaucaguuaugaacaguguuuuuguuuccuuugauacugcuguauuuguccuuuugcuguuguuucuggguagcucugcuuuggugucuguacauuugaaggaacauacauuugguuuugucucuuaaggacuguuucauacagacagacuuuucuauuugugcuucuauaacaauauaccugagacugguaacuuauaaacaaaagcaauguauuucucacaguucuggagucugaaagguccaagauucagacaguagcagguuggguugucuggaacugcccucugcuuuggagguagcaccuugcuucugcaugcucuggagggaggaauccuguucucagguugaauaaagcagggcagauucucaggcucuuugucaagggcaccuaaucucauucauaagggcagaaugugacucagcagucacccguuauuuauuucuuuagacucuggggauuaaguucagggccuugcagauaauaagcaugcacgccaaugagcugcucuucaucacuguagucacuguuaaauagucacacuccuacauaccauuguauagaggaggaaccgucagcaccaauuauagagggagcagaaagcauguaacuaaggaagugauugagcaggccagagcaagcuacaugguucacaguuggguucauagcuagagguuuggauucuuguggucacuggguagcccugacugucauaaggacucuaauauguuuuagagucuagguggcaggccuaucguagguuuauugacagcaccugcugaauucaugacugggucucugaguugucaauacuagccugacuaugaccuagccacaaacuugcuucaggaucaacuucuaccaccaaaaucuuuaguuguacccuaggauaccacugaccauggcuccuucuaguugucuguaguugggacugcugucuaacagaaucugaaaggaccugcucucccugccagcacuucugcagggucuguuguaguacugugcucaccaugccugucccauaaacuaggccacuguuucccacucccgaucuuucugugggcugaauucugagcaugauugcuucagccauugacaagaagaccagaauuaacugucauggguggcuccagaaccacagacaugaaugaagcagucacaucauccaaggcguacgugaguguggcuccuccaaguuccucuguuucaugguuuuggcaggaaaaauuuccaaggccaaguagccucaggaguuuggggccauuucuaugucuagagcuggaaaaauugcuggcaaguuugcuccugacacagagcucuguggacccugcuucuuauggguucucccaggccuucaacacauucuuugugaaucccaguacucuccucucccagaagugcuucuauccauggaugacugugaacucauuguguagguacaagugcaaaaccaccuaucccacuguuauugaguugacaguuuucuuuaugagucuacucuguguaugacuguaucuacuacuacuacagccgcugcugcugcuacuacuauugaguuaaugcuuuauugcauguuuaaauauaaguuaugauuuaaauacaagauaugauuugaggauacuuuauuuaagucuuugcuuuauguuuucuauucauucacagugugguaaaacacauacaugaacauauuucagguauacacuguuacauuaguaacuguaggcacaguguucuauaccccacccaccuugaagugaaagauguaaugagcugagucucuaagagccuuauucuucccccuuuucuccuccuuuuauuucuucuugauauaauucuuccauggagcucccuucuuuauguucugaccaucuacuuucugaccaacaggaccuggaguggguucuccagggauucuaucaguuucucgcaauuagccuccuggagccaccuugaagugaugcaagagggccuggcuuccccagagccauccucuagucuaacacuccccuuaucugcugcuccagggagccagauaccaggaaaccauuauauuaaugcagcaacaacaacuucuauuuuuuucaaucccacaaaaaaacacuugugaccugacaugaucuuaagaugcacacaaagccucaacacacuuuagucuaggagucuuauuagcacuggccuaaaccauaacccuaagacagucaugggagaauguucuuuccucuugucugagcuagaugcucccuggagcagcgauacagugcugcugccuucuuguaguuugucuuuuagcuucccucuugucuaaacaaauuauguuuuccucccacauuugcuguuccaccuaucuaucagauacuauugaucuugcuuuuuggaaauacauuguucccauugcuuaucuuucuuuuaaaaacuauacuuguuuuauggauaauaugugaagaaucauuuuuauguucaguuuuccaaacuugcuuuagauaaauuuuaaaugucuugucuuuuucagcuuuacuaauguccaguguguguguguguguguguguguguguguguguguguguguguguaugugugugugugcaugcauguaugcauguguauaagauaugguaaggaacagaaagcuugcaguuagggaagugauugaguagggaagugauggagcuggcuacaugggucacagugagguacacagcuggaggcuuggauccuuguguucacugggugggcuuugaaaauaacucucuuuccagaaaccaagauaaaguagaaagagguaccaagaaaggaggcagagcaaaaggacaaguggcaugaaagcagaaaggagacuaggaggaaguugcaaggagaagugucacuaaagcauacuuggcuuggaacugcugcagugguuucuaauagcucacaugcugguuugaaggaaguuuaaaaagaaagugcaugggagauauuagucaucuauaaaaugaugcaucauuuuucaauacugauaagccuacaagagcuccaguauucuuaaaugucccaggaucacuuaagauggacucuguuccccauuuugugccaggaugugggcaaugagagggagauggauggauuuuuuuuucuucuguuuguauauagagauugcuucaacuucucaaaucccgucuaacucugauguugucucauuuguauuuacuuuucuguggcaguuuugugugcagcuguccauauaugcucaugugcaugucucuauugaagccaaccacggcuuucacuacuuaagugcugucccccuuguuuauuuagacuugcccuuuacuugaccuguguuauuagaaauuuugggguaucuuuuuguggucacuagaugguagcaaggaaauuagguccccucacauuaauuaaagaauuuaagaauggaaaaacuccaggcaggcaagcugugaaucuugacacagccuggaggaauagcaugaggaagagauggggaacuaaaaagccuugccguuugagugacaugcaggucagccucauggaggcaggcaccuguaaggcagggaggagcauuuuagagaaagagcaaaacucaaagcuguagagagagcaugcuuuuaaaauaguagaagaaaaggaaaaguuuuguuuucuaauaguucagaauuccagcagacucaaaaagucacaugacugugacucuguaggcuacuagagauuuaaaucuagcaagggaaguccaucaucucauuaaagggauaauuauccugccuaucucuuaagcauaguuuaagcugagcuugucuuccuuaaccuugcucaacuggaaugugauguguccacacuagccagagauuucauccucuuggcaaggaguaguuuucccuuggugggccuuuacugcugcacugucaccuggaacuuaacagcaaacccaccaggccucagggaccuaacuccccagcuaugggacgcuuuuguaagucuggucucugggaucacacucacaaggcaagcacguuaccuaccuacugcguccucaguacucacuaugcuuuuucaaguauuuuguuuucuccagccaguugugaauguaccauauaaaauuugaaauauuuguuuucuucucccacaaagcaaugggcuuuauuauuagugucaacaucaaccugaaaagaaaccuagaaaaaaguugaaaucagcaaaauuucuuucucuuacccuuugguaacauuuuuagacuaugaaacauuauuuaacuuccccccaguuggccuuagugagagaggaagugcuuaguccugcugggacuagauaucccagggagggaugguacccaagggggcuuccucuucucugaggaaaagggaagggguaauaggaggaaggauuugcgagggcaggucuaagaggagacagaggaaggggagcugcgguugagauguaaugugaaaaaaauaaauuguaggcaaaauuuauaugauauuuuugaaaauuaacauuucuuaacaugauaagcacaucucaaguguuugugcauuaagaauaucagagguuguuggauauucuaauuuucuuuuuccuuggaaucuucuuugacuauauaccuucuuuccuguaacuuugugagucucauuuuagaauuuacuucucagccuucaacuaguugacaguuucuugacuaaaaauuuuuuuucaguuuucaaagugaauuucagagucaggacuugguaacauguuaggcucagugagucccuccugacaagacaggacagaggauggagaaagugguacucugucaagugaguugaugcugcuugccacuacuauagcuuaacuugcaagcagaugccaacucaccagaauuuggccccauccgaaagcagcaggaacuggugaaagggagaauuugguucugugugaaaugaaacaggcucuuuuuauuuccuggauggugcugaggcuccccugcagaacccuaggcuguggacacuuucauacugacacaagucacugagagacugaaaaacugcuguacagaacaaguccaagaaggacaaguccaugacugugucuucuucuucuacuuggcugagauuccugucagaaguccauggccccagaggccuuagcacgagcaugugaaauugucuuguccacacaucagcuuccgucucaccugccaggcaguguccguccgagaaucugugcaucucagccagucuugugucucuagccacuaaaagaaguacugcuaauugguacuguuuuaugucaccacgccuguagucuuguauuuccucuuauugccugacaagaguuuauaaaauacaaagaaaucacucuccucuuuguagcagccuugauaaaauugugaaauaggugcuuacuagcaugagucccaucuauauuauauuucaccuagcugaaauaaggcucuacaugaauuuauauuuuguuuuuuaaauauguacagaucuuacuaauuuuuuucauguauuuauaagauuuuuacucuaggagguuauauuucugagauuauaucaaaucacgguuacagaaauuuuauuuaaugcucuuauuuaauuuuucuaauacuacaaaugaaauuuucuguauugugccuaacagacuagucauguuaaaacagaauaauuaagugacugccuauaaauuuuccuauaaguaaaugacugcucacugagccaucccuagcucaacucuauuucuuuucauguguugucauaggcacaggacaauauuucuugacauugucaccaaacaucugagaguucaguaaaagcuaugaaccuuucuuuaucgagaagugccuacacacacucacacacacacacacacacacacacuacagcuauaaggauaauuaguugugauaugccugccauucugccaagcugcuuauaugugugacuuggcuuauugcuuaucauuacaguauaagaagugaucugcuauucuaauuuuugauuuaaugauuuuuaaaaacauaaacaaaguuaagucaucuauugaacuugggagaucuacaagugaagauguagagcuccaguuuuggggcggcggcugccaugugcuguugcugcugcugcugcugcugcuauucucucucucucucucucucucucucucucucucucucucuuucucucucucucucucucacacacacacacacacacacacacgacuguucccuuaaaaacuaaaaccuauaacaacccagagacuuuugcuaucauuuauaggucuagguuucuagugaaucuugauuuuuauguaaauuauuuaauugaaacauauuuaacaauauuuguuaagcaucuacuauuuuuuaauauguaaaacauuuauuuauauaaggguauuagaaacaugcuguuuuuuuuacuuaauuuuuuacuuauucacuuuacauccugcucacuaccaccuccugagcaucuacuauuuuuaauaauuguugugcuuuguaauaggguccuuaucucuaaggaauugacuaucuuuacuaucaaugugggauuauagggauuauaggauuguaguucaguaauaacauacuugacaagcaugcacaaggacuuagguuugaugcucaguacugauaaaguaaaaagaggaaaaauuacagauaagaaguugacuuuacuguaauuagacauuuccauaagugauuuguagagauuaaucucuucacuucaucguaccucgcauaauuaucauucucugguucucuuuauaaaaaggcuucaguaucuugugggaaccugaggauuugguaugucauaaaaaucaggucucuaaaguaaaagagaucagcaggaaacauauccagacuugugagccaguuuaucuaucaccagguucauguucauugaggaauagcaugaauguaagccuagcucgcaagccuuccagugguaugucauggagaauucuguugaguuugacauaggcaggacagcagaacaucccaauagcugggcuccuucugauagagaggacucgaaaugcuuuaaaugaggcaacacuggcuugaaugauacagacaaucucuaaccuuggaggaaguacgcaaacugaacacucaacaggcuguugggaagagaggcuguaguuauaacuggaagaacuuguuucaacaagcgcaucaugugaaguaauuguacauuugggaugcacaguuccuguacuccagguuacuaaauaugauuguacuguuacuuacugcacauuacuguugauguacaggcuaugcugugucaagcuuuucagcagcaugcuuuucaguugauguuuguacauuuuagaacuuuacucuuuugaaacuuagguuucuuagucauccuuuggauaauauuggauucuaaguuuugacauaaugaguuucuucucaaagcaaacagccacuuuacuuaggcugucuguguuuggaguugaucucuuuucuuaugcauccuuuucauuugaaguaucugcaauaagaguauuuuguauucagguauauaacacauuuaugccauguugaaauuaauguacugauuuacaguucuuucauaugauguucacuugucucuauaaucuaguuugguguuauuuuuaaaacugggacugcaauuuuauguaaaucuauuaugguuucaagaugaguagaaagggagagacaaagccaaacaagcgguaaucuuuguucguacaucaucuuuugaauuuguccuauauagagagucuucuacuuuucuagcuagcugugaaaaauaaaaagaagauauuacagcaguucuauagguucuuaacuuugaucuugaagaauauguaucuuuucauguuuuuuuccaaguacucgagcugcuuuuauuguaaauaguagauagaugugaaaugcccaucaugguuugacuucacaagaagagcugacugugcuaugugcuuaucuguguggaaggaucuucagacuuuuugauuuuguaauaagaagggcucagagacaauaaacuugucauucuuaaguuguaguagcauuugucccuguaguccuucgccauuucuuucuugauaaagauguggaagccagaauucuaagagugcauuguuucaggugcuacugagaacugaagauaacauccguaugagccucuuugaccuuugaggaagcagguggagggaagaaaagauggaauuuuuaaagcagcuuggaaaugaaagucaagggcaaagacuguaggagaaggacacacauaugcaaauaugccuuaccaucuguaguaagccucauccaggugggcaucuucacaucugucaauacugcuuugcuuuuuuaagccaaauucugaucaaggcagcagcugcugcuaguggugugcaugcgugugucauguaggagguuggcacucaugagauaauacaaauaaucagugaaggaauaauuaaugauguggcagggaauauuuuugauaaaugcuuagggaaugaggugacaggcgugaaauuagaaaauuccuucagugaucugaaauauaaauagcuuucggaacugaaaagaguuucucagcugaagauuuuauuguguugagaggaaaaacuuuuuucuuuuccccccucccuuccuccuuugcaaguuguuuguccauucacaaaacaaauacucugaagcccagagcggcucaugggaauaaauuucaggucgaauuaguacaguuuccuugcugucaggaugcuggaauuaaugguguuuugaugacacgaauuuugaagggccaacaaagaggcugaagggagagagacaugacuccuuagaagcucaggccuccucucccccagcuucucuugucuucccugucauccgucugccaaucucccuguccaugguuaguuaaaggcgcuuuuuauccucuuuucuuucccacagaguuugccagauccggcccggugccuggguuccaggaggacacgcugcaguuggccuucaucgacuugagacaaguaagucuuuguguuuuuguuuuuuguuuuucuuuuaagaugugugacugaagaccaucaggucuuaaggaaaaggggaggggaggggguuuggcauuggugauucacacuggagaccuaagggcuuuucccuguguuugaggccaccucuuuuauuuagcuaucugagauccuuagcaaugguggaguaaagauuucguggguagaaggguaggcagggggugggaggagggauccauagaguagagggacucaagugacccucaagugaugcgauccauuguguggccauugacuucugcagacacagcaaaaagaugacucgucaaacccaugcuaagcaggugcacugaugcagagacugccugccuagagaacuuugucuguggauaaugcggccaauaguguugaaggaaaaugaaaugcuuugcuuucuggauuguuagugugguuuguugacuuuuccuugcugccuccuaccuucuguugccuccuuuguagaaugcagucagucaucagcaauggaguggaguggggugcuuacagauggucugcaaagguucugaccagucaugcuagccugaugggaaauccuguuacagugucaugaugaaggcugauauuuaggucuaccugagcuuuggcaagcccguaaaauggaaaggccacccauagggcuguuuuugcaaacuagaaagggaggguugguagguaggcccugguguuugggguauaggaagaaaagguaggugggggccaagcgggagagccguaacuaugcucugucaucucuucacucugaagauggaugggguuggauagaaagugugaaugaaguaagcaucaaugacugauguuucucuccuauuaaaacaaucuuuuuuugucuguuugagaagggggcuggcuuuguuucuccugccauaaugaugcagugccucuuguuuucaaagcugacauaguuugcauucugaaaacuuguagaugcccagaguguuucuuaaagcuguaggaccccuugucuggguaaccuccuuaccacugugucuggauuccugccggaauagcuuuuaacccguaauggauggcgugagcuagcccuggacccuuguggaugggcaguguaaucugucauugaugacaauuccggaaagcccuguucagcagaaucauguaucuauagucccaccaagauuugaggauucaggccacguccuagaaacgugugucaacuuaauauuugggggcuggguuagggguucucuuuuucauaaaacauuccuagcguugucagaaauggagaucucccccagugcugaauaccuuccaccucuggauuugagaugcucaaguuuuagccuuugcucuaagaugggaagaaugaaauuuuguuuuaggguucaguggggauguguucccucccucuggaauuuguucuccaaaaccucuaugccuguucaggcuucuuggaaaacagaaaguguuuuucauuggagggacauagccaagaaaaagucuuucuuuuuucacuguucaugcaaagaaaaugucauucucaguaguuuguaacucugguaccuauggaaagcaauuaguguuuaaagauaaugugaccugagggguaaaugggaaagcacaucggggugagugcaagcacuugugagcucaguggagagucugaagggccuguuugggcugcauucucucccugaguguuucuuuugugauguuuaaaugguaaaagcucaaaauacagaauuuuacugauaaugacagacaguaucauaaauuccacuuguuccuuucucuguuacagcaguuggaaaggggucauuuccaaccuagaugauuugaaccacauccauaguuuaaggcuguguuaccagauaguuaacaugcuacaaaacaaaccuuucacauucuggucuaaaaacaucucuuucuuuuaguuuaucuagaccauucucagauguucacacuacaaguaaaacuccauuuguauguuauaauaggggacuuaacguaagaugagggguggcuaaguguuuguacuccucacaguccuaaagcacaauucuaaaucgggagguguaccauagaacuugcaauguucccuugcaauuuucuccaucuuugcagaacacacaacccacacuguguguugggucccacuuggugagaacucuacccagagcaacacguucaccuacaagaaauaucauuguaaaauggccauaacuagucucagugcuagcccuuugaaucugcuuucauugccugcuuguuugagaagagacuuuggcuuucuguuccuuaugcugccagucaugcgucuucuuuucugaugcuggugucguuucucugugcaggagugguuccuguucaucuggccuguagauggugguuuuauggacugaaccuacaaguggggcucucacuaauccuguucuucuuuaagaugugucagcacagagauucugucauucucacagcuaucuaaaccuguuugguucuaauuuuauuauuugacuuacuaauagacuuaauuaggcuuuuacaaguuaaagaucaaaacaguaaauggaaugagcagggacuaguacuauagcucagcaagugaagcacuugccaugaaaaccugccugaguuugcuuccagagaacugacugcauaaaguuauucucugaccucugcaguggugugugcacacacacacccucauccuguacacacacacuaauaauaguaaauaaaauaaucuaaaaugguaauggaaacaccagaagugaaaguuuaaagcaaauguuauaugacauuuucuuaccaagugucugauuauccaagauagagcauacacaagagcucccagaacacccccccaaacaaacaaacaaacaaacaaaaaacaaaaacaauuccacuggagucuagcuggaguuacuuagucuccaguuccaguucaagggguuguuuauagggaacacgagcaacuuaaucagcuaagccauugcagaagaacugccccugcccagcauuuguagcuucagagaggggaggagaaucacuccccuccuccacguccaggaggaaugcauaagggccagucuugugagaguccuguaggcaaucacaggugcuaugauuucuagauggcaguagccaugccaggcaacagcugugccugucccaagcagaguuccauaaaaggcaaacuguaggguauaugcccauguaaaagagaucugaccuggugugcuucaggaugcguagucuuucaaugccaugcauauacuggcuguuugccugucugguuucuaagugugucaugccgaucaugcgcuccuguucucuuguguuagacuuucagaugcaauuaggugaaugauaauuuaaaacauauucaaaauauggacguugaugaaagaaucucuguauaggcuguaauagcagaguguaauuuaaaagcccuguaauuucauuagaaagaaaauuagauguggauuauaaagccauucauccuuuuucacguacucuauuuccauuuuucuacuucuuaagguaaaaagugaaaugacauuuugaauauacaagcuuucaugauauuucagacuuaaaauacauugacauacacuuuucauuuguuaagauucuagaauuagaaaauuggcuauuaauaauaaugaacuagucaguacaaguugaaagguuuuauuccuuaacaugucauauuuauguuauauaaguucaauuucaauacaauuuuacaugcaaaaauauguauauauuucaucuuccaagcuuggggaauguuaaaagcuugagaacaaaauaaaaucucauuuaaugaacgauuuuaaaguaguagcuacucuccagaaauuggugaccucuaauuauuccucuuuaagcauuauuaugggccagcaguagauucuugguggcucuuuacuuuuuagcaauucuauggggaaaacgugaaguagaaaugcugcugaccaucaacacuggcuuuucauuucaguucauuucaucaaacaccgagugccuguugugcacacagcuuaaaugaugcauagugagcacacacugagcaugacuucugccuaaaggaccacauggacgaucacuuaaguccuugauucuaauguggacauguugugauaagaauugucauguagacaauagaacauuguauguauuucaguuguuugacuuucguaacauacuggcuugaaccaugugugguguucaaaauucuauuaaucagcaaugcuagaucacugagcaagucucuucacuacaguuagcugcugcauugaaaagauuggccaguguagaagcucucaacaccuauguccagcucuucucugcuucaugugauguuucaugcacaagcagccuucuauagagcugcuuacaccguuugggaaggguuccaaaagaggaagugaacaaaaacauugaggucugugcucagaacuagcagaucaacacuuccaccacauuuuauugucuucggcuagacacagggucaauucgguguaaaaaaauggggacauaaacugcaucuuauagucuagcuggaauugaauacuuauacaugaaaagugcagaacaggacaagacugaaccuauaaguaccaaagggguccauuuuaggcacaaagagcuguaaaauaaucguggagaggagaauuaaacugaaagaaaauuagacucucugucuuccucuguaugucucuguguuucugccucugccucugucucucugucugucugucgaucuaucucuuucucuuuguguguguguauauaucaguguguguaugucgaugugaguguguguauugguuuaagauguagacucuucauuccuuugcuuauuaagaucuuuagcccuuguccucuaaguugucuuauuuugucuuuauucucugcuguuauguuucuugauaaauuuuuuaauguccuauuuauccuccuucaaugcuguaaagugugugacccuagaauauuugaugcuguuguuauuugaauucacuaugagggcaucuagcugcccagagaagguauguuguauuuauuuagcuuacaguguucaucuuccaugucuuaaaagcaguuaacaguugcagaugaccuuuucuugguaauaucaccuuauccuccccuuuguagccccagcaguuacuuucaaucugcauuaaauguuuuuaaagcugaaugaacaagccuaugacauugcaucagaucuccugaaugaagcuuguuggcaaggcacuuccacacugagccaucccaagauaucugggcuuuuuuuagagugagcuggggauauucccucuagggcacuuauuccccaacuucuucccugcaucuaaaguaaacacagugcauuuccauugcagaugcagggcuugccuuaaaaacaacaguagugucuaaagagcugccuguccauuucuuucugguuguggaauagauuauggugcuauuucuguuaagguaaaaggaaucaguaacuugaguuagucuccacuuagaaccagaaaacaguucagaaaccuuuguccagcuucacuuccuauuuucuauugugucuugauccuacucaauaaaaauuuuguuuugaaauaaaauaucuauuucuaaugaacauuauguuauuccuaaaaugaaccuucccucuguuaauuauuuaaaugcuagucuuaguagaaaguccacuuacaucaauggaugauucugugaccuaccacacauuaaaauauacuuugauucacaggcuaaccauucuaaacuacugacuaacugggggacuuuaccagaggcaaguaggaguugggcagcuccauguuucaaaaggccccaggugcaaguuaucauuucuuaucacaaacaagaaguuguuagcauaaaacuaccucccacaagugcuucuucauauuaguccuucaacugcuggaaugugagggacuuuuagacaguuuauaagauuauauuuauuguauuauuaacauuguuguugugagaggcuuuuagacaguuuauaaaauuauauuuauaucauuguuguuuauaagauuauauuuauuauuauuauuauuauuauuauuauuauuauuauuauuauuauuauuggcaggcccucaccauguagcccagguuggauuuguacucuggauccucaacuuccugagugcuggaauuauggaaaugcauugccaugccuggcacaaagauuccuggagaauaguacuaggggcuguauaggaggggaaugaguucaugaaagagagucuugguggugggcaucagagggaaguguuaagaccccuucaucaggugucuuaguuaccuuucuauugcuguaagagcaugacuaaaacaacuuauaaaagaaugcaccuaauugguggcuugccuacaguuugagagggugaauccuugaccaucauggcgagaagcauggcaucaggcaagcagguacagcacuggagcuguagaggagaguuuagaacagaucuacaaauuggaggcagagaaaagaagcugggucuggcgugggcuuuugaaacuucaaagcccaacuauagugacacaccuccuccaacaaagucauaacucuuaaacuuucccaaaacaguuccaccaaacuagaaauuaaucagcuaaauauaugagcuuauagggccauuuucacucaaaccaucauaggagggagcugucuaggccaauaauuguguuuguagaagcccuucccaagcacuguugcuuggcagggguccuuuucaauuaugugugaaugugagugugucagccugcaaguucaggcaucaucugccccagucaaaaauaaauagguugauaaauuguggacuaugagacucauauggauaguaggucuggaaggaaaggucuugcugugucugacccaugaccuauaggccacauagggcagcucugaauguggccccacaaaaaucauaacuuguuuaaaacuuuaugauacuuguuugcuauuguuuguaauccagaugugcaguucuucuauuugaauauuugauggcaacaccauguuauaaugccaaaagugugggcacuccuaagccuuaaagcagccuguccugguaaagacaauccgcaccacuaagcuagggcguguagagagagaugacagagcaacugugaaauccagauugcgaggucaugguagcacaucugacuaccugcacauaucucucuguucucgcugucaucagaaguccuuccugcuggccauaauuuguguugugacauaggcacagcaagcaguugaguacagaugccaauuuccagauucaggaagcauuaucuuauauuuaccaucaugcuucacaccauugaagggugaauagaauacagugaaggugacagggcccuucucuauagacuuggguuuuucuagccacucuggcuugaaagcaugcuuuucagcuuucugcucuuccuguagucacucuucggguaguccuggugcuuccaggagaugucacuuucauuagcucauuugugugugugcagccacacuuguucaauuuuaaguacagcugcagaacuuccugcaagauccccaggcaaggauaauuaugcuauacuuugcuauucagauucucaggaaaggacuuuuagcuugagguaacaccaaccuagcauuaaaaugguaacuaacuucaacaagguggucuuugggucuuuggaaacaguuuuuuuguuguuuugaugaaauaauauguuuugccgacaccugugcccuucaagauuaugccuccuacaucaaaggaaacugauagcaaauauauccuguuccuuaugugguagaucuucauaugcugcuuauaaccuuauaaaaacuaugacuggcucagcauaggucaugauagggcacagugaugaggucuuuuuguagaacccccuucuaagcacugcuguuuggcagggcuccuuuuugacuguguguaaaccugagugccagccugcacgcucaggagucaccugccagucagagacaaauagguugaugagggaaggacguuuucugcucaguauccucuugccauagaggaguacuaguuacaaaagucuguacagaauugcuuuagggaggcugagaauugaagaagaaaaacugcuaguaaaggacaacuacaugaaagccaugguaguuuaccauucguucauucauucaguaaaggcuggguccuugaagggaaacuggaagaucaggugaacucugcaauguaucuucuaguguuugauuuccucagaugaugaagagaccuacuuucuggcaguaggucauaaggccuugguucuuugugggguggcauuugguagauaguuagcuuuuggccuguuugaugguucuuccugugaaucauuugugugccuggcaacacugcuuauggaugucuuauguuauggaccuuccuaggguucuuuuauuguuuuaaugacaaauacaugaugacagaaagccaaguucuuuugguuagguagguuaggagaaagcucuuuugggugcccagaagcaaaacagcagacuuuuagaauauuuccccaugaaaaaucuguuagguuuggccuucuagcuagggggccucccuaguuaucaucuucuuuuauugcuuucaccccaccuggccauagacaggaguuagcuugacuguccacauauuuuacugcagcuuggaagaguacagaagaccuuuucuacugcgugguagaacagaaauuuccacaaauggaucuggucugccacaacccugggaucuuuacaucagcagggccaccauaauuuaccuuggguguggugauagcaucacucuccagaccucccuaccaggucugucagcacagaagucagggcuauauuccauuucugauugugagcaaagcccuaacaaucauaguauagaagcuuccugguggcuucugccuuaguccauagagugugucacugagcuccuucugcuucaucuuagaugccuggugucuuaguuaggcuuuuacugcugugaacagaccaccaugaccaaggcaacucuuuuaaggacaacauuuaauuggggcuggcuuacagguucagagguucaguccauuauuauaaaggaacauuaucaucaagggaacauggcagcauccaggcaggcaugguagaggaggagcuccgaguucuacaucuucaucugaaagcugcuagcagaauacugacuuccaggcagcuaggaugagggucuuaaagccuacacccacaguaacacaccuacuccaacaaggccacacccacuccaacagggccaugccuucuaaaagugccacucucugggcugagcauauacaaaccaucauaccuggggagccugcaagauagccugaggaauuccacuauguucugauucccuuuuuuaaaaaaggccaauucaggugcucuuccccauauuuaauaccuggcauguauaugcauaccuacaaauuugaaacuuugggguuuuuugacacagucccaacuuuaagaagagagguaggagauucaucacagaugugucucccugugagcaguguuggagguuguguugacgcuagcugagugaaagcaccgugguucugaauacugaccugaggucugcuagcucuacuaucuagggucagacuggagaacacucaguccaaagaggaagcagcagagccaggccugaaacuugucucacaccuacaucacugaaucucugacagccacuggagggcagcagugagagacagcaaaggucuagauuuagggaauuggggcauauuucauuuuggggaaaauaaaacgaaacagcaacaacaacaaaccuuugcuauaaacuauuccaagcucccuagacuccuggggugcaagugcccaaaagaauccagagagcccuaacuuaaagauuucuucuaggcaaguucagaaaccaugaauggauaaaggaauaaagacuggugagaaaggagaagcaaauggcuucagugaaggaaggaaaccagaaggacagucuacauccuuacaguccaucacaggguggacagagcaccaugguacagccacacuguuuugagcuuagugugcuugcuuccugaugcacuaagacaguuccagacuccaugggggauaucaagaccuaagggguaagcugaaacagagcagucauacaaacgagaaagcgcagaguagaguagaggagcaaaggcaaguuacaaagguugguucucugaggcaguggacccaggaagaaggguguccuuuccaagagaagauaacagcaagcaggggccugcagaggcaacagguuuguguauaagcagccauacccacggguggaccauuuuuuacaguagcuccuucuugauuauccuguauuauuucuuuccuggucuguugauuuccagggauaaaacaacucacugaaguuauaggaaaagaaagaugauaggacagucuaagagaacucuuacucugaaguaaaaucgaacuugacuaugaagccuuccuagauaguauuucuuuggaaagacagcucuccuuccucugauacccucagcacccccacccucuuuuaaauacugguaaaacucacaggaaauaaccaguagggaaaaaaauuacaaaaacaaauacaaaacaaacaaccaaaaaagcuugacuccuaguuuuuauauagcaacugagauauauucaguuaaucuagaaacucaauaucuguuuuaggaggccagcaaaaggcuguguuuccgaggcuuaugguggccaaauggucagcagugucucaaaccucuuaguuuaggaacucuuaauuuuucucuucucugugguugaguauacuuucucgaacuuguacuguuggcaaggcagcaugaugucaagaaguuuggagcugggcacuuguagguuacuagcugugauauuuaauuaaauuauugaucuuaaauguaauuuuugaccuacaaaacaaaagucuuuaacuuacaaaguuuauaagauugguguaaguauuaaguaagauaauauaaucauggcauuuaaugcuugguuagcguauaccugaguuaguaggacuguuacuaucuagccauuguuacuccuguuuuauggugucuguguaggcacagcaucuacagucuacaucaggcgaccccuuuguugcugucuucucauguuccgagacuccuggugagugagaaauugagaauagcagcuauuaaauguucucagcucugcuaagcacagugaugacugaaaagaacaugaaucuggcuuucucuugccuauaaucaauuacaaguugguggcuuugguuauuugugugugggggugcauuaaaagauauuuauuuagaaaaaagacaauugcauauuaaaauaauuuuaaagauauaaaguaaagcuaaucccaguaaaauuguacuuuugugagccucccucuggucuuuauuauguguguauuauaauaccugugucauuuuauuuaaguuuuuaaauuuaacauaacaaacauuuuaaacuguuuuaaaacucuuaaaaaucaguuuagugaagguauaauuuguuuccaaugaaaugugugggguuuuuuauuuuggguaaguauacauucuccuaugagcaccaacuccuaugagcaccaauucuguugugcauagaaucucuuuugcuucucugaaguugguccaucuccuggaccacaggcagucacucaaguguauuuugaaaauucuagaguugauacucuuuaguguacucugucuggcuucuguaguuccgcaugauacuuggugaugucuucacagggauaacuguuucagugguucuucuuuuuauugaggaauuaaguuuuuuacacugaucuguuauuauuuagcuguuaaucuguucauuuuugugcacauuguuuuugauuugaacuaugugguaguuuaaauaaggauuaucccaaauagucccuggcauuugaguucuuggucucuacuuggcugugcuguuuggguagguuugggagcuguagcucugauacaggaauaguguagugggguguggcuuucagaguuuaaagccucuugucacuugcacuucucucugcuuccugguugaggaugugacuucucagcuccaugcuguggcugcuugucucccucuggaaugauccaaaauaaccuucauccauaagucacuuuggucaaggcauuuuaucacaaccccagaaaaguaacuaauucaggucacuguaaacaaaguugcuaagauuguuaccguggaaguguucauguggauguaggcuucaugauuaaccuuguucuuuuaaaauuucaaacugcucucuguuagaccauuuuccguucucaccaucaugaauaagaaugcaggucgucccacgaucugauuaccacuucagaucauacugugaucucucugacaucacaguuuugucuuuuccagcaugcuguaugguaguuaugcuuugauucacucagcauauugccuuuggaguuuccccauacuggggccuauguuacuuauucacucaucgcuaucaucuaauaguauguauucauauguaugaucugcuuacucauuuaccgguugauuaguauuugguuuacuucuauguuggggguauuaugaauaaaucuauaauaaacaggaguauaugggauuuugaguaaacauauauucuuauuucuucagaguaaguauuugagaguagaauuacuaaaucaauaaaaguauauuuuaacuuuaucaaagguuguuuaucaaucuacuucccaaagagacuuauucauuuugcaucccuaccagcaauucaucgggguuacagucuuucuauaccuuugcagguauuugauagugcaaugguucauuuugacacuuuaaaaaaauuacuacauuaugugugugaguguguguuuguguguguguguguguguguguguguguguguguguguguguuugugugagcaugugugguuguuagaggacaaguucuuguaauugguucuucuucuacaguacagguccugggacggggucaucagacuugagagcaggcaccaucauucacugacccauuuuauuuuucugauauuguuaaaguaaaauuuuuaucuaguucuaaaauuaacucuuaacugaauucugcaggcauuuuacauauucugguuaauagccugguguuggaaauauauauguucaguuauuuuuucuuauucuguauauaaucauuuuauuuuucauugauuuauuuauucacuuuauauucaacaucagcucccucuguccucuuaguccccucuucacauggcuccucccacauucuccccuucccuuuucuucuaagagagggggagggcccuuugggcaucaccauauccugaacaucaauuuccugugggauuaggcaaauccucucccacuggggccagacaaggcugcccaguuaggggaacaggauucacagguaggcaaccaguucagagacaguuguuuggggaccuaaauuaagaucaagcugcacaucugcuauauauuugcagagggcugaggcucagcccauuggcacucuuugauugguggcucagucucucggagcccccaagaguccagguuaguugacucuguuguacuuccuguggagucucuauccucuuaaggucccucaguccuuccccuaacucuuccauaagccuccccaagcuccauauaauauuuggcuguugggucucuacaucuguuuccauuggcugcuggguggagccucucagaggacaguuaugcuagguuccugccugcaggcauaacagaauaucauucauagcaucagggauugguucuugcccaugggauucaucuuaauuugggccagucauugguuagccauucccucagucucuccuccaucuuugucucugaauaucuuauaggcagggcauauuuuggguugaagguuuugugguuaggcuguuguccuugucccuccacugggaguccugucuggcuacaagaaguagccacuucagguuacaaaucccccacugcuaggaguuucagcuauagacugccugccuacccucaaucucaggucucuggcauguccuagagaugauccucucacugauuuccauucuuucuccagcucucccuauaccugauacacacacauaccccguuuccuucccuauucccucuccaaucuaguucccuucauccacccaucuguucauuuucuuaauaguaucauuuaaaaaaacaaaacucauucuuaaaaaguuuuauuggcaccucauuuacaguaacaucagcuuuuuuaaacaucuguugcuucucuguuuccucuccuaacaaaucuucaguugacccgaggucaugaugauuuucuggguuuuuguuuuguuuguuuguuuuuguuuuuucuagaggccuuaaaaugccagcuccuagguuuaagugugugaugauaaaucuuguguuagcuuuucaguguggugcaaaguguaguccagguuccuguggaagauaugguuuuucuaugacaguuuauuuuuuuuaaucuguacuuuauugauauuccuugacaaaaaucaguugaggggcuggagagaucucuuagcaguuaaaaacacucuugcagaugacauaaguuugguucccaguacucauacugugugugcugcucacaccugccuuguaaauguagcugcaagggaucuaaugccuucuuuuagucucuacugacacuacaugucuauacauagacacauaauaaaaauauaaauuuaaaaauauuauugguuuaaauguguuggucucuuucuggauugccuauauuuuuucaguugauaucugugcuuacucuuuaguuuucucuugaucuucaggcuaaauuuugguaucuuguagcaugauuucugcaccuuuaucucccucaauguuguuuuguuauuauaaaucucucucucucucacacacacacacacauacacacacacacacacacacacaaaacacauauacauauacauauacacuuggaaaucagcuuuuuuaaaaagcuuucuggaguuuugaucaggguuauuuugaauuuguauauuuguugaagaaaauugacauucugacauuugccauucuccugcaagaauguugucucuccauugucugucuuggugccggauaacuuugagcaaaucuugccuguuuugccaaagugauuccaugcccuuacugguuuaaugucaguguuuaauucuuuuguauauauggaaauacaaauguguuuuguuuauugguugaaucucaaacuuucugaagaacuuccuauguuuaguuucucggggacuuucugugggauguuuucagugauugucuccucaucuauggccuuuguuuucuugccuuacuguacuagagccuccaguguggugguagggaaguacaaaagaagaauucuugcauucuuucugaucuuagcuguaaagcagucuuucacugcuagaaauaguaaaucaaaguuguguaugcuucugcagguggaggaagguuaauucuuaauuuugcuuagggauuuuauuauguuuguccugucaguuuuaucuuauguucuuucuaacauuuuguuuugcauuuaaguuguaguauucauaucucaagucuuuggggugcugaauuucuucuuaagggacauucauuauuaaagagauguuauaaacauaucuacuguagcucuuagagaccuggcuaguuucugacaaaggguuccuugagauuugcucaugagcuaguuuuacagaaaccccaucucauggaaguuugugcuuuuaaauguucuuuaauuagauagaauuaaaagaaaaccuuuaauuuucauuuaauuuuuguuaugcuuaaaacauauugacagccaaggcuucgcagugagacccugucuuaaaaagaaaaauaauauaccaaccaccaccaauaacaacaacaacuauggagagggccagguaugugcauaugaaagccagagaaccaauuuggauguccugcucuauaaaucuuaaaaaucuuugccuuaccuccuuaagagggggccucaugcagaugagcuugguugccaggacucauacucacccuugccuucuuacugugcucagcaaaugcugucaccacuccccaucgugcacuuggcccuccucaugcuugugcagcaugugcucuucccugccaucuccccgacuccacgaugucuguuucuaauucuacaauggaugaucuuugcacuccgauucagugaaccucuaacuuacucuuagcuuauucuaaucaaguaauagaggcaggacuaagacuucuaaaauguuaacuccuaguuaaaaaaaaaaaaagcaguaugugaggaucugaaagugcuucccagagcccguauauuaaaggcuuacuuuguuggcuuggggcuguuggaaaaagguacaacuuuaaauacaugagccuagaagccaagcauaagauaaccuuaguaggaggcuagccuauauuaaagugucuuaucuuuaaacacacaaaguaaacaaacaauagcaaagauuaaaacagaaccaaacagaacaccaguggggugugaugggaagucuguggguuauuguggggguaccuuuggagaagauaguggaccucaucugcuucuaccuuucucuggucuuucacuucuggccaucaguugaauaguugugcuuugccaaguccucccacuauaaugagcugccuccccagagcagcaggaccaaaaguuagaggaagcauuguccugcuuaucucagggacuggcugugguccugcagggugguugauuucuuuguuguauauaagcuguauacaugugucucuaccuucagaaucuaagcagagucaguuccauguaacacuuuuacuucuucccuagugaccuuugaggcuaacaauaaaagaaguagcuuuacauguguuuucuuuggggucccaacuacauucauuuucucucuguguggauauuucuucuuucauugcccacuuaggugacaugauagggaaaggagauaggacagcaaggugacacagauguaauuaugucccuguucuuucugggaaguauuaaacucagcuucacuccuguuucucuuguuuccuguguccuagcccccauaagucaugucauuuacuacuaaaauggaggcugaguguucaacaacaaaguaccagccccagcaaagcagggaugguccuagguugccuucugacauccucuuccuuucaugcuuccccauauaaccucuauccagacacacaaguugccuguuuggggagaauuuugaggcccucuugccuacuacagagugcucuaucucaauggagugacagccuucuucacacuuugucucaaaugucaucucuuuauaaaucugccccaaccuaguuaauuguucccucuuugagucccugacauuuuguaugucccuucauuauaaaugcuuuuauaauuaguuguuuaagcauccacuuucauuagauuccacauuuaugaagggcaaaaacccucuuuuauuugcccuugauguccccucucugguggguagcauagucagucccugccuguacuaggcuuuuauaauuguugcuccaaugcaucaguuucauaguguuuugugucaucucagaagugaggggaaguagguuggauuucugaaucauaguuguucccaaacacucaaaggaaguagucaucguuuuucuccuacuccaugaucuucauuuccauuuuuaucugauagcauuuaaugauagaguuaauuuggaugucguggccauagguagggcaggcaaacaggaggaaaggaguugauggugagagucaggaagagggggugcggggagagcagggugcagcacucgcucugcugcuugcaggggagaucauugccuucucaucccuguguucccacagagacauuuucucuguacugauacaaccugggaguucguccagaaacuuccaugucuagcccuaccuuaccucagagaugugugggccacauuuagaagcaccaccgaagcaaggcaaaaucucaguaccuauucccauacaccaaguccagggugcugaaauugucuucacaguaauguuuaagucauuuuguuaagucaaacaguuuauucaugauucuugcugaacaacaaaaaauguugaggauggggaaauaauguguggaagauaggauacauucuccaugcucaccauuguccaugugguagcacagcacacuguguguccuguucugguagagcucagaguacucagaguacuccagaacuguuacuucaacaggucuccucacucaacuaauggugcugucauauccugcauacagucugucaaaaaguuugcuuucucugucccucucaaaacaugcccagaacuuggucacuugcaguucucuccuaauccagcacuaaacugucacauuuuguguccuggcaguggcaucuuacuggcaggaagaauuaaacuaaaauuuagauccugucauucucaagauaguccacaguagucaccuguaagagucagguuucacucuuaaguaaaagcagccagaggucuguuaauguucugcaagccaguauagauuagacacauacaugcuuucgcaccuauuggcacuguccucuucacugcugucucugagagugcccuucuuguuucucagaugugcuaacagcauaucugucucagagucugcccccugccucaguacuucugaaguagaaaaauuuuauugacagaagccaacauauucccacagagagaaugcacuccauacugaaguucauuguuauuaaguuauagugcaaaauauauagaaaccuguaugaguauuaaaucauauaagucagaaaaauuagaguagguaaagaaagaagaucacauuagagauaacuuauaauuacauauuuaaauagcacugaugccauuugaaauuucuuuccuguauuauuucucaagcagaauaaaguuguaggggaagugucauaacauauuugauugaguuuggcugcuuucuuagguuaauuaguguaauuacuaguguaauuacuaaggcuucauauucugcuggggcacacaucauaccuucuaccuacaaacccucauugauacauacaagcacgauuaaaaggaaacaguaaaguagcgcucucacggggaaacaguaugguauucacucuuuuucuuuuuuucaaaauuguucucaaaaauuugcuguugguucacaggacuagggaaggcauauuagaaaccccaugguucuuacugugaucucccuucacuggugcuuguguaagaagugauaagccuuauuaucuguagaaauaaagugaucacugaucuucuagaaacuauccuugggcagucucucuuaauacaaaagaaugaggugacaggauuguaggggugacaccagccuucagaaacaucagucauguaagggaauacagcuuuguuugcauguaugguggucucuagcaucuuauagauacuuaagaacccauugugacugcuuuccuuaaaagcuuacuccaggcucaucuucauuacuugcuccuugcaguaacacaguuggaggauggagacugcagcuuggcuucaguggagugagccauuuggauguagagcuaccaccuaacugucuuuaguuugugggaagccagaauccucugcugaacuucuccacuauuucuugacucauagccaacuaaacauuggcaagugcuucagcuuugucuuguguaugaugaauauucucuaaaugcugcugcaacucugcuggcuguacauuauaauaugcugccuguucuaaagcaaaugauacuguuucagaaccagggaaagaucuuguuuucuagagaaaaugcagcuugauugucuguaccuguuaauaaaugcuaccaccccaacaccacgucacuuaggguggugauauucauuuuaaaaagaaacuccaugagcccaaagcucaugucauaacuuggcauugauaacuguagaagaauaaauugcagagaaauacagaaaucacuugaaaauauguaaacagaacgugucuaaguauagcaugggcucaugacuggaaguauauguugucaauuuuaauacuauauagggacagggcaacauccuacccaucagugcaugguggguauaaagagaugccaggugguuguaagaaccuggaacaaggaaugucagcacaccaggcagaaguccuccugacacaucaucagaugugaaugcagugguacagagaauauuuaagccagguccucuggucaauagaugcuccugaggaauggcagggaacucuugaguaauacgauucaagaccagugaggcaccuucuguuguuuuccuccugucuuuucuccccauccccuuucucaguguggcccucaguauucuguagaccauagaucuuuagaagccugggcugcagugacccuugucuguuccaacccccauugcuucuaugcaggcacuugcaacagcucaguacuguccaguagcacauugccuaagugggaaucauagaacuuaaaauggaaccccugaauagaugguucuggaauguauaagaaaaccaacugagcaggccuguaagcaguguuucuccaggaagcauugacuccuucuuccaggguccugcccuguuugcacuacugcccugucuuccuucagcagugaaguauggugaccuaagaguuauaagcugaaauuaaaccuuuuccucccaaaguuguuuguggucaugguguauuaucacaguaauagaaacuuucacuaagacacuccccucucuaaagucuucuagcagagcuagcaagucccaagggcauauacucucuauggcauccuagucuuaguagcuucagaggaagaauuagagcucaucuuuuuauauguaauuucauuacuuauaaaaaaugaucuuugcugguuuucuagaagaguagaggcuagaguuauuaacuaguauagcuguguucucauuucuguugagauuaaaaucucuuuagugacaggagagccauccauucuaaugacacuagaaugcaagcucugggaacaguaagggugcucuuucuguucugcuccuugcaacugccuuccagucaaaaucuacucuaagaugacauuagugugucuugaaugcuuuuacuagggaucauagucccaaaaugucuuuaucuaugcuuuaagucuaaaaaauucuuuaugaauucucauauuucuuaguuucuaguaagcuuuagacuguauuuucaugagaauuuuaagagaugauuaggaagacaaauuaaacaauguuaauguuuccagcacugccuaagaaaucuucaguguagaagauggacagccaaguccaaaaacgugaugaggagacuuccucccuggauggaggcuguuggaugucccuugggauuuuucucuuacuucuaaguaacugugauucaggggccucuggucuguauaauucugcuuauguacuucucccuaucauagacucgugugaaaacguauaaccguauagaucuugcagaaugcuuagcagaaaaugcugcuuuagacuaagauaauaagcucagucucagcacaugauuuaucauguaaaaugguaagccuuucuugguauguagcacauagcucaugcauacuaguuugcauuuucauagguuaaaccuuugaaggcuaaaguccaaagugaacuauaagauaaccaaaacuaaacaucuuguuuaguacgguuuagcugcugauuguggagccucuauuaugcacuagcagguggccuucuuuuugcugcacuguucacauuuguggaaagcucauuuguacucccuaccugaaguaguucuucugaauacagacugggucugugcaugucaaagauucuaugcagugcucaccuccaucugucccaagcaugcuuagugucugacauucuuguuuucuaccucuguuccuuauccauuuaauuucuucuaggugaguaaucacgugguugcucaaaaggaaaugcacaaagcagguugucacaaaauuguucagugaugagguuaaacuuucaguuugaccagucacaauuuugauuucuuaaucugauuaaaucaugguacauauuucauagaaguguaguaggcauugaauuaauguuaaugaagcacugagaauagugucuaauucauggcaaucacuaugcuucuaaaagaauuaugaaccuaucauaggcuguguuuauuuauuaaacacagauacaaauuuauguuaaaauuaaucacaaugugauauuaagacagaaauagguuacaacauauuaccaguaaugucaucaaacagaucugaagaaauauauuaaaaguguuuuuauauuagaugaauuacaugcauucugauuucuuuagauuaguuuauuauuuuauguuuugugcaucacauggguaccuaguaccuauagagagucagaagaagccauugaaacuccuggagcuggaguugggaacugcuauguagauuccaggaauggaaccaggguucucugcaagaacaacaaguguaucugcugagccaacucuccuguccccagucugauuuuccuaauaccuguuuuccuuggugaagagaaaauaucuuguguacuauauggaugcaucaccugucaauuuaaaaaaccuguggccuauggcuuaggcaggauauagagguaggacaucugggaaauaaaaaagaucugagauaaaggcaggcaggagauuugccgggauggugugaugagauaggggcaugguaccugaguacagguaacaacgacguggcaaaauguaggcuagaauaaaugagauauuuuaaauuauaucuagccagaauagagccuagccuguauguccaaggaauuuguaaauauacuuuaagacugagucuuauuuuuuggcagcacagggcugggaggaagaaucaaggcuugacuuuagcaauaauuaaacauugaccucaagaaacuuguuuacuguugaagguuuuuaagaauucaccauggacccaugagacuucaacccuagacaaagaaaauaggcaauuaagaauagcuguaaacaggagagguggacuuucucagggaagaccacaccaauugguuguugaugccaauuucaguuucaggguauacacacacacacacacacacacacacacacauagauauagauauagauauguagauauugcaauaaugguugcuuuuuuuuuaagaggccaugaguuuggaaagaaagaaaaaauacuauacacauggguuuggagggagaaauuuaaaggugaaauguuguaauuauaaucucaaauaaagaaagaauucacaauagauugucuuguucacaugacuguugaaguuacagugguuaauugcaguacuugguuucauccugaguaaaaacaagauucuagaggucaaguugaaauaggcugccaaaccuggaguuucuccuaauuagguacauauauguaggugagaguaaauguaaaagccauaagacaggaaaagagcauugaaggaggaaugugugguauauaauggaacacaugagacauggacauggaagagaauuauugggggacagaaggcucuaguagagauggggaugggggauugguuuagugauaauucuggaauuuugguuucuuuaagaaaacacagaauauuguaagaauaugcuucauuuuaauccuagguguggaauauagggauucuucagauuguccauaguagcugacuaugauuugccucaugcucuaacaggggugugauuuugcuagcugcagauaguuccugugauugugugaagguuggaauucugggaacuuuucaagagcauauauaugcuaaggccuuaagagguguaauggguuguuggauuguuuugguuguuguuagucaggguuuguuaaguaguuuuucucaaagaagaaacaaccaucacaagaagaaauuacauauccuaauggcaaagaacaaacuugccacaaagaacuugacaacugcaaucagcaggaaauauucuaaggauaacaucacccccuuucuaaccucugacuuuauuuaagcaucucuuucuuuuuuuucucuguccuuuuuuaauuuucuaguguuaggggguuaaaacaguugaagcaaaaggguagagcauaguggaagaaagaaacaucuacaaaguaaccaugaauggcuaaaagugguauccaugaguggagcuaggcagaauggaaaacuugauuucaaaugccuuagaggaaauugcaggugauaaaugaauagaaacuucuuugcaagacaccagcaaaaaaauuaugguggcuuccauugcugggauaaccuucacucuguuccuagagggacauuucuguuuugcuucuucuucuuccuauauuuuguuuaaaaaagguuggaagacuaacuauacaacgagaaaaauuauggguggaaguggaagcacuggggaggugaggagcaccuaaaaagagaaagccaaaaggcuuaguuccagugucugagcaagagagcaggaauuucuugcaggaggaaagaacaaaugaaugaaagaaagaaaaggaaggaagggaggaagggagagagggagaaaggagccaugccagagggcaaaucaggacagagaaaagcugaaaaggcaggaggauguuuugaaagaaaggauuacucuugaaccaacagugcccaguagucuuacagcauaugcccccuaaaaguguggaacaagguugugagaaguuuggauagcauccaauagaaauaauagauauaaggcauuuuaaagaggccauuauuucauaugagaugcauuccccuuaugugaaacaaauucaaaauaacugggcuacucaaaauagaauuauucuccaagacuggaagggauuggugacggcuauaucagaagccaauuuguaguuacaugguggagggaagaagcugugaauauucauaguggaaaaaugugaggggaaugaauauaguauuagaucaguugcuaggugaaguacagaacucugguauaugagaacagauucaauuugaugaugggacuauggaaaacuauugcuuaguggcuuuaagagcuugggacaaaauugaggcacuggggggggggaaucuaccucauuuacaaagauuauauauacaaggcuaugaagaagccuucauugauuuuuuuacaaagauuaauaucagcuaugaagaaagcugucucagacuuugacgcaagacagguguugauagagaccuugguauuagaaaaugugaauaccagauguaaacgagguaauagauuguuaaaggcauggauagugccugaggacagguggauaagggauacagcugauguugauucuaauguguaccaugcagauauaauaggucaagcuauauauagcuagaggucucagauuucaaaaugcccagugcuucaauuguaggaaauauggucauuugcaaagaaacugugaccuagccgcaaaaggucucagaucucaaaacucuuauugcuuuaauugugggaaauauggucauuugcaacaaaauuguaacaaggcauuuauaagguuaauguuuuuucuaaauauaaaccagaaagguuuaggcuuccugggaugugcaggugauguggcaaguguugccauuggaccaaugaguguagguccauaacaaauauuuaagguaauuuuuuaccauccauugugaaauggccuucauugaaaaugucaccauuuauuucccacuacauacagcauaauuaaugacuuaaaacagaaaggaggaaaccuggaauuugguuucuuuaaaaaccacaacaauauaugaauaugcuugcauuuuaaucccaggugugagauauggagcugcuucagauuguccacaucaggugacuaugauuugccccaugcucuagcagaggugugauuuuugccagcugcacauauuuccuauuguuuugugacauuugaaauucugggagcuuucagaggguguauaaaugcuacagccccaguaggcaggggugguaggguuuuggagaguuguugguugguugguugguugguggugguggucaugguuggucauuguuuaaguagucauacacaaaaaagaaaaagcaacaacaaguaauuagauaucauaauggugaaguaauuagauaucauaauggugacgaacaaacuuaccacaaggaacuugauaccccuaaucagcagaaaguagucuaaagauaauuuugcccccuuucaggccccugaguuuauacaggcaucuuuuucaguuccucuuguuuuuucucuuuauuuaguguuaaaggacugaaagaguagaaaaggauggaagaaccuacaaaauagucaagaacagcuacagauggggagagauaacuagcaaaaauaaaauguguaugaaaaugccauaagaaaauauauugcucugcaaguugauuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucuguguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggguccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccauuggaugguuuuagcucccuugucgaagaucaagugaccauagguguguggguucauuucuggaucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugauuaugugguuuuugucuuugaguuuguuuauauaauggauuacauugauggauuuucguauauuaaaccaucccugcaucccuggaauaaaaccuacuuggucaggauggaugauugcuuuaauguguucuuggauuugguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagcgcuaugaguuucccucuuagaaaugcuuucauugugucccauagguuuggguauguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccccuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauucguggaaagauauugugugaacuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuacgugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuuuuaucuccagcguugccucgcuuuggguuuucuuuauugugucuacuuccccuuuuaguucuaguaugguuuuguucauuuccaucaccuguuuggcuguguuuuccugcuuuucuuuaagagccuguaacucuuuagcagugcucuccuguaaaucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuugcgggugucaggcgacucagcuggcaagguagcccggggcucgaguggaguggaagggguuugugccccagaucaagcccggguagccugcuucccuauguaccgcagucucaaguuccacgcgauuggauugggguaggcgcugugauccacucaccagaggucuuagggucccguggggagucccgugugggcccuugcggguguugggcaagacucugcugucaagguagcccggggcucgagucucgaguugagcggaagggacuugugccccagaucaggcccggguagccugcuucccuauguacugcagucucaaguuccgcgcgauuggauuugggcaggcacugugguccacucaccagaggucuuagggucccguggggagucccguguggacccuugcggguguugggcaagacucugcugucaagguagcccggggcucgagucucgagucgagcggaagggacuugugccccagaucaggcccggguagccugcuucccuauguaccgcagucucaaguuccgcgcgauuggauuggggcaggcacugugauccacucaccagaggucuuagggucccguggggagucccguguggacccuugcggguguugggcaagacucugcuggcaagguagcccggggcucgagucucgagucgagcggaagggacuugugccccagaucaggcccggguagccugcuucccuauguaccgcagucucaaguuccgcgcgauuggauuggggcaggcacugugguccacucaccagaggucuuagggucccguggggagucccgugugggcccuugcgggcguugggcaagacucugcuggcaagguagcccggggcucgagucucgagucucgagucgagcggaagggcgcaaguugauuuuaaaaaguaaaauuuuaacaacguuuuggugguuaaagagcaugucuuaguuaucuuucuauugcugugauaaaacaacaugagaccaagguuaacuaugaaagaaaauauuugauuuggauguaauuucagaggguuagaguccaugauggugaaagaaaggcuugguagcacaaacagcugagagcguacaacuggaucaucagccauaagacaaagaguagggcauauuaggaauaucucaaaucuuuugaaaccucaaagcccaccuacagugauucaacaaagacacuccuccuaauccauccaaacaguucucccaucuggggacugaauuauucaaguauaugagcuuagagggaacacuaaaccacuuagagagacuauucaaaccacugcagggcaguuugcauguuuacauugaguagaggguuuugaaguaagcggcaaauugcaaacuuccuugaaaggaaagucagaaucgcuauuuuauggaauucucgcuuuccaugaaugguaaauaaguugaaucugugaggcauugguguccuggcuaguuuuaugucaccuugacaucaacuagaaucauucuggaagaggaggugucaauugaaaacauaaccccaccagaauggucugugggcaagccuaugguacauuuucuugauuaauaauugauguagaagagcccagcucacuguggauggucucaccccugggcuguugguucugggugcuaagagagcaggcugagcaagccaaaaggaacaggcuagaaagcaacacuccuccacagucucugcaucaguaccugcccugccuucccaaaugauggacuacaaacuguaacuugaaauaaacauuuucuuccucaagaugcuuuuggucauguuuuagcacagcaauagaaacacuaagacaaccgggaaguauuccucacuuucuggaagcaccaugcucugguuuguugguuguaagauauuuaaauauuaauuauugaagugcugcaguuccauugaaauuacuuucuuaaagcaaacaguaauuacaucauauuauaacuuagucuugucaccuagaagacugcacucccgguuucuuguuaucaacagcuucuugacacuagaauuguagaacuggauaucuacaguagagaaugaaucacagccuaaaguuuauacuaucugucucuuuucacacauaaaagucuccucugcucugacauuaaaugcaagaaaacggaaacacauauaagcuuuuaaaugaaacgaaucuaggauaaaguuauugucuuuagguaauaauguuguauaaauagaccaauagaauguauuaauauugcuuguuucauuuuaagauaagaccuggcuguacugaaacuugcuauauaaaccaggcuggccuugaacucacagagaucuucaugcuucugcuuccgaaauucuggaauuaaaggucaguauguuaaagcaugcuggaugugaggaauuuuugaggcauuuuaauuuuuaaaauguuaagauccuuuacauauaaauauuuuugaaaauagauaauucaguuggaaguacuuauuuucuccucaaucaaguugggugagaauauguaguaugcaaaugguguauagacauauaugcauacaaaacacccaaacaauuacaaaauaaauggaugcuaugcucuaauuuuucauguuuguuuugguuuuauguuucuaaugagaaaaagaaauaaaaugaaaaacuguacggugaagacccucuauacucuugacauugauaaauuauguaaauucauauuuuuaacugaguugagaucauucacauacauucuuauuauuuagcaaagagucaaggaaagugucucuguagcuaaugagcagaagugaaggagacagcagagaagaacacagggcagaaagcacaaggccagugaucaggugucucauuauggggauaucaggagacugugccccuaauaaaaaggaggcaacaggaaccuagaugcucugaaguugaguguggcuaaagccagccggggaugcauaacaagacccuaacucaacuccccacaugccuuaaaaaacauuaaagaagaaaaauaaauuugaaauguuagaaggcucaaggcaaaaccaugaagcuaaugcaguuugagaggaagaagaggcggcagcucagcagcucugcagcugcagcuccaguggagccagggcacgcauuugugguucaggcugaacugcaccuucagugagcuucacuaaacaagcgauugaucgagcacgaucaucauggccagucaccauagaaacacauauaggcuaccugaagagucucaucucagccauucagcucugcagugugccuacaaggaaagggcaggcuggggaggagcaggagaugugcuccucuuucugagcagaugcagaugguggugauuguggccuguucuccacgugugcuucccugauuccacaugccuucuaauuagagccacauuggucagaagcuuagagcuaagcaauuggaucaaacuguugauggucugcuucugcugugaagaaugaaguugagaacagggagcaggagggcuucaguaacuguucauuuggguugggagaacaguacgcaucgguccauuugucaggucuugucuccucauacaaaucaucuuuacuuucuagguguguuuuuauuaucuuaaaagguuaagguugcacuuugaacucacuaaacugcugaagcauugaucauuacccacacccaugucugauggagagcccacuccugcuugcucuucuaacuucccaccccacccugucacugcucacuuuugcuuucuugcauucuacuaagaaugcaaaacagcuuuauuucugaauuuccuucugauuuuuaucuugucuuuuucaaaacuguuucuccuuuggauugcuuaaggauaacuguuuucuuaaguugaauacccuugacuuccauccuggaaggggcaugcugguguacuacugucuuuggcucuccacagauaguguuuacuggaguuugcaugccauguuguauuccuaaaacacaagaaaaggaaaggaaaggaaaggaaaggaaaggaaaggaaaaaggaaaggaaaaauaaaaggaaaggaaaggcaaaggaaaggaaagaaaaggaaaaggaaaaggaaaaggaaaaccucuuguauccaagugaggagucagcauuuuagugugcuucucaggcccagaagagagagcaagaaaauuuguccacaagucaucucauguugugauuuucuaagcccacagcuccagugcuaaaauuuucauuucaaaagauauuucugaguucauguggccaaccuagacccaccccuugagaaguuacaguuccuaucugagucucaucccgaaguccaucauuccuuucuuucauguuaauaggccggauggauagaaaagcugcugcccuaucaccugguggguauucuuggaucucaucugugcccauauugugucucagaaguuucacauugccuccaaaaacguuucacucuugcccucugucauauagugugcacgaauacuaaguaggguaacuguuagauagggcuaguacuaggcaaaauaaguacuggggagcagggcuggagagaugacucagugguuaagagcacugacucuuccuccaaagauccugaguucaaaucccagcaaccacaggauggcucacagccaucuguacagcuacaguguacuccuauacauaaaauaaauaaacaaaucuuuaaaaaacaaaaaaguacuaggaagcauaaguacuagauagugugagaauuaggcaguacguauuagguaguaaguagguauuagguucugugaagauucaucuuggugaaccuucaacugcuuugagcagguagaacaauuguuaguagccaucaaauggcauuuccgauaaaacaaaaaaaaaaaaaaaaaagauccuuauaaagucaaggauauacuuaccacacaagccuggagucacccuggacauuuuuguuaaagaaagaaacuuaacuguauccaaagccugugagacuaccaccuacauuuacagauuuaauguaaacaagaagcuuacuuaaggggcuuuauaaggcaugauucuggccuuuccugugccaccacagacuuauugacuuggagucucguagauauggaaccaaggaggccaaaguuggaaacaguuacagccuggguucucucucagcuagggguaggaguagagagaauggugggggcugucuacaggaacgcuuggcugugguucucagcccugcuccagucuuguuagggugacaguccuucugaguuuaucaguaaucaucauuuuauuucucagcucuucuggauucauggcugugucggugggaggguucuugaaccacuugucacaugccgucugaaaccagaggcagggacagcagggacacucuuugggugcaccuugcccuuaccccauucccaugcccagcaggacugcagaguucuucacuacauuggguuuucacauugguauggugucgacauaaaucacauuucccgccgauauuugcuagugaguggaagauggccaaggcaaccacagcacagaugucaguuaggaaaauuacacccaaaccugaaagcacuggcaguggcgauuuuguuuaugaaaauugggaaagcucuccccucacagccacugacaucccugauuuauuguuucucugcugaaaauuauacaaagauguuuuucagacaugagcuggugaaagcugacuauugaggguggaggaagaguaaagugcccucaugucugugaauugcugucagcuguaacaucuuuuuaacagugcaguucuuuuugugugucuggaaaaccagccauggagcuaagaugacccauaauacugaagaauaaaagcaucacagugccaagaauguccgacccauugucaggaggcuuauuuucacccugaugcuagggcuaccuuaaaaggguccuugauucaauggccuagcuguugugaaccucaguuucuguauaugcagcugugggguuuuguuuauuuuuuaaaugcugcuuccaaacaccugaguugaagcuauagugaacauaacuccagaucagagcuuaaaauaggucauuguguaagucauauagacaacaaaauucaaaauuugcaugauuuaaagauuauaaauuuaauuuuaauguacuuuucaguauaucaauuaaaacauuuuaucuuuuucauguaaaauuauagaguacuuacauuuuaaaacugauuaugaaaaaacaucauuuauugacuaaucuaucuguaauauuuuacuguuguuugaaggucaauaauauguuaagguacuaauccaaagagucaauuuaggaccuggcaagagggucacaagucugaagucagccugggcuaucuagagagaucuugucucagugaugauagugauaacaauaauauuaauaauaauaaccaaaaauuaaagcagcagaaucaaauccacuuguuugguuuuuaugaguauugaaaacuaauuuuuauaauuuucaaauuuaauuucuuaaaagaagaaaggacauuugugcacguauuucucuaaaauuguaguacagauaugaauaauuuuaauucuaaugaauaaaagucauggugaauguaaauacuuacuuuccaguugucaauugugaagaaacagaagauauagaaagauugcuucuuucuuccuauuguauaauuaauguuuagaggaacuuuaguuaucuggguuuuuuuguccaguccaacauuggauauuuugugcuuuuuccccuguugcugguaauuuggggcuuuguugaugcuugugaucugcccacaggcauugccuuaacagaagcaggaucuugccuuuaacccuuugagaagaccuaaguucgucaucaucuucagccuuucuucuuuucuacaucugcuugacaaucccaauccauaaugaucaguguauuguccuuaucuuggaaacuucaauuuuuaaauuauuuugugaucuucauucauuuuucuauucuuuguauguucugcuuguuccagauacucgauagcaagcaaaacagcaauauguuuguccacagucgugacucuuagcgagaccuguucguuugugagaccugcuugucucagugccaggaagggcacaggugugcaguuccauucuugauucugacugcaaggaagagcugauguuacaucuugagccugaaggcaggugaaaauaacagcuauguccaaagccaucaggugugggagugucucacaggaacugacagcugaccuguucugaccucgcuauuugcuugagacccacaacacuaagaacaguuuacuuccagcaguuacaaauaaaaugucagaacucaucaagaaacauccacacagacacaugcagaaccauguuagaccaguugucaaggcaaccagugacccaguccaguuacaugcauacagucauucccauuacucuguaauacaugcugauugcauugccccaaaauccuggcugcaccuauucaccaucacugcccaccauagaagccauggauuuucuucuugucuguguauuuccuaauguccuauagauccaaucauauaguguguagucuuuuuagauuggcuuuuuuuucaucuagcaauaugcauuuuaauuucuuucaugucuuuucuuggcuuaauggcucauuucucuuuaaugagccgaauacuguuucuuugucagaauguaccacauuugcucacucaucugcggaagagcaucuuugcugcuucccguuuguagcaguuauaaauagagcugcugcaaauguccccacacagguuuuguguggcuauaagggauuuucuuuguuucuuucacguuuguucauuuuuuaagauaggcuuuucuauggagagcaaacuggccuugaacuuaaagaacaccucuugccuuucaaguauuaggauuuuaggcauguaccacugucacaaucuuaaauuuucagcuuuucuggaugaacaccagugagcacaauugccacaucacauuguaaaaguuuaguuuuguagaaaacuaucuuuucccuacguagcaaugacugcguugcauuccuaccaacaauaaaugagauuccuguggcucgaguucauaguaucuuucaguguuugcuuguuuuagacuaggggugcgacuaagugugugagaguguucuuauuuuaacucguaucuuccugaugucauauaauguggaggaucuuucugucugccuaucugacauauagguuccuuuuuagugagauuucuauaagguuucucucucccguuuucaguugggucguuuuucauuauucagucuuaagcauuccuuguauauuuuggauaagagacccuuaucagauuggcuuuaauaaguauuuucuccaacuuuaggacuuggauuuucauucuucugaguauaucuaaccuagaacagauuuuuaauuucaauaaaaucuugcuuguaaacucuuucuuucauggaucauguuuuuaaguuguaucuaagaugucauugccaaguccagaugcgucuagauucucuccuaguuugucuucuaguguuuucauuuagaacaguuaugagauacuaguguuacuuuuagauauagguaauaguuacuaacuuacuuuagucucuuacugcuuucauauuauuuuaauauuccuaauauaggcugcugcugcuuuuaaauugucugaauuuuugcuugccuuguaacuuaaagaugaaagaaaugacauuuucuuuaacuauuguauuacuuacuugucuuguuacugugacaaaaucccugauaaaaacuugcuaaggguuucuuuuggcuugcaguuugaggauacaguacaaaguggcugagaaggcacagcagcaggccuuuaggcagcuagucacauugcaucuuacucagggaagagagagagaugaauucugguacugaacuuguuuccuuuucacucagucccaaauccuagcgacuuauauuuaaggugaaucuucucaccucauuuaguccaaucuagaaauucccucauagaugugaccagagacuugucuccaguaggauuauaggauugucaauuugacaaucaauauugaccaucacagguauugaauucuaaauuaccaauucuuuuccuugagcauuuuagcagggcagcuccauuaacuucuaauguccaucauuuuaucauuuucauugcuaaugucgauuuuacugcugcuucuuugagguuuuauuaaauauucugucuuugauauuuuguaauuuuauuuuguacccuauuauaaaucucccccacagcucuguucauguguagauauguguguuuaugugugagugcauguuuuccaagugaauuuucaauguucuuggaacccuccuuggcauucagaguucgcauguuuauauuggcuuugcucacuguguccuauggauucugccuuccugcuucaaguuagauauuugcccccgucuagauauuuuguaugaacgaguuuuccaauugacuaaucuucucuucagcuguaucaauucuacucauaaaucucucugcuguguucuuaguucuaacucuuucaguuaguuuucucuucaucacuauaauaacggaaggccuaguauaaauaacauaaaagguugagauguuuauuuuugguucacaguucgacaaaucuaauuccacaauuauuugaucccaguugugugucucagugaugaagcagaacaugacugcaggggagccauagugaagggaaacaaagacccagugacuuacuucaucagucaggcucaucucccaauacugccauuaaauuuugugcuucuuuggaccccaaaugaugguaauaaauauuugguuaacuguugauagggaaugaauaaacucuuaaaaugaacaccaaacuuuauauuauuuuucuugguuugauacucaaccaaguauuugguuaaaaccaagauuuuuagguguaucaggagugggaaagaaauuagacuugaaauaauaaggaaaauuuagacccugguccauacaaagacuauggacaguguugguuuuuuggcuuguuguuguuuuuaauagaauugugauaaaaauguagcuacaaagcccugaacuuucagaguccagccauaggaauggcaucacuugagucuuaaacaguaaacaccuguagcacacagggugacccaacuacuccuuuggcauugccauggcuagauuuacucccuuugccucccuugccagguccuuguuccucccuaguccuuuuccaucuccucuacuuugccagacacucuaaauccuaaaaagaaaacuaagugauauaaaauauucuuaaaguuuuauccuuaccuccuuaaaaggacaaauucuguguccaaaauuuuuccuaucuggaugauauauuuguuuaguuuaaggugacagcugucuacuguacaguuagucugagcuagguauuguagagcaauaacauaaacaaagcuccugcccucagagaucauggugcuguuuggcuuuuguagucuccacccagcacaugcacauaauacugaggauggaguccauggauucuccaugcuaggcaggcaagcaccuuguccacuuguauuuguuguguuuauucauuguaagaaauuaccugguagaggcaguuaagggcuuauaguuucaggaguuuuuacuccucagugaugagaauaacauagcuuagcuccuagacauagugcaagcuggaggagccauucucauggcaguaaagagagaaguaagacuaaccccuaguggcucugccagccaggcuccacucucucaaagugucaccagcugaggaccacuauucagauauacaagccugucauggacauuccacacuugaaccccagcucaagaugauaacauaaugguagaauguucugaaauaauuacucauacaguucuauguggaacauucuugccacaucuagauagcaucugucugcccaaacauacauauguucccaccuagugaggcuaagcuacauagaaccaggugguccugcuguguacuguauaguaggcauagaaauccaaggugaggaagacagaagaguugagcuucgaggccucuacaugauuuagaccagcucugucucagcaacuuuggcacucuguguuuuauguauaggcuucuucauaaaauucuuuugaagaaaacaaaaaaaaucaggucuggaagugacuuuuaaaucaguguucuuauacaucaacaaagcauuuagguguuaugugggcaucuaagagcaaugagaaauaaccuuccuccuuugaaacaucagugcuggaauagcuauaggcaagcuugaaaagggaaagauuuguuaaacucuugucuuacaagagaaggauccucagaaggagugugggauacugucagacaagcuugauagggcagauugcacugcaaacugcaacuacagcccagccagcaaagaaucaaaacuucagaaaagauuucuaagcaacaugaggcaaagcccaugccaaccauauugguguggauccccugugccucagcgggcuccauguuuacucucagucugucagguccacuuguaaagugaucuguuucagucugagcaucugagaugccugcgacaugugaaagguaaacuaaaaacauagguaaauaaaaacagaaaauaagcucugugaaauggagaaucuaauacccaugcaagggcuggcugugguaguucaccucaguaaagccuagcauuuggcuucagacagaagaaucuagaguucaggacuaaccagggcuauaucagacucaucuccaaaaaaaaauaaaguaaaauaaaaauaaaauaaaauguagaaaguauucuuuuuaaaguuuuauauauguguguuuaguuuugauuuuguguguguguuaagauauguguguagagaucucauagaguugcagcucucgguagugagucacuugacauggguacuagaaauguaagucaggaccuuggcaagagcagucagcacacuuaaccacucauucuccaucucuucauuccaagaaagcauucuugagcaaaaccuuugggauuucuuguacaggaauugggcuuuaaggggagaaaaugggucaguuguuucuagaaaaaaaguuccacaaaacuaaauuuuuuccugugauauagguaguacagagaaggugauggcaaagguauacccaagcuggcuuuucucuuugaugcucacaacacuuaauaggacaaagagcacuuccuugcauaaaaucccuguccaucugugauuucuccucugaccugcagaaaauggaaguaaacuuuguauauauugcccaucaagcagucaagccuccauguucaaaucacuucagaauguagcaugaggcugcuucuaagccaguuuuguuucuggugguaauguuucaaguaucuagaagcuucuauuagacuccacuggaaaagugaagaaccuuucucuugagcauuggcccuuagccacuugaaccggcagaagacagcugcuaucuucuuaccuugucacccuccuauccccaccccuuccaacuucaucccuguuccguacuuccuucacagcucuaaggucucucuggaauuuguggaggugaagauuuaggucugggcaaccaguuagaaauaugaauugcuacagugaacucugaguggccuuucaauuugcugacagaaauuuacuccuuguagacccccucucccccgaaaaaaagcagguaaggucauuuggaguugaaacaagcaugcugucgguguguuugaaaaugaaauuauaauuaaccuacugauggcugugagguguuaccuugaacucuguguggccucuuggcacagcggcugaacuugcuuuauugaauacccagagaccugaacaggugaaaucaggauauguccggggccaauuguacuuucagaaagaagauuauaucucuguuagugcugacuguaagagggcugaggauuaacugagcagcacuaaacagaaaauaaagaugaguuuugacugcccacgccuguaugaauuuaaugugugaaacugcuaaguaaaaugacucuacuugccuguucuaugaauucauuccuggaguauaggcacguaagauuauugaagguggaaaucaaauaacauuuacaugucuaaaaaagacaaaaacacuguuauuaccauagagagcagugaggugcugucagauucuaaguguccauagaggccugagcuggacagauuucuggaaguauuugacauggagaggagcuguaugguggagagugauuguccauagaaaguguauuuuaaaaugaacauguagccuccucaaauagucaacaaauccaauaauggugcucuagauaccaaugauuaagggaacaccuugcacaguuaguucauugccagagucacuccugacaccuugucacugccugagacugaguuugucuuaugcuuugucacauagaacaagaaaagaaccucacuauucaguugcaacuguaauugccucuuuucucucuaauuauguuaugucaucccaugguaaagucuucuuuuauaaaagcagaaauuugggucccuccuuguuuuggcugagaacauccauuguuagacuaaacaaacuguuaguuucacucuguaccuuugacagccuggcuagaaugaaagcuccuguuggucuaauaaacaaagaauaguaaucugaaauggauuuuauuacuggaugaaauuccucuauucauagcauccaaaugaucuaaguuuaaagcuuugcuucaucaccacguguguaaggaacauggagguuuucuuguuugaaaaggaguucugaggcuggaaauauaguuaagugguggaugcuugagugagagccugaguucaauuccuagcaagggcuuuuuaaguuuuaguucaggcacaaugcaacagcucuuaccucccuggugccucuuugaccagaauagcagagucaaucucuacacacacacacacacacacacacacacacacacacacacgcccuccuguuugugacuauauuuuucucuuccucucucugucucucucucucugucucucaugucucucuguguguaucucucucugucucuaugugugugucucucucucugucucucugugucucucucucucuuucuguguguguguguguaugugugugugugugugugugugugugugugugagagagagagagagagagagagagagagagagagagagagagagaacuugcugaagugaguguccucacaagaagccaggaguccacugagucacuguccuuuugcuaggcugcugauugagcauuauuaacuaccuggggaaauuugugucucuuagaaagaaagcacuuuguuuuugucuagugugucucaccaagcgcagauauggacuagacuguccggcuguaaauaaguaggugugacaagaucagugcagcauugaagaaauaggcuguccauuccaccuucgggucuuguuuauauauuaguggauuuauguacucuaacgcuaugguguaacgucacuuaacuguuugaagaggcaugauucaucauccuugagaaggccuagcaguaggaguauagagcaguggucucuguccaaagucaggaagcuguaagaagggacuguauacaucucuccuuugucccuuuuuaaugaguccuagagcccagccuauggaauguugagagagaccuguguucaggaugggacuucccuccccaguuaagccucucugagaauacuccccagacacacacaaagauauauaucucauuaauucccaagauguuuucuuauccacuuauagccaccaaaguagccuugcuguaauacaaauuuaacuaaucaacucuauucugcccccucaagacacccuccucaggaguaagcacuuuauaauguaagaagacucacuggauucuggagcaacaagguuuuuaaagaaaaagagguuuaauugugcguggaacauucacugugaccuuugucuacuucagcuucagaaagaaugcagcccaguauagcaacaaaucaaggguuggcuucuagggaaagcuuuuagccuuauguacuugcaccauauuaguuagggacuggguaucuuccccaguaggcccugccuccuuguagauauauuucuugccauuccuguguuauccccaaauaugacauaauuaaguuucuuacugugcaugugugugugugugugugugugauuucccuugcaaacauuuacuugccuuuuaaaauaugucugaugguugcccacccccacuucacuuaagccugcacccaugaauaccaauagaaugcugucauaggugguagcauguccacuuuucagugucuccuccacuaggcuguaaaccauguaagacagacagugcuguuuuacuauucugauaucuuugucuugguucuugacacacaacagugauucagugcuuguuuguucacugcauagacaagcaaaugaaaagguuuuuguggaggggggucagguggauggagagcauuaaaaggaacccagguaacuucugaugggaaagaugcuuagaaguuaauagcaaggcauguuaauguaguauuuggguuuuaaacuacuggcugaagguccugggcacacacugcgucucagcauugaauccaccacuuugguguguaccugggugugagaggcucuucuaguuggguguaaauuauugcugcaauugauugaguuagacuccaaagucagucaugccagaggaaucugccaaguguuuacuuugaucuuacacuugcucauuaauccaaugugaguuucaaaaaucaaacuuuuucuuuucuuuaguauuugcaguauuugagacuagacuuuaauaggaggaaauuaguauuuuugucuagauuguacuuuaacucauucuuuuggaaguggccaguuuuauaaagaaaauuaguguaacaacaauauuacuaugcuccuguuugggccagauuuaggaaucccucucaacugauccucagccccuaaauaugaagcacgacucuggagcuuaaucuacuucuuuuccuguccuuaagucccaguuauccuccucuccggggaucuggaaacaggcagcagaagcaguuuggaaauaaauaguaaggacucuguguuuauagggaagaaacccuggacaagcugagcugagugccguaugacgucaugcuggguagguucagggucaggccagugagguagugaaaaggcagagacucuuccacccugggccuuuuaaccccugccagugaccugaggauuuucugaaugaauuaccauaauuggauuucauucauaagagagaaguuucccagugcgccaaauaugcucugcaauugagacagggaaagagaaagaaacccaacaggaaauacaucuuuguaaagugaaaaggugaugcguugaguccugcaggcacugggcacuuauccaaggugaccucuucaucacccucuggcacccuggcucaccccgcuucacuacccagccagcguuuaccagguggauucacuuucuucccucccugauaaggcagggagggaccuugacacacccagacccauauccagucuccuuuccuguuuccccugacccuggucauguacaacccugggugauaaugcugcugaagcauacaguaaagcagaucugucguauccaugugagggagggcaaggaggagaaaagcaaaaaggccacaugggaguucagcuucaccucucggugaccuuggcugugugugaaguacacaagaggaauugccaggaccuugcagccuguuccuauccagcacugcuuugacuuagcuuggcuauagagcaacuuuuauagagaacuuuggcaaaaaacaauucucugugaacugcauauccaaaccaagaagcauuaaucauaaugaacacgcaacuuuucccuaugucaacauugcuuagcaccagcauuuucucacaagguguuuuucauucuaagaucaggaaagugaguggaugucgucuuuguauguauuuaccaccgcugucccuuccucccccucuuccuuuccuguuccuucccuuccuauuuucuuccuucuuuaauccccucccuuucucucuucuuccuuauuucaguccuuccuuccuuccaucuuuucaguccauaaaacauuuuucuuagccgugaagcauuuguuuugacaaaccagcucuuacccuccacugcccuuucuccaaggagaugcuguauagcaugugcacaucgcccuaggacuagguaauaugcaagacucccuguaaucgucaaguccuugaugaaaauaucugagagaaugcagaacaguguacagaaagaacacauccccacaaaucagugggaagauuucuaaaaccccuacucuggcuucaguccugcacuagaugccucccaccacacacuccuuuguuuuuccccucccauaaucagggaugcacaucaccaacucuggagugggaggcugcucaggagaagaguaaugcucaagcaccuucauacuuggaaacuuaaugaacuuugcuuaagcuucugaucucuccuuuccaugcuguuugauguacauaaagaugaagaaagcagagacucaaaggucaucuugaaauucacuuagaucugcccucuccuccacaccaucugggugcagcuuuauguucugaccacugaaugcuaaagauuaguaacuagaggacauugguaucuuuugcugauacccuuugaagaaggaacugcugauaagaaagcaauuuuguuaaaaaaaaaaaaacgaaagaaagaaaaaaaagaaaggaaggaaggaagcaaagcaagcaagcaagcaauuuuguuauguuuucaaccgagacuccuacugaguucuggguuguggguggggaguaagggaguaaaugggagaauggccccacuagugguuucuucaaaaucuaugguuuaauaugucucaagaguucacauuucaguuuuuuuuuuuauccugaacacuaacuguuagcaguaggaaacugacacagccccauaccucucuguagaagaaaaauggcagucuuaggaaacauggucuagagcagccugcuggccuugcucgggauccuguuuuaugauucaggguaggguccucccagugcugcauuugucuacccaggaauuuuaaauccugccaagaggaagugucccauugcugugaccuuuacaacccaggcuucuggaaaguucaaugguucagagccuucacagguucaucucuguagucuuugaucuugaauacucuagcuuguuuuucuagguuagaacagggcugacaggauggcaagggaggccagggcauauuuggagguucccugcccuucaucaaggauuuacaguauacuaggaaaaacuaaguauguauuuacauguuaucucaggucacccuccugagcccauguaagauaaaauuauuaacauuuuuuugaugaggaaauggaaacucaaaaaaguuaagcaaguuagccagucacacuagggagcuaagcaaggaaucuaaggcaggccuucuggagccugagguaugaguguacuguucugugucuaccugucugugaucucauacagaaucgcaacucacggcuaggcuagcugcugcagaucugcaacagcaaauguucagauaaccauggacucugccuuggaguuucaaggggaugucaguaguucagccuuuaccuuaguucaggauccuuacacacaagagaugaauuucuguguagcuuaaaguaaauacaggcagcauccuggcuucauugagacuuaguauuugggggaaauuuaugaaaauaaauaaacacaauauucccacagucuauacuggaaauuuuuuaaccuuauuuuaaaaucugucaaaguaguaagaauauaaaauuguggggaaaaaggaccauccuauagcuuagauagcaucaggaugaagcaagccguucuaucuugaguuagacauuuacuacauuuaccuuucuguuuacuuuucacugcuuggcugugggugcuguguaacauugcauuguucugcagaucuugugcaucacacuguauaauauggcaacacucucugugccuuaauaccaucuaauuuuuccucuuagucuuccuuaugucaguaguugaacauuuaaguucuucuugguuuuguugucacagaaagcaccuuguugaacauuuuauuguuuacccaugcauauggguguuuccuaggcaucuucaaacuuggaguccuugcaaacauaaugauuuucuuguugaaucacccuuuuuuugaugaaugugagauuuuuuguuuuuuuuaauuggauauuuucuuuauuuacauuucaaauguuauccccuuuccugguuuucccuccaaaaccccucuacccccucuccccuccccuugcucaccaacccacccacucccacuuccuggcccuggcauuccccuacacuggagcuuagagccuucacgggaccaagggccucuccucccauugaugaccgacuaggccaucuucugcuacuuaugcagcuggagccaugagucccaccauguaugcucuuugguuggugguuuagucccaaggagcucaggggguacugguuaguucauauuguuguucuuccuauggggcugcaaaccccuucagcuccuuggguccuuucucuagguacuucauugggggacucugugcucuguucaauggaaggcugugaucauccauuucuguauuugucaggcacuuguagggccucucaggagacagcuauaucaggcuccugucagcaaaugugggggaaaguguucauagucaaagaagaaggaugcagauggcauugguguuggguauagaaguggcuguguugaugucccauuuaguaagcagaauggcucaacagacaaaacagaguugaguaaacacaacaauucuucuuuguuugguacacuuucuuuuuauauacacucagggauaggcccauucuuuaauucagaaaaaggaaauaaaauagcuuaugcccagaauucaggaucugccaacucugugguaucccuagccaacuacucucaggaucuucauggcauuuugacugucagaacgcuuuacugugaugccuguggcgggaccugagaaagggagagggguuuguuuuguuuuguuuucuucgcaggaguggcugggugccuugagccuguacauugucuaagcauucugcaggauguauaaaguauucguuuacuguaguuaguggcuguggcugugacuuuaucuucuucuagcucacuuuccaguguaacaggauaagaccacuccugccauuaugauuuaccaugcaguaaacaaugagggcuuuuggacugcacuuuauggaacucuuuuauucaaucucuccucccagcuccuuugggaacaaauugacaauugauauuucucuuuuggauuucucagugaauucugcauuccuagauuuaguuucuguuugugauuuggcuuauaaaauccauugcuuucaggaugagacuggcuugcauccagcauaaaauauucugccugucugcccagagguaggaagggaaggauagcauggcuugccccagcucaguuguuguguucuuacuuuccuccaaccacaucagugucccucuucaaggacugggaaucaguuuugacugugaagcagagucucuucccagcaacucaucuucagccaugaaaugcucaggccccucagacaacacacugggacaggcagcucacuuacucucacuguaggacuucauaggacaguuuagcucaucuauagagaagggcuuccuggacccuguggcuucuucccucagucccaugccaguguaauugggcccacauccagaucacauguugcuucacucuggcuauuuguauucugugcgugcauguucuuugaugcccgugugcuuugcucauugucugugcacuugucauaugaccauuacugagcuccuuucugucaggcccccuuuuguaugaauuuuacuugcugaugcuuuuuguauugcugauuuucaguaaguauauauuaaauuaauuccauguguauuugagggguguauucagaacuuguaggagguaggaaagcuauacaaugaaaguaacucugccaguucucagcuauuaugcagcaagcaggcuacuuuaccagugcuccuaagcguaguuguaacuccuauccuagguaugucgcuuccuucugcaccuccuaugcacacuguccgucaaaacugauuaaguauaagugcagcuuauggguuacuauuauuaucacugccuuuagcauaaaggaugcuguugccuggcuacucugguguuggcaguuuaguuggcagguccaaggaaucugacuggacugcccuggaccuccuaaccaaagacuacagcugcucaaaccugauccaccucugcacacuugaucccgucgagcuuuuaccuagagagcugcccuccagcacacauucuuuuccuuucuaggcagugguagaaacccaauaaaagcaauuagucuggccuagagacaugcuuuuguuguuguuuugguuuuagcuuuuugauuguuuauuuuauuuugaggcagaaucugauaucguccugcccucuguaguagagaauaaucuugaacuuuuguuccuccuaccucccaaauuagaugagagcccugagccaucacuuuggcuuagaagugguucuugguccucagauuaaauguuuuucaaccauuucuuuuccauuccccauacucuguugccauauggaagaaacauucugauuuucugacuaguggguuauuuaaguaugagauaggcaaugaggaucaggaaauacguguccuguuucuaucucugcuaucaccugcuucuguauguguuacaaccuuuguugacaucugucauacacugauaauguaauguaauggaggccauuagcuaugcuaaguaauaagccuaugccuaagacaucucauuuagagagccacaaaaggauccuggaaaaguucauuuauaaugaaguuaguugagcuaguaagagucugaaaaccuuguguaaaacacuggauauuuguuggcaaagagaacagucagugcuucaugaucuccagcuuaugcaauacucacuucuguugcuugcuaaucaagaccuauccugaaguuuccgggaaagcacauugccucaguguaagaggcaccuguuuacagguggcaccucuaggauuggagccaccugcauuuccucacacuggaggugcgugugcggaaaugagucaaguuuacaagaggcauuuccuauuggacagcaaguuacagucaguggucccuaaagucuuuuccaaaucucaaaaccuaucauguauuuugagugaacagacucuuucuaacccucacuuuugugauccuaaaagaucucuaauuauuuccaaaacauuuuuuaaaauccucuuuaaggguaggugaggcauaugguguuguuuuucgccaugacagacucggucucugaugcucgugucacauguucccuggagggggugcuccaagcauguucgucuccuccucccgccuccaagcacaucugccaugcucuuuuucuuccuuguaaguuuuuuuuuuuuuuuauuucuuuggaucuuuacaggugguagcaauuuugguucaucugacuugaugguaugaaauucuaaauaguuggggucauuugaaaugauuacuguagcuuugugcucuggaagccuggggguguguuuggagcugcuuaguuuauaguccuugucaacaucggcuucaucuucucaucucuaacagacagcggaggguucacaugguggaugucaugcagcauuauagcagucucuaaacugacuccacgucuagagagaagaauuccauagauuaucaccagacaaaagugaggcucccaugucaugggguguucucugugggaaagcccuuugggaugcacucuucugugugggaauuucuucaccucaccuccuuccccaggauuaaguuaccaagaauugcagcuauuaaaagggaauugccaggaucgucucuguucucuuaucaaaugaucuagauggcuuuuuuuccuucucccaucuucuugcugaaaucugcuggagucuguguugucugugagauuuucuucccauuacacuugcaggguguuugaaacccugucuagauuauuggcauuggggacaggcaaaggggcucuuuaucuuugaacuugauauuuguggugacauuuucuaaaaacaauuuuaugauuucacagagauugaauucaugauucucuauacaaucaacgcuuuguuuuccuauaggcuggcuccaaagugucaacuuuuaaaaguagaucaccauucuuuccuagcacuguagucagagcuacuucaccugugaugauuuuacuccuauggcagcgggacccacaggccaucaccuuccucucagaugcacacacacagcuuaguuucucuccagauaccuaugcuuagaugauauguaauuaaagugcuguuuuauugucauauauagacaugaagaagaaauauaacuucugcaaagaaaacacaauggcaugcugagcuaacgcuagcuggggcuccguugcucagguaaaacuugggcugauuucagcagccgacauucccaagcauuaucaaugggaggccagcuacuguggaaaacagcuuagcaguuccuuaugcaacucauuauaaaucgaccuuagaacacacgacagaaacauuaguccacagacacuugggaaauaaugcuuacaacaacguauuccuagcuguaaaaacugaaacaucuucagaguccaccacagaagaauucguaaguuguauuauauuuuuaaacaaugccauccuacccucuaaucaaaaagaaauugcugcugauacauaagacaauaugaucgcauuucuaaaauaguauauggaacgacaaauauuaagaaagguuuauuucauauucuugacugaauuaaaucuugcaguaagugucuauaauuguuauagaucaagcaaaucuugucuauguggggaaaaugaaaacaguggcugcuacugaagaguugggagugauggcagaaaaccuuguucucauggaaguucccauuauaacugaacaugcauuugucagaauuuaucuuaacuguacgcuuaagauuugaacauuucacuauuuguaaauuugauccacgaauaaaaaguagaacuacaaaagaauauugaaaggaggcgaugauaugugugaugaaauugauuauaauuuggauguuugaaaaauaucaagaaaggauaaaucuauacauuaugaaauaaauauauguaggcuguagaagcuauguauuguguguuuguacauuuacuguuaaguuguucaacuucugucuccaaaaccaauaagcuagacaugguggcauauaggagguagagccaggagggucaggaauucaagguuauccacagcuacauagcaagucucaggccagccugggauacauagacucaaacaaaagaaaaaaaaaaaagcucaacauuucuguauguuuaaaaauauuugaaaacugcuggugguugcauggagcggggaaguaacaagaaaagcuggauuucugugcaccgaguccuuccaacaccauuugucauuauuguuucucgguuagugagcauucuguggucaccuacucugggcucaagauaaauguaaacguguccaagcagggcacuuuagcauacacaaaucuaacaugcucggcacacaguccgcuuuauauuacuaaaagacccagugagauguuagagaaugaaccagccuccagcuuaaaaaaaaaaaaucaagagugaaguucccaggugguccccacugagauauuuccaugcugcuccucaggaccuggaaugcagagaccagaaagcugucugucuguuaccuuaugcauuaacuuuguccuaucuaucuuguagcuagugacuagcucaggcaugaggagauggcugaucggagguggacuaacuccugcuuugaucucuaugaggcgaagaagaggaugcuguuucauugauuuuccuugagucuucccuacugcagacuucauaagcugccuccauuaggaucgugagggagcugacagacacguaauucaagcuuaguguguuaacaggccuuguuagcacacugcauucagcugcugguaaacaucagaauauguugccuuugauuuaaugacccccagacugccagugguucuucaugcugcuaagcuugaguuuacucaguaccaacuaauauuaaugauuaaaccucagcucuaaaacacauggcauuuaucuaauuuuaauaucaucagaaauuaaauguagggaaaaaacaagguuauucugagaaccaagaagauagcccaauccuugguugaaaaacaaagcaacuuucgucaagcuuggccuuuccuaaggaagauguguuuuccuuuauguauuuaaguuaugugacuucugaaagauggaaaagauuuugagaauauuacucucagaugugguaaguccaugcuggcaugccucacuuaaauacagacacugaauaaucccugcuacaccuggccugugcuguguuacaaaugugcuuuucauuuacggagagaaagcucuucaccacugucaucuugaucuuaggccccaggugagauggggcaggaggacgucagccuaggagcaggacugcuuaaguagaacaaaggggaguggguuacuuuggcccagauuccauguuccugggccuggaauaaguggguuccagguacuuugccugauuguguccauagaggaaugcacagugcugugcagguauguaagugcugaaaacuguggaauaggucucuaauccaagugcagaacucagcaccaagagagcagugcucaucuggacugggcuucucacauucagggaaaugucuaaauuagauucguuucaggagcaugcagcaggcaagcuuucuuuuguaagaguugccuuggggagacccgccgaacuuaggaaauuagucugaacaggugagagggugcgccagagaaccugacagccucuggaacaggcagaagcacagaggggcugaggcagcacccugugugggccggggacagccggccaccuuccggaccagaggacaggugcccgcccggcuggggaggcgaccuaagccacagcagcagcggucgccaucuugguccgggacccgccgaacuuaggaaauuagucugaacaggugagagggugcgccagagaaccugacagcuucuggaacaggcggaagcacagaggcgcugaggcagcacccugugugggccugggacagccggccaccuuccggaccagaggacaggugcccacccggcuggggaggcggccuaagccacagcagcagcggucgccaucuugguccgggacccgccgaacuuaggaaauuagucugaacaggugagagggugcgccagagaaccugacagcuucuggaacaggcagaagcacagaggcgcugaggcagcacccugugugggccggggacagccggccaccuuccggaccagaggacaggugcccgcccggcuggggaggcgaccuaagccacagcagcagcggucgccaucuuggucccgggacuccaaggaacuuaggaauuuagucugcuuaggugagagucuguaccaccugggaacugccaaagcaacacagugucugagaaagguccuguuuugggccuucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcucuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugauuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuacccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucuacacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauccuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuauagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguuuggagcugagaugaaaggauggaccauguagagacugccauauccagggauccaccccauaaucagcauccaaacgcugacaccauugcauauacuagcaagauuuuaucgaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggcgaacgccagggccaaagggggggaguggguggguaggggaguggggguggguggguaagggggacuuuugguauagcauuggaaauguaaaugagcuaaauaccuaauaaaaaauggaaaaaaaaaaaaaaauccaaaaaaaaaaaaaaaaaaaaaaaaaaaaaagaguugccuugguuauggcaucuuuucacugcauuagaacagugacuaggacaguaccuuaccuagcaccugccucugucuguacauuuuuuucaucucauaugaggaaauuuuucauuggauuaaggaccaguugacuuacccauaaugaugugaucuccaaauccuuaacuaaauuauaccuucugagauccuauauauaguuguacagucaugaacaauggauguacuuaaauguaucuucugaaucaccauucaaccuacuauacuccaccuuuucuaccacaaaacucacaucuauugcaugggcaaaacauacuuaucauuuuccaucaugccaaaaaaaaaaugauaagccauuguuguaguggcucuaaguuuaaugucucaccuaaauagcaccaguuucauccuacuaaaagguccguuguuuuaucauuuaaugauuccagaucaucuauacuauguaugcugagaaucuggauguaguccaucuuggagcaaaagcucucggugucugugaaccuaguaagcagaucaccuauguccaaaaugugaggggacagaguagaggagacauuucucauagagagaauaugauuagggaccuauuacauuagggaauugaaaaucaccacccaagagaauuuaaauccagcauuacaaguucccuggggucucaaagucuggagucaauuuuugagacccuucacucuguccuuuguaccaguggcucugucuuuauaccugugccagcuccuuaggcuucuacuuugauaccuaugucucugccuuacauauuuguagcacaaacuugcaacuaaguaguuuauuuaagucagcuuugugcuuguagaauguugaaguuaagcauucuuucuuuguuuugacacaucucuguccccuucacuccaaacuggcaguguuucuuuugauacaucauagaaaaccuugauucucacaucacagggaucuaaauaugagaugaggacucuauagcucuuucuuagcugcuaucuuuauucaugaccucugcugagauggauuagugaauaagggaguucuuagcacauuuccaauccagcagcuugucuguccacacuuuauccagacauccauggcuuuaucuccucugcaugcuuuagacuagcaauuuccuaacuuuguuauaucugagcagaccaagaaucugccaaauuaucaauugcuaguuccauucugcucacaacuuuugucuuccauuuauuuuuucuuacauuuuuaucagaaguaaaagaaaucaggcuacacucuaaauauuuggccuacaaguuuccucaucucaguguauacacacacacacacauuuugcuugcuaguucuacuuucuuucuuuuuuuuuugcaugaagucuagauuuuuucacacauuuuuauuagauauuuucuucauuuacauuucaaaugcuaucccaaaaguccccuauaccuuccccccgcccugcuccccuacccacucaaucccacuuuuuggcccuggcauuccccuguacuggggcauauaaaguuugcuagaccaaggggccucucuucccaaugauggccaacuaggccaucuucugccaaauaugcagcuagagacacgaggucugagguuacugauuaguucauauuguuguuccaccuauagguuugcagaccccuucaauucuuggguacuuucuguagcuccuauauuggggccccuguguuccauccuauagaugacugugagcauccacuucagaaaacuggacauaguacuacggcuagauucaacaauaccucuccugggcauauacccaaaagauguuccaacugguaauaaggacacaugcuccacuauguucauagaagcccuauuuauaauaaccagaagcuggaaagaacccagaugucccucaacagaggaauggauacagaaaaugugguacauuuacacaauggaguacuacucagcuauuaaaaacaaugaauuuauuaaauucuugggcaaauggguauaucuggaggauaucauccugagugagguaacccaaucacaaaagaagucacuugauaugcacucacugauaaguaaguggauauuagcccagaaaccuagaauacccaagauacaacuuccaaaacacaagaaaaucaagaaggaaguccaacacauggauacuucauuccucccuagaauacggaauaaaauauccauggaaggaguugcaaagacaaaauuuggagcuaagaugaaaggauggaccauccagagacugccccacccgggguccaucccauaaucagccaccaaacgcagacacuauugcauacgccagcaagauuuugcugaagggacccuaauauagcugucucccguacggcuuugccagugccuggcaaauacagaaguggaugcuaguuuuacuuucuacucagcuauggagcacacgagauucugccaccuuuucuccuccucuguaauauggguuacuuuaccuucagucuaccucugaaguaucaucagaaaccuuuaagguuuguauuucugcaccacgguggcccagaugaaacauccauuuccuaaggcaguggaggcuucauuugucauguuucuuaugaauuucugauccaguuucaaaguuaccuguacuauuucucccuaccaacaguuucuaguaguagucuaguuauuucucaaccauuugacucaaaaguuucacaucuucuuccuguuacucaauuccacagcaauauccagcuaccaaaaucuauauuagcuuuuucaggacuauuguaacaaagucaccagaaauuuggagacuuaaaacaauagagauuuauuuucucaaagcucugaagacuagcaucugaaugaagguguugguagagcugugcugcuccugaaggcuauggagagauuucuccugacucuuccagccuucagcgcuccuggcagucuuugucuuguguccgccuaugcccuuuccucaugccuucuccucuuuuguguuuuagaaaaauacuagucacugggcuuagggugcauccaucuuggucuaagagcuauaggauggucucuguaauauuucucaauaaguucauggcaucgcaguugcuugcagagccuugauuggaaccaugucuccuacacagcagaacagaagcuuuuccucuucacaccuucuuucagcguuugggguuuuguucuucaaauaggacuuuuguggaacauuacaucacuuuugugauaauacuagacacuggggagauacaucccaugagccccagacauguguacaaacaugcacuccagucacagagaagaaauaucuauguagacaauaaggcaaccaccuccccuuuacuuguauaaauacaaaaccauagcccuuucuauggcucuugugcccagcuucucuuucuuguucuuuaauauuacucagaacugucaaaauggagaugaugugauauauauguugugauaggaacaguuugcuauaggggaaaguugaugguuguagugaggagaacaaaguucucagauggucagaggagugggcgcaaguacacaaugaaaggaaagggugguuccugccuccugacagagaggaagauguuggcguaaaagauaauguucuugggucugaaagugauauacagucauggaaacuaaagcagcuguggagauguaagcuugcuuaagcuuacaugugcugaaaauaagcgaaauucucacacugugauuacuacaguuaggcugucaugauuguacaaagugaacagaguuaaacgugugcauaacaaaggaaagguuacucagaugcagugacuccaggggcauaguuaugcuuuucucuacaagaagaaucacagcaaauauguauuuaucuuagaccuguuguccaaguuaugguuuuaaacuucuuucacaucauuuuucuacuuaaaaaaaguaauauuauaauguccucaaauaucuagguauuguaccggcuaacauuuuagcauguuuagcagucuuacaaaaguauaucuucaguauuaaagggaauagccauaaggauggaucuguauaugcuccuaccacugagcagaaacccagccacuaugccuaugacagguguugcauagucauaccuauuccuccuagauaugguauuuaaaugguaacuuauuuggauuauagugucucaugggaaccuaguccugucaguuucuauacccugugcucuuugaaugcaaaacaccuagaaaacaugccccaagaagcuggguuuuggcagaagcuuagaacacaugagggcauaguuaugaaagaaugggaucaggacugagcacacuaauccuuaugauagauauuggauguaagggcacccauucagacagcugcacaagugucaauauaacacaggauccgaacaggugaacaguaagcaccugcugccuucauuugcaggaagcaaauagaaauuaauccccaacaagaacugagaggaaaggaaguaugauucuuuuuaucauaauagauuucaaacuaagugaauuuauuagcuuacagaaaucugacuugugccaaguaugcuugugucuagacaguguugucagagucaggcaggagccaaccaauuuggucuaguauuacagaggcuacggugccauacuuauacaagaauuaggagaucuucaucuccaacuuaugaaaaguuggucauggaucuuucuucucugucuuucaagcuauguauuacuuucuugaucaaagaucuccuuaaaauaacucaaggaauaaaacaccuauuuuucuagcaaaucacuuaccuugugccaggugcuaaugcaucuacaauuuuacuaagaaguaaaaaagguaggccagaguccugggagauggcucagugaguaagaggaaaugcugcauaaaugacuagagccuguguucaaagcuccauguaaaagcuggacacgggcgucaguacccauagccccaucuuugcucuugcucuugcuccuuugccugcuugcugcgugagacugaguaacugcuagauccuuggacuuccauucacagcugcgacugaacaauuguugggaauucggcugccgacuguaagucaucaauaaauuccuuuacuauuuagagacuauccauaaguucugugacucuagagaacccugacuaauacagaaguuacuggucagccaguguaacauaaccaguaaggcccaaaucccaguuaaagucccuguuucaaaaggauaaggcaucaaaugauaggagagaguacucaguguucucuagccuccacaggaauguacauaggcaugcauagauguauacaccacacacacacacacacacacacacacacacacacacaaagauugggcuuccucaccuuugauggccacccuaaagagcuugucagccccauuacguuuuguugaagcccauaaaacuaccaguaauuagcgaucucaugcagcacagccagcugguaagcuggguaagguuucugguuuuccuuucuguacuguuggcauugcuuuguugucauaaaccaugaaaacagccaagccauugguuaauguuuuugcucagcauuugcuucacacagguuguuuacucugcccgcauuuagugcacacccucucugugccaggcauucuuuuuugagcugagagucuaguguugaacaagucaggcaagaucugcaguccguuuacaaguugaugggaucaccauuaaaugaauaauaaauaaccagguagugaaacuuuauagagaaaguggauuauacauauucaacuucuauaaauccugauauuggaaaugccuauucauaagaaacuuuacaaaggcuuacaaaguuaaagauaccuauuuuaaaaugguuuguuuuugaguuuggugaaguauuguuuagucuugacucucaucauucccccauucacucuuucuagaaucuauuaucaggaacuucauugaaacaaaaaguguggccuguuuuucucuacuuggcugccaaggagccaggaaccccuucaguguuccacugcaguggcaaauucaccuggagcccugccucaacagccauucuuuuccuccucugcauguguucuccugugugugccagaggcuagaggucagaggauagccuagguuguuguuccccagcugcuagcaauucuauuuuuugguuugauuuguuuguuuguuugcuugcuuguuuuuuuguuuuuuguuuuuugauucaaggucuuuuacuagccuaaacuuuccaaguagcuuguguguuucugcuccaauagaagaguauccugggacuuggaagcccaggaaccauacagcucugaggggagacaguaucccagugaaagggcaauccugagacacaggcgcgcaggaaccacuuagcucuugggugggagagugucucaagagcauccugagaccugagagcauaggaaccugccgcucugaggggagccuccucagcagaggcauugcagcucccagggaagggggaucccugagaaggucagggaccucagcucugcuccuucccuucacuucugcugguuucuuuuuucuuuucauugcuucuuuuccucuuggcuucuucugaucaguaaaucacaccaggcaggaaaucucaugaaagaaauguauuggagggcccagaguauggagggaugaauccagggaucugcuuccuggaucggacaguggggaguuaggcaaagggccgugcuuauauaggauuucugaagggguggagcuucucagggcagagauuuccagagugaggauuggugggauuucaaguccugagcucagggacugguggauuuuuccuguuuagggauuggugggauuuugugggaagucagcaauuggugguuuuucaugcucaggguuugguggcuuuuuuucaccccccuuucccuacacugguuccaugaguuagagugggaaguccuuccugacugcagcuagcuuuugcugaggcaccaucucuguagggcugcuagggaagggcugggggauggagagaggugcugccaguguggacggcucuuguggggcagcuccugcagugguuucauggaaacuguaggcugaggcaggaaaaaacaugucgccacuguggacagcuccuuauguuggcaguaggcugaggcaagaaaggugucaccguuguggacagcuccugaugggcagcucucgcugagacuggaaggacagugagccaccauggacagcuccugcaucucuuguuauggcugcaggccgaagagaugucuuggugccaccagcuugacaggagccaucauuuuuggacagcuuuuaacugugguggcuguaggcuagggccggaaggaggggccugcuaccgcuuuaaugacuuuuguggcacagggauuguggugggugagcugcucagggacuacagauugggccaguugaccaacaagucccagggauuuaucugucuccaccacaucacaacugggauuacaaacucacauggcuuuauguggguuuaggaauaaucuguccuuguguuuauaagaacauuacuagcugaccuacuuccucagccccuuucucaguguaauaaaucugucuuuuguuuuaguuuuugucuacucuucuuugguaauaggauagauguggauaauacucuaauuguaugucagugcacaaugcucauuuucucuacaaauauuauugaacacugacacaauauuuuuauguuggacaccaaaagauaacaaaauaaaugagauggguggagucuauagaaggucaugacaggcgcuaauagauauggcauucuugaagaaaggcaauuaauuacagcucaauauuuugauagaggacuagauauuaauuaagcuuagucaacacaaaaggagaaagaaaaagaaaggaaagucugcuagcuagcugagucacuuuagauaacagucugaauaaacccacaguacaaaguuaccauaaccaucaucagaauuauugugagauuugcuuagauguuauuacagaaucauugguggaaagcucuucaggacagccagucuaucuucuauucucagucauccuucaacuccaccauaaaaagauaaaugacugucuuucuaacccuccaaaauucucaagaacaaggucuaacuuccaguucaaagcaucguaauaugucuuauaaaccucacaagguaaaucaaagaaaaucauuauaaaccuaguguucacuccgaaacaaguaccaaaaguacuccucuucccucagacaagacucagcuguacugucaucaucaucuucuaacaaauuugcaaauuucucauguguacuuuccaaagcagcuguagaaaagaggcugggaguuuacaugaguaguuacaugcugaaaccuaaccuugccaaaaaguuuauuucugacauggaaaagggaggacuuuuggcaucuagagggagcuggaaaggccaggaauauaccauucggucauuacagaaucuuauccuuggaaagccuuggaagaagagucuaaccuuuaaaaggcacuaagcaaaaauggcauguguuugaugauggccacagccuugaugcauucccuuggauaggaucucugcugagucucugcuuugacuacauagccaucccacuguugcuacuuccaauacuucuucuugucacuucuuggaaucaugucuuggacacauaguggaauuagcaauacgguaguuggugucuacccauauugggucauuccacaucuuugcuccugagaugagauugaucaaaguacagcauauuugauuacugcauaaaugaaaacugcccauugagaaaguccuuucuauauucuugguaaaagguauuguucucacaguacaaagucuugccuccuaguguacaaauugggggcgugugguuaaaucccuccucuagaaguauguuuuggcaccugcaggcuaauguacguauguaucuauguauguauguauguauguauguauguauguuaagcaaauggcuguuacguggcucuuaagcuauuaaauauggaucauaucaugugaagcuccaugguggaaaccuaaaccucuugaccccagcaggcucuuacgggaucaucucuuuuagugcccgccuuuaucaguggauaggauaauaaucacuuccaaaauuaagcuaucccagaauguuagucaguaaggcaguccaucagcugaucccaccaaauaccaagaauagcacacagaggaacaaagucacaagcccugcccuugugacucucacacucagaaagguuaaauaaacagugugcugagugugauagacuaugacggggaagcacaagguaucccacaauguaucuaggaguccucaugucagcuagaggacagucuuagcuacuuuucuuuuguuaugauagcauaccaugaccaagacaacuuuaggaagaaaacuuauuuggacuuaugauucuagaaggauuaagaauauuugauuuuauagcauaggcaugguggcugggguaggaagccgagaacucacauauacuucaagaaagaagcagagaguaagaauuggaaauggcaugaggcuuugaaaccccacccccaccccaagugaauucagagaacaugauauguaagcaaaauaacaauaagauaauaaaugccuaaagaaaacaauaugagaccaaaagucuacaaaaaugccauuggguuuguuuuguguuggucauuuauugcugugcauggggacugcccuugagugugguuaauguacuccauuguaaaaacuaaguuuuccuuugcaaguagauuuucuuugaagauagcuuguugguuaaaggugagagacugugucuacuuaccuuucucaguacugagaccuugucuggcuugggccuaugcagacacuguauguacugcuauagucucuauagguucauacaugcauuauuguuucuggaagacacuguuuccuuagagccauccaucccucugacucuuauaaucuuuccaccuccuucaucuucagcauagcucccugagcccugagggcaucucauuuaggacuggguggaucagaguuucucacucucuacacauuguccgauucugguccuccaugucaguuccuucuacuguaagaagaagcuucuuugaugauggcucagcaagacucugaucuauggggagagcacauugucauuaggagacauuuuauugcuuuuuuucuuuuuagcuuaacaauaguuuuugguuuuccccagacccaugcccuaucaagucucagguucuuggccacugaagcagugucaggcauggguuacaguuuauagggugggugggccuuaaccauucagagagugguuagucacucccacaauguuugugccacuauugcaccagcguaucauacaaggaggucacuguugcaaacugcaggauuucuagcuugguuaaugaauaccugucuuuugugaaagcaugcagaguaaccuccagcaucaugaaaacuaagucaguaggagugaagccuuuaguuaggcaccaguauaacuucuccauguucaacgagauguguuaaguauugucuucagcaauaggacuucaccugucugugaagagcacccaguagcuuuagcaauggccugagauauuuggggguuucuauaagguccuuuuggccaacaacucaacuagauguaacuagcccauuccuagcacuagggcuuucacuugguggcaaaagaugucuagugaguugauuaucgccccuguuauuuggugauuacauuuaaacuuuuuaauauaugaguauauuuuaagaugccucuacaguaguagguuucuauauggccuccccaaaugaucuuuaguguuagcugccccucuccauauuuccucccuuaccccauauaauccucucacuccagucuccuuccuguuucucuauaacuauauauacuauuucugauuuguuugggcaaucuuccccucuccccccuuagcucuuuacaugaugccuaauaucugugguuauguggauuguagcacacauaucaaaggcuuaaaaguuaauauaagagaauacauacaauauuugcuuuugggggucuggguuaccucagaaugauuuauucuacccucauucauauuucauuauauaaauaucacauucucauuaucuauucauccauugguagacaucugggauguuuccaguuucaagcuauugucaauagauuagcaaugaacauggaugaucauauaucucuguaguaggauauaguguccuuaaguaugggcccaagaguguauagcuggauugugaggaagaucuauuuccagcuuucugagcaaucaccacacugauuuucauagugauuuaaaaagaaaaaguccaaaguuccaaauuaagagaaaauauauuuccuucuuucuuccuauguuggcccuccugucucuuccucauccauacuuuaauccuccacagagcauucaucuuucaguccacacaguaccaaaaucaauggggauggaccauauagagcagaacucuagaugucacaguaugugaacccuagcccaagcugcguaugcacagaucagaggucaugcaggggacagguaaggaagguguuucccucuggagcugggcucuaugcuacuuggggcuuaccucagugugucagcaagagacuccauuuccuuuagaaucagcuuccuagucucauuauguuccuuuucuauugguuuccuuguauauuuuauguaaauugguuaacucuguaugcccugacauauuuaucagucccuucaguuugaauauguacacucucaccuuccugaugaaaauguagugucccagguacagguaccugugagacauagcauaggcauucccuagcuuaggugcagaucauccuagcagauacuuaggaaauacuaaugucugugacagagcacagccagcuuagguauggcccaccuuagcagguaccuaguguuagggguucaacauucuucauuucuaacuccuugaauaucacuuauucuuucauagugguguuuugagugucuaaaaaugcauggggucuugaauaggcaaccagaaugggcugagcauccauucuuuuuguuuggagagacacacuauuccuuuuccucuucaaggcuuucucagaaguauucaguauguagaacguaagaaccuccugaagcuaggagcagagacugaggcugauuggagccccuggaggcuaucaguguccuuugcuuguccugucgcauauguuugcauuaggucuggcuagaugacagcuaagucagaaguuacaagaaaaaaaaaagagaaaagaaaaagagcuuuuacugagucacaggacccccagccucuuuuguggaacagcauuguugauugauuaaagucuuuaugauccaaacauguccgaacaguucaaaggcaagaacagugcugguauaaagcuucuaggggaauaugcaaaaccuauuuaaauuuuuggugcauaucucuaaggaaaguguguugagcauauuggcaaaucaaauggcuagugauuguggaaguccagauuccuggugguacagaaaagccagagccaagauuuuauuuuacuuccuuuuacucuuugaggagaauauccuagaguucauuuuccaaguucagagcaaaucaagauucagacuaucucaaaccagcuccucugcgcuggugaauuaguacuuaaugcccuguucuucacuucuauguuccugagauuauaaaucaaagccagccguacaggucagccaccagcucgugucacuaaaggauugugugcuucaguuuuuaagaagcugccugauuuaguuaggagaggagcuccaguccauuuguacucagcuggagaaccugcuacaagugaagcagcucucccaggugucucuuugcuucuauccagugugagaagaugccuucucaucucagauacaacuggaaugauuaaugcaacauuuuugguguuuuggaauccaucaugagcuggugucugcugaguaaguccaugucgcugugcuagccuugaaggacuuauaugccccuugaaugaugggugggccauaauauaccuguaaaaagaugagccacacuucaaaaucuguaucuauauguuacaugaaguuauguagcaguggagacaagagguggacagaggcugcaacaggauagaagaugcugaggaggacaagggcuuagcuaugcagcugagagagaggcagcaccacgccaucuggaaggaacaaaacacagcaagagcuggagugaugcucagaacugguaaaagaccaaagaugaaaagaagccuagagacacaaaugggaguucuggccucuugcaaggucgcuuuaguuuccacacagcaccauuuaaaguguaugucuguuggaucucccuaaauuucuuaguccuacauaacuaagaagguaugaguuuacagugaggugaauuuugaaauucucuguuccuuuggcagcauggucaaaggcuguuguauucagaaggguuuccuucccugacaaugaaagcaacaucuuaaaauaaauaauaaaaaaguaaagaaucuugacuaggaaucugauguauguagaaaauuauaaccuugaaauauggcuaagacucuguguagauuugcaucuugcuuucucauuuaguguuuguuaucauaggagcacauaugcauauucuuaaaagccacacggcaucacuuuguaucgcaugccauggaauaucacuuucugugcuuaggcauuuugauaacacugcuaugaacauacuuugugcauguccuugucuagguauccucaguaaguccucaagaucaaguccuagaaguaggacaaguuaagucaagucauaaggacaucaugguuacugguauuaauuaacagccacuucccagaaaagcuuugcucauucauuuaggcccauauaccagccauucucaacucguagguugugacccccuugggagaugaaugacccuuucacagggguugccuaagaucagaaaacacagauacuuacauuacaauucuuagcaacaaaaauaauuuuaugauuggaaucaccacacaugaggaacuguauuaaagggucauugcauuaggaagguugaaaaccacugccauauacaauacaugagcgagccuguauuuuuuuaggaauauuuuaaugugauuguuugccuguaugugugucugugcaccacuugcaugcuugaugcuguccaaagccagaagauguacaucauccgguuccguagaauuagaauuauaggcagguguaggcugaaaacugaauuugggucugacucuucaagagcaguaagugcuuuuaaaugcugagccaucucuccauuccccuuagugagcccauuguagcugugccgauaagcacacaccauccucucuaccagcuucucacaaaacuacuuugaacaacucuguaagacagguuaaauaaggcaccuccacuucucaaauuacagugcagugggcaacaugaggcugcaaucauugcuuaaagauguugcucagaagucaggccuccccaaacagucuuucuauuuguacuauucuuuaagugacucuguuuucauagcuuuccuuuaaauuaaucuuguauugucaaaguguguucaacagaauuuuucauaguucuauaguaugccaguaagugauuuacuuugaauggaugcuagaguaaauaggaucugggucacaccgagcugaacagguaugccagugaauacagagaaucaaccucagagagccucucagcacaccucaggaaguaguguuguuauuucuugccuuuucuucugcauuuaucccuucccuuccugcuucuauuguuucuuugguuuucaaucuagaauacauugaacaauacaaugauccugcauuuuaaaaugcuuucacuuggaggugucugucagaaagauucccuauccugauauaauuguguccaguauccugccuccccccacaaacaaaacaaaacaaaacaaaacaaaacaaaacaaaaaugucaaggcucaacaguguaagcuuuaaggcaaguuauuaagaaccaugugguauuuauuauuuauuugucugaaugugguuauauuuucugaaaggaauauuuugaguuauuguacuacaguuuauuacuaaucuggcccuuuguugagucuuuaguuaucuauaauuugcuuuucuggguaucuccacuguacauuuuccauagcauuuacuaugugggacaaaaacaggccaucuguagauugcuuccucucugucuucuggaauguuucucagugcucacaggggaacuugucucucucucugauaauaccuaaauuauuccagaucuggaaagaggcaccuuggcucuugaacauacauuauuagacugaauuauguccugguaccacaagaccccagauuuaaagcaagugaugaccugauucugcccagccaaugggauuucccuaguuccugaccacucccuguccccuguuuccugcacuccugucaccaucagaucauccagaucuccuuaaggaaggaucagugacccuugacauacacauuaugucuugaacccugucuucuuuuucucuucucuuauauucuuuuucauuuguaaccucucugccuuucccuaccccaggcagaacugaucaacaaguaacccacacccagcacuguagcuuucucuucaauuucuucucccacuuagcucauugcucacauagaggcucaguucucaguugauaugacuaagugccaccucugagcacccacaaguagacacucuugguuaugucccuuugccuaagugacaaaacuagcccuuccuuucccuaggaaccgcacaacucccaccuuucuaacagccuccuugcuaccuucucccuccuacuuauuccuucugcaaccgccauauucuuucccuuuguucagccuuugcagaccccuccucuacagcugcacuuccuggccuggucaguauaagguguguaaugcagggaaccaaggccucuggccccaauugcaaguugaauaaaaacuuaagguuccucaggaaagugucuuccugagagagggguagugcacauguucuaguuauuugccaugucacuguuguggugacucggagaaugugguguuuguuuaagguuugcccugcagcaucuuccugaccugcaucuauaaaggccccaugcugcuugaaaggauggguguuugcuggaaugcaagguuacaaaugaacaaagggaaccuuugugcugcuuucuucuacauauguugccaauugcauauaaguucauguguguauaagugcacacauucauguaagugggccuuugggggucagaggucaacuucaggcaucgucccuaggagccauccaccuuauauuuugacgcaaggucucucacuggccaguuuuuaaucccccagcacuggaauuacaagugcaaaccacaauacccagcuuuuuuuuuuuuuuuuuuuuugaggauugcuggggaucaaacucaaauccuuguacuuacgagucaggcacuuuaccgacugaauggucucuccaguccuucuuuagauuuuaaaauaccuacuuuauuaguuauuggaagugcaauuuuuaaaauauuuuuauuagguauuuuccucauuuacauuuccaaugcuaucccaaaagucccccauacccucccccccccacuccccuacccaccaaucccacuuuuuggcccuggcauuccccuguacuggggcauauaaaguuugcaagucuaaugggccucucuuuccagugauggucuagugauggccgacuaggccaucuuuuaauacauaugcagcuagagucaagagcuccgggguacugguuaguucauaauguuguuccaccuauaggguugcaacucccuuuagcuccuuggguacuuucccuagcuccuccauugggggcccugugauccauccaauagcugacugugagcauccacuucugugcuugcuaggccccagcauagucucacaagagacagcuauaucuggguccuuucagcaaaauccugcuagugugugcaauggugucagcguuuggaagcugauuaugggauggauccccggauauggcagucucuagaugguccauccuuucgucacagcuccaaacuuugucucuguacuccuuccaugguguuuuguucccaauucuaagaaggggcaaaguguccacacuuuggucuccguucuucuugaguuucaugaguuuagcaaauuguaucuuauaucuuggguauccuaaguuucugggcuaauauccacuuaucagugaguacauauugugugaguuccuuugugauuggguuaccucacucaggaugaugcccuccagguccauccauuugccuaggaauuucauaaauucauucuuuuuaauagcugaguaguacuccauuguguaaauguaccacauuuuuuguauccauuccucuguugaggggcaucuggguucuuuccagcuucuggcuauuauaaauaaggcuacuaugaacauaguggagcauguguccuucuuaccgguuggaacaucuucuggauauaugcccaggagagguauugcgggauccuccgguaguacuauguccaauuuucugaggaaccgccagacugauuuccagagugguuguacaagcuugcaaucccaccaacaauggaggaguguuccucuuucuccacauccucaccagcaucugcugucaccugaauuuuugaucuuagccauucugacugguaugagguggaaucucaggguuguuuugauuuguauuucccugaugauuaaggauguugaacauuuuuucaggugcuucucugccauucgguauuccucaggugagaauucuuuguucagcucugagccccauuuuuuaaugggguuauuugauuuucuggaguccaccuucuugaguucuuuauauauauuggauauuaguccccuaucugauuuaggauagguaaagauccuuucccaauauguugguggucuuuuugucuuguugacggugucuuuugccuugcagaagcuuugcaacuuuaugaggucccauuugucaauucucgaucuuacagcacaagccauugcuguucuauucaggaacuuuccuccuguacccauaucuucaaggcuuuucccuacuuucuccucuauaaguuucagugucucugguuuuauguggaguuccuuaauccacuuagauuugaccuuaguacaaggagauaggaauggaucaauucguauucuucuacaugauaaccaccaauugugccagcaccauuuguugaaaaugcugucuuuuuuccacugaaugguuuuagcucccuugucaaagaucaagugaccauagguguguggguucaucucugggucuucaauucuguuccauuggucuauuugucugucgcuauaccaguaccaugcaguuuuuaucacaauuguucuguaguacagcuuuaggucaggcauggugauucuaccagagguucuuuuauccuugagaagaauuuuugcuauccuagguuuuuuguuuuuccagaugaaucugcugauugcccuuucuaauucguugaagaauugaguuggaauuuugauggggauugcauugaaucuguagauugcuuuuggcaagauagccauuuuuacucccaugcucauggauuggcaggaucaauauaguaaaaauggcuaucuugccagaagugcaauuuuaaagucucucucuuuacacugucaguuuuggcuuuauguagcuuuaaauuuugaaacugugcuauuaagaauauaaaaguuuagaaguuuuaugacguggugaguuaucuaguuauugguauguaaugguccuuuuuguucuaauuaaugcuuucuuugucauauccauauacaccagcuuccccucuuuguuggcuauuugucuuccuccauuucauaaugcugaaccuucuugacucuauacuuauaucucaggguuuuucuaaaacagcacguaacccuguuugucacugaauccaaagaccuuuacucacuaaauaaugcccaccaaccauuacuaccauguuuuuuuuuucuaacaucuuacuuguauaaguugcugugacuugguuuuuuuccucagucuucuugucuccuguuuucaggguuuaguuuuuaaagugaacauuacaaauauaagggcaaagaauacagauauacuuuuaggguauuaugaccgaaaauugccuuucuugauauacauaucaaaaucuguacacucuccuuuuagccuuuugcuuuuguauagugauugucaguuccuuugcuuccuauuuauuugacaaguguauagacauuuugcuccuaguuuaaggggagaaaacauugccaguucucucaaagcauuggguuuugcuuuuaaugucauuuaacugacagacaguggugucaaauuagugcauaaucaccaccuuuggcaaugcacaugcuucacaaaccaguuccugaaugccagaucugcugacucacugagugaaguuagucacuucccaggugcagcuguggugacaguguucagugacacuauuguguaugagcaucaaaacaugacaacgcaaggaaaucucuguugagguuguuggguuuggggggaguucuuuuguuuuuuguuuucuaaggaagacauuaggugaaaagggagcaaugaaacagcuugcccauggacaccguuuuauucuccagcaacaacacacugccuauaguuucugcauggguggaaccaucuuuccccuacaucaagcugccuuccucuucugcagagcaggacuucccuuuuuucuuucucccucucuauuccuucccccuccucucaaacuuuuucugaaguagauuuuuggaaauaauuuuagaguuccagaaaggcuauagagguaauacacagaguacaugauagcaucugccauuucuccuaaacaucauuucuguggugguagcugcauuugccuaacccugagacauuaguauucaacaaggcuucaucuuaaugucaacacuguauccacugcugucccuuuccuguuccagagugcagcccaagauaccacacugugccuugucauaccugcuuaguuugcuuucuguuugacugcuuuuuaaaaaaucccuuuccccacaguuccuauuacuuuggugguuuuacauccuauuuuuauucucugagauguugccagcucaccauguuuccuagucuccuugucacaugcagugccguagcauaaaaugaaucaacuucuaagaagggaguauaauguacagcucuuuccaggaaucccuccagcauucaguucuacaaaucugcaugcuuguguauacacaccaguauuucuagauaugugauagagugaugugaaguguuuuauaugguuaugaaacaaugcccaguauguuguuaagugucagagaguugcguauagagcaauauauuuagugugccuagacagauucccuuuuaccuugugauccaaggacucuguuuucuggcugcccucucacuaaugcucagcacuugaauccugucuccacaugggcaccuuuguacuaacucugauccuugggcaccuccgcaucccugugcagcccuccagaaggaucaaaugaauuugccaugcuguugauucugaaaaugaccuuuuuuaauuagguauuuucuucauuuauauuucaaaugcuaccccaaaaguccccuauacccuccccuccccacuccccuacccacccacucccacuucuuggcccuggcauuccccuguacuggggcauauaaaguuugcaauaccaaggggccucucuucccaaagauggccaacuaggccaucuucugcuacauaugcagcuagagacaugagcucugggggguacugguuaguucauauuauuguuccaccuauagguuugcagaccccuucagcuccuugaguacuaacucuagcuccuccauugggggcccuguguuccauccaauagcugacugugagcauccacuucuguguuugccaggcacuggcaugggagcaaaaucaaccaaguggaaacaagaagaacuauucaaagaaucaaccaaacgaggagcugguucuuugagaaaaucaagauugauaaacccuuagccagacucacuagagggcacagggacagcauccuauuuaacaaaaucaaaaaugaaaagggacacauaauaacagauccugaagaaauccaaaacaccaucagauccuucuacaaaaggcuauacucaacaaaacaggaaaaccuggaugaaauggacaaauuucuagacagauaccagguaccgaaguuaaaucagaaucagauuaaugauauaaacaguccuauauccccuaaagaaauagaagcagucauuaauagucuccuaaccaaaaaaaaaaaaaaaaaaaagcccaggaccagauggguuuagugcagaguucuaucagaccuucaaagaagcucuaauuccaguucuucacaaacuauuccacaaaauagaaucagaagguacucuacccaauucauucuaugaagccacaauuacucugauaccuaaaccacagaaagacccaacaaaaauagagaacuucagaccaauuucccuuaugaauauugaugcaaaaauccucaauaaaguucucgcuaaccgaauccaagaacacaucaaaacaaucauccauccugaccaaguagguuucauuccagggaugcagggaugguuuaaaauacggaaaucuaucaacguaaucuacuauauaaacaaacucaaagacaaaaaacacaugaucaucucguuagaugcugagaaagcauucgacaaaauccaacacccauucaugauaaaagucuuggaaagaucaggaauucaaggcccauaccuuaacaugauaaaaagcaaucuauagcaaaccaguagccaacaucaaaguaaauggugagaagcuagaagcaaucccacuaaaaucagggacuagacaaggcugcccacuuucucccuaccuauucaauauaguacuugaaguccuagccagagcaauuagacaacaaaaggagaucaaggggauacaaauuggaaaggaagaagucaaaauaucacuuuuugcagaugauaugauaguauauauaagugacccuaaaaauuccaccagagaacuccuaaaccugauaaacagcuucagugaaguagcuggauauaaaauuaacucaaacaagucaauggccuuucucuacacaaagaauaaacaggcugagaaagaaauuagggaaacaacacccuucucaauagucacaaauaauauaaaauaccuuggugugacucuaaggaagugaaagaucuguaugauaagaacuucaagucucugaagaaagaaaucaaagaagaucucagaagauggaaagaucucccaugcucauggauuggcaggaucaauauaguaaaaauggcuaucuugccaaaagcaaucugaaaaugacuuuuaaagucaaagaauaacccacuaucugacauauauaauagucaguaaacauuaauauaguugagauagcuuguaauuuuauguagccaaggauaccuuugaacuccugaucuuccugcuucuaccucucaaacacugacauuacaggccacugagcccagaguuuuucuuacuguuuuuguuguagugguuguuguuuguuuguugguugguugguuuguuuuuugugguggugcuggaaaugaaauucagccuuucacacacaaagcaaguucucaacugcugaguuaaguccccagcccuuuaagacaguaucuuuuaguggucuguaacugaccaagcaggcuaaauuggcuagccagcugauccccaagaccagccagucucuuccagcacuagaauuacaagcacaugucacaugcuaaacccugcuuuuuaaagagcaacucugaagacugaacucaggucaagcaaauaauuuaucagcugaauucuuuucguaaccugccuucaagucgucuucaugcauaccuuuccgauucuuauuuaucaguuucucugugagaguuugguugugugcguuauguugacagaguugcuaugaagccagggaauucuccugcucuagcuucucuuguguuggccuugcaggaguacaccaugccccauucucaugccucucuauaaugggcauaaaagcacaucccaucaaguauuacuuacacucauaaaauaaagccuuuuuguuuaaaagaaaaaaaaagauggcaauuuucaauguacuauuucagacuacacgugucauuguuucuuccuguaagaaaauucugauaggcauuccuccccaguaaaagggguagacccacuugagguccauuuucagcucaguauugauuuucuacuguggccuuucaguccagaggguucugcuccauguaucuuuaugcacauaacuuuggucuaguaauugauucucuuugguggauuucuauggguagacuccuguggcagguggauuuccacggguggacuccuguggcagguggauuuccauggggagacucugaggcaggugaauuucuauggguagacuccugaggcagguggauuuccauggguagacuccuguggcaggagagugccugguuugugugauucuccugacuguccugcugcaacacuguuggccuuggaggauguacuuguuuacagcccuggagacuacuuauaauugauuugcugauucucacauguaaaauagcgcaccuacuaggugcuuucaugcccauccccuugguugcuggugaacuuagacuacauguuuguucagcauacauuucuggugccuuuuauuacuuuaaugcauauauuuagacauuaaucuaaaacucucuuuauuuuaggcucuuguucuuugaaaaaaaauuguagcuaaacaaaccaaaaaguagaggaauucacuccagaaaguggcuauguuuauaaacaagcagucuugaaauacaagaccucuguggugcuuggaauggugugcauuccagaguauccugcucacuagaugccaaguccaccaaauggccagggaaagccugacugagcaguauauuuauuugccucaagcugcucagauggggccaaucugaauuccugagcacuaggauugcucuucgccccagaucucaggguguucuaauccucccaguguuugcauucaggguucuguagccuccugaugucugccaggauucuugguggguuuuuuuuuucccuaacaaacaaaaaacagauugccaccaggucuaagaacauuuucucucuuuauaaguguauuuaauaauaaaacagaaacacauguucuuuuucuaaacaccacacuaauucaaaaaagcuuguucacuagaugagauauacagacaagcuacgaauuacaaaggcagaaauuaaauuguaaacuaugcagggacgcuuuggagaaaaccuuaacagggguaaucagagaggcuagcccuccugguuugcuguuugcagucugccuuuguaggaaaugcauggggggaggggaggagcuggggcuguuucauaaucuguaaccacaaagagauggcuuagaucuuuaucuucuauaaacugcacucacaagcuauugcuuugcucacuuucccaaagucuaagugucuugaguccagccaaaaaagugugugugugugugugugugugugugugugugugugucugugugugugucugugugugugucugugugugugugucuuugguugguuuguugccuagguuugguuaguaugucccuguuauuagcuauuaaaguugguuaacucucaucacuucaucuacuuuuugagcacuuucaacccuuagcaauuuagaguagagccugguauugagaacagauugcuguguuuugggugggaugaaagaaagguacaggaucccuccucucccccacaaccagagccucagagccucugagcacagguguugacauucauuuucagaaccggugccucauuuucagacccugcggucacugaagacagaguguuauccugugaguccacccuugacaguaugagucuccucuccugucccagaaguucugucacaucauacuacucacuuagugaagauauaagaucccuguugagacuuugcucuacccaguuaagguugaagauaguuagaagagucauuuggaaugcugggauuugagugcugcacgcagcugucugugcagugauagcauuagagggagcauccccaugcagccuagccagcuaugcgaccacacaggcuaggauugauguuuccugggagagguaccagugccucauaaagacccaauuauaaaacccuaccuggaucucaaggcaaaacaaccguucacugucuccucaguaaucgccuuagcugcuucuagcccaagccuucuguuucuuucugagauuaugcauaaggaaacacagugauucucuaauaugcaauguaguuuucagacugaaaaagaauugcucuguguguguguguguguguguguguguguguguguuguguauauguguguucauucagaggacagauguuuauuuccuuaaucacucuccauguuauuuuuugaggcaaauucugucacugaaccuggaacucacuaauucaccuaggcuggcuagcaaaccucaaggaccuuccugucucugccuuuauagaucuggaguuagaaguauguacaaccaagcccagaucuuauauugaggcuccagcacaggccaucgugcaaucuucuuagccuccucuaacagccucagggccugacuggcuauguaagcucuuccccagaaguaccuccuccagcaaaugcagauauucaucaguguggaauagcaucugccuucccaccucacacccaucuucagaccuggucauuucucugcuguagucccuaguaguccauauucuuacaggacucacuauccuaauaauuggaagaaguggacauggccaacagggaucagaagcuguacuuacugggaggaaucuccaucuuccuggcuauuuuaguaaauuacuuaggcuccuggaacccuguguuguccucucaaguccucugacugauucucaguuuugcucaaagcuuugccuuugugccuuugccuuuaccaaccuugacccuuuugccuauauacuaaaucagagggauuuuucccagagcaaagagaaaaaccaauaaaaauaauuugaacauggaguguuugugcuugucagauguacaugucaaucaagcuuauaaugucuucuuauucuaagugaccauucagaagcaguuagcuccuugaccuuggguaauccaaaagugaaucuugccuagaggaucacuuggcacauaaucucuuagccuccacugugggccaggcauuccagagaccaagauuucuagcuuccugaagaggacagcaggugggaagaaacagacaagcagugugcccauucauaaauguuguaguagcuggugaguggugaggacugucaagggagaggaauuggaaagagauggcaugcuuagcaagauagagcacaucauugucuuauguugugagccccauggaggcaggcaacagacuaagcauaggugucugagaggauaguguucuagaugaugagaaagcuguucuuuaaccuugaaguagcuuguuugauacuuaauuauuaugaacaugggauaucgccaugaaugucagcccugcuucaagugucuuucaguaacacuucaguuugaaauucuuucuuuguuuuacaaauuagaaugagaaagacucuggagagggauaacaugacuuagugcuucagaacugaauugucaccugcuuugacaguggacaaugcucugacucauuuugucuuccuugaaccuuagaaguuucuuuucuuagaaaguaaguuaauucaagauaucaccuuugauacaaaguuaaauugucacuugugucccuaugcauuaaguuugauaaaaagaguuaggugaauuucagugauaugagcuccagacugucacccacuucaggcauaaggcaaagucauccuucaguggccaguacucuacaugcuguuuggauauccugaaaauucccaggguguguucuagaggacugagggcucauauggagggucuccagaaggcuugcaauaggcgccuacuuacugucuaccccaggggcccuccgcaugagccacuccuucuuucuguauuggcagauagcuugcugggcccaaggaagaauguacagcagagacaggguuugcaaaucacacaucucagcugggacacuucugaaagagccgaguauagucucuaaacuagcucaguauaacaugaggucucucccaggcccugggaaacacaaaaacugacagaaauucaccuuauuuccaccucccgguaccuaaugugcuuuaacauuaaaagcuuauuaaaccauuuauguaacauuuagaauuuccaaaugccuucauaacucuuuauuggccaauuagucucugcagcuuuccugguagcaaauugguuacaccccaccccaccuccauuugggagauuagacacaaauaggccaagugacuucccugaguuuguccugugagucaagucccccaucacuccacaaggcaguaauaguauugagccaugacuuuacuaacacaaaucaccuaagcugccugaaccuuugucuccaccaugugcacaggagacacuagucaucaguguccucccuguuuuagaacugauuguaaaaacaaaaugaggcaagcuggaaaugcuaaauucuggucauggucccaguggaugaaggcagagucuguagccuccugcuuacuccauaaguaaggaguaccgcuuguucuaagcuagagcaggaaaaaggugaagcaaggcaaccaacccuggcugacccucuaacaaaaccaagucuucauuugacucagucuagagaagaagagggauacagagagggauacagagagggauacagagagggauacagagagggauacagagagggauacagagagggauacagagagggauacagagaacagccagcagaugaggagugagcauggcaagggggcccaggacugggcuggguuggguuggguuggguuggguugggucaagcaguccugacaggugugaguaguacuuuuugcaccuuugauuuguauuucuuaaauaauuacugacauauaugcacuaaaacacaaaauaaccguaauaacaauuaaguuggguuguuuucuuacuaggauuuaaacauucuuaauauccucuauuacaauccuuucuaaacugugugaauugcaacaguuuucuucuacuucacggccuuucuucuauuuucuuuuacuaugauaaaaagagaguugcacgaauuuauuauauuuuagaauccuuauauaaacuaaacucaaagagauuccaucuguuugugaaguuuuauagauguaaguuuuagaucuagguauauaaucuucuugggguuuuugucugugauacaauauguagguuagaaauuuuuuuuuuuuuuugucauuuguuaucauguuuugugguauuuuccuguggcgacugaguggcagccaucaaaaagcuauguccacauucuggucucccaaaucuuuauguggcaaauaacugaaccaagggucuuuagaagaacagguuucuuguccuaccuaggggaccuugagcccuuccuaagaaggaggcuaaggaaucuugagauacacagaaaaggaggaugcaguaugcccauagcacagagccugggucaugagcccacgagccagggaacauuggaguucucuagugucuuccaaagggcuuucaaagggaugcagugaugccugaguuuggauguuuggcuuccagaucuaggagggagccacccagugucacccagugguauacucuuaagaaggacauucauggcuuuccaguaguuucagcacaguuuguugaaaaagcuccuucaguuuguugaaaaggcucccuuugcuccacgaaguagccuuugcacaccugucaaaccaauaaccacaaucaugcacugcaccugugugcaucauugguguccugaucugucugccugucuccuuagugcugccuguuauacucagugguaauuuaaaaacaggcagcaugagucccacuguugccuuuuccggauugugucagucuucuggaguccacuucauuuucugccacaacuugucuugugcugaagcuguagugacagcuguguugacgcuuucagucagcuagggaacuuggaugucuuccuaacaucacguccuuggccauagucacagugucucugcaccauucaguccuucaccuacuuuucucagucugcaaucuuuaacauacaaauuagaauucuaaguauucccugggguuuuguguuuuuugguuuuuuguuuuuuuuuuaaaucaguuucuaauaagugcauugcuaguauggccugaggauggauuguggccaagaauggcuaugauuauggugcaaacaaauuauagaauuacugagaauauuuuuuaaaacacacuuauuuguauuuguuuacaugggcaugugacagagugaguucucuccuacaaugugggucccagaaaugcugagcucagucaucggccuuggcagcacacucuccugcucacugagccauccagccaucgccauacucccauuaucagacuuuuuccuuuucucucucucucuuuuuuuauugccucuuuguuguuguuuugaacucgauuacauagcccucuggugugaacuuugcaggugacagaucaugccccacugucagaaggaacugcugaacaguccuuguuauucuguuuugauuugguauuuccuugucucacuguguugccuauguugugguguuuaagagacuugucugcuguggaauguaugcuguaggccuucccucuggcuuguaugagaacaaaucuccuugaggagcucacugcugaugcugguugucauagugacaguuuuggaauuuugguuucuuaaaaacacacacacacaguaauauuauaagaauauauuuuugcuucaaccgcaaguguggggauaggaggcugcuucaggcugaucacagcagcugacuaugauuugccucaugcucuagcagaggcauaguuuagccagcugcauauaguuucugugauugugugacuuuugggauucuggaaacuuuuuagaggguguaaaaugcuaaggcccuaguccaauagguugguaguuagugguggguuuaguggacuggcugcucuuuguuaguauuaauacucaaagaauaaacaaacaaacaaacaaaaccaauuagauuuaggaucucuuucucucccucucucccucccucccucccucucuuucuaccucucccucucuuucuccucuauuccuaucuagagauagggggugaaacuagagggauaaaggguggggaaaagaacccacaaaguagcaaggcccaucuacacguuguuacugcuugcuagcuugcuggcaagagauagaggcauuuguaucuucuugaugacccugucccucugaaagagguacagauagcuaaugaccuggacagaacuguguugauuuugucucauuuuguuuccuguuccccuccccacagcucucugcuucaugguagcccaacauuggcuuuuaacaauuuguuaccagcuugcuagcaccuagcaucuguccucaggaagccuucauacucuaugaauucgugaagguaccugucuuuagauuuuaaaugaauugcuucugcaaccagccuccuacaaaauuuuugcuauucuuugacuuaauugcucauggagaauaaugauuucuuuccugguguuacauguaguaggaagacaugagagaauauguagagcagaaguuuucucggcugagguugcacugcuugcuggguaauaguauaggcauucaaagauguguugaaacuucuaccuggcccagagacauuucagaauaaagcacuguuucuccucccucagauguuuugcagaggacagcuaugaggcagcaagauucccuaauuugaauguccagcucuucuuccuguguuugaccaacccaaagagauauuccuggguaggcaagugaauuaagcugaaauuauuuggcccugucccucugcugacuagagaagagauucaguggccucauuguagccccugcuccaggucccagcauaaggagaacucaguuauuaauaauagggcacucacucacagauaauugugagaugcccagccccuuucacuaugucuucucccaaagagcagucuugacagaaguucugaaaguuacccugcuucccauugacaaugaccucaccugucuguuuuaaaaguucaccccucaaaagugauucuugcacaugaaaagcaucagccagaucuaagaaccuucucuugaacucucaacucugacucugguaugagaauaaacugaucucuuccggauagaugagcaucucacacaggagucuugaugacgucuuaaaagaagcaugcaaguggccaccucugugaaugucgaacacauucagucuagagauaucuggugaggaggaagggcagaugguaaagaggaagaagacaugagcccagauucgagguggauuaaguggaaaauccuaccgggaagagacugugaaaagaauuagcacagaccuaggugguaacaguuguaagaaaggauauucaggagcacagcuguaccccaggcaacaguggcagcuugaaguaaaaucagauggcagaaaggaacacagucaacuucagucugccccagcagcuagggacuuuagggcaauaugcagguguuacuauuguaaggaauacucaaccaacagagaaaaaacucuuucuuaguccauuauggauucuguauccacauuccaucaacugaguauccuacaaacaaggagaaugucuguuucacaguuguggugucuggcaaguguaagaucaagaaagacuugguaucugcuagugcuccacugucagaagcauggcacccguguauaaggacaucaguccacuccugagggcucuagccaccuccccaagggccccacauuuaaugcuuucucucuggagcuuggaucccagaagaugaaucuggggagauggggcauucauacuaugucacccuuugaaggcuuccgacauggaagucuuucccacaaguccuagcaaaauguacuauagaauucuaaagcaauauauuccuccaccuuauccuugagcucagaugagcuugagaccucuucaguuuacauugccugguucacucaaacaaauuuaucuuaaaacacuuccaguuuuccuuauauuaacaagcuucccccaaaacugauuaaucaacaacuguuuuauuuguucacaauucaguaggucaggaauuggccaaaagccaauuccuuuuauccuucuccuccuccucuucuuccuccuccuccuccucuuuauccuccucuuccuuuuucuuuaaaggucucucucuccauaccccugucuguccuggaauuuacucugcaguccaagcuagccucaaacucaagagauuaaucugucucugccucugaggucugggauuauuugccuacaccaccacucagccauaagucaauucuuaaauuaguuauuagcuauagucucccagaaggaugaucccauagcaguccuggaauacuaguauggcuuuauucacaagucugucaucuagggagggcugaucaggaguaggucaucuuuuagcuucuccuugagaccaccucagucuucucuuuucggcaacugaauuccaagaaugagcacugcaaauagcaaagaaggguuccugugucagaaggugugugcaguaccacuuucaccauagccccuaaauaaagacaagacuuagggccaugcucagauucaaggggaaagcaguggagcuucaccuuuugauagcugaguagcaaggacaaguuuuauaacauauggaagagagauggcugcagccaucucugaagccuacucuaucacagucucagucuaugcaacugagacuuccucuugaacugcucuagugagaacagcuuuguagccaggguggcggugcaggccuguaacaucaguacugagacuaaagcaggaggagcacagugacuuggagggcagccuggccugcauagacccuacccagacauacugucuuuaauuagugcguuagaugcugcacucagaacacuccuccuuuugcucacuuuacaguagagacagagagcauggcacugacacccuccagacagucccuaaagguucugcuuuucucaaguaagaugagagauguaaggggaaaccuagagggagacgagaugcagauucuuggccuguuucccaucauuaccuuagucaagugcauuuugauuauuauuagguuggagguguuuuauuacccacacagggauuuucaguuuaguuaauaugcuggauacugacauuuaauuuuuuauugcuguucuuuuauccuuucucaaugcuagcaauucuaaguccucuuuuauagggcucuuauuuucuagggauauucuguuccuguguguguuggaaaugcaguuuuaucucuaugauauguuacuaauuaaagcaaacucuuucaaguugugaaacagccuucccugcuucuuaaaccugaaacuccagaaagaauuaagaacugaucagggcuagcuaauagaucccauugcauccuugagagcacaguuuuaacuucuaucuaaauauucuuuccaucuccugaggacaaagaugccaccuuccuacagagagcagcaccaaguaggcuggugccuguuagccgacagcucucauuuucacacagcguagggccaaaggggagaugcaccaagcauuugccaagacaguggagcugcuuuuuuuccacuucagcacaccucagggauuuuacacaugccuaucagcucauuagggcgaugagaccuagaagcucugaggcuggaaaaaaaauccaccauggagaaucaccaggauaagaugugaagcagauaaggauaacacuaggugacagaaauccacaccgaagcagcagacaaacacaacuaacacucagucuccuguguccuccacauggccucugagauuagcccauaucucacugauuucacaguaaucaaaguuugugcuacucagcuaccuaccagauugacacugggaagagaggagacgugauaaaagugaauaauauuugucaggucacuucugcuggccuaccauguaugagaccuccuggagcaucucugcaaaacccaaccuagagcagggacggcagcaugcccaccugaaguaggggcagucuuuguguguguguugucucccuacuguuuggacaauacuguuugcauuuauucagugguaaaugauuaaauauauguguguagaaaucauggcacugagacauggcaggcuucuuuuccuggauaguagagccccagcagaggagaaaggcuuuuuccugcuuugucucacuggagaauauggcacagggagagauuaaguuucagacauagaaaggggcccuuggaaaucaauuagccccugaaccucauuuuauuggagaaauuuagcccagcaauauuaugacguuuuccaauaucaccugucuaugugggacagauaaaauggucuguugagaaaugauucuggaggcugcaggugccuggacaguuggugcagaugggguucauuugaggucaggaggaaaggggauaaaacugcuaauauuuuccugggucagcucuggccaggaaggcuaugacugucaagagagaucagaaagugcugucaucuucuacauacaugcuggcucagccgagucaacacccuagagaaaaaaaaaaaguugcucucuggccaccagccacggaauccccaacuccucagcugauucccuuugggauguguguguugcugagaacgaaaggacaaugaguacauggucacuucaucaccauggaugacuuauauagugaaaaaucucauuagaagugcaagucauacucccaugggcacuaucccccagagaagcagagcauacugauuugcuagaugagauguagcccccucugggauggcugccagaaaauuguacaaccuuauggaaauuguaaugauucagggcccuuuggggaaggaagguguccuggaaaacaccuggucccuuaacuuugaaauagacagcagaucaggagaggggaaaaucauucuauaaacauguauuagcuuugguguugggcacugugcugggaacugccugcaacaaagguugccauugccuacugcucuuccucggcaucucacaacagcaauacuuuucuuacuucauuuauauugacuucucaguuuucuuuggcauugaugacauguugauaacauccucccaaaauguauuuuggcugucuuaaauauguugaucuggcuaaacugaaguguucuugagggcagagauuucacuugcugucaagugcaaagaagauacuaaagguugguuauacaucugcuuugaaaauauuugccagcccaccagggaggacugggaaggaguuugagagcaaacagcagucauuacugaaaagggcaacacguccugcaggugguagcugcagacacccacccaaagaagcuguuauuguggaacuguuaacauugugugcccacauaaaugaugccuaggagcaccacaggcugcauccuuuuggacaggaagagccguagcacaaagauauuaucacugagacugaguauauagaguaccugaccagcaugcauaaagcccugggucccauuaccaauacugcauaaacugggccuggugacacauaucuauaaucccagcacucaaaaaguggagacaggagcucagaaguuucagaucauccuuggcuucacaaucauaucagaauguuuuacugaagaccaacauuaaauacacacacacacacacacagaggacauagaagaaggaaacucaugcucuuugccugcguguccuccaccuugcuagcaaguuuauuaauucacugguauuagagccuauuucuucaagauuccaguguacacuaaagaccagcugagacaucaugggcagaccuugggggaaugaacagcuacugaauucuuggacuuucuguugguagacagucccugauguacuagcuagaccacagccuguagaccacucuaauacauuuuucucucuaauacaacaaguaaaacugucagguacucaccauuauuuccagugcuuacuuggccauaauguuguggacaccgguuacacugauucucagauguagaccuacaucaucaggugccacaccaaggaaaaauacaacuguaguccaguguuaacaugacuggggcauuuuuuccuucugugugcacagcacagggucuuugguggaaacaaacuuaauuucuaauauaguagaacacucacauuuccugguagcaaggaagagaccuaagagaauuuuagggaaguccuaagaauagcagacuuugcuucccuugaaaccuaaauuuuugaaaaacgauuuuguuuagaauaacuuacuauauuuguuaaugcuuacauuugauggagggagcaaaguugcauaauugaaaauauuccaagcccuucagagaucaagggugucuauagcucacuuccucugagcucauuugauaagaguuucuagagagaagagagaggaaaaccuguggcugcaaggccagaguaaagaaaaugugcuucuuaaugucugauagugaaaugaaagguuucuagaaaaaaacaaccaaaagauaugaggggagaggagagcugcagggugcaagaagccccccuccccagggccaaauucguuuggagguguagagcuaaaucuaagggacuaggaaggaauuggcaugagaucugccauuuuauugggugugcugacacaccccuauaaucccaacacucaggaaacugaggcaggacaguggagaauuugguucaguugggccauauagugaauuugaggcuagucuaggcuguauaacaugggguugggggaaagaucaauauaagcaucuuuggucacuuuguagccuaacuauccucacuguaccauuugaaaguauaacguuucacagcaaauaauuuaggugguauuccuacuuaaaaguguagccauuugaaaacauuuugcaagccauaaagcacuaucuuaaguacagcaggcuacaaccuucuuuccagugugucaguauuuacaauuuauucucaugauuauuguuggcauuuaugauuuaggaagagaaggaagcacaagaucuuaugguagaauauuauacaccuaaagcuuuuaugagugugccccuuugguauuucuaacagaaauagguucuuugaggaguauuucuguucccaaacacccaugacaccuccuaaugggaguauaaaaucuggagggauaguaaucaaugacaacccagaucucugacuucaaauccuguucuuagggauguauugccauuaucaguccucaccguugguggcuuuuguucagcacagcaaugugaaaggcacuguucugaguacucagccugcaccacaaccugauagguguacuauccccauccuguccuguaggggaugaagcuggaucacagaaaguguaauacaucacugguuauguugucacugcacucaggagacuggaguaggccagcaaguuccagagagggagggaauaaagaagaaagaguaaguaacuuguccaacgucaugaaagugacuaauggaaaagccaggaaucuaccucaggcugccuagauccagaaccauuuacccauugcauuauacugucaucucuucugauugugugguauguauuuuuuguguuuauguuuguaagcaugcaguggagccaaaagugucuuucugaucccaucuccaccuuugaacagggucucuuacugaaccugaaggucacugauuggccuggccagucagcuuuagaggccuuccaguuuccaccccacccauauugucaucuuugauggaauuauuaaagaaauaugcaaagauauauuuuacauguuucuaucaaggcacuggauaauagagaaaaggacuggagggaaauauucauuaaaaagggauguguucaguuuagauagccauuaaaagcaaacgaucugaaucuuucaaaaugaugaagaaagauaaucuacauuuaaaaaucuguauacaaaaugcaucccuacugcauagucuacaugugugugaaaggcaccacgcugcgcuaucucccuacaugggaaagacauguuguauucagggaauaggcuuuugucagcauguauaauguacucuauuuuggguaagaaaacauucuuuuuuuuauuagauauuuucuucauuuauguuucaaaugcuaucccaaaaguccccuauacccuccccccacccugcuccccuacccacccacucccacuucuuggcccuggcauuccccuguacuggggcauauaagguuugcaagaccaaggggccucucuuccaggugauggccuacuaggccaucuucggcuacauaugcagcuagagacacgaguucuggggguacugguuaguacauauuguuguuccacuuauaggguugcagaccccuucagcuccuuggguacuuucucuagcuccuccauuggggggcccuguguuccauccaauagaugacugugaacauccacuucuguauuugccaggcuccggcauagccucacaagagacagcuauaucaggguccuuucagcaaaaucuugcuggcauaugcuauagugucuggguuugguggcugauuaugggauucuuaaaagccagacaugaaguuguugacauucauuauccccuggagauaaaauuaugaguggucacuuucuguuaugcuuuuguguuaaaauguuuucuaauuuuuaaagcauguacguuucuuacagaagugcacaagaaaacuaauaauuuuaauagaagaagaaacacaaaagcaguagaauaucaagagcuuuuuguuaguuucuaggacuuuagacacaauacacacacacacauacacacacacacacacacauauggugugggccuuggcccucaaagagcugacauuuauucuggaggcuacagacucaaaauagucagguuucucugguuuacugauaucgucaguugugagggacaaacagaggagugggaaccuauguaagagcacuuuccauguauacagauggguucuggguuccuagaggagguggggccuucagcuggcucuaaggaaccaugggggagcuuagucugacugacauaaacucuggugcauuauuaauucuguuuucagaauucuacucuuagacacucaguuaagccauuggcugccuuccuuauguagacagacccucucugggcuuugggggacacugccucgccagcuauggugacagugagcuucuuaagcacucugucacugccauggaaguaaccagagacaagacaacucauuccaaagguggcuuuucuggccaguuccugucaccucagucugggcuuccugaccacuuuuuuuuuuuccaagucuuuuggaucaaauagaauacucccuaguuguagaagucucauugucucacagguaacacaggcugguuguaggcaccucuuggcuuuggaauucuagagaguuuagcaaacuuucagugagauacuuuuguuucuacuuuaagcauaaaauaauggaucacagaaauaaauguucuuggguuaucuggucagcugggaugcuuccucuagaacaugguccucucucugucgaaaugucucaaaugcucauagcagcugaaagaagaaaacgcuugcagccuccucuuucucaccucuuucccugucacuuuccugaacuaugaagcaagcucaagggaaaguauucccucucucucaagggucccuucagggcagaccaguucgaguguccccugugaacuuugagguugucuagaaauagggccuugauuaccacagcucugcugcuaagaauggggcucugcagcccucuagagcucugacuccucuccugaccaauauuucucccuuucuuucugggacaccuaugccuuguuuucuucuuuguucagaaccgcaaaaaggaacuguuuguuugacuauggacuuccuuuuuaaacucccccacuguuccaaacccauugcucucuuccucucccaaagaagaaaggaaagcaagccacaauaauacuucuguaaauuuauggccacucuguaauguuuaaucacaucuacgugacuggggccuucagagcaggcgcacaaguucagcgcaaggugaaucuugugugagauaaucugaaaguucauucagaggugagggcagcggccucuagcagacagcgagguuaacaggaggucaccuccccccgccccccuucuggucuucuccucuacaauguguaaacaaaagggaaauguaacuuccaaugaaccuggcauauguugugcucacacuaaucuuggcccagccaacuguaaacaguccaaucuccugugacugagccuuuccacccauuauuugccugcuagagaugaagaagcacuacaagagauuguagaccagcgcuacgugagccagcuccuggaaccaaccuugggaaagcaggguuagcaccagaggugauguuugcugccaggcacucagagcugggucaggacaccauccuucuguggugcucucagucccaagucagcaggccucacugaguuccuucacucccuaccacacagcuaacaagcaaagacaaaaauggacaugcccucaaauugcucacagcugagcggcaaaaguaucugugauauaacugaaacaggaggauggacaggagcugugcuggcaucagaaagagcugaggacagugucugcacaggaugcagacacuaccuccauguagggcugugcuacaguguucagcccaaugcaaguucauccauuggguggaacucuguaguucaacccacucggccaagagaauucuaaguauauagaggcaguuuuuaaugcccaagguuaggaguauucaacaguugacccugaacagccuaaagaaaaaaaaaauagggguguagacaacccucacuuaucaucagcccugugcccggaaguccagagcugcugggccagaacuaaucuauauggggagagacuucugcuguacuucaggucuaacuucuugcaaauggaugcauaaugggugcuuccagacuagaugaaggcucagcaaauuguccugggcaguauauuagucagcguuucuguugcugugaugaaacauaaugaccaacagcaagcuguggaggaaaggguuuauuuggcuuacacuucuacaucauacuccaucaccaaaggaagucaaggcaagaacucuaggcaccuggaaggaagacaugaugcagaggccauggaggagggcuguuuacugucuuacuucccaugaugugcucagccuacuuucuuauagaacccgggaccaccagcccagggauagcaccacccacaaaggucuggucccucccugcuugaucacuaaucaagaaaaugcccuacauuuauguuauggaggcauuuucucaguucauauucccuucuuucagauaacuccagcuugcauuaaguuaacauaaaacuaguuggcacagcaaguauuuaucuugaguuagcuucuagaacuccuugcucauuagcagcuauacauaaaguauagaguuucaucauuuagcuguugcugaugguaaaggaagucaaaaguacugaacaucuaaaaagacacacccuuuagcuguaaaaucuccugguuauuauguuugguaucucucugggaucagaaaauagaaaacacacacacacacacacuuuccuaaauucccaugggucuagaucuguguauagguagaagcagagagaaauagacugauaugacaguuuuauagucuuccaaaggauacuaggccaaauaaauagcuaguaauuucagauagacuauuguaccagcaaaugaaaugguucccagagacuggaagacgguuuuugaagaucucuucaaaguaugaaggaucugacaggagaaaagaaaagaagucuuucuaaaucagaaaaaguauaagguguggggaugcugcuaucuucagugucuguacugucgucuuugcuggugcaggcugacauuugcuagauggcaggcucuauagagcacuucaucaaaccaaguuauuuccacuuuaaagaaguugguaaugggucccagagcacaugaauuaugagaaaguauuagaggcaugagcugacugcagccccuaggcaaggugucagagauggccucagaacagcuuucuaggacagcauaagggaaggcuucauggccaccugaacacccucuaucuccaccucagaguugugaaucaugcagggacaggaauugaaaagcuaaugcagaaacuuagguaaagaugacaucuucaagucagaaacauggacugucauaauauggaaaggacuagacaaagugacuaccuagaauaagauuuuccaguuuugucuuggucuguacuuuguguugacuuucuuguagacaugagagagaucacaggggaaaguauaaacuguucauccuuauagugucuaaacuugggaugcucucuuaaaccucucuacugaugaccuggcacuugcugaaguccuuccuuaaugaaacucaauucccaggaacaagucaugugacaaaugguaaucuucaguguccagauggcucugguccaaagaacauggacaggauggaaaagggaguuguagccugggugagagccaggggcuugauuugcuguuacauugaagcagaagucaaagagguuccugucccuguuaaguucacaaagggcaguggaaccuuugauuaauaaugacaccucugugguggcuaugcugacaacugugauagccaacauucaagugugcuuucacuuacuguaccucuuucagguccuaauuugaugggaacggguuuuuuuuuuuaaaaaauuggauauuucauuauuuacauuucuaauguuuuccccuuuccaggucuucccuucagaaacccccuaucccauccucccucccccugccucuaugagggugcucacccacccaccuacccacucuggucuucuugcccuggcauuccccuacauuggaacaucaaacgcccucaggcucaagggccucuccucccacugauguccaacaaggccauccuugggggacagguuuuaacagaaauucauuaaauuuaugauucagaaaucccuagugacuuaaugaaccuccauaacgggccaugcucuaaugaggagauaauaaauauaccgauuaaaugcuggaucaagauccucauaccuucaaaaaguauacaugcuuacugcuccaaucacauaagaagguagagucaguucauguguacagauuucuucucagacuucugagaacaagugguuuaaaacucucccaucccaaguuucuucuuucuccuaauuucuccuacccagcucaguugccgccuaacaggcauguugcuccuaggagaauuucagaggcaauauagucaaagaaggaagcccugagagcagagcuuauccugccgugccaacugagccuuccauuccuuagaagagucuuugaagauggauucaauccuaaggauucuaaagugggaauauaacccucacuuccuacugcagaggagggauggcuugugugcaucuucauucuggucaacacaggcuuccccacugggucuuuaauguguguuccuguguguucucuuccaaggauagaaggacccuuuuagucuacucacucaggucuaggucuggacugauaccugcauuuuccuugugucacuugcuaugaaucaaguucaggaguugcuuacaacacuggccugacauuuuuacaucauacaguguggugacagucuucuuaccacacucaccuaaccugcuaucugcccugagugccagcagacauuaauuacauucccuugccacucagaacacacuugggcaacucuucaccagaaacaagcugagaaguauauuguagugugcuuugauauucuuauauccuggagaguacuauuuaacauuuugaugaauaaacaaauuuggacugaucaaaauggauaggucuagaaauuauaaggauggauaaaaagguaaccuguggaaaguuauaguggugugugugugugugugugugugugugugugugugugcgcgcgcgcgcacaugauauaagaauccauaacagaugccaaguagucaugaaaacauguagugugaggacauagagaugggcuacucucacuuuucuuccaugcuuauguagaguagacaaacuauuggcauuuauuuauucucuaagggcaacauugauuuugugcacuuuuuguaguuuggguuuuuugagacaagagucuugcuauguauagucaauguugccauugaacuaagauccacaaauguuaguauuauaggcaugagccucaacacucagcauacuuauuacuuaauuuuaaaacagcaaguaaaauucccugucauucucugucaccucucuagguaucugauauaucuauauguagaagauagauagauagauagauagauagauagauagauagauagauagauagauaucauguucuuaaguauuucaguucucuaccaguuguuuaagcuguauuuuuuagacagaaagguuaaacaaaaucagggcuugggcuaugauuguagcucagucacagugacuuucuggaccuuagucccuuccuuccugaaggaaaggaagggaagggauggcacacgucuugcagcuccucauaagcaccauccagucauuuguuuccuagaggggcuuauuaguuuuagaaacuuagagguggaagagagucuauguacuuugccaaugaaaguagauucuagaagaaccuucaucagcaaggguacuugcaaaaaauaggcccagggcuacagugcuggucuucugccuucuacauuacagucagaagcuaugggauggugucuaaagcuagcaaaggaauguaagagguccagaguagguugacuaaccaagagaccaguaguauggagcaaacugggaguauccugaguguucuaaacauggcagacaaaauucuccucaaaggacaauucggagaaaugaugugaucauuucuggcaugacagcuuucaaaagagauucuuggaaauaaaggaaggacagcuacggugauagaggaagaggccauuuguuccacaaacaagauaaucccaaagacaucacuuucugugagacugucaucggucacuaaaucugccacagaguccugcccucaccuaugagaauucaaugaacaaagacaaaaaaagaaccaaagguguuucucuucacuuccuccacucucccacacacauguacauaugucacauguaugcauacacagacacacacacauugcugaagaaucuuucagaaaauuggaccacuuagccaagguauuuuguaaacacugaccuacuagguaugccuuugagcuacuugggggugaauauagugcugagcuaaguuguauggaaaucuaaccaucuaagucaguuaguuucccaguagaaucuuugggaagucugaguuggcauuccugccuccccuggggguggcucagaacagcugccuuguuguucuuacuuacuaaggccuacuagcuagauuagggaaggacccuugguucuacaguuuaaacucacccuaucccccugcacucuccaugugugggcuuccauuguuuccugggguuuuacugguuaucugcucuguucuaagcaccucucaaaucccagcucuuguagagacugggcaagucaggcgucucuccagcucuuagcacauccuagaagccugcucaguaucaaggauuaaauacauauucccucacuaauuguguagccaucugauuccuuuguucuuaacuagugaguuacacuaugugcuagccauaucagaagcaaaagauggacagaaaagaacucagagguuauugccuacuuuucuggaaugcaaacaguuaugggacagggaggaaccuuagccauuguuaucuuuuuccucccagauguaaguugcauuauaaaagggugucacuuggaguuagaaacguuuaaagaugacacccucuguuuacuaaauuaaugaucuugggugggucacuuaauucucuuauugacaucuauaaaaugggucauugcugacugucacagaauuguugaaagacuaauaaaaucaucuauguaagcaugucccauugcaucaaugcucuguaggaucucaggagacaggcagaaccuucucucugccgauggucuaacuagauauagccugagaagucuuguacugaaugguccuugccagaaggguugaggaguaauauagggcacaccacuauuuuuggacaucagcagcucagcagguggguaggaggaaagacaggugauacucuuaacacucaauauuuagccuugcuaacgagggcugcagagcuaagcaugagaagguaccuggugguacugucuccucucugggcuauguuguugagaacuguuuagaaguuucauacugcugacccaggaaggauaaggaggugugacauuguuggaggaggugugucacuggggcugggcuucgagauuucaaaauacaguuagcuugcucucuuucugcgucauccuaguuguaagcuuucaacugcugcuccagcaccaugucugccugccugcuucauugcuccccacuaugauggccauagacucacccucugaacuauaauccccaauaaacucuuuauucuauaaguugcccuugucacauugucuuaucgugacaauaaauaaguaacuuaaacagcgugaauuccauagcacucauguggaggacaggggacaacuuuggguguccguuuguaccuuccaccuugcugcuuguuaaugugcaccaaguugggauucucccaucuccaccuccuguuucagugcacccagguuuacguggguuauaaggauaccaacucagguccucauguuugcauggcaagacucuuacccacugagcuauugccccgacucaccaauccauguuuaauccuucacagguuucauuucaguuuauuaaauggcaguaauaccuaugaguguuggcuuuucugagcguuauguaccauaaguaagcaagauacauaccuagcacuugccaugugguagauguucccauuaucaggucucucugcuccuccuacuucuguuccuuggcuucuauuagucgguuugcuuacaauucccuguuuucuucccuuuaaucugacagaauggaacugucaaucuccugaguuuuuauucuuccucacugggaauuucacauacagaacuugaugucuaggugucaccuuugacucucaggggcaggugcuaggcuaguuagaacuuuuuagcaaguuguuuuaccaccuguuuccaaagugagcuugaggaaauaugaacacacacauauaauuaaauuauauuuaauuuaaaauaauaauuaguaacuaaaauauaauuagcaacuauaauuaaaaggaagagaaaaugucuuaacucuauaaggauagcauucuagcauuaccaagaaguaaugcuaauauacugcaggugugaggggacgauuccuuaugaaacugaaguuuucagaggagcgacaaagagcagcucuugguucuuuuaucagucuauugauuaguuccagcuuuuggcagugaaauuccaaauucaguuuuauucagcucuaccuccucaaaugaggaaacaaaagguugaagaagcuagcaaucacuagccuucuggccagacccaacuauauguccuggguuauauuuauucucagcuuaccaguguguaagagcauucucuacuuuacuaucuuaguauucggcauguuuucuuaggccuagagaaagugccugggcugggauuuguaauugcaacccacagaaggucuacaacuuuuucuuaauuuacacaucuaugguaaggaccaaagccauucauuaugacuuuauaugauaguuuucuugcuuguuuuguuuuguuucuugagacaggaucuuaucauauaacccagccuguccuguaacccacuguguaacccauacuagccuugaacucaugauccccacuuuuucagccaucaaaguguugagauugcagguaugcuccaaaacacauaguuauaauaguuuuccuuguauauucuagccaguuucuccaaacuuuucauugagcaccacuauugguaaaauaaaauucaaagauuugccuuuaauguauauuuauauuuaugacaauuuauuaaucaacuauagacgugaauaaauacaaaagauauccuaagccacaucuuauucccacugcaguuugauauagagcauuaucaucaccuuuauagaccucuguguauaugugcacacauuguauaugugugugcauauuuacuugcauauacauacuuaaugcuaauuaauauuucaagguuuguauuuuuuauauaggcuaagaagaguucaucacucauagcucuggguauaaaucauauuuuaaauauauuuucugaucauuuuaauuguaagggcuguuugucacauccaauggauuuuacuuucuaaaguaggugauacagaguuuguauugugguuaagacucuugaauucugucauuguuuugaugcuugcuuaugcuuacacugucgaaacacuucuaucuauggccccuuugcagagaugcuccuaaaucugcucgguuugggcuggggaaugugugguaguugaguuaacaacucaguaauggagucccuaagccauacaguaguauacuagcaaggcccugccuuuguccccuccaaaaaaugagacacagccacugggcagcaucacuaggaguguuuaauacuaggggccuccagaagcuccugugugcccagcuagacacaacugugaaggcacuuucagccuaccuaucuuucccuugcucugccaagauagccuuagaagggaagggccuagagaggcaaccuagaaacaaacaucuaucauuuaucauuaaaguaaauaaauauuucuggacauauuguuuucuuucaggagaaaguacuguugcuuaguugacagagcuuccugaugcuuacaugcaagugguagggauaugggaacaguaagaaaucagccacacacccaugacuugcuuuuucccuucccucuuccugcugagggaaaaggggguggggcagacccuucuagaagcuccuggagccagcuugcagcauggccauugucgcaagguuugaguagagauccagagagcccaggaggguucucuagucccaguuuugucaccggugaaaauccagaagccuccugugggcugcugugagccccuguauauuguccaucuuggugccuccugggcuucuguuucugcaggaagcuugcagcucucuaguugugcuuugauacaugcagaaagaggcaggagagaggcuggccagccugccagccuuuacucaagcaucgggagggaaccagagaucugucuaaacuagacagcaacagcuuugaaaaaccuccuuacucaguuuccaggucuccauaguuacccaggaccauuagcaaugucuuuuagcccuucacauacauguucauuaaauugccucucuuccagaucugccucuuaacuaccugcccaaauuucuccuccuuucucugcagaugcuucuguaucuugaggggcuugccuauaauaaugagguucuuaccuccuccuugugauuaagugucuugucuuucuuuucuuuaauuuaauagauaugagagauaucacaucuugagagacaacacacacacacacacacacacacacacacacacacacacacacaaacugcccuucuugaccuggaucuaaagcuagacuucccugaaaaguccaagaguacagcuuuaggcuuuccuagcauaugguagcauucgucauagcuacuggccucaacuauuacuacacagaaacagccauagauaagcuaguaaacacuaaacuuccaauaaaacuuuauuuuuuaaaagggguggggguagugauuauaguuuuccaucugcccuagaaaauaucagggagcauucuugauaaaagcaaguagagaggcugccagcugaaacuccgugcccuuaacaucaaggccauuugucccuugcuuucuuucuccuaguuauuuccaaaguacucucaagagacacccuugucagcuuccucgccuggcauccccucaccccugccaauccccacaugucuggauagggucucaaagcccuucguaugaacugggccaucuucuuaaaguaucuuagugugcauuacucugcaucugcucauuuaccagccucaguucaagucuagacauggcaucucaccaucuucccugugcaguacccaggagugccugcuacauuguuggcaguauguuuguuaaagucauuuguuccuguucugacauuugcccagaugucuguaucaggaaacauuucuggggucaugcaggaggcaagccaaagcuguucuuugaauuguauggcuaagggcauggggucaggggaaauccuggcaauaaacacagaugggucauggucaggucuucuguucagcaguuucucuaccgucucccugggucugcccucagcuguugauagaagcauuaucuuuggucaaacucucaguuggggaacccugggccuguauuuguucuuacuguguaugcccugcugccuccugaaaaguaccuguauggcguagauaaagaaaaaugucuuaugaugaugugaugaguucauccugucaggcugucagggagcaagggacuccugccuaguguuccaaugguccugcuccuuucuauaaggaaacuacuuacagaagauacagcauauuuagaauuuugugagguuauauaaauaucuuggaaaacaugcuaacauuauaaucuuguacucuauccuguuuagcaugaagaauucuuuuggauguuuauaagguacacacucauguuuuccuuucaccucaaggacaguccuguuugcagagcacaguuuuuacagaaaucagugggccuguucaacagaaaacuugucagcagaucgagcuaugagaagcagagugugggcuccugucaaaguguccauugcuguauauaccuaccuucauuccuaccauucuuuguucucuguggaaucuauauagcaugcuagaaggaagagauguuaccaacuugagguugggcccgugcuaucuaguagagccugugcaaccaugaccagcauccucuucugugcugcucaugggugucuucccuuggaacccugagguuagauagccaagacugggcuccgucccaguauggaugccuccccucaguuugaugcuuccuuuguccucaggcagucuuccccuagugccagcuggaaggacccuagcuuggcccacuugucagauugguuugggaaaacacaaauuguaaguuuuggcccaucaucugcccaguguuguugcuauaaaaugucagcucaccuauuguauuccuuuuaauauguaguuauugggaaccuggcuaggaaucuagaaguauauuguucagugcuguggagaugucacgggauauaugucauucucacccuuggggagcugcuacucucccuacaacaaaagaccucacaaaaauaaccuaagcaagaugcagaugcauuguuuccuuuguggucuaucaucucuuaaacaugacuucuaguuuauuuaaacacacagagagagagagagaaagagagacacacacacaguguuuauaugcuaaaucauuaauuagagaaaagcuucuagauguuaaguucaaauauaguuccaugggaggaaaaguacaggagaguagcuauggggugcccuucauauuagaaaaagucgaguaugagaaaauacaugugcuuguucuuggcucaugguuugagggaacagucccucauggcagggaaggggcgauaagaauggcuccggcguggcaauuggauugugaggcagcuagucacauugacccagucaggaagcagagaugauggugcucaccaugccuuccuuccccuuccuccccuuagguucauuguggguauccaacuacacauaugccagaucuucugugcggaguuaaaccacucuggaaauacacuuacagauacagugaggugauucuaaauccagucaaacugacagugaagauuauuaacaucacauccugggagaggagguucauagcugaagaauuagcaaggaaggcagaaagcauccaacaaucuucguuuuccgugaauuggcauaguaacuagcugaguccagaaggagucacaggcuguacccucuaccaggcuuucuguguaguucuuucugcccaaggaguagacagguacccagagagcuugauucaauacuaaauuguaaagcuucuuugggauugccaucauuagccacagcaagucaucuaccagaauuuuuaguaucuuuugugcugaagaugugugugaacuagucacacugcaaaggucagcagaccugcauuaucuuuacacugucccaccccaagucuuuccuggaacuuugcauuuguccugcuguuagaaccuggcuuuucucugucuagggagcuacaccugggaaaagauuuugcuuuucaugccuuuggauuuuucuagucucucucagcuacaaaugcaaaagagaaggucuuuaaguuuggccuagcuucagaggagcuccuaacuugaaauagaaucagugaagauuuaaaaacaaacaaagaaacggcuacaaccucuuugagaaugcaggccaggaagccauccuuauuguuaaauacuacuuguccucugccucucucuucucccugccauccugaaucagaaucacaacuuaauauuaaacaagaggaagcucaaaauaaugaagaaauauagcauucagcaaagcaaggucuccacuuggugcagcugugcagcacggggcucuucuaugugcugucccacagaggugcauauuuguauaugauaaagaguuguuauuaugauaauaacuugugaaauaucacaaacugcuacacugguuuaauucuccuguucugaaugaauauccuaaacaaauuaccuguuugagaucaaaguaccauuuaaugacugauugaguucuccuuugaucaaauuagcucuaacuuaucacuguguccuacuccagaaauguugguauuuaaucacccagguuggcaguaaaaugcuccccaaaucuuauauguggucugucaacucuuaaaaaacaaaaacaaaaaaaaaaaaaacccacaguguuuguaugcaaaaucauugauuaaggaaaacuuuagguauucaauucaaauauaggaggaaagguccaccugugaaggugugcccuucauaugagaaagaggaaagcaugagaaaacacaucugcuuguuuguccaaaaacagaagcacaauaaaacgagcugugcuaccugcagaaguagaugggaaaggagcagagagaauggagagugggcgagccuacacuaauaacuccagaaugaugacuguaguggauuguaagugugagcagagaugccucacuucugugcuuccuauguggcuuucacuucuagaacuacagcuuuauuucauaugccacaaagugaacaauugaaguuaagcagaauguaacugagugcagacguagcgggaagaaggacaacccagaugaaagucaucacagcaaaugcuuaaaggaaacacuuaucucagugacuacaaaccaccaagggcuaaagcaagcgccauguccaagcucugagcucuaguugguaaaccugugucugacagguguguguuaggaacucugaaaacacuuuaugcuagaauugaagaaauaagccaacuaguguaauaaucuuuuagaaaaagaaguaaucagucaggaaagggggcaagacuagaaugggucugagugauauauuggacuuggagaccucaguguggacuuguggccuugcuacauaugcacccaugaguaaagcaguacggguggguacacacaugcuuucuuuagcucuguuaccaaagaggcuuuuaguaaagcaucccccagcagaaaaaaaaaaguguacccugugcagaucuuggcuucuaaauaacauucuucuuaagaaagcaccaaagcaccucacauaagagauugauuaaggugggaggccaugaacgauagaaggugagcuuggaacaucucggagaaccugaaaggaaguauucaaaauagaaaagagucaggucaaaaauauagagaccagugccaaagaaucccuaguaacuaaagcuggaacaacagacaacaaaauaaugacuauaauggauuauauccugccauaguaaguacacagaaggucauacugauaugugugauuagauaaacaguagggagaaacaaugcuuuuucucacagaagauuuggaauuaauagcuugaaagggaguagaacaaguagaagguccuaugggcaaacacuacaauaaauauugucacaggcaaaaucugcucaacaaugacaggccaaagccuggggagaaccugaagauuuacauaguuugaaacaauaucucccucaagaaaucuguucguuauaaagagagaaauaaugaugcuaccauugagauaccuuucaccuuuguaugaccugaaccaagcagucaagguuaauauuaacaucacugguaaggagggccaugagaaucagaucugucugauuugcuacauuaaaaacaagggaauggggguuggcuugauggcucagugggaaagggaguuggaucuacagaagcugcaugguagaagaagaaauccaagucucacaaguuguucucugacuuucacacagugcuugccguguucauacacaaaaaaaaacaaaaaacaaaaaaaccaaacaaauguaaacuuuuuaaaauaacaauaaaauuacugugauuguuuugcaaaagaaaaacuuguaacucaauccaggauauggcccccagaggaagacaugaugucacuuguguggaauucuaguuggaaauacauauugugauaugagagggcaucugacaaaacaaagaugaaggagcaguggcaaugagggacuacagucuucaaaaaugucaauaucauauaagaaaaaggcugugggaaaaguccagaugaaagucaacugaaaagauguuagauaaauguacugccugaucccaaacugucgaagacaguggguuaacagcaguaaggcugucaaggacauuagcaagucuacaaaaugagaauauagggaacaccagugcugacugacugguugaaguugcauuguggccuugggcagcaccuccucauuuguucauuguuggauucugagcucuuuaguaaguagagcuuggugcacagaagacucaugauaagcauuuucaaaugaguaagugggugagcacuauggguccugcauuugagaucaguccagaauagugucuccacaggcuggcccuugaggcucacugcuaguguggaaucucagcaguggacuugugcuuaugguggaaauuacucuaucauugacauguacuucguuguaguguggccuucagcuauucuuaccuuuguuacauguccauuucaguauuuuaggaguuagcugguaguaaagaauaaugaaauuacugagauccugauuucccuugucuguuuguuuaacccuugguauggggauugggguauuuuucagcuauuggaccucuuuauucagugggauugguccacauaccuugccgacuauggacagcccaacugcaaguaucuccgggugaacccugugacagcucugacccugcuugagaagugaguauccaauccuguacucugugucggaggugggcaguggaguaagggguauuauacaagaccauuuaacuguuuccagugcugucagccaucuugaccauuguacuuggcagucagucauaauucuuacuuagcucuagcaaacuauauauacagaucauaauggaauucuuuauugcuuuguagccuaaauagacaaagugucuuuaccuaaggaagacaagauguaagaugacuuaguuugggcuccggacaacaugauaagcagaggagugugucccagccuuugggguuuaaugauaugucgaacacaugccucagaaaugugguuuaauugaacuagauuaugcagcaccacacaucuuaaagcuagccaacaugucacccaggugucaguauauacugcaaccuggcucuaguugagaaauaccaagccagaaacuaagacccauguuaagagguuuuuaaagcaaauuagacugacuagucaaaagauaccuuuaucaagguggugaagaaagcucauguguaugggcagccaggcaugcuccaacccuagaaagacaaaggcuagaguacagaaggucagaauagaucauuagggagggggaaaaaaaggaaugaagguguaauaucuuucuuacuaggggugggggauuggagaguguaccaaaugugaggggaagcaaagaguaggcaagaguaggacguugggcacugugugugaagccaagcgauaugcugagaauugauguuuucauguuaacuuucucccaugguucucucucccaacgauuuucuuuucuaggcuaucuagagaguaaguauauuguucacuuaggaauuuuucaucaguuugaggcaaguccuucccauuucccaucagugaugacaauaacuaaacuaaaauccugauccugugaguggucucuacccugacaaacuaaccuccuaaacuagccugguaccacccaguaagcacuuccccuuucuuucuuuguucguuacagagcuuugguuuaccaauucauuucagggugggaguaauggcaggggcuuuuccaucagcacuggagaaaggaucucuuccauucagcuuucuggcgugcuugguacucuuauuggcauagagucugcaguucagcccugccagaagagcugcuaaguaaaucccaguuccuggggacaaggcuuaugacuucagggucuagaaccuacauaucccaugaggaguccucaucagagacaaaccauguccagaguucucaugacucaguagaaauggggagacaguccaguguuuggccugaugcucagucaugucucuugggauccuguacucuuccuuaggugaugucucgacauucucaccuagcaggcaacaaagcugugugcuaaguccuagccaucaguggacuugaacucuuuagcuccaaaauuggaaggcaaaggcuccccaggucacugaaaucuccaucuuccagccucacaugagcuccgucucuccugaccugguucugcuuccccagaggcagcugcuccccaugccugcuaguuucucuuucuaaaucugaaucuucauaguaaggcaagacagaagaacccauagcacugccaguacuaucuaggaaaaggcaaagucccuaugucacugaaagguggacugccuaaaggaggagagaaugcuagacuuucaagagauaggaaaggggaggagucacuuuaaguuuugaccauuccuggauacaaaccaucaugccacugucagccuucauagcaccugagagcaugauuccaaccaaaggcuucgguggccaagaacuauuugccucuugguuugucucuuucuccuguagaguauaggauccuccccuggagcuacaggccaugucuggacacucauuucagugcugcugcaggaaauuauaacaucaaucaaaccaaauguccugcaaauguagaaagggcuucucuguuuccucuuuccuguugguuuuuaaguuguuuggauuuauagcuuauccagcaaaaggaagaggauuccuucagaauaaucuaaaacccugccaguuucacaaacauaauugugcaacuaguguuuaaaauagcaggcuguacucaccagggccguaaggaccauugugcucucuuuccaacccagucaggucaucugcccuccuuccuagccuagagcaggcuuccaaguaugggcaggaauucaguucuggauggaaaacuccaaccugaaagaauuacucuugaguuuagacuagggagaaaagucacaguuagcuuuggcugucacugucagagagugagacagcuguguuuccuugccacucagaugcccauaucaacuauauguaucccaguggauauauaaacauagaugaacucacacugggccuaguguauagcaugcaagauguaaauugcauuugugggaucccugucuuuugauucauagucuccaacuauaccccucuucaaaaaucugcccacaaaggagaagaaauggcccaggauuggccaaagaccuuuggaaaguaugcccggaaguaaauuagaccucuggccuuucucccuguagcccuaagaacagggaagucaaggagccaguucaguucuaagaacaagggugucagccaacucacuucacucaugcagauuaggguauauagaggcuagaccagaguaagucaucagcgauggauuacaggcccucuacagagaacagcauagucaaaggcucugucacuggugccuuggcugaaccuagagacugcaguaauaucagucuggucuuacuuucuuuuacccuccauccugagagggccauccaccugacauagcuaucuaucuuuauuauuucuacuccaugagugucaccuguagagcuuuagcaggaccauaacauagaucugagauuguauaggaccauugagagcucaggcugucucucacacaaaguuggcuuuguuaacugagagaggcuggccaucccuagagaaccugcuuuccucagcacuuugcccaccauuguaccuggccauuguacugcuuugcauccauagcccugaaacuaaucaggagaccaaaaaugaaguguugacuucauuuuuucaggggcaagaaagagugaccagguagagucugggcucaaagauacacaguggcucucacagucucuugcaguuaauuucaaggcaauauuuuucugucucaugguccaaauuccaucucuuaagucccaacagacuuaugaauuaaguguaccccagacauuuuagacuggccagcagaguugugccaugucucagacauuuauaaaggagcucaucugaagacauaagagcggguuaggugagggaggugugaggauaaagacgcucuaaagccagcucuugaccaaaggcuuguugucaggaaggugaugggugucugaaagagacagguccauaaugaguagguagcuggacaauggaaagauucccgacucuuccacucuagguaaugguuaagauacaucuugccaucuuccuacuuccugcuuguccuuugucuggacuaucucaaauaccuugccaucuuucucuccuucucuguuuaggaugaaagauacuagccgcaagaauaacauguuugcacaguuccggaaaaaugagcgagauaagcagaaauugauugacaccguggccaagcagcuccgaggacucaucagcagccaccacuccugaauguuggccuugggcccacagagggccacuugcuguagccagugguccaggaucuccccugggcuggcccugcauuugugcauucuuccucaaagagagcauauguauuuuuuuauuaaccccuguacaguuuucacauaaccuuucccuauaguaagagaggcacaagaguaagcaagaaccagggcuuagaggaaguuacugcuacacuuuccugggaaagcuacacugucagugccaacauggugagccgcauccagugcuccacgaauuuaguggguaccuagcacugggaguugagaugagaaaguaaaaggauaauaauauauauccuguuugcucucaaguauuugcuuaaguacauaaguagagccuggcagacaugacuauguaguaugccaaagccagccucaguuuaggauaucuaucugccuugcugguugaauuauuggcucaugagaguguggcauguggcaagaugacaguuucacucuggucccauagcuugcaguuucauuaguuuaggucuggcugagccuuguggggagaaggguaguuagcugaaaaggaaguugccccacuaggugaguuguuuuucugaaucuuaaaaagccaaguugggucaggacuccaguccccaugccauucaucucugucucuucuuuuaugaccauaacucuugguucagaacauaaaucagcaauucuuaaggucccugagagucucacacucaauuccagcagcaucucuaaaugcccagauucccugaagucugaaaguagccugggugcccucaccauggguagagccucaugaugugugagauugcauauuccugucuugaugacagccuuacagcuaccaucuuucaagaaaacgucccaagcucuacacccuugggcacaaccaccauaggacuagauguuucugagaauggaucuaucaccaugauguagacagggucaacuguagcuaauggauuauugccucuggcccagcugucaucaacaaaauaacaucacagagacaaggcuugucuuguucaagcccaaggcucccaucuucugagcugucccuuagccucaccuaagagugcuuucucgaagucacaucucuguuuucuggagugugggcuaacuauagacuccugagauccugugaaggcguuccugugaaguuggccagagggacuuugcacugagacacuuguagaagcuguuagccugacugcugcugagaguuuaauugcauuguggaacacugaccaagaugccacaaaaguguuuccagcuccagugaggagcagagagacuggucaagcaaucacuuauuacguuugucagcuauugugucauucuggaacagcuguacuuccauaucucuuagcccaccacagccuacgucaucuugaacacgccucacccuugccauagcaaucucaaacaccagcaagaaaaguacaccacacagagguacagcuuucuacaacuggagagaacaagcuacccagguguucugcauaagccuucaagucucaucaucaggcuacauaauggcccagagguucaggaagagucacagaagaauacacaaaacuuacuagccagcagagagcccaggccuguggaagagaagacaaggagaucucucgaagcccucagucugugaccagugagaagugacuccacaaaccugacugacugagaaggaaggaaaggcccuuucuucaccagggcuugucagccuucaguguagagagugggcugucacaacauuuguccuuuggggacacuuuuaaucacuccaucuugcugccugucuaguugccaccucugucccaaaggaacugacauggauggaaugaaaaccauguguaggaccagggccacucuaccuuccucaccagaguccugcugacggggacucucauucagucacagagugugaggauggccgcuugccuuugcccagcucugcgucugcugugcuguucucugacaaagcagcuugcugccucugagccgggaaagcgggguccacagugugagggggcuaugaauugaugaggugggacuuuguuuuuucauuuuguccuuaggccuaaagcugagcuggccuugaagacuugagcacagaaugugugcugguaggccucagacucugaccuuaccucagaugccuacagaccauauuccuucaguuucagguggggugagacgcugcugccuggaagucuguggccuucuaaccagauccauagcccuguagacaguaugguuugugagccuugguuaagcaggggcucacuuauuuuuuuaucauucaugagggaaaaacauaacaaaacaaaacaaaacucucaguaccagguaacacugguauggguggagaagagcaggaccugcauacaggagcccagaaucccaguuaacaaaagcaguaucucccagugacucuaucaugcaucaggccugacaguccguccagcucuauggcacccagcucagcaggucccaagcccaaggguggcaguggccaguuuucuccuuagaccucugagugcaggcuuggguggcuucaccacgccuccuucagccugcuuuugcugugccccucccuccaccccucuguuccuucucuccuauucacuugcauuugcgucacuccucccugacauguuggaaauugccuuuucguuuugcgcaguuccacauuugugggagaaaagcagugagauccaucugaaccuccaaaaggaaccuucuccucucaugcucugcugcaggcugcugcagaagggggcuccucuguggaaagagcaugaguaacccacuccccugugcaccuuccucuuuuaacugcuauuaaacgagagccuacauacccauugcaaaagccac

SEQ ID NO: 3141 - RNA, 1285 nt, Mus musculus
ggcucucugcuccucccuguuccagagacagccgcaucuucuugugcagugccugccucguccuguagacaaaauggugaaggucggugugaacggauuuggccguauugggcaccuggucaccagggcugccaucugcucuccacauggcaaaguggagauuguugccaucaaugaccccuucauugaccuuaacuacauggucuacauguuccaguaugacucuacccacagcaaauucaacagcacauucaaggccgagaaugggaagcuugucaucaaugggaagcccaucaccaucuuccaggagcgagaccucgccaauaucaaauggggugaggccguugcugaguaugugguggagucuacuggugucuucaccaccauggagaaggccggggcccacuugaaggguggagccaaaagggucaucaucucugccccuucugcugaugcccccauguuugugaugggugugaaccacaagaaauacgacaacucacucaagauugucagaaaugcauccugcaccaccaacagcuuagccccccuggccaaggucauccauggcaacuuuggcauuguggaagggcucaugaccaugguccaugccaucacugccacccagaagacuguggauggccccucuggaaagcuguggcgugaugguuguggggcugcacagaacaucaacccugcauccacuggugcugccaaggcuguggggaaggucaucccagagcugaacgggaagcucacugacacggccuucuguguuccuacccccaauguguccgucguggaucugacgugccgccuggagaaaccugccaaguaugaugacaucaagaagguggugaagcaggcaucugagggcccacugaagggcaucuugggcuacacuuaggaccagguugucucaugcgacuucaacagcaacucccacucuuccaccuucgaugcuggggcuggcauugcucucaaugacaauuuugucaagcucauuuccugguaugacaaugaauacggcuacagcaacaggguggugggccucauggccuacguggccugcaaggaguaagaaacccuggaccacccaccccagcaaggacacugagagcaaaagagaggcccucgguugcugaggagucccuaucccaacucggcccccaacacugagcaucucccucacaauuuccaucccagacccccauaauaacaggaggggccuagggagcccucccuacucucuugaauaccuucaauaaaguucgcugaacccacc

SEQ ID NO: 3142 - RNA, 3876 nt, Mus musculus
gaucuuuauaugcuaauuuauuuuucucuaauguggugaaaguaacaaaaguaucuccauaacagauaggcuuagacuuaagucaaauaaugcaguuuacucugccaggcgcauggagcccaggcauaguugucuucauugucaucgcgguggaauucuguuuuugcaguguucugaaggacucugaaggauucaaugauuucccuaauuuuaagagagaggaaaaacauuuuuguaagugucuuugaggauuugaaaccagaguuuagucacaguuuguuauguuuuuguucguuuguuuguuuguuuuguuuuuagugguguugagacuaugaauaacaccagcuuucgggagaaccuccaggcucucugggauuuauuuuauugucaccaacuucggauuuuguguuacccuucuuccuaagaugguuaaagccaguaaaucauuugaggagucucagaagaucauugugacagcaguuuucaucagcgucaagugaccagggacuaaucaauaaaaguuuuuuuucccccuuggcacgguuaguaaucauuuagaaaugauuuugaugggauauauaagugaaaagcauucaaacagauuaggccugauacuaaaugagagagagugaguguugaaaauguggcauguggggagaccuugaaaaguuguuaacuugaggaagggaaauaucaauaucucuguggucuuuuaggaacaaaaaacaucuuuugcugagagccuagaguuugagccaaaauauaaagugaccuuggaggcuggcuggcucaccuuccaguuuccuagggagagucagucacugccucugccugaucauggccagcagagcauuuagcagugggaaguaaggaaaugauggccagagcgaggaaugacuguuguuucucagcagcagauaggcacacagcuccuggugaaaugauucagcaguuuagagcugagagcugagagaccuugguuaacacgcggggagucggggcccaggaggggccgcucugauggaauccuucuggggccacucuauucccuuugcucugaaucacaaauggcugcucuugccagugcucacucugaauccuacccucagagguccugugcuauuuggaagguuuuagacagcagcugguugaaaauguaggcgccucggugugggaagcggagagggcagcgguugcuucaucugccgcaucaguaugaaaggcaccuccgucgguuaaagcugcugagguuauucguuuccacuuucauuccuggacaaaaacaggccucuugucuggaucuuuucuuuuuaaugauuuccaugaaaaggcuuuuauccaggcucugacaugacugucagaauacacauuucaaugugagagugcuuaaaaggcuauugauauucccccguggaaaagaaaaguacuuaaaaaaaauccaucuauccuuauacaaguuaacccuaucaccuccuuucuuuucucuccuccccucucuuccuucucccccaccuucuuccucauucccuuucuuuucucauucucuuucagguuaaagccacagucuuagucugagccgugcaugucccccaucucccaugagcugucacuuugauacauugauggcucugaugaguuuagaaucgaggauacugaguaaggaggagauaagcuuacuuuuaccugauguuacuguugagcuuccgcaaacaggcuguugcuuuggaaucuuagguucauuucucuuuccucuggguguaucuuggcuaugugagcagaguaaauggucgguaucuuagaaaugcuagagacaacaggaguggcaugaagccuucaugaacugaagcaguuugccaugagcuuaugagguguuaguggggacucagguucaaguuagauugcuaugcuauguaaucaaaaggguucugaagcaaggaaggaauuugauaagguuuugauuaauuuauaggugugugaacauggcuugucagcuuaguagauuugcuauuguggugggaaaagguuguaucugcuaacuccucucucuucauugcuuucuuguucccuuaagugugaugguuuuacucaaggggaagagcacaagcagugacauccguggcagcaauggaaggaagcuuucaggaugagugacacuguuggccuuuguuucuccacugugguggugaugcuccugucacuccccacccuccccauuuaccuccagcuuucagcagaaucucggagugauggaggucaucagaacagcuuucucagauuccuuuuguuuuucucagccucccucccuguacucacucucccuuuccuauuucagaggaagaaauauguggcuugcuuaauguaauuaauagcuauaaacuuuaaaaacacuacucuuguucuagaauuuucuaaaaauuuaguucccuuaguuuuauucuucuugauuggccuuuagacuucuuccucaggccacacauagucuuauacuuuaaaauaaaaacaauagaaauuauuagcuuggauauauuuucuuauaugaaauuuuaccuucauuaaaaaauuaguuuuggaguucuuuaguucuuuacuauuaguaccuuuuguuaguacagguggucccaccagccugcuuucagggaccuagcaacugcuuacaucaucaucugcacaguuuccauaugugcucucuguucucuagucauacuuucuccugacuucccccaucuccugugugugugugugugugugugugugugugugugcgcacacgugugcaucucaaaucucagucuucagguauggugagcauaugcuggccuguugaguuacaugcagcccuuacuuaguguagugucuuacauuagugaggcauaguaguuauaacugguaguuaucaccaacuuaaguugauaauuucuguuagaauguaccuuguccaguauuggggguguggaucugcucagugccauauguccaucauuguagcacugugaagaauaguucacuuacugaaaucucguguucuuuacuugggcauacucauaaccucuaauaaccaguguauuuggccucuguugcuuugcuucuuccagauugucauauagugugaagcccuucacaguugccccgacucaacagugugcguguaugacuccucuguggcccccacucagcagugugcguguaugacuccucuguauuuguucuuguuuguuugucuuuauuuugaagaauaguuuauuucaugaauguucuguaguuugucauuuugguugcuucagaguuuuggcagaaaauauuagagggacuguagacauuugugcacaggaguuuuguauguauucauauuuccaaaucauuuuaguaaaagcuuaauagcugugucuuaggguuucauugcugugaagagacacuaugaccaugacaauucuuuauaaaggaaaacaguuuaauugaggcauacaguuuuaaugguguauuccauuaucauggcaggaaacauguuagcauucagauaguuauggugcuggagaaggaguugagaguucuacaucuugaucugcaagcagcauagucucacucugggcauagccugagcaucuaugaccucaaaucuuaccuccagugacacacuuccuccaacaaggccacaccuacaccaacaaggcuacaccuucuaauagugccccucacuagggccacacauucgaacauaugagucugugggggccuuacccacucaaaccacuacagcacaauuguugaguacacuugggccauauuuaacuuuguacaagcccgccagccuucucacagguggcuauauugagucauacgcauaccuacagugugccagcuccuuguacgacaucagca

SEQ ID NO: 3143 - RNA, 988 nt, Mus musculus
ggugguuguaagcccacaucaaucauuaaucaagaaaaugagguuuuucagcauggcggccggcgcggcggcugcuuuagcguucuugaaccaagagagcugagcccgagcugggggcgucgggggccugagggucccggccccggucacaauggacaguuucuucuucgguugugagcucuccggccacacccgcuccuucacuuucaagguugaggaggaggaugacacggagcacgugcuggcguugaacaugcugugccuuaccgagggggccaaggacgaguguaaugugguggaaguuguggcccgggaucacgacaaucaggagaucgcaguuccuguggccaaccucagguugucuugccagcccaugcucaguguggaugauuuccagcuccaaccaccugucaccuuccgccugaaguccgguucuggcccaguucggaucacuggccggcaucagaucguuuguauaaacaacgaccuuucugaagaagaaagugaugaugagagcgaagaagaugaaauuaagcuguguggcauccuuccugccaagaagcacaggagcaggcccuagcccccugaucagguaacugcuugcuacaggugccaugcuccguauguuccuggacaaguucaagaaugguuuucucgaugaagagaauagggggugggagggagggauggacugugguuccugaggcuucccuuuucuauuggggugggacaaccuuugaacaccucuucugacccaccuaacccagauucaguccccagcacugcaaaaaaacaaaaaaacaaaaaaaaaaaaaaacaaaaaaaaaaagaacaugaaguucagaacacauuuuuaacacuuuguacuuuuuuugauaaauaucuaaauaaagugguguacgguugguuguuuugcaaaaaaaaaaaaaaaaaagaaaagaaaagaaaagaaaaugaacuacaggcuuaauuacaaacugaugaaggc

SEQ ID NO: 3144 - RNA, 988 nt, Mus musculus
gccuucaucaguuuguaauuaagccuguaguucauuuucuuuucuuuucuuuucuuuuuuuuuuuuuuuuuugcaaaacaaccaaccguacaccacuuuauuuagauauuuaucaaaaaaaguacaaaguguuaaaaauguguucugaacuucauguucuuuuuuuuuuuguuuuuuuuuuuuuuuguuuuuuuguuuuuuugcagugcuggggacugaaucuggguuaggugggucagaagagguguucaaagguugucccaccccaauagaaaagggaagccucaggaaccacaguccaucccucccucccacccccuauucucuucaucgagaaaaccauucuugaacuuguccaggaacauacggagcauggcaccuguagcaagcaguuaccugaucagggggcuagggccugcuccugugcuucuuggcaggaaggaugccacacagcuuaauuucaucuucuucgcucucaucaucacuuucuucuucagaaaggucguuguuuauacaaacgaucugaugccggccagugauccgaacugggccagaaccggacuucaggcggaaggugacaggugguuggagcuggaaaucauccacacugagcaugggcuggcaagacaaccugagguuggccacaggaacugcgaucuccugauugucgugaucccgggccacaacuuccaccacauuacacucguccuuggcccccucgguaaggcacagcauguucaacgccagcacgugcuccgugucauccuccuccucaaccuugaaagugaaggagcggguguggccggagagcucacaaccgaagaagaaacuguccauugugaccggggccgggacccucaggcccccgacgcccccagcucgggcucagcucucuugguucaagaacgcuaaagcagccgccgcgccggccgccaugcugaaaaaccucauuuucuugauuaaugauugaugugggcuuacaaccacc

SEQ ID NO: 3145 - RNA, 1016 nt, Mus musculus
ucuggcagcugcgggcaccgaggccggcaugcagcgguugccucugagcgcgaugcugagcucccgaggcccgaggggcugcagcgccugcugcucaucaacaacgcaggugagacuccgguccagaccccggcugcgagcucucaccucaucgccuuuuggguaagaggagggcaaguucgcaaaaguccaaaguccaagaggguguaccagugucacugaugagugacagugccuccuggcgggugugugagucaagacuuuuugaacaaaucucucugcuuuacuaaagagcauucaggaguagucuuagcuugcauuaggggugucugcagagcuggggcagagggauagcaaacgccuauggggaggaacugaggaaggcugaggaagaagagcgccccaguugugccauuucuuugguccuguuuuuuuuuuguuguuguuguuuguuuuuguuuuuguuuuucagccacucuuggggauguuuccaaaggcuuccucaacgugaaugaccuagcugaggugaacaacuacugggcucugaaccugaccuccauguucuguuugaccuccggcaccuugaaugccuuccgggauagcccuggccugagcaagacugugguuaacaucucaucucugugugcccugcagcccuacaagggcuggggucuguacugugcggggaaggcugcccgagacaugcucuaccagguccuggcugcugaggaacugagugugcgggugcugagcuaugcuccagguaggugggugcuccugacagugcugucccuagacuuagcugguaccuuucugccacaccaccuccaauaggaucugugugacaagugccacagagugaggagauugaccucaaaauggggaggccuccuggaagccauuauggaacucuuugccggagaaaaaauuauugagcuguaguucucauggugaucuaucuguuuuguuuuuucuuauuccuuuucuuauuuacauguucugauagccuagaccaa

SEQ ID NO: 3146 - RNA, 2816 nt, Mus musculus
uauaaaggaaaccauuuaauuagggcuggcuuacaguuugagagguuuaguccauuaucagcauggcgggaagcauggcaguaugcaggcagacauggugcuggaggagcugagaggucuauaucuugaucugcaagcagcaggagacuguccacacuguguguugcuugagcacauaugaccucaaagccuacccacacagugacauauugucuccaacaaggccacaccuccuaauaaugccacucccuauggccaagcauucaaacacaugaguugugagggcaguuauuaaaucaucacauggggacaugccuuuuucuugggaaucugcaagacgcugggaaagcucucuucccuucguguaguauaaagagcuuagguuaggugcaugccccuacaacacccuauuuuauccucacugagcucuugcucuagggcuguuauggaaaaaaaugcaguuagaugaggucagagccucagguccugugugcuaaccuccacucuaccuaacaggugauguacugcagugcagaaugucggcuagcagcugcagagcaguaccaccaaauccugugcccaggcccaucccaugacccccggcacccccucaauaagcugcaggaggcauggagguaagucucuuccucuucccuacucuucccuccauuccugccucagcucagcagcuauggggagcuuuggugaguuauauuccuaaauagaagucacaguuuuggcaaccuguuuuaaucugaacagccagcccuagcaucuucaguacuuuagacacuacacugccagaggguccacccaacccuaagggauacaaaguugccuaaguccagccuuugauaacugauggacuaggcaggaagugugucuguagccuucaugcuggguuugcuuggcucugcuccuagggagggggucuuguagguuacauguuuuuccucuuucccuaggaguguucacuauccuccugagacugcgaguauaaugcugauggcccggaugguagccacggugaaacaggugagccagagaagguggcccagucagcccuaggucucagccaucugaccuugcuugggugcucuugcgucuggguuuccugaaggacagcugcuugcucuguagaaucuccagagcaugcuaacuuuaaaucagguguaggcuguggccccugguuuugccugucuucauuuuucugagagaucuguagcagcaguucccaaauuuggucaauagggaucacuaucccaggauaguguuucuuacaucaagaggucuuguggaccccuucugucuucacuauucuuccucuauggccuucuguuuucaagguguuuugaguuggcaagcccugccccagcugggaaguggcugagugugggcaaagugggaagggagaccugggugguggucauucccugacagcagggacuugagaaacauaacaccucucuuccacacggacgugugcauuugcuguguaggccaaggacaaggaccacugggucagacucuucaaccacuucugcagcaggacagccaaccaggagcaggcaauuguccacaaacuccuaaagggcaaguucaaggucggcuuucucccacagcccuuaccccagccccucaaguagcccgcggugucuguggcuacuuuuaggggaaacucuacauuugcccucuucucagcuacagcagggguuaaaaucugguccugaaaaucccuucaaagaaugcacauccuagugccacuuaccuuugcgaccuaauauagaucuaaaauuggaaguagggacaaagggcugcauguccuacccaggagugcuuauuaccccaugugggaaggcaagacucugaggaaggcagcagcagacacaucagguuuucuggagaguggaagggcuggggcuccacgggucagagaguugugaaauuggugaggugagaauaagacacuaaggcccucagccuuccuuuggagcugcccaaguggggaggcugccagagguaggggcugucugagggagggaggaagagggcgggagugcagcugugggaaagguguaucucucaggcaguguugcaguacuguaucuagaagaaagaaggggaaagccaaguuggucagaggccaagcaaaucuuagggacgcuccaagggaggguaaggauagguguucuaagcccugcugccucagucuugcuggaacacguacuggaaaaaggaagaaagguuugaguuuacacccucauuuggagccugcagacuuggagcacugcccguguccccagggacagcucaggcacacagauggcuccuuuucuuucuauuacuugacuucccuacuuaccuggugcuaaggggaaguucccagggcuucaaugucccucuguuuccccuaaaccaggaccagcuggaacuucugcuugggcucuucaaagaggcccuuuaugaagaggcucucagucuggugagugugggaaggcaggagcacgaagccuuucuuccuggugcuccaggccuggaguugaagugcagugggguuaggaaaagcaagcaccagacucaccuuucuuucccuacagugguucacaccagaaggauuccggucucucuuugcccuuguugggaccaauggucaaggaaucggaaccagguuaggagagaauguucuagaccuacuaaguaauccuccagguucgauagaagauuaauggaggaagguagccacagauucuuugaagaugguaggauuggguguugucaugaccuggguucgaggaaugaggcaggggaaucugcug

SEQ ID NO: 3147 - RNA, 2816 nt, Mus musculus
cagcagauuccccugccucauuccucgaacccaggucaugacaacacccaauccuaccaucuucaaagaaucuguggcuaccuuccuccauuaaucuucuaucgaaccuggaggauuacuuaguaggucuagaacauucucuccuaaccugguuccgauuccuugaccauuggucccaacaagggcaaagagagaccggaauccuucuggugugaaccacuguagggaaagaaaggugagucuggugcuugcuuuuccuaaccccacugcacuucaacuccaggccuggagcaccaggaagaaaggcuucgugcuccugccuucccacacucaccagacugagagccucuucauaaagggccucuuugaagagcccaagcagaaguuccagcugguccugguuuaggggaaacagagggacauugaagcccugggaacuuccccuuagcaccagguaaguagggaagucaaguaauagaaagaaaaggagccaucugugugccugagcugucccuggggacacgggcagugcuccaagucugcaggcuccaaaugaggguguaaacucaaaccuuucuuccuuuuuccaguacguguuccagcaagacugaggcagcagggcuuagaacaccuauccuuacccucccuuggagcgucccuaagauuugcuuggccucugaccaacuuggcuuuccccuucuuucuucuagauacaguacugcaacacugccugagagauacaccuuucccacagcugcacucccgcccucuuccucccucccucagacagccccuaccucuggcagccuccccacuugggcagcuccaaaggaaggcugagggccuuagugucuuauucucaccucaccaauuucacaacucucugacccguggagccccagcccuuccacucuccagaaaaccugaugugucugcugcugccuuccucagagucuugccuucccacaugggguaauaagcacuccuggguaggacaugcagcccuuugucccuacuuccaauuuuagaucuauauuaggucgcaaagguaaguggcacuaggaugugcauucuuugaagggauuuucaggaccagauuuuaaccccugcuguagcugagaagagggcaaauguagaguuuccccuaaaaguagccacagacaccgcgggcuacuugaggggcugggguaagggcugugggagaaagccgaccuugaacuugcccuuuaggaguuuguggacaauugccugcuccugguuggcuguccugcugcagaagugguugaagagucugacccagugguccuuguccuuggccuacacagcaaaugcacacguccguguggaagagagguguuauguuucucaagucccugcugucagggaaugaccaccacccaggucucccuucccacuuugcccacacucagccacuucccagcuggggcagggcuugccaacucaaaacaccuugaaaacagaaggccauagaggaagaauagugaagacagaagggguccacaagaccucuugauguaagaaacacuauccugggauagugaucccuauugaccaaauuugggaacugcugcuacagaucucucagaaaaaugaagacaggcaaaaccaggggccacagccuacaccugauuuaaaguuagcaugcucuggagauucuacagagcaagcagcuguccuucaggaaacccagacgcaagagcacccaagcaaggucagauggcugagaccuagggcugacugggccaccuucucuggcucaccuguuucaccguggcuaccauccgggccaucagcauuauacucgcagucucaggaggauagugaacacuccuagggaaagaggaaaaacauguaaccuacaagacccccucccuaggagcagagccaagcaaacccagcaugaaggcuacagacacacuuccugccuaguccaucaguuaucaaaggcuggacuuaggcaacuuuguaucccuuaggguuggguggacccucuggcaguguagugucuaaaguacugaagaugcuagggcuggcuguucagauuaaaacagguugccaaaacugugacuucuauuuaggaauauaacucaccaaagcuccccauagcugcugagcugaggcaggaauggagggaagaguagggaagaggaagagacuuaccuccaugccuccugcagcuuauugagggggugccgggggucaugggaugggccugggcacaggauuuggugguacugcucugcagcugcuagccgacauucugcacugcaguacaucaccuguuagguagaguggagguuagcacacaggaccugaggcucugaccucaucuaacugcauuuuuuuccauaacagcccuagagcaagagcucagugaggauaaaauaggguguuguaggggcaugcaccuaaccuaagcucuuuauacuacacgaagggaagagagcuuucccagcgucuugcagauucccaagaaaaaggcauguccccaugugaugauuuaauaacugcccucacaacucauguguuugaaugcuuggccauagggaguggcauuauuaggagguguggccuuguuggagacaauaugucacuguguggguaggcuuugaggucauaugugcucaagcaacacacaguguggacagucuccugcugcuugcagaucaagauauagaccucucagcuccuccagcaccaugucugccugcauacugccaugcuucccgccaugcugauaauggacuaaaccucucaaacuguaagccagcccuaauuaaaugguuuccuuuaua

SEQ ID NO: 3148 - RNA, 5188 nt, Mus musculus
cucuaugguuagcucccgagguagccggcuagaggagucggagguccagggacgcucuaggaacucgcguuagcuuuggcgggggucaucgagucucgcagugcuuuugguuuguaaggugcgguaaggucccgccucagcccgcgcucccagacgccaugguagacgugcaaugagcuaucaguacugaacaccggcuaggagaagcaccuuaggugagugaucucacugcaccugcucagcuccguggcgagggagcuccgugaguuucacagguagcuugggaaguugggaacagugucccgggucacaggugcgcggcccgcucgggcgcaggaaauuugcucgggucggcuucuagcucuguagcgccccuuaucggccgaggcggcgccgugccgccugccccuucgcgcgaggcccgucucugccuggggaggagagccguggaucccgcgcaaccccgcgagccgcccaccgcagguuccgggaggcgcgucuauaaggaggagugcgggggcggggccgcgaacugcaguugcuauuaagaguuuuggccaaucagcgcccgguuccacuucuccuggccaauaggaaguggccuagggcgcagaggaggaaagugcggccacacgaacaggcguggcggccaaucagccgcuggccuccguucugugcuccaaccggcgcggagagcgggccugagggaggccguggcagcugucaggcuaaagucgggcgagggaucgcggcgggacggcggcggcggcggcggcgggacgggcccuggagaugagccguggcgccgcgggcuggugcugucucgugcucuggcugcccacgugcgucgcggcccacggugagcggcgacggacaggcgggcggggcgggaauccagcgugcgcgcuucccgggcugggggccacgggucaccuuggggaccccgcgaguuugggccgcccagauccagggacuagacggcugcagcggguggaugcugguucccgggucagugaguaggcacaaccugacaaccccaccccuccccgucgaaacaagagcuuucagcuuuccucccacugaaggcgacccuggugacagcuagagauccagaacggaggaugugagcguucuuauaggcaggaacacacauaugggcucacacgcacaggcacccacuuacacaacucgaacauaaauguacacaccuacgcguuaagugaacacaugcauauacccgaagcuuauuagauaagcacaucaaaugccagacaggggugugcuuguggaaaggguugccugguguuaauccagaaggcuuccuggggggggggggggguuauccaucugaugaaguguaccuacacucaggacaaaaagcugcaagcccccuuagcucugucugagcuguaauuuggaccauagacaggaucaauuauagacacagcaauuggauugacuaacagaccugagcuuccauccaucaacauuuacuugccuuucuggcaaguuuaaagaauccagggacucaaauccaacugagaaaaaauauccuagcaaagcucucgugguuuuuuuggccauucucuuguucaggacagcagagcugggcagaguucuuuguuuaguaaccuuuacugagcagccacuguguccuaggcacuggagauucaucucuguauaaagccacauacuuaaggcuggagaggugguucagugguuaagagcacugacugcucuuccagagguccugaguucaagucccagcaaccacaugguggcucacaaccauuuguaauggggaucugaugcccucuucuggugugucugaagagagagagaccguguauucacauaaaauaaauaagucuuuuuuaaaaagccacauacuuagaaucacugcugcgaugaaagaagcugacauagaauauuaugaauccaccauaauuacagaggaaguauuagcugggagaaaguauauuuugaauggguggaggaaggauaaggcagcaucuuucugagaaaugacagguaaacuuuuaggaagacccaaaaagauaaagacacugaaaagccaguacagcuuuaacaugggaaagaggaaacaagaguggaguggguauaggagucaaaucaggcagggcuuucuacaccacagccaacagcagcauacacuuuaguaggugaaggggacauugaagcucuugcaguggggcagguggacagaggcagagagcuggacagacagcuuggcaguuaggaauacuaguugugcccggcagugguggugcacgccuuuaaucccagcacuugggaggcagaggcaggcggaucuuuugaguucgaggccaacuuggucuacaaagugaguuccaggacagccagggcuauacagagagacccugucucgaggaaaaaaaaaaaaaaaggaauacuaguuguucuuccauaggucccagcucaccacugucugucccuccauuucuggggagcugauacccucuuacagacucggcuagcaccaggcacacacauggugcaugaacauauaugcagccaaagcacacauauacauaaaauuuaaauuaaaaauacaaaaaaaaugaaggcagaugagaagcugaggcaggaggauugcuugagccuagaagguugaaaaccagucugggccacauagcaaaacccccaucugaaaaagaagacauggaagcaaggcuagauagguugggucaggacaagagaugacagugacugaucuagaagauguuggugagaccagagcaaacuuguaaguuuugguuagaaacuugggggcuucccuguccacucugaaacucuuagggcuucuucagguaagagguggaugucaacccaagagcuccaggucuuuguggcucaccugcuguggcagcagcagcaacaaauacaaaucuccugcauccggucugccuuccagugcagaaaccagcucuccagcugggcauggugaugcaugccuguaaccaucauguuugggaggcagucaggaggaaggauucaaggcccaccaaggaaacaaaacuaguccaaagccagccugggcaguaugagaccauuaaaaaaaaaagaggauuccugaguaugauggcacacaccuuuaauuccagcacuaagggugagggucggggcuaucaaaggcuagucagggcuacauagcgagacucugaaaaaauaaguuaaaauuaaaaacaaaagucacgcucccuaaggauucagucagcugaugccagggucucuggccccagaccauagcccacccaguugaagacauaaaagaaguccauacuccaaaccugaaucagccuauucagagaggccuucaucuacacucuuuccuuuaggcuuacgcauccaugacuacuuauacuuccaagugcugaguccuggggauauucgauacaucuucacagccacaccugccaaggacuuuggugggauauuuguaaguucaaagaugcccagaucucugaucuucagucaccuucuugccaucauuuaguaugguggcccucuucccacuuuuaugcuggaacagggcaagaaguagaaucuagcucugccucccaggagcuccugcauacuauaaaaaccagggaggggcugccuuuauuaaaaaaccaagggccaacuaccuacugucaguucuaccuacuucccccugucccuggguuauaaccagcuccccucucagaaaggcacagggugagguugaguggucaggugggacuuugugagaaucagauuaaaaugcucaggugcucagccacagagaaaccacuccauuuccuuccuucacucguuaugaggcaccaauagauguuauuagcccauuccaaaaaguguuuuccuacacucuuauuuguccaaacgucuaaacguuuuuucagcacacacgguaugagcagauucaccucgucccugcugaaccuccagaggccugcggggaacucagcaacggcuucuuuauccaggaccagaucgcucugguggaaaggggguaaggagugggccggcgugacacaggggaagggcagauucugacuacagcuuaugguacuuugaaauguagacuuuuaaauaauucauccuuuacaaaucuuuaagaaaugucuugucuacuuucagcuauguaccgaugaaccucaauacaaguucucuaugguccuuucagccucccagagaggguguaagggaggggcagcuagcaccugccugacuuuugaucucaucaccaccucuuccaggggcugcuccuuccucucuaagaccagggugguacaggagcauggugggcgggcugugaucaucucggacaaugcaguugacaaugacaguuucuacguggagaugauccaggauaguacucaacgcacagcugacauuccugcccucuuccugcucggccgagaugggugagggcucuuugcuucuggcuggccaugcugcacuggguguugugacuuggugggggucaaaaacaaucaccaguacccucucacaagcccuaucuugaauaucccagucagagggcaaaaaaguucugaguuucuggaacucccagcauaacuggggcagagggcaguguugggugcugagaaagugaccaacgcuauacugcucuucaugcccucccagcuacaugauccgccguucucuggaacagcacgggcuaccaugggccaucaucucuaucccagucaaugucaccaguauccccaccuuugagcuacugcaaccuccguggacuuucugguagaaaagcugacuccagguuccagugacaagugacucaugggaagaggaaacccaagauucugcuauuuggaguuuggagauagauucugaggacaaguggaaccagagaggacagggaaccccuccuccuggcuuucccuuccccagggccucaaggacaucucaugauucaggaagaggcuucugacuagaauuugaaacaaaaggugcugaaggcagauggcccugauacacaccaccuguuucagcucccagcagccaagcccuccucacagugagccuuguagcugcugcucaagugguuuaaagaagugauauuuggggacuaauaagcccauacuuucagcaauaaagccaaacaaagcucaccagguuugugccuguguccuaaacu

SEQ ID NO: 3149 - RNA, 2568 nt, Mus musculus
guaagcuuuuagcacaauaauuuuaauugcaaaaauaaacaguuuugucaaaugcuugagaguagcgucugcuuuacaaaaaaugaacaacaaaaaggaaauaaccccaaagcaaaaacaucacauccaaagacuugcuguacaaaguucuuaagagaccggcucgguacauccccagcuugucucuggggagggauaaagaggaaggcguggggcguacgccaguuacaaaaacacuuucuucagucccaaggaagugccuguucuguggguggaccgagaggacuguccccagagaggcuggcuggaggaaggcggcucccgaacagcgggcgcuguccgcggaacccgugcugaagggcgugagcggcgggcgcuucgggggaaacuggagcuggacugcggguggccccggacgugcguggaagaggcagggagggcagcggggaacgagggaccggccggaccgugccgcgugcgccgagcacccggcgcccccgaccuacggggccagcuccgguuacagcgcggcgaaggagaggcccagcgaguagaagcccaggcccuugaggcgcuccuccgcgcgcgccuucugcuuuaggugcaccuugcugugccguuucuucucgucacugcgcgcgaagcggcggccacacacgucgcaggcgaagggcuucucgcccgugugggugcgcacgugcguggugagguggucgcugcggcugaaguugcgcaggcagaugcggcacuggaagggcuuguggcccguguggaugcgcagguggcgguugagcucgucggagcgcgcgaagcuccgcacgcagcucuccaccgggcaggcgaaggccuugacgugcggccgcgggcagaagcagcgcgcgcugcacuugccgccccggcgucccuugcgucgggcuuuggccgcggggaaggaugcggcgggggaugagggcgcggccacgccgcugccccccgggagaucggccaccagggguuuggagaaguccgccguggcggcaccgcgcaggccuagaggggacagcugcgccggaggggcggccaggaacucuccgccuucgccgccgcucccucccuccccgccgggaggggucagcagcgccgggaggcccucgguccccuccccuaagucaccuggggccaacgagaaggugucguaggccccugccugguagagucuggcggccgggccgggcagcucggcggggcagcugauggacagcagguccucgaccuuggucccuacugcagagaagcgggccuccgggguggucuggaagcuccccugcgacccacaguuccccgggaccccggccgacagcagcucccagggggcauagggcccuuugaaggcugaagcagcagcguccagcgcuggcgaagcgggaggcgcccgcagcccuggcuugacgucgggcggggagagcuggggcucgaacaggcacugcgagggagcgcccgccgaaggcgcugccucccaaaacgccuccggaaaggcggccgaacucagaucuggggaguagagguccggcagcaaggcaucggggcccgcggggaaagggacauccaggggggaccgagacgcugccgccucgggaccggggaagggugccaggcccaagaugccagacaugagguugaagagggccuccgggucgugcggguguucgggaaccgccuggaugaagaagcugccgcuguagcugaggcccgaagggggcgugggugcagggcccuccaggaagcaggagucuguuaagucccccccggcgccgcagcugcucaaagcccagcucaagaagucgccugccaaaggagggaccacgcaucagccccgcacaccucaaagggcgugccucggagccuacagcugcgacccccuccacccgaguccuccuggcgcaaggcacccgcagagcgccucgugcacuuccgauccugcagcagagggacccccacggacgccccagggcgcgcacacccaaggcucccgcacaggcgccuguggccuuggugggggugggaaugguacugcgcgcuuggggacccccaccccccaccccgcgcgccucuccuaucacccuucaucgcguucagagucuucgagcucccagacccgcuccuuaccuccaggauacgcggcggccgagggagcgucccuagcaggcagccggggcagcucggggcuggcgugggcgcagccuucggugggcuuggagagaagcgcgucggagccggagaagucgcucagguggagcauggcgcgguggcggcggggcgcccggggccucgcuggacuggggcgcgcgcggcuggcagggaauccgggcgccccaguuccaggcuccgggcgcuuggcuggggcacgaggguuggggggccgcggcgcccuggcucaccggcaccugccucggguggcggcuccuggcuucuccaaagugcaacagggcucccccaaccuacaguccccccacuuauauagcugcggcggcgcuggcuccgggcuuccgacuccccgggccacugccauuucgggaggccccggcccug

SEQ ID NO: 3150 - RNA, 2568 nt, Mus musculus
cagggccggggccucccgaaauggcaguggcccggggagucggaagcccggagccagcgccgccgcagcuauauaaguggggggacuguagguugggggagcccuguugcacuuuggagaagccaggagccgccacccgaggcaggugccggugagccagggcgccgcggccccccaacccucgugccccagccaagcgcccggagccuggaacuggggcgcccggauucccugccagccgcgcgcgccccaguccagcgaggccccgggcgccccgccgccaccgcgccaugcuccaccugagcgacuucuccggcuccgacgcgcuucucuccaagcccaccgaaggcugcgcccacgccagccccgagcugccccggcugccugcuagggacgcucccucggccgccgcguauccuggagguaaggagcgggucugggagcucgaagacucugaacgcgaugaagggugauaggagaggcgcgcggggugggggguggggguccccaagcgcgcaguaccauucccacccccaccaaggccacaggcgccugugcgggagccuugggugugcgcgcccuggggcguccgugggggucccucugcugcaggaucggaagugcacgaggcgcucugcgggugccuugcgccaggaggacucggguggagggggucgcagcuguaggcuccgaggcacgcccuuugaggugugcggggcugaugcguggucccuccuuuggcaggcgacuucuugagcugggcuuugagcagcugcggcgccgggggggacuuaacagacuccugcuuccuggagggcccugcacccacgcccccuucgggccucagcuacagcggcagcuucuucauccaggcgguucccgaacacccgcacgacccggaggcccucuucaaccucaugucuggcaucuugggccuggcacccuuccccggucccgaggcggcagcgucucgguccccccuggaugucccuuuccccgcgggccccgaugccuugcugccggaccucuacuccccagaucugaguucggccgccuuuccggaggcguuuugggaggcagcgccuucggcgggcgcucccucgcagugccuguucgagccccagcucuccccgcccgacgucaagccagggcugcgggcgccucccgcuucgccagcgcuggacgcugcugcuucagccuucaaagggcccuaugcccccugggagcugcugucggccggggucccggggaacugugggucgcaggggagcuuccagaccaccccggaggcccgcuucucugcaguagggaccaaggucgaggaccugcuguccaucagcugccccgccgagcugcccggcccggccgccagacucuaccaggcaggggccuacgacaccuucucguuggccccaggugacuuaggggaggggaccgagggccucccggcgcugcugaccccucccggcggggagggagggagcggcggcgaaggcggagaguuccuggccgccccuccggcgcagcuguccccucuaggccugcgcggugccgccacggcggacuucuccaaaccccugguggccgaucucccggggggcagcggcguggccgcgcccucaucccccgccgcauccuuccccgcggccaaagcccgacgcaagggacgccggggcggcaagugcagcgcgcgcugcuucugcccgcggccgcacgucaaggccuucgccugcccgguggagagcugcgugcggagcuucgcgcgcuccgacgagcucaaccgccaccugcgcauccacacgggccacaagcccuuccagugccgcaucugccugcgcaacuucagccgcagcgaccaccucaccacgcacgugcgcacccacacgggcgagaagcccuucgccugcgacguguguggccgccgcuucgcgcgcagugacgagaagaaacggcacagcaaggugcaccuaaagcagaaggcgcgcgcggaggagcgccucaagggccugggcuucuacucgcugggccucuccuucgccgcgcuguaaccggagcuggccccguaggucgggggcgccgggugcucggcgcacgcggcacgguccggccggucccucguuccccgcugcccucccugccucuuccacgcacguccggggccacccgcaguccagcuccaguuucccccgaagcgcccgccgcucacgcccuucagcacggguuccgcggacagcgcccgcuguucgggagccgccuuccuccagccagccucucuggggacaguccucucgguccacccacagaacaggcacuuccuugggacugaagaaaguguuuuuguaacuggcguacgccccacgccuuccucuuuaucccuccccagagacaagcuggggauguaccgagccggucucuuaagaacuuuguacagcaagucuuuggaugugauguuuuugcuuugggguuauuuccuuuuuguuguucauuuuuuguaaagcagacgcuacucucaagcauuugacaaaacuguuuauuuuugcaauuaaaauuauugugcuaaaagcuuac

SEQ ID NO: 3151 - RNA, 115225 nt, Mus musculus
agugagggcaggugcgccugcgcgcagccgcaaccgccagucaacucgcuuccccucccuuccucgccccucccccucuccuccucuuccaaaggcgccuggagcgcgaggccaacauggagccugaggaccugccguggccugacgagcuggaggaggaggaggaagaagaggaggaggagggcgaggaagaggaggggaagaaagagguggagaacgccucggcggcggcgaccgaggaggcccugaccucugaggagagugggagacuggaagaguucgaagaggcggggcccgacuuggauuuuaacuacgagucccagcggcaggagagcucggacgaagaggaggacgagcuggcuaaagccuggcugcaggcucaccccgaccguccuggcagugcuuucucucugcccccucccacgccuccgccuccgccuccgccucuguccccgcggcuccgguacaccccaguggagcaucugggcaagacugaggugagaagcggcucuguagcccggagcugggcuguggggaggagcggggcugaggccaagcgacuguagagaugcuugagcuacugaacuggguccaggauaucgggaccuacgcgcugcgggucgccuugcuuauggacuguacaccuugcuuguggggcuggcagguucuuuguagucuuagguucuuccugacauugacagcuccguguuuccugcgccucucaguggauccguuuuuuuuuuuuuuucguuuuguuuuguuuguuuguuuuuguuuuuaaaguagggcagauaagacagauggcgcugggagccgguacucccagagcgagcaguuagaaaggcuucuuuggcaggaggugggagcuggggagggagucuagggaauagcuaacugguggagagacguuuagcauuuaacaccuuaguuuuauugaagugcaagaaacaucccccccucacccccccccccccacuaggaauuauuguugguuaaguauucugcgugagcuuuugugugucuucccgcccauugugugucuuugcacuuguagcaauuaauagguuccuagccaguggcaggaacuuggaaugaaagaaagcuugugaggcagcucuggucuggaaaauuagaaagcaccaaguuaggaccaaauagaggaagagccaaguuuacagagguccuaccaagaucauuuugaaacuaaccgugcuauuaaugcuuuuuaacuaucaggaacugcguuguuggucaguauggucacgugugguucuuuacauacgaauuaguuuuaaguaacacuagaaaggcuggugguguauuuaagugguagagaggucuugccuagugugugcaaggacuugaguuuucaagcccuaguauuggggaaggggaaugaauaaaauuaggaauucagugauccuguacacuucucaagugcuuaauagaccugcuuaguggcugucacguuggacaaagcaauugcagaacaauuucauuaucacagugauaguauggacugugauugucaaaaagcaauacaugauguuugcuugcuaggugguauuaaauucauucagcuuauacuuuaaguguuuaccuuguacuugauacuaaggaaaucauggugaacuaaacugcugccuuccuaguguucccauucuaaagagggaggcagauaaaauucacaugaucucauaaguaaaacugcuauauacaaaaaugcaugcauaaaaaaaaugaaugcaugaaauagguaaccuggacuugucagugagguuggggaguuaccuugaagacugcaaggcuaguaaacaagggguuaaacaaagcauagauaaaacaaggcacuguugguuagcaagagugugacuuuuucacauuuuacauuuguuuuuuauuuuuuauuuuauaggguuaggauugaacccgggccuuuaagcaagcuaggcaaacauuguacuuacugcuggaccacaucauuuaaagcaugacauuuucaagaaaaagaaggccaucgaguugagucuggacuauaaggcuuuauguguuaugccaggcauuuugaggcuuuaucucuggaguuuugggaagucaauaaagaaguuugugaucagauuuguauuccagcaagaaaauuaauaguguagcuagcugugcuagcaagggggauucgagcagccugacuaagugaaggacaguaauuagaggacccgggcaaugcugucaggcaaaaaggguuuuagaacaaggaagugagcaggguguggugucguauacuuuuuaauuccagcauuuagagcaaugguucccaaccuuccuaaugcgacucuuuucuaucucauguuguggugacccugaaccauaaaaucacuucauagcuguaauuuugcuacugucauaaauccuaaaguaaaugcaggauaugcaacccccaagggguagaggcccauagguugggaaccuccgauucauaggcaaaggcaggugggucuggaguuccaggccagcuugguuuacauagaauggggaaauugaugggaauaggagaaauagguuguuucgagauguuugucaugccagaaacaggguugaugggcuggugacauggugcugugaaugaauucacaagccaaaagggcagaaauagaaaguuuagguucuuuaguggggagcuuuucuggcacuguucaagugucauggugcugcucucugguugcuuaggucuugucuggugcgacuccuugugcauuucuuuucuuucucuuuuuguuuucuuaugacugugcaguugaagguaugagucacagggggucaaauuucugauggucuagugcgcucauuaaagaguggagacagugauuucaguauguucugagacaggcugcagccagggccuguuaagcuagaucuuucugaaggaggcagggccuuugcuuugaaaccuagccugcuuugaggccaaaacaaaauagccuugcucugagauuagaauaacuuggcauacaccacccaucccaaaauaacauuaacuuuuagaaagcaaaaucgugguacuucauaguggauuggauguggaggguaguguccagguauuagguuagugaguaaaugcuugugcugauuuugagauggaccgcaucugugguggcuuugagcaggugaugaauugucugggugggugauagauugaauuugguuuuaaaaauuagagaaguggucugggcuagaaauuuuaaguaguauguuaucuacaucuagaccauagugaaagcuauacuuuugaagaccuuuccuaacuuacuuucuucugacuuauuuuaauagccaugaauauuuaaauuuauuucuuuaggucuaguggaggaauucuuaaauuaguccacuuaccauaccuaauacgagaaaauuguuuuucuguauuacagugaccugucuaauugaaguagaaaaauacugcuucuuagagcuuggggugucuuucuccucccguggaaauuuuguuuuguguuugagacagaaucuuacuauggaguccuggcuggccuggagcgugcuaugaucaggcugucuuuggacucuuugagauuugacugccucugcuucccaagugcuggaguaaacaugugguuauuauacccaguccugguuacaucaguaauuuacauuagagaauauaugaaaguguagccagcuguccuuuuguuuguuugcuuuaugaaguuguggguuuccaauccugagcuucaugcauuuaggcaaaccugccccugagcuauagcccuccuacccccauuuuuucuuuuuucuuuuucuggaaacagggucuuacuauguaguccugacuguccugaaacucccuaugugaacucagaggccucccaagauuaaaugugugcacugcuuauaccugcccaguuuuuaaagauguguucauuguccaucuguugucuaacaauguuuguuuugugugugugugugugugugugguguaguguuugugugcacauaugcauuuguguauagguauauauugaagccaaaguucuacuucuacuuggauugcuucccacuuuauuuauuuaauuugacuaggcuggucuacauagugaucuuuauagagauccaccugccucugccaccagagugcugggauugaagguguguggcaccacaccuucuaccuuaauuuuuaagacaggaucuacuacugaaacuggagcuuauuggaagguuaggcuggcccaccagcaagucacaaauaucuacuugucuccugcuaccagagcaggggcaggugaaagucaggauuguguguguguguguguguguguguguguauguauuugguuuuccccuuuuaucuugggauugaacucaggucagcaggcuuuauauauggagucagcuccuuucccuuuuccucccuacaucuuguuuuuuuuuuuuuuuuuuaauauuuuuauuagguauuuuccucauuuacauuuccaaugcuaucccaaaagucucccauacccuccccaccacuccccuacccacccauucccacuuuuuggcccuggcauuccccuguacuggggcauaaaaaguuugcaaguccaaugggccucucuuuccagugauggccgacuaggccaucuuuugauacauaugcagcuagagucaagagcuccgggguacugguuaguucauaauguuguuccaccuuuaggguugcaguucccuuuagcuccuuggguacuuucucuagcuccuccauugggggcccugugauccauccaauagcugacugugagcauccacuucugugcuugcuaggcgccggcauagucucacaagagacagcuauaucuggguccuuucagcaaaauuuugcuagugugugcaauggugucagcguuuggaagcugauuaugggauggauccccggguauggcagacacuagaugguccauucuuucgucacagcuacaaacauugucucuguaacuccuuccauggguguuuuguucccaauucuaagaaggggcaaaguguccauacuuuggucuuuguucuucuugaguuucaugcguuuagcaaauuguaucuuauaucuuggguauccuaaguuucugggcuaauauccacuuaucagugaguacauaucaugugaguuccuuugugauuggguuaccucacucaggaugaugcccuccagguccauccauuugccuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcaucuuguuaaagacucauuucagugaguuauucugagccucugcucuuuuguuuuccugcugcucagauuauuuaaaacaccuccccuugaagcuuacauuuugaagggaauuguuuuggguuguggcccuagaaauucuuggucuccaacuuuuaaaugagucaugaacccagcuuacaaauuuuugauuguuuccuguuggccccuccucccuuuacucuuauccuccaguuuccaucuaguguucagcaccucuucugcuagcauuuuuuuucccagaaggaaaacauagucugagccuguaguuuugucugugguguucuauuugcaugaacagugcuggaaugaauauuuccuauguccaggagaaccuuuuacuuguguggaaauauuucucuaauguuugagugacaccagaaacaaaacuauggugcuuccagauuuccucucagguguggucuguauacauagacucauguuucuuagguuaauuuugauaauuuauuauuuucuuagaaaaauuuucuuagaaaaaguucagcaacagcucuaguucauuagaaugcauugaguuuuuuuuuuuuuuaaagauuuauuuauuuuauguauuugaguacacuguagcugucuucagacacaccaaaagagggcaucagaucccauaacagaugguugugagccaccauaugguugcugggaaucaaacucaggaccucuugaagagcagucagugcucugaacugcugagccaucccauacuacauaguuuuuaaaacuuuugcaucuauguggugauuuucauuuccuauuccuaguuuuguguguuucauuuuugucuugauuugcacuguagaggguuauuuacuuuucaucugagggagcagcucuuggaauguucuuucuuuuuuccuuuuuuuaaaaaaugucuuaggcuguuaaaaugcuguugcucuaaacauacacauauauguuauuguguguacaugugaguucauugcucuugaauauauauaugggaguggaauugcuggacauuuugcaauucuguaguuaacccuauaaggguccaccagauaguuuccuguguggcugugccacuuuacauucuugcuagcauuguaggagaguucucauucaccuugucuaaugauuauaaccuguuuuuauugaucauucuuguuuuuauugaucauucauacaucaauuuacagaaauguccauuuaaagcauuugcuuaauuuuuauuugggcuguuucauauuggguuuuaaauuaaaaaacccaggauuuugcauguauccaaggaucucuuaucuaauguaauaaguaggccaaauccugcuuagcuuccaagauaagcugagaucagucaagugcagggaggcaugaggcaaacuauuggggaccuuuucauuuuuauagucagauggcuuuucuccuauugaaugguaugacauauauauauauauguauauauauauauauauacacacacacacacacacacauacauacaauuuuuagauuuauuuauuuaauguguaugauguuugcuguuguaaauauacaucugcaccacuuguaugcauggugccuguguuagagcccuuggaacaggaguuaugguugugagccuccaugugggugcugagaaccaaacccuaccucgguccucugcaagagcagccagugcuuuaaaccacagagccaguuuucuagacccuaugucuuacuuauuuauuuauuuacuuguuugucuauuuauuuagguuucucugaguccuggaacucacuguguagaccagacugaucuugaacucacagagauccucuugccuuuuucaucuagugcugggauuaaagguguuugcccccuucuuuauuuuuggcuaauguguuuaacuuuagacucguaguuugagaauauugcaaacauuuccucccauucuguagugugccuuuucuuccucuucuccucuguuucuauccccuuccuuccucuuugcugcuuuguuccuuugucuuucuccccugugcuggauagauguaaggguuuuaucuuaguuaugguuucuuugcugugacaaaacaccaugacuaaaaagcaaguugaggagaaaagguuuuauuuagcuuacacuuucacauugcuguucaucaccaaagaagucaguauaggaacucaagcaagguuggaaccuugaggaaggagcugaugcagaggccauggaggagugcugcuuacuggcuuacuccccauggcuuacucagccugacuucuuauagaacccaguagcaccagcccagggauggcaccacccauaaugggcugggcucuaccccauugaucacuaauugagaaaaugccuuacaaccagaucucauggaggcauuuccucagcugaggccccuuccucucugcugacucuagcgugugucaaguagacacacaaaaccagccaguacagcucucaugugugucaggcaaguacucuacccuggagcaucauuuuguuguuuccuuugcugugcagcuuuuuuuuuuuuuuaaagauuuauuuauuauuauacauaaguacacuguagcugacuucagauacaccagaagagggcuucagaucucauuaggagugguugugagccaccgugugguugcugggauuugaacucaggaccuuuggaagagcagucaagugcucuuacccacuuaacaugugcaauuugcacauguuaacaauauuaauuauuucuaaucccaaacauuggcuaucuguuuauuggugagccaucucgccagcuccccccccuuuuuuuuuuuuaaagauuuauuuauuaucuauacagcauucugccugcauguaugccugcaggcuggaagaaggcaccagauuucauuauagaugguugugagccaccaugugguugcugggaauugaacucaggaccucaggaagagcagugcucuugaccucugagccaucucuccagccugcugugcagcuuuuuagucugauaagaguucuaucuuuucaguuuguacucugagcuuguagugugguguagaaaaaagcauugccaagacuagaauuaaagagcuuuuuucuuuguuuucuuguuuuuguaguuuaaacuucaguuuuuauaauuaaaaacuuaaguuauuuucuuguguaguugaaaucaagaaauaggacacaaagcuuuuucuuucucagaauuguuuaaaauuguuuugggucuuuuguaguuucauaugaauguugggauuuuuuugcuuuaaauuuuugugaagaauaccauuguaauuugauagauuguauugaauuuguguauugcuuugggcaauuugcacauauuaacaauauuauuucuaaucccaaacauuggcuaucuguuuauuugugccuuuuucuuuuucccuucucaacuucucccuucuccucucccccaccagucucacuguauagcuuggcuuggcugaucugaaacucagcuauacauacauagaucaggcugggauuuaaagguguaugcuaccauaucuggcuaagggugguuuuuucaauuucuuucauuagaauuuuagacuuuuugggauacaggucuuuuaccuucuugacuuaauuuguccuuaaguauuuauuuaugaacugacuuuguguguguguguguguguguguguguguguguguguguguguaugugagagagagagagagagagagagagagagagagcgugugugugugugugugugugugugugugugugugugaguguguguguguguuagggucuguaacuugcuauaacccaggcuggccuugaacucuuuagguccucccucugacaaagugcuggaauuacugucuguugaucgaucaauugaucuaucuaucuauuuaucuaucuaucuaucuaucuaucuaucuaucuaucuaucuaucuaucuguacuggcuaguuuugugucaacuugacacagauggaguuaucacagagaaaggagcuucaguugaggaaaugccuccaugagauccaacuguaaggcauuuucucaauuagugaucaagggggaaaggccccuugugggugggaccaucucugggcugguagucuugguucuauaagaaagcaggcugagcaagccaggugaggcaagccaguaaagaacaucccuccauggccucugcaucagcuccugcuuccugaccugcuugaguuccagucccgacuuccuuggugaugaacagcaguauggaaguguaagccgaauaaacccuuuccuccccaacuugcuucuuggucaugauguuugugcaggaauagaaacccugacuaagacacuaucuauguuacuuuucuucuuuggguaguuacuuguauacagaaauauaacugauuuuugugugugugugugugugugugugccuguguaauauauauauauucaugcauaugugcaugcagguaugcaaauacauggaggccagauaucagcucuccucaguuacuaccaccucuuaaugcagcucauagaaauugaacccagguccuuguaaucauaaagcagguacuuuacugacucagcuaccugucuaaccuucuaggcuuugucacuugaaaucauugucucuguugcuauuuuuauuuguucugacauuuugcugacuuuaguuuaccuuagcuuauuggacauguuuuaaaaaguaacuuuaaaaacuuguuugcgugugugcacagaugugcagguauguguaggugaccauggaggucagaagaauguguaggauuucuuggagauggaguuagaguugauuguuaccauccuucagcccaugggugcuaggaauuaaauuuaggucuuuuggaaguguagcaaacacucaaaggcuaggccaacucuccaggcccuauuuuuauuuaaucuauugcuuuuggguguuuguguguguauaugugccuucacauaugcacacuuuuauuuguggagaucagaggauaauuuacgggaaucagcuuccuucuauuaugugguuguggguaccaggauugaacaauguguugaucaugcuaagugaaaguaucuuuaccugaugaguuaucacaccaccucauuuauuuagggaaaguaucauguagcccaggcuagccucaaacucacuagccaaggauggcuuugaacuucugauuuuccuguuaccacaucuaaguacuaggauuauaggacuguauuaccacacuuuuaguguuuauauggugcuggagguugaacccagggcuuuguguguacuaggcaagcacucuccaacugagauaccuaaacaguuucuacucugauucuuaaugucuuguuuguuauuuagcucuccugguuuuucuuaauuccuuauaaacucagauuugcauauaaaagucacuaauuuugcaacuucucuuguuaauuuguaguagauucacuguuuugcuucuagauagaaauugauaaagugaauuuggauuuuuuaaaaaaauggauuuuuuuuaaaaggcaguuuucauauuaccuuuuaaccaacagaggaguugcuuuucagcauugcugauuucagcagcccaaggagcuccucccagguacuacacucaggucucaggugaagcagaagucuuaggcuacagaaaggauuuuaggauggaucagugagaaguagaguucauuauaaacaguauacuccaagacuccuguggggaaguuucaagagagacucacacuaaauaucguaucaauuuucaaguuaucuuguuuaaaggauguaauguaucaaacuuuaaaagauuaaguaaaaugugcugggcgauugaugguggggagugucuuuaaucccagcacucuagagguagagucaggaggaucucugaguuccagcucaggcuggucuacagagugaguucuaggacaccaaggaccacacaaagaaauccuguuucaaaaaacaaaaacagaaagaugcaguacaauguuuugguaugcuuauuuuuucuuuuugagacuauaauauaauuacauaauuucucuauuuccuuucuuccuuccaaacccucccaaauacccuccuugggcccuuugaauuuauggucucuuuuuucauuaauuguuccaugcacgugcauauauauauauauauauauauuuuaacaagaucuuaaguuauuuauggguguuuugugaagguuuucagaugaaugcuaauaagauagauaaggucauauuuuuuuucugucaacaugucccuucucauagugcguccgauuugauuuguaugcauguacaauuauacauauguaauauaaauaggaaauuuaaauaauauaaauaggaauucccccagaauucacugaaacaaugaaguuugucuuacuguacaugcaccccaaaccaguucagaccagaucagccucucuuuucuaccuguccagauccuuugggauuauaccugaauagaaaacaguccagaucugauuguuaggggcagagaagcuuguacuauugcucagagugaagugugcauucugccuaguguagguggagaguagaggguucugagauugcuaggugcauuguuugagaggggugugaguacaugcaggauaaggaacuagacucucagauacguuaauacaaggcuguguguacauaauccaaaccaaagaggucucaagccacugaacuauuuccuguguuugccugccuuauaauggcuuuccccacacccuccugugagggaagagcaacagguccacucuugagagucucuugugggaaguuacagcugcuucugaugaagaugguagugcugcuaugcuuggagaauagcauuuuauaacagaaugaaagcauuuuauaaagugaaagguguuuucuagcaugguuacuuuuguuauuguacaucacuuggcuacaugugcuuuuugauuuuuagguugucccacugacuugccguguauggcagcagucaucauaucaagauaauucuagagcccaguuuuccaacuccaguacaauguuauuggaaacagggguccgguggggcucugaggaggaucagguaaaucuggggcaaauucuuuuucuuuuuaccaguagcauaagagauguuguagucauuuucaguguccuaauagugcucauaauuuuauguagaacagaagcucgucccugcucucuccaucucaauagucuacguucuuuuaagagcauuguaaagggcuuuguauaugugcauuaugucuugggauacuuagcauacaagaaguuaaaauauucaaaauuacaaacucauuacuugaugguaauuuauuuuauuuuaagaggaaagguguccauuugcauuuuuuugucuguuuuuuuuuuucuuuuuuugaggcagaguuuccucuguauagcucuguauagcaagcaaguuccuggaauuugcucuguagacuaggcugccuuugaacacuaccugccuccccagugcugggauuaaaggugugugcuaccacuacccaguuaucuauuuccacuuuuaaagagcuaaguuuuuugauguauaaagaaauguauuaaagugaacuguuuuaucuauacaguuuaucagaugagcuuugaaagauacagucacauaccacuaugguugagacauauagcuuagguauuauauacaaaagauuaugaauacuauuuuugucauugccuucucuagucccugauguuauagcaagcacccuguuguuaguggcuuugccuuuucaaaauuauagugugaggauuuuuaaaaucugauuuuuuuucccuuucuuucuaaaauuagccuauguugcaugugucagcucuuuaauuuucauuguuaaauaauauucuuuaaggguuuuuugaguaaacaugacuuucuguugaguaaauaccuaggaguagaucagcuaaauuauuuaaugguauauuuaacuuuauaagaauaugcuaaauuauuuucugaaguaccuguucccauuuugcccaaggaauauuguugauagguuuggaaauacucaguuuuuugucauguaccaaauguauugauuugacaaugagaacuuaaauauaguguuaagugucagugacugccugguacuaggagaugggagugaucagaagagaacgaggagguuaauagggcaagaaggaacauagaaggaacaacuuuuuuucaacucuggugagaauauuguuaaauaugcuaugaguagacaguaguauuaauguguugacucaguuaacgaccaacaucuuuuccuuuaaaauuuuccuuucagagaacagagucuuggcauugucuuccucaagaaagggauucuucccaaaccuuggcuaugucccagacugagaucggcagaguagaaggaacagaaguaccagaccuacccucucaggagggagguuuaccagcucagucacaguguccaggaaagaagccaaagcugaaugucuuguguucuccauugcuagguaaugccuuucucucucucuauuuuaacauuuuauuuuacucgauauggguguuuuaccugcauguuaugucugugcauuguuuucgugcuuggugccaauggaggccagacgagaacaccuaaguccuggaacaggaauuaugggugcugagaaucaaacucagauucucuugaagggcagcuaguguucuuaccugucaagcucucuccucagccuuaaauggccucugugucuuuacccagaaguaauagcuuauauuuccuuucuuuccuuuuccucucuuuuuuuucuccuuuuuuucuuucuuucuuuccuucuuuccuucuuuucuuucuuuccuucuuuucuuccuuucuuucuuucuuucuuuccuuccuucuuucuuuccuucuuuccuucuuucuuuccuucuuucuuuuuuucuuucuuuccuuccuccuuucuuucuuucuuucuuucuuucuuucuuucuuucuuucuuuccuucuuucuuuccuucuuucguucuuucuuucuuuccuuccuucuuucuuucuuuccuuccuuccuuucuuucuuucuuucuuuccuuccuccuuucuuucuuucuuucuuucuuuccuucuuucuuucuuucuuucuuucuuuccuuccuccuuucuuucuuucuuucauucuuucauucuuucuuuccuuccuucuuucuuuccuucuuuccuucuuucuuucguucuuucuuucuuucuuucuuuccuucuuuccuuccuucuuucuuucuuucuuucuuucuuucuuucuuucuuuccuucuuucuuucuuuccuuccuuccuuccuucuuucuuucuuuccuuucuuuccuuccuuuccuuccuuuccuuccuuuccuuccuuuccuuccuuccuuuccuuccuuucuuucuuucuuucuuucuuucuuucuuucuuucugucugucugucugucugucugucuuucugucuuucuuuucuuucuuuucuuucuuuucuuucgacaggguuucucuguaaccuuggcuguccuggaacucgauuuguugaccaagcuggccucaaacucaaagagguucugccugucucugcauccugagugcugggauuaaauuugagacaugucccugcuuggcaauagcuuauauuucuaaaaacacuuuguguaugugugugcacacaguaacuuguuagcuuguuccuaacuaaauuuuuuuuuaauugaggauuucuguggagcuauacucaaaagaauuaguugguuuuaguuuuccacaccagcugguagggauagccauauuaaauauacuauugauccucuuuuuagcauugcucauagaaggcugaaagguggucacccccauucucauggguauuuaucauuagucuucuguagcacaguugcucuuggaaaagagcacauuaucuuugauuggcauucccucaucaguggagacuguugcuucauauaaaauaacuguccauaugucuucauuugcuuuuuauuguugugauaaagaucaugaacaaaguaucuuagggaggacagaguuuauuugguuuauguccauugagagaagucaaggcaaggacuuaagauaggaacugaagcagaagccaugguggaacucuccuuacuggcuugcucagccugcuuuuuuguacaaccaggaccaccugcaggcaguccuuucauaucaauuauaaaucaugaaaauaacucucagacuugccuaugggcaaccugauggagguaauuucucaacuaaggauaugucuguguagauuuacuuuauuugauccuuagacucauucuaagccauugcuauguuccguuuugagaccaaaacaagaugaaauugagucauuucuuugagcuagaucauccugcuugucuuuuaauguagaauggcuuucuuagcgcuucaccaaagauaaacuucaaguaacuuucaaaucaagguauucaaccauaaagaugauuuuauagagcuuuguagaguaaagacuuggauccaacugagcauauucuuuucaaaacaagcuaauguuuuggaagccaggauccuagugcaguguuaugugguauagcacauuaaagucuauuguagguuucccuuuggagaaaggugguugaccuugcugggaggaggcggcugugaucaaaugauugaaggcugccuugcuaaggagaaaguaacuccuuuuuuguccacuaguuuauguaacauaucuaaaugccuauuguguuuuaauccaaggguagauagaugaacacuaccuccuuuucucugaagaaauuuccauaguuacaaaacaagaguagaagucuacaaacuguagcccacagucuaaaauauguacucuuuuuuuuaaagauguauuuauuuauuuuauguauaugaguauacuguagcuguacagaugguugugagccaucauugugguuucugggaauugagcucaggaucucugcuagcucaaggcccugcuugcuguacacuguagcugucuucagacacaccagaagagggcgucaaaucucauuacggaugguugugagcuaccaugugguugcugggauuugagcucagggccuuuggaagagcagucagugcucuuaacugcugagccaucucuccagcccaaauuuguauucuuuaugaguacaaauuuuaaaaauguuuauuuuacguaucuauuuaauuuagcuguuuucagaaagucuugguauacucuuauuuugcugggaauucugugucuuccuguucaacgucccaagugcugggauauauguguguacuacccagccuggauucauuuuucuuuuuuacuucuauugagguucucuagauuuaaccuaaggccuugcacaugcuuugcaaauauuuuacugcugagcuaucacccucaccauuugaauuuuuaaaagauuaugaaaacgaaguauaugugacaguucauauguugucaacaagccuaaaauauuuauguucugacccuugacaaaaaaugcuugcuaccuuguagugcagagguuaaaauggggauuuguaaaguauaggaugcugcauuuagcuuaauauaagaucuuuuuaaaaagguaacauaccagcaacuaaaaguaaguucuguuacagcaaaaugucaagggaaauucuacaauagaaagauuucagcauugaaugagagacuauacaguguaauuucuuguauagcugcacuucuuccuugucaguagauaaaauagacauuuaaagcuacuggaucuugcauuguauggccacuggauuugccauuccugcuguucugucccucauggauguuaucaucaugguauuaggcuuucaccaauggcagauauuguugauaugaugggugauggagggaccuacguuggcaacaucucuccaaaugugaggaaacaacaguugaggacaaguaugaggaagucauugccuucccaucaauuacacacauauacauggcaugauugaaaaugaacaauucuggcuugcuccuuuaaaaaguacauuuuucuauuuaaccugauuuaacucuaaaacaccacucagguaauuuuaaauauuuaaggagaugcucaaaugguacuuauaacuaauuacuuaugauuuuuuuguuuuaucucaauguuuaugauaauaaugauuucuguaaauucuggaauuugguuagggauaauuaauuuuuaauuuuauuauuuauuuuucauauuauuuuauguguuuggguauuuugccugcauauauguuuguguaccacucgagugacugauacuggaggaggcuagaagagggugucagaucccuuggaacuggagucacaaaugauuguaagucaccauguagguggugggagucaaacuuagguccucuggaagagcagcagccaguucuuuuaaccauuaagcuaucucuccagaaucauuuuugaaaaccagaucauucuaagugaccguuauaccuaguuaauugaaaauaauuucuuguacucaccagaguccuuuguggugucagcccuaguuucuuuuaaagaacuuuguugauucuucgagggaugaagaggaucuguuuugaaggauuaucuaagccagugccagggaugagccguauuagcucuucucugauguuaaguuuuucucucucuguguguguguguguguguguguguguguuuguguguauggguauuucaguaugcaugcugaaggacagacucagguuuguuucccagaagccauccauuuuucuuuuuugugacauugucccuuacuggccuguaacucacugauuugacucauuggcuggccagaaaaauccauggauuugccuguuuuaccuucccagcacugggauugcaagugugcaguaccacgccuaacuuuacaacaauuauggaguugaacucagguuuucaugcuugaccagaaagcucuuuauugacuaaaauuauguguuuaaaguuacuaucauuucuuauuuuuagccaauucaguagguuuaauuuacuaccuacuaaguauauagcagauacucuacuugucauugaggauauaccugugauaaagcagcuuuauagaauuugagaggaaccaaacauguuugccaguccagagcagugagaauguuaggguccccagugagggccuauaucaccaaugugagcaaaacuucuuugagggcauuucaggaagaaggcuggugccagguggaguccucaaguguagauauaguugaaaucaagaaagugugcuguagcaaucauuagacucauguugaaaaagcaguuuaguuuuagcagcacaucacuagacaauuuucguagguugcuguuuuagaaaucaaguuuuauaggaauaauuuuuguuuuguaauuuaauaagugcuauagggaauaaggauuuuauacuauauauauauauauauacauauauauauauauauuuaaagagauaagaauuaaagcugagcaugguggcauaugucuuuagucccagcacuuggaagggagaagacgaggcaggcagaucucugaguuugaggccacccugaucuacacaacaaauuccaggacaauacaaagaaacccugucuugaaaaaaacaaaaacagaaccccacccccaccccaacaacaaaaaauaauuaccuaagcuguuaggaaacuaguguuuuuuucuuuuuaagguucaaacucuuuagguaacauaccuauuuuauacauuucagaaccagaacuucaaagaacauuuguguuugugauaccaucuuaugguagaguuuaaacagaaaauuuaagaaauguuuauuuauuuaaaacuauuacuuacauauuagcaccauacguaauuuucucgacaagccauuuuguaauacaaauauuuaaaagggaggccuuguuucaauauuauuuugaauauaauuuugauccacaucaucucuuagcagugucauaggaccccagaacccuuagauuacccuuugauauguucauauauaaaauuuccuauuaguuaaaauugagggccagcaauaugacuuagcaggcaaaggcacccgcugcuaaaccugaugaccuagguuugauucuucccacucaguaggagagaaaugauuacuguaaguugccuccugauugccauuugaucaccagugcacacucaugcccacccaccaaucuaacaccuacacagaauaaaaauuaauaaaaaggacacacuuuaauugcuaauaauuguuaacaauuaauguaaauuguauaguaauuuguaaagaaguuagaaugcugucauuuaaccuauuuacauaugaagagauuauuuaauuauauuaaguuuuguaaauaaauguccuuaccucuaagguaguaaugauacuuacucuucgaagucuucauggauuaaaugaaauacuguauguuaaauguuuagacuuuuucuuguuccauagaugauugcugcuguuaguauauuauuauugucaugauguagaaggugcuuuaaagaauggcccgaguaagguaaacauugcacuuuugauugcucagccuuuuuauauugaaacuuugcagugauacaggauaacuuugcugcuccugauuugccuuugcugacauguuugauacaagaccaagaagagguugagccugauuccuuguuucaacaaagugaacuagaauuugcaccuuugagguggggugauucauuuauuugccuucuaaauuuucuacucuuguaguaaguuguuaauaguauuaaugguuucaggcuaaagugggauugggaguagaggucagguauucuuagcauauucuugugucuuaaauuggugcaguauuuuacauguagagauguaccauguaacuauauuuuauuuagaaaucauguaugguuuuguguagccuuuaggcaaacuuugguuaucaguaccugaguuuccuauucuaaaucucuguaugcugcugcuguccuuccccuccauucugcaggaaagcaggcauuuauuuuuaagauauuaauuagucugcacuuugaguuugcucagcuguucuugaaucaaccuaguuagcuuucuuuauacugugcaaauaucaaguaagauuuuuauaauauuucaaauugaugucuuuuagaacaaucaaaaugggaggacauuuuguaauucuucagaaacauacuuggaacuguccaaggcuuuguuuucuguuaaaaccaaaagaaaacucuaccuuaaacucaaaacucuagauauuuagaaaguaaacguauaaacccccucucauuauguuguauauuacuuuagaaucaugguugcaaaauucuguuuccuuuguauuaucgaggugauuaagcuauauuguaguuugggaguagaucuauaagcccaauaacugaccaguaaacugaggaauauaaguuagugagugucaauucauaguagguagcauacauuuaaaauagcaaaccugccggggcgugguggcgcaugccuuuaaucccagcacucgggaggcagaggcaggcggauuucugaguucgaggccagccuggucuacaaagugaguucuaggacauacagggcuacacagauuaacccugucucaaaaaaacaaacaaacaaccccccccuccaaaaaaaaaacaacccaaaaaagcaaaccuuuuuaaguuuaaaaggcaagcuuuuaaacuuuuuuuauaauguugaaauugauucuguuuuaggagaaugcagcaguaguaucaggugguaguuuacuuauugguugcaaaauuuucuuuguuuaaucuuuagcuaaagauugaagauuagaacuuuuaaaaaugcacuuucaaguaagccugauuuuagugacaccagguuuguauuuuuauuaguguuuaauaauaauaauaaucagauuaugauguccuauauucauaugucauggccaccagaaaaggacacucagcagccagaaggcaacuuggcugauaaagaccacguuuucaccuuagcuuuaucugauauuagugauuauuuuaauuauuaauuaauaguuaauacucaggagcuaauuauuucuuucugacuuuguauuuucagaggaauuccugauaagucugaagauucugaauggcuugcucgaccaucagaaguuagugaagcuuuaauccaagccaccucagaaacaucuucagacuuagcuaacaguugcuuuaguauaucucagcauccacuuacagguagcacaacuuuugggucucagcacucucuuuucauguuugaacaagagaauaauggagaaacuguaccaucuaaugccccugaugaacugaaaagcccgaaggacucagaucaugauguccuguguucauauaugucauggccaucagaaaaggacacucagcagccagaaggcaacuuggcugauaaagaccaaguuuccaccucaacuuuaucugauauuagugaugaaaguauagcugcuaaaagaaacaacaguuuugguguuucuuguucauguaaucaguauuggaaccagaaagccuuacaacaaacugaagcaugucuagccaguaaggaccaugcuucuuucccauguaaaauuacuccucuuccuaauaaagugccauacucuuuucuacaacgcauguuaaaaagaggaaaagaggcuccuuugaucgcugauaaucaucuugagaauguuuguuuaaggacuccagcagaagaugagaugagucuaaagaaugagucuuuggaggguuuugaaggaaaugaagaucugcagaaagaauuaucucaauucuuuaagcaaaaggagacuagaaauacuugggcaucuucucaggugcauaccagauauccagagauaaaguauauugggacuguugccgucccugauaguaaaaaacaaguugcagaaccauauauucucuacagaggacuugauaucucugauuguccucuuccgacagucaaauccaacuuggaugagacaucagaacaacucuauuuucaagaggaaagaaaccaaaaggcagcuucuacuuuugaugagaaaaauguugaugcuacugaaaauguagccuuugaggcaauuauugccucaauugagucuuccaaucaagagagucuuauaagugagacucaaacggauaacacugaacuguuagcagaugacagcgaagagaaagaaccccuaaaaccagaucuuuccccauuaaauuguaagaaugaaaucucuuucaucgauaagcuuaaguaccugaaauaccagucuacuccugggguguuugaaccagcagauucaaaaucauuguuguauaaagaagaugaugcuaguucccuauaucuguauccagauuuaaaauccuccauuaaugcuccucagaacaugcucaauaagccgguuucugucacucuagagcuuaagucaucuuuaagugaaaaagcuugcaaucaggcuguuggucuugaaacacagucaccuucauuucaauaugguauaagcaaucuugaccuuacagagaagguaggaucuucaagcauuaguuuugcaaugaaaauagcaacuucagaaucuuggguuuuagaagauuuaaagcagcagaccuuugaagaaguugcagauuccucagacuauaaauuggguaaggauguaaacuguaguaaccccauuaaaggucuaaucugcugcuguauggaacagcuuauuagcaaacuuggcagcaugugaugcaagucccacuuuacauuaacacugaugaaugaugcaucacugauuauagucagccaagagguauuccuggaagcugaugaaggccaaggugaaauuccuuggccuugggggcugagucaggcuguguguguguguguguauguuauaguuacgcaacaugacuucuuuuuuccuuuucuuuucuuuuuuuuaauagagggccugcaggggaaggcugaaucugguguccuuacuagguguggugaugcuaaguacuccagccuuuaugaaaaccuuggugcacagagugaaagaauugcuguauugcagagagaggugagauacaaugaagugaucaugauagaauacaguccuuucuaguccugauucaggaaauauuacuuguuuuuuuaccuuucacuguuucccagacauggggccuacaaggcuuaacugguaaguacuuggagcuugcagacuuagagaauuugcuugaugauguuugugacagcuccuuguuuuggcuacuuacuuuacaccaucaucugaggagcgccauuuugaaaagccuguaaguuaccugacauuuuuuuauuuuauuuuauggauagguaaaggaauauuuuaguugaaaagaaaaucauaaugaaaguaaagagcucauuuguuuuuuauaccaaucugccuuacaauguggucuucaucuccuacccaggaauaugaucccuaccaacuguugacagaaagacucuuucauagccuguaacacuucaccaguucuuuggugucuuaggaaagggcauuuuuuggcagacuagacuuuuuaucuuuaucucuucucuucucuucucuucucuucucuucucuucucuucucuucucuucucuucucuucucuuuuuuucuuauuuuaguucuuugagacaaggucucuaaguaguccuggcuucccuggaguuugcuguguagaccaggcuggccuugacuucagagaaauuuugugcaucugccucccaagugcugggagugaaagcauguaccaccacuguguucagcccuccagacuuauuuugagguauccuuuucagguugggcuaagcaagaauauuuggaauaugugaaaacaagacacacucaaaguucuuggaagucuugaguuagggcauuuaagaaaaugccaagcaucguuguuugucucgaaaggagacuucaaugcaaaguccaaacuagucagucuuucugaagauaccuaacugccucuucucaaaugagcaacauauuaagcuuguauacauuccccaccugucugcucaugccgccauuaucaugucuguacuaaaaguggugacucuagagacuuacauaaauucuuuuuuuuaaagaucuauuuauuaauauaucuauguacacuguagcugucuuccagacgcaccagaagagggcgucagaucucucauuaugggugguugugagccaccaugugguugcuggaauuugaacucagggccuacugaagaacagucuuaaccacucuuaaucguugagcuaucuuucuagccccauaucaauucuuuauaaggaaggcuucauuugcuuggcucuuuggaccuccuugagucccacccuuguuugugugaugugcccuuguucacguuuagaagcugguaugggaagauagcaaagauaacauggagaguuuuccuuuuauuuauagguuguuuacuguguaagaaaauuucaugggauuaauuuguuuucuucagcauucuagaguaugcauuguuugaauuuuuaaucugaugagagguucgguaccagcagguuaauaggucauagcaguucacuaguccguccuguuagauuggcuuaguguggauuauuuuguuccacaguuuacaaggacuacuucuaggaucauaauucacuacauaagaauacuaauaggagaccuuaucauguucuugaaugcuguauuaugaacugccuacgaccuaacuuuagcccucugcccucaagaggccuagcuuucuuaggauugcuguucacugugcuucugggugguaaucuuuccaauuuaggcccucuaugguagcuuacguuguuuguuuguuuguuucuuugcuuuuugagacaggcuuucucuguguauccuugguuguccuggaacuuacagagaucacuugccuuugucuccugaguacagggauuaaaugcaugugccacuacugcccaacaagauuuuuuuaaaaugaacauuaugcucacccccaguucaacuuguauauaucaaaauagcucauacauccccuauauuagacugauccugcauauucugccuuuuuauagaaauguuagcauuuuucuaguuucuuacucaucuuuuauucuuauuuucauuggcaauuaaaaaaaugggaauuuccagaggacccaaguuuaguuccuaacaccgauaucaggucacuuacaaccaccugaaaccaaagcuccaaaggaucaucaggaaccucucuagcuucugagagaaccugcguccaugggacaaacauucauauaaauagauaaucuucuaaaguaauggaaauuaagggcugaaggcccagcuuagugauagagcauuugccuagcaugcccaagguccuggguuuguuacccggcaccacacauacagauuuaaaaauugaaaauuaaucugaucauuuuccuccugguuccucucauuuucaaauaguucuucaaaucuguugaucuacuaaguacuucucauccuuuuaauucuacauuauuuacucuucacuuagccaacaggccacaaaguuauccgcauauucuuugguauuaccugcuauaauagcuuuuauguucaaagguguguuaauaguacauuuuuauugaagucaaaauuauauuuuuuuucuuccuuuauuuggaagcaguggaagaacacuaauucauucuccugugucuacccauaucuacuuuuaucucccuccccucuuccuuacucugccuuccuuccacaagcuauacuuaaaagaaacuaaacuuuuagaaaugagauucuugacuuaaaaauuuugggcuucucaguauuuauauuuugaacuauaucuuuuugaucuagagaaccacucuguauuuuagucuguuuucuagcauuucuguccacuacucacuagguaccagcagcuuccuguuuuaccccccguucucaccauuuaugacaaauaaaacauguuucuugacacugcuaaauuucucuuugcaagggauaggauuuucucaggcaagagcuaguaggcuuaaaaaagccuuucaggaaauagagguagaauauuaauuccuacaugugugugccugccaacuucuuggcagcugaaaacccaguuuaaaaaaaaaauauauauauauguguguauguguguguguguguguguguguguguguguguguguguauguguaauguaugccuguaauccuuguacaugagaugugaagaccggaggauaagguguucaaagccagccccagcuauauagugaggaguuugaggucagccugggcuauaugagauccugcuccaaacauacaaacaaguaagcaaauaaaaucauguuuauguguaucuuuggauucuguccuggauucuguccugaaagggcaugacuagacuaauccuuuauaagguuaauuaaguacacacacacacacacacacacacacacacacacacacacacacacacacauauauauaauauaagguuauaauauaauaaggcuauauguuuuuaccuaauugucuuauaaacuuaguggagauuuauaugcauuuaugcuuuaaugccaucaguuacuuauaugugauauucucuaagccagcauuguaaaccacagaacuauugaugcugucuuaaucaaacaaaauaugaucuguauaugaauucaaauggcuugagaacaugaaucucauucuguuacuagacuggcccaggucuuacuggucuuacuggucucaguaaacgucuuucuucugagauuucagugggguauaccaccacaccugggaggaauagaaucauaaguaacugauaaaacuccucaguguguugugcugaggagaugggucaucagugaagagcgguuguugcuccuuuuaaagauuuacuuuauuuuuauguaugugaauguuuugccugcauguaucugcgcaccacaugcuuguaguaguaccucuggaaacaagaagagggcauuggauucucaaggacuggaaucagacucuugugagcugccaaauggugguuaggaauuaaacucaggaagaguaaccaguaaucuuaccugcugcaaaucucuccauucccaacuuguucuuagagaagaccuggguucuauuucuaguguuuacauggugggucauaaucaucuguaacucuaguuccaggggauccaacagcuuucucuaaacucuguaccagguguacauaacauauaugcaggcaaaacacucauacauuuaaaaugaaauuaaauaaaaaaaauuauuaaaccucuuguguucauuuuuaugaugagguuugguuuuuagccaaccaagugucaaauuaauagaauuuuuuucccccuucauuucucauuucauagguagguuguucuaaucugggcauuagccaggcuucuccaucuucauugccuucauuuguuccucaagaaccaaccagugagccggaauaccauuccuccaaucucagaauguugaggguaucucccgacacucugcuaacaacgcauacacauucagcagguauguagaaaacggaggcauuaacuacccuuuguaucuagggugugauuauugucuuaccaugccguucuagcaguuggauggauuaaaggaugcccagaugucuuauuuuguguuuuuauuacugugauaauaccauggccaaaaucaaccuagggagaaaagggcuuauuuaaucuaaauaacuuuauaacugagggaagucagggcaggaacucagugaaacuggaggcaggaacugaagcgggaaccuuggaggaaugcugcuuauugucuugcuccuccuggcuugcugguuuuuucuuacaucccaggaccacuuggccaggcgauagcaccauccacagcggguggguccuuucuucccacaucaauccuuagucaagaaaaugccccacagcuugacuuuauggaggcauuuucuuaauggagguuuccuucuuucauaugaauguagcuuguguuuaguugacaaaaaaaauuagccaacacaccagauaauugguaaagcagcaucuacacauaccugaaaggcuaucugaggaagagauuugaauaaguggacugaauauggaagaucugucucaccauugugaguuuguccaguugguugagaccuggauugaacaaaaaggucccacugggacaccuuuuaucugcccuugagcacagaacuccagguuacuuggccuuuaggcaguuucccugccuuugcucuuagacuggaauuauauuguuggcaugauugauuuugggguuuuggagugugagccaagcuauaccaucggguucuuuaggcaaacaugguaggaucaauuucuccaauuucuucagagaauuaccugcuaaucuuuauuuagucauuuccauuuaguuuccccuucaauauaaauucuaaguuuucuuuucuuauuuuuccucuuccuuuuuuccucuuuucuuuuugagauaaggaucucacuauguagugcuggcuguccuggaacucaauguguagaccaggcuggccuugaacucacagaggucugccugccucugccuugagugcugagauuaggugaguaccaccaugccuggcaaauucuaaguuuccaguaggccacucucaaucugcuucuacuacucaccaccuuccucaguaaauaauaugcuuuccuccucaaaaugaucuucugugcucuuuuguacaagauuauuugcauucauacuucucuugagcucaauuauuuuugccuuccaguuaugaaaaauguuuuguuuuguuuuuugagaagauggggauucauauagucagaaugauugugaccccugaaauuuucucuuugaaauucuuacucucagagugauggcauuaggaaguagagccuuuggauggucacaagaacucuagugacaaacuaaggaccuuggagugaucccuugucacucugcccacaugaacacaguacaguggcaucuucuguuucuaagaggcccuugccaagugcuauaucuacaagcaccuucauguaagauguucuuccuccuucuuuugugaaaauaggcaugcauucuaaguccuuguauguugggccagaaaggccuccuuaaguguucacauagaugauaccacuaaacuagaucuuuggaagaaaauauauucagaaacuuuuuuuuuggccaggcugacuggucagauucugguuguugaucuaguuguauuugucucuucagugcauguggacuuuagaugauauuuuuugagacuuggucuucucuuucuauuauggguucuaaauuaaacucauguuaccaggcuuuuauggcaagcaaucuuaaccugcugaaccaaaucacuaagucuuauuuuuuaagcauuugaucauauuacuugcaaacaggagggcuuugauuucuuuuccuuuucuguuugcauauguuguauuucuuuugucuuauuguuguagauaagacuuaauauauuuaaucugaguggagaagguaaauacucuuagauuuucaguuauuucccauuuaggaauauguugacuuauguguaaccuucauuauauugagauauguuucuucuguuucuaauucuucagggcuuuuaucuuaguggguguuggacuuugucaaugguguuuucuauaucuguugaggugauugugugauuucugucagaguuuauuaaugucguauguugugcuuauugacauauaugucaaauaauucuuauauuccuggaauuaagcuaacuuggucauucaugguaaauuauccuuauaauguauuauaauguugaauuuaguuugaaguauuuuacugagauuuuaagcauuuguguucuucugguguacagacauauuauuuucuuuuugugaguucuugucuagcauugguaucagaguaauacugacuucauaaaaugaauuuggaaguaucccuuuuuuauccuauuauauggaauaguuuggggaccauuggaaguucuuuaaagaccugguaggggcuaaagagaugacuuaauguuuaaggagcacuggccauucuucuagaggaccuugguuugauucccagcaucacauggcaguuaacaacaucuacaauaccaauucacgccaguuuacaccuuucuuuggucucugcagguauugcaugcauuuggugcacagacauauucggacuaaacacccauacacauaaagauaaauaauauuuaaagaaaaguucuaguguagagccagaggguuggcucagugggaaaaagcacuugcugugcuaauugggcauuugauuccugugaaaggagaacugacuuuugaauguugucuucugaccucuaaggcacaacauaguacacuggugucuuagucacuguucuauugcugugaagagacacuaugaccaggguaagucuuacaaaaggaagcauuaaacugggggauugcuuuuaguuucugggacuuaguucauuaucaucaugauggggaacauggcaacacacaaagguuguaguaguagcugagacuauuagauucugauccacgggcagagagagaaccugggccuggcaugggguuuugaaaacucaaaccccaucccuaguaacacacuugcuccaacaaggccacaccuccugauccuucuaauccuaucaaaaaguuccacucccuggugacuaagauuucuaauauaugagcauaugggggccaaucuuaucaccacaacucguauuuguguacacacauacacuaaguaaaauuaaguauuaaaacaaaguuuuaaaagaagucugauagucuggguggugguguguaagccuuuaaucccaguuuuuggaggcagaggcaggucuggucuacagagagagucccaggacagccagagcuacauagagaaacccugccuugaaaaaccaagggaaaaaaaaaagucugauaaaauucagcaaagacauggcaccauuuuuaggugacuuuguuuaaaaaaaaaaaaaaacaaacuucagacucauugcuuguuguaaauauguuuaaguuauuuauaucuugguuuaauuuuuauaguucaugucuggugguuugaaugaaaauggucccucauagacucauuuauuugaauaccuggccuccaauugguggaacuguuugggaauugagugaugugucuuuguuggugguaguguguugccaugaguggguuuuuagguuugaaaaguccauacuauucccagugagugcucucucugccuagugauuguauuucaagauguaaaaacuuagcuacugcucuagggccauaccugccugccaccauguucccuaucaaugaugguuauagacuugcccucuugaaacuguaagccccgguuguagauuaaaauacuuaauguaaaacaaaauaaaacaaaaaaagguuucuuuuuagguugcuuuggucaugguguccaugauuaaguucuuuauuugaaagcucugacuuuuuaaauguagguauguguagcuuuaaacuuccuucuuauaauggcuucauuguaucucacaggaucugcugaccagaagauuggagcagcaguagucucuucugcuuacucacaggaaauaaagccugggaguuuucaccaagaagaguugccagauaggcaucuuaaugaagagauucggaaagugucaccugcucuuaggacagcuggccagaagccagagaugcuaccaguacaaucuaguucuuacucuaaaggaaugaaaucuauuuucuaucaacauccugugucacauggccaucaaggcaaagagccucuaaguguuucagcuguuuguggaucagcugguaauaaagcuuuccaccagcuuuccacauuaucagacagucuacuaacugaagaaacauggccaguuucuguuauuccuggccuagguaaccagaagacuccuuuaccaucagaauucucucuuucauauucucauagaggaaagaaccugcccgaagauguugugaaaguuuccacugauucuggaucugcucacaagaaggcugacauucuaacagcguccucuagaaccuaccagcacaaaaugaaaccugcuaauauuuaccaccaagaguugccagacagucguguaccuauagggacuagaaagguugcauuugaaucuggaccagcuggccagaagucugggguuucucacccauauggugagaugcccaguguuuucuaucagcagggguugccagauaggcauucagcaaaaagcccuacaaaaaccuuuaucccaggaccagcugaccagaagacugaucuaucaccaguacccccuacuuccucuucgcaugcagagaagccuguuucccccuaccaguuaaccuugccagguagucaucuaccugaagauguuuucaaagcuucuucuguuuguaagucaucugaugagcuaucuggaauaacagcucuaaccucugcuuccuacucauauaaagggagacccaauaguucuuaucagcagaaguuuccagacagccaccuaaaugaagaggcccagaaaaucuuggguacaacuggaacaguagaccagaagacagugacaccaacaaugucuucuuccuuuuuacaaaaagaaaagccuaguauuuucuaccaacaaacccugccagaugguggucugucugaagaggaucugcagguuucagcuguuccuuggccagcugaccagaacauugcuauaccaacaguaacuucugcugcuuucucacaaagagaaaagccucggauuuucuaccaacagacucugucaguugaucguuugccuggagagccucugaauguuuuagggacuucuggaccaccugaccagaacacuggggcaccaacaguaacuccuaguuccuacuucccuggagaagaguccauuauuuuuuaccaagcuggcuuuccagguaacacucugucugcaaugucuuuuaaaguuccaaggauuucuggaucaacugaacagacuaacguaacaacaggaucaucaaguuccuacucaguuggagagaaguccauuauuuucuaccaucaggccuugccagauggucgucuuccucaagaagcuucuccugcaccagcugaccuaaacacuggggagccaccaauguauuuggcuuccuguucuguuggaguaaagcccauuauuuucuaccagcagccuaugucagauagucagcgaacuaaaggucacaaagaaucagauguuccuggaccaacugaccagaagacuggcauagcaacagugcauucuacuucccaaucauauauagggaggcgcacuguuucuuaccagaaagaguuuccagaucuuagugaaaaggcuuugaaaguucuaggugauguuggauccacugaacagaaaacucaaauaccaguagugucuucugcucucuuacacaaagaggggccuagugcuuaccaggaggauuugccagaucuuacugaagaaccuuugcaaauuuuagguguuucugaagaaguuucuucuagcucuuaucagaggaaguuaccagaucauauugaaguauuuuugaaaucaguaggcucuggcucugcugaucggaagacuggggcacaaauagucuccucaaguagagagaaguccagugguuuucaucagcaggaguugccaaauacugguggggaugcaguagaugcuuuucaucccgaaccaguuguccaggaggucaggaagguacagacgccuggggcaccagcaggaccuucuaguucccacuuccauaaagaaaaacucagugauuaucaaaaggccucgccacaucgugaucuaacugaaaguucuuugaaggcuucaacuguuccaggacuaucugaucagaaaaagaaaccugcagucucaucugguuucugcuuacacaaagagaaacacgagauuucagcuucagcuuugcugaauugccagacagccgaguugcuaacaguuacucagagguccuguuuacauagagaggauccugcaauuucaacugugaucaaaccagaugaccaaaagauuccauuaccaacaacuuuucauggcuccagugaucaaaaaguaaaaccuguuauuuuuguucaaaaacaguuacgagauagagaucaaagugaagauauuccgaagauuucaacugucucugagccaacuguuguaaauacaguucuaccaguacuucugccugguucuuacucacacagagagaagucagauucauuuuacccacaggaacugccagauggacaucuaacugaaguugaucugaagguuucaagcggucuuggucaagcugaccagauuucuggguuaccuacagguauuccugguacuuauucacacagugaaaagcaccagcuuaucucagaacauguccaagagcugauggauaacuugaauucuuccgagucgucuugucucaguguggauaguaugccucuaaauucacaaaucgaugauggaguuaucauauguaagccagaaucuuuagguuuugccaaugcuggcugugaggaaaugcagaauauagaucgugguucgaaaacucuuaaggaaauucagacucucuugauggaagcagaaaauauggcacugaaacgaugcaauuucucuguucccuuagucccuuucagagauguuaacgauguuucauuuauacgaucaaagaaggugguuugcuucaaagaauccuccacaacugauguuuguacccagagggaaucauuuguagaagaaguuccacacauugaauauguacagaaggacauuggcacacagacgaaccuuaaguaccagagggguguuggaaauugggaauuuaucaguucagcuaccuuuagaaguccucuacaggaagcagaaggcacagcuagaauggcauaugaugaaacuuuuaggcaauauaaagcugccaggucuguaaugaggucugaaccugaaggcugcaguacaggcauugggaauaaaaugauuaucccuaugaugacaaucauaaagagugacucgaguagugauguaagugaugguugcugcucaugggacaacaauuuaccagagucuuuggaaucuguuucugauguuuuucuaaacuucuuuccauauacuucacccaagacaaguauaacagauagccgagaagaggagugguugucagagagcgaggauggcuaugguaguacagauucauuggcugcacaugugaaguaccuucugcagugugaaacuucacugaaucaagccaaacagauacuuaaaaaugcagaggaagaggaauaucggguccgaacccaagguaaggacucacugacauaauaggcacagccacgcuuguuuacagcuuagcaguuuaaagugagacauuuggaguucuacauuuguuuucuuauaaaacuguagaauggucauauuuucuauguaaaaucuggaaaauaagaacaaugcuguaaaugagacauaugaucaguagugcuagucuguuuaugguuuuagaaggagauucucauguuagaugugcaguaagaaaguaguuuggccagcaguuuaacagacuuccuuaguuaauucucuuauuguaauagccuugucuggggacacauaugucuccaauuuguucuuugguaaguuguuuguauucuaaaucuauguaugcuuucucucuguuuucuaaugacauuuuuggaguugaucuaaagucuaaggggaaagacacuuaccaggucuuuaguacuauauagaggucuaagucuaaaggguauuuauuagccucauuaaucucuaauauaaucuuuguaaaggagacauaauaaucuuuaagacauaaggaaauguauuuuggguaguaacuuguacaugguucaggacuggcucggaaucuuaagguuaacugcuugugcgguuccuguacauuuggauucugucaaaaucucccuaguuuugcuuguauuagguaucauagagguguuaguaacaaguacuauggggagauagauuuugauuagaagaaaaauuaagauuaaugauuuaaauacuauauuuagauuggcuucuuuggagauaaaucuguaggggaugguuuaaaaaaacucagaauuuuaguuuauuuauggugacacauaauuguaaucucuguucuaggaggcugaggcacagagaucauaaguucagaauuacccugugucuuacuggggguuuacugcuaugaacagauaccaugaccaaggcgacucuuauaaggacaacauuucauuggggcugacuuacagguuuagagguucaguucauuauuaucaaggcaggagcauggagcugagacuucuguaucuucaucugaaggcugguagaagacuggcuuccaggcagcucgaagaaucuuaaagcccauauccacaaugacacauuuccuccaacaaggccacacuuccuaagagugagcccaagcauauucaaaccaccacacccuggauuacauagaaauacccugcuuugguagauggucagacucuucaaugaagugaccucuuaugaacuagugugucacauacuugagaccauaugcucagcuuuguguugugcauuaaggggcagauauuggugguuuucuuuacuugaauaguaauuuaaaaauuacuaguuucacaguuuuuaaaucucaacuguucugugauuucuuucuagccuggaaucuaaaguuuaauuuaggacgugaccguggauacuccauuucagaauuaaaugaagaugacagaaggaaaguagaagagauaaaagcaaaguuguuuggucauggaagagcaacucacaugucugagguauaaaaccuagaagugaaaacugaaacugugaaagagggcaguagaaacgagagcucugacuuacugaugauuccagaugaguugcuauaaucuugugcuaaagucuuagagucuuaguucucuaaaaguuaagauugaaggacuagauucuuuaaguuuugauucauuccaaaauuaucguaguaguaaaacaguaauugaggucuuuugccaaugcauuuuuacaguugagagguuaaacuucuccauuacaucuuauaauucagauggaagcuuagauucagaaguguauguucuguuugaaaguagaguucaaguaguuuuauguaaaacagcuuucuuuuuaauagugcuucuccccacccccccuuuaguggacuguuucuugaauggaagcauuuaucuuaaaaaaaagaaaauuauuccuguguuuccuguuuagcucuagaaacagaacauuaacagauacaauuaaccuggacaugguagcauguacuuuaauccuaguauuugggaggcuaaguccaaaggaucacaaguucaaggccagcaagggcuacuuagccagauuguauuucaaaaaccaaaccaaaucagcacuccccaaccccugacaaaugacuuuguuuuggaucuccuucccuagacuuaucuuuauuucuaauccugacauggguuggcuuucugcucuucaguaugcuuuugaauuuuacauagaaccagcaugaugugggcugcagaaaugccucagugguuaagagcaauuguuggccuugaguaucaggguucaguucccagcauccauauguaguucacaaucauccaugacuccaguuccagggaaucugacacugucuucugacccccaaagucaccagacauaccugugguacacauauauacauguaaaacauucauguacaagaaaaaagaaaaucagauguauucauucuuuaugaggcuaaaguuccauuuuguauauauaccacauuuuuuuucuuccacaucccuauuggacacuuaaauaccauguuuuggcuauuaacaguagcuuuuaaaaagaggaccucuugcacaccugucaguauguugacuuauaagauuuuaggaagaauagucuaaaaauaguguuugacagguacuaaagcaauaagaauucagaaaaaauuuauauacauuaauuuuguggggagggugccacaguaugccugugaaggucagaggacaauuuuuaagauucuauucuuuucucucaccauguugguucuggggauugaacugagucaggcuuggcagcaaauguuuuuacuuccugggucaucuugccucucaaauacucuaaagaguuuuuuuuuuuuuauuuuauuuauuuuauuauuauauguaaguacacuguagcuguauucagacacaccagaagagggagucagaucuuguuacggaugguugugagccaccaugugguugcugggauucgaacucuggaccuucggaagagcagucgggugcucuuacccacugagccaucucaccagccccucuaaagaguuuuuaaaguagaaaaaucauuaugaauuuguuuacuaugaaaacuugaaagaugccacaggaggaaguaggccacugagaaagagaaauauaaauacauuuuagaugaauaccaauauguaaugauuucuaguuuugaaaguggaggaaauuuauuucuuagauuaaggcauuuguuucccagugaucugucaggagguuccaggcuaaucagaagcugcacauuaaaaauggcaauuccguguauuuaaguuuuuuuuuaagccaacuauuguuuuaaauuguagcauuucaugcagcuguaugaaaugauauggagagaggauauguguccugcuguauccaguuucuuuacugaucauguccuacaaagggauguuuuguuuuguuuuguuuuguuugagacagggucugguugacuuggaauuuacuuuguagacuaggcuggccuugaauucacaagagaucugccuaucugucucaagugcugagauaaaaggcauacacuacuacgcccagccaaugucuugcaaaauuuuaaugaucuuccccaguuaugacauuugcuuuauagucaugauacuaaaaacugauacuucacaaacugucugagacuguccuuauguauaauagcuauaucuauguaccccccuuccuacuucuucuguaacacuugucaaacccuaguuuaaucuccauuuccauauuuuguaauuucaagaaugucauaaaaugaagucauauacaugcauuuuuuugugcauguugaccuuucuuauuucaaauaacugaaauauuugaauugagacuaauucacagagaugcccuuuuuugauguugaacauucuuuuaaucuucuuauuucucauuuuuauauccuguuuguugcucuuccuauuuguguguuaugcuggggaccaaacuuauacaucaugcaugguugggaagcucuuuaccacugagcuacccacaagccccacugcugaguuugauuuuuuuuuuuuuuuuuuuuggugguauguguuugauaugaguguauauguucuuuuuuaggaauaauaauaguaauuuauuuaaauaaaucuacuugaguuauuauuauuaacauuaucaucaucaucauugguuuuucaagacaggauuuuuccugcauaguccuggguauccuggaacuugcucuauagaccaggcuguccuccaacucagagauccaucugccucugccuccugagugcuagaauuaaaagcaugcaucaccacaucugacuacuuuuauuaauuuuaaguauguauauaccugugugucugcauguaggcauguguacaugaaucuaggugcccuuggagacuuuuuaaagaugguugugaccugcuugauuugggugcugugaacugaacauggguccuggaagagcagucaaugcucuuagccacugugagccaucucucuagcuccaaguagaacaauuuuuaaagaguuuccuaaguguucuucauuaucaugagccauuuuauucuguaaaguuucauuuuuuuuuuccugcuguuccuugaucugucuuauagacaagauaacacuugugguuauuuuuagcuuggauauaaaacuaaucaguauaucucuauuggauuacuuuuuauauuuucuagggcuuacgaaguccacaaggcauaggauguuugccagaagcuguauguagucgaauuauuauugagagccaugagaaaggauguuucaggacucuuacugcugaacaaccacggccagacagcugccauugugcuuuucgaucuguugaaccuucagacuugauuagaggacaucggagcccaucaucauggagaggcaggcacaucaaccuuuccagaucaauagaacagagcaaucccuguuucaaaguagggaguuccuuucaguuacagagucaucccccauuucaaaaacuuuuaccugaugacaucaaaauuagcaaggguguuggaaugccaguccaugcauacauggauccccagccaucagaauuaguagaaccuacuugugugccagcuaaagaaauggauuuuccuuccucaucucaaauacugcccccugagcccaagaagcaguucacuacugccaucacuuuuucuucucacgaacacucugagugcauuucugauuccucugguuguaagguugguguuacugcagauagccaguguaguggaccaucuuuagggguauuuaagccucauauccccgaagagcagauuucuccuagagaucuuaaacagaaaaccucuuuccagucaucacuugaaaggcaugguucuacaccggugacuauuuuagcugaugguaguaggcaaaggcaaaaauuaccuguugauuuugagcauucucaucaaaaagaaaaacucuuacaaagauuagguuuuaaagucagccauucugaacccaaugucaguacaaauguuagcaauuucaagggaguucaauuuucugguaaggauaccauuguuagccaggacaaacuaacuucuacaguagagguaaaagagaagaauguaacuguaacuccugaucuuccuucuugcauuuuucuugaacaaccagagcucuuugaggaaagccacaccccacauacagaucuucagaugagaaaauacccuucucccucuuguccagaaauugcuucucgcauuuuucuugagcagccaaaacucucugaacaaagcaaagccccacauguagaucgugaaauaagagaagaucacucuuucuuuccuaagugccaggauuauauaguugcagacccuucucccgauuuuccugaucagcaacaaugcaaaccuccagacguaguuggccacacgagaaaacagaacucucuucuuucugaaggucaggauuaugaguuagaagagguucagcauauaccucagucauacuuuucuaauaugguaaauguugaagccaaggucagugaugcgaucucccagucagccccugaccacuguacagcugcaucuacuccaccuucaaauagaaaagcacuuucauguguucguauaacucuuugucccaagacuucuuccaaguuggauaguggaaccuuaggugaaagguuucauucauuggauccugcuucuaaaacaaggauuaauagugaguuuaacucugaucugcgaauuauaucuucaaggucauuggaaccaaccuccaaauuacugaccuguaaaccaguagcacaggaucaagaaucuuuaguuuuucuaggaccuaaaucuccacuggacuugcaagucgcacagucuucucuuccagauaguaagacuauuuuucaggacuugaaaaccaaaccuccucagaauagccagauaguaaccucaaggcaaacacaagugaacauuucacauuuggaaggauauuccaaaccagaggggacuccaguaucugcggaugggugagucacugugauaacaggcaaaccgauggaauuuguaacaaaggauuaagcaaucugaaagacuuugggguugggggagggcaaugugauuucuuuauaggagauugaaucuaacuggucugguagaggucuuaagagguauguaaguaagcgaauaugugaagguauuguaaacgugaaacgugaaguaacaugggaagaacuuuuuguaagauuugacaacagauguaagaaauuggaaacuuugaaaagaaccauuguucggcccauaguauauuuacuauuuauuuuuauauuggagauucucugaagauccugggagguagcagcauaaguguggagagauuuauuuuggccauaguuuuagagaggucaacugauguuugcuuguuucgauauuacauggcgacaagaggaugagguggaggagccgccaagaaaauacccacggugaucuaauuucucccaacuauuuccuaccuugaacaguucuaccaucucccaguagucuguuuauauuuugaauccaucaguaauuuaagcuaucagaguugucaugaucuaauuaaauacccucaaacagauccagucauuucucaaaacaguuaacuucacggucaggauuaaccuuauuucugcuugcaauuuuacucucuuuguauauaguucucucucucuccuuucuagcucaugauuucucuauuauauuuuguauuuuuuagagacuccuuuuaaagccccauaacuuuauaguauuguguuauucugacacauaagcacuuuagccagcccaccaguuaauguauaugguuuugauguuccuggaugagaauccucucuuaccucguguuacaggaauggaacuaaguucauggacagguuaauuagauuugucuuacucaagcuaguauuaguaauucaucgcugauucaguuuuaccuucauaagucuuuuuuaacuaaggagaaagaauuaccuguauguaaaugguugagaagguagcauacuacuucuucccagggcuugggaagaaagaaggaagaaguguuuauucaaaaucuaugggaggggaagagagggagagggagagggagagggagagggagagggagagggagggauauccuugagacauguuggccaaucagucuaaccgucuguaaaagggguuacgagcaaugacauccaguaacaaaucuggagcuuacuucaggguuuguaaauagaugaaauacuaugcugcauacaaaagaaaagcguuugggcuggagagauggcucagcgguuaagagcacugacugcccuuccagaggucuugaguucaauucccagcaaccacaugguggcucacaaccaucuguaaugggaucugaugcccucuucugguaugucuguguacucauauacauaaaaaaaaaaucuuaaaagaaaaaaagaaaaaagaaaagaguucuuuagagaacuggcugauucugggcuggagugggaguagggcaaaauccugaagucacugcucucagaaacugaguaacuuaagcacugaauuacaacucaaagugugaaagagauaugacugagucuacugaugcaaauaauuaaaagaggaauaaaugaauggacgaggugcaauacuucuuacagagaauaucagggauagaaguuucucuuggcugggcugggaauauacaguucaucauagugggggaagggacagugauggaaguggcaggaauuaugauggcaggaugugaggggaauuguuacaucucagccgaacagggagaagagagacuagggcaggaaguagggcugguuacaauuaccagcacccgcucccuagcaacccacuuccagcagugaggcaucacuuucuaaggguucuacagccucccaaaccagugcuauugucuagggcuagggaccuccuugauggcauuuuacauccaaaugcugaccuauuaacugucuuuagaccuuuaacugucuuaaaagacuuuuuuuuaauuaaaaauuuuauuauuuuugucauguauauauauauauguauguauguauguauguauguauauauauguauguauauacuugcaugcaugcauguaugcauguauguauguauguauaccauaaguguacagugcacacagaggccagaagaacuggaguuacagaugguugugacccaccauguaggugcugugaaccuaaucuggguccucuggcagagcaguaggugcuuuaacugcugaacucugucucaucccuuuagagacaucuuuaauuuuuuuuuucaugguugauugguuacccuggcagaaacgaaauagauuuauagucauuguuuucuucacaucaagagaauauuaaagaaaauuucucauucacacaaaaaaucucagggagaucuguccauaagcaggucuggcuggcaugcacaaagcaaaugaaguggauugagcucuaauagcuagaggagaagacaugugugaagggccuacauuuucuuacugguaagcaaagacuugcuugccaaccuguccagcuaaggaacuaaagugggaaaggcgggggaagucauaaaaaggaaauuggugaucaagcaucagaaacagagggaaacuauuauuguggguguuguagugauugucaucuacauccguaauucauggacuccugugcuaauaugauggagugaugcuuaaagauuucuacagcugugcucaugagaagcguucacucaccaguaguuuuccaguauugaacuggaauucuuuaugaaaguauugguagucugaagauuuggaaucaguuuuauguuugguagaauucaccaaugauauugucauugaugggguaguuuuuauuacuaguuuauuauuaauuuguuuaaugcauauggcuauacaguuuuuucuaguguuuugaaaaaauguuuuaaaauuuuuuuuucucuagccgggcagugguugugccuuuaaucccagcacuuggaaggcagaggcagguggauuuccgaguucaaggacagccagggcuacauagagaaacccugcuugaaaaaaaccaaaagaaaaaaccccaaaauuuuuauaaguugacaugugauauccuguugugacauuagcuuccccucacccccuuuucugauaauugguaaucuuucugugagguaauuauuguuaaggguuaaaaauugggguuuugguaagccucuuuagugguuuucguuaauuucuacucuuuugucauauauuuugcaucuuaauuuguuuuggguuuuuaccuucuuaagaguaaauaauguauucauauuuuuuuguuaauuuuagcauucuuuuguauuacauuuuuagagaguuuuuuuuuuuaauguaguuuucagguuuuucuuugucccauugacuggugcuauguguuucuuuuuucuuuucuuuucuuuucuuuucuuuucguuucuuuguuuuuguuuuuguuuuuguuuuuuuuuucaagacacgguuucucugacuagcccuggaacucacucuguagaccaaguuggccucaaacucaggccaccugccucugccuuccaagugcuaggauuaaaagugugcaccgccccugcccugcuggcuuuguguuuuuuaauuacauuguaaucacggcaguuacucggaagaaugaccucaguuacucggaagaaugaccucauucacucuauguaaacauguucagaauugcuuugugauguuuuuauuuugaccaacuuaugguugucaagauuguguguucugaugcugcuguguugagcagagaacaauccaguucggcugucccaugacuuguugcuguauuuccguuugcuauauuugucugcuuuuuagccaagacaugguaggcacauauugcaugguaacauauaaucacacuuccaagcaugauuuucucauuucuguccuucccuuaagagagagagagagagagagagagagagagagagagagagagagagagagagagaaggagagugcauuugaguuaaaaguuauggggaaguuguaaguucuccuuguacuuagucuuuuggggaguuagugaccugcccaaucacuuaacaugacacauuuucauuuccuaaaagauuuucuacauagugacaaugaaaacauccaggucaggaaauugauacuggaauuaauuacaagugucauucugacuucucuacuucuccugcuggugucuuuuacagcagaagaaauaauucaaaauuacauguuauauuaguuuauguguguuuaaaguccuuuccuuugaaacuguuucuucagugguuucuuguuuuuauuuguuuuuuuguuuuugagacugggucucucuauauagucuggguuauccugaaacucacuauguagcccaggcuggucuggaacacaaaggucuaccuucuacugcgucccaaauucugugacuuaaagaugggcucuacuacguccagcuuuaguacuuucuuaauauucauaagcuugaaguuuuuuaagauuucauaaaaugauuauuuugugaaauguucuuugaguuuucuuauaguugcauuucuguuaguuacuuuauguagcacaaauuauauugacuuucaucauuauaucauaacauguuacaaaguuuuaauuuguuacaugauugaaaaccaucacuugaauuacuuaguaagacuguagcggcuacauguuacuauuuuuaaguuauucuuuucucuacguaauuaaauauguuauaagauucuuuaaaguuauauaaauaucuuaguauuuagcaaauucagcuuauuauuuauaacuauacagaaucaugcuuucuuaucugaguggcuuaugacuguuuuuauuuuuaauucucucucucucucucucucucucucucucucucuucuuacucuaggccuugaagucacagaaaucugccugcuucucccuucuaaaugcuggaauuaaaggcgugcaccacacccagccucuuucuguucucauagaaucuucucuguaguucaggccugcuucagccuugucaucauccuuccugccucacauauugggguuauugugugugucaugagcccuggcuauugaugcugcuuugcuuuuuccuuuuuauuugaaauaaacacagaguaacaggaaaacacaaaaauaguucugagaagcugaaugugguggcucaggcaucuaugaagcugaggcaaaagaaggguugucauaaauuccaagccagcuuggccuauauauuaaguuauagaguaaaacuuucaagggcuggagagauggcucagggguuaagagagcugacugcucuuccagaggaccuggguuuuaauucucagcacccacauggcagcucauaccggucgguaacuccauaucuggcauucucacucagacauacauucaggcaagacaccaaugcacauaaaaaaaaauagaaaaagauguuuaaaaaauuaacguucaaagagauaaagccagcagugguggugaacaugucuaaucccagcacucaggaagcagaggcagguagaucacucuugaguucaaggccagccuggucuacagagcuaguucuaagacagccaaggcuacacaguaaacccuguuuuagauggguuaaugaucuucagcuaccaauuaaaaccugagaucuuuuuaaggccauccuugaccuuccuauauuaauagaguucuuauaucuucuauuauacucacuaguuauuugauacuuuuauaguaucauguaugauauuucuauauuuuaaauuuauaacuuuucugagaugaaaaauuuuaauggauuuuaaaguuuuuuuuuaucuuauaccuggcaauuuaaaaagucaguuuuauucucagguuauauaguauuuuuuauugguuauguacaugauauuuauggcuuuuuacuuuuugacucauuuaccuuuuuuucuauuucugcccacuauuucugcauaucacuaacaauuuacuaaaauguugaauaggaauguugaguugaaaccuuauuuuguugcuauauaaaaugauuauucacauuuuacucuuaggaugguuguucagauauaaaguuuuaaaaguuuuucuguguuuuggguauauucuucauuuuuucucuaaugcaacacacuauguuuccuuuccuuuccuuuccuuuccuuuccuuuccuuuccuuuccuuuccuuuuaaaauuuuuaucauuuuuggaguuagagaaaagcaccaccaaaaguagcuaaauuuauuuuugaaaacuuuauauacucgcagaauuccuuccaguaaucacucagcuucuccuauuuuucuuuuuuuaauuuuuuuuuuuuuguaauucaucuuuuacacuccauauuccauuccccgccccuccccauccacccuccgacugcuccacaucccacaucucccccguucccccccaaucuccgcauggaugccccuacacccuacccccaaccucuaaauucccuggggccucuagucucuucaggguuagguacuucaucucugaaugaacacagaccuggaaguccucuacuguauguguguuaggggccucauaucagcugguguaugcugucuguuuggugguccaguguuugggagaucuggggggcgggagguccagauuaauugagacugcugguccuccuacagaauugcccuucucagcuucuuucagcguucccuaauucaacagcaggggucagcugcuucuguccauugguugaguguguacaaauaacugcaucugacuuucaacugcuuguugggucuuucggagggcagucaugauagaucccuuuuugugagcauuccauagccucaguaauagugucaagcuuuggaaccuccccuugagcugaaucccacuuugggccugucgcuggaccuuccuuuccucaggccucucuccauuccaucccuguaauucuuucagacagaagcaauuaugggucacaggugugacuguggaagguucgacaagcuuuuuuugaaucacagaagcauucugaccacagaagcaaauauacuaugaagcuguaccauuagaaauaggagaugcucacaagggcacuucagcuuguugagccuuuugaauccuguggacuguaucuuguauaucaaucccacuugggagagagaagaaagcaaucacaaguguguguguguguauggggguaguggggacuugggaugggauggcaaacagagcaggccucuuccucuacacaaaaauaaaauucaaaauuaagaucucggcauaaggcuuaagccuuuaaaacuccuguaggaacguauagaggaaguacuucaagacaugggcacacauaggguuugacuuccuguggcuuaggagguuacagcaagaguugauagacuacauuucaaguuaaaaagcuucugcagagaaaggaaauauuaaucagaaugaaaagauagcauauagaaugcaagaaaaucuuuccaucuauucaucugacuggaacuacuaucugggaaauaguaggaacucaaaaaaguaugcaucaaaacucuuaucucccaaucaauaaauggaaagaaugagcaauucucuaaagaguaaguacaagugcucuauaaguauauggaaaaauauuugguaucuuuacccaucaggaaaugcaaaucagaacuaggcugagauuccauuucacucuagucagaguagcugauaucaagaaaucaaacaaaugcuggcaaggaugcaggggaagggggcaguguugguggggauauagauuuuacuacagcugguguggaagguaauguggcaauccuauaaaccaaaacuguaauaccauaugaucuaauucuaccaguucugggaauauaccugaggaauauaaguuuacuacugaagaaaacugaguaucugugcugacgacuguacuaucuacaaaagucaggucacaggaucagacuagauguucaacaggagauaaaugaauaaagaaaauaugcaaucuauaaaaaauggaguuuuagucagccaugaagaaaacugaaaugaaguccuuugcaggaaaaugaguagagguagagaucauuagcuaagcuugagacaugccagaugcaggcacacauauuacaucgaacuuucucucauacauagacucuauauuuuaaaacaauauggaaguuaagaaaauuaaugaagaacgaagaccaaaguguggauacuuugccacuucuuagaauugggaacaaaacacccauggaaggaguuacagagacaaaguuuggagcugagacaaaaggauggaccaucuagagacugccauacccgaggauccaucccacaaucagccuccaaacgcuggcaccauugcauacacuagcaagauuuugcugaaaggacccugauauagcugucucucgugaggcuaugcuggugccuagcaaacacagaaguggaugcucacagucagcuauugcaugggucacagggccccaauggaggagcuagagaaaguacccaaggagcuggggggaucugcaacccuauagguggaacaacaauaugaacuaaacaguacccccagagcucgugucucuagcugcauauguaucagaagauggccuagucggaaagagaggcccauuggucgugcaaacuuuauaugccucaguacaggggaaugccagggccaagaagugggagugggugggggagggugagggggacuuuugggauagcauuggaaauguaaaugaaauaaauaccuaauuaaaaaaaaagaaaauuagaugaaauaaucguuuugggaagggagaacuuauaagugaggaacuuggcugaaaucgcuaaguauugaagguacagcuuggcuuuucuuagauguugguuaguaaguaauagaguaagaaaaauaaguuuuuaaaaauguuaauuuauuuaacuuuauuauuuugcaugugcacaaaguuauuauuaauuagaucauuagcaacuuaacuagcagugguuacccugaauaaaauuaacucuuccacauuugaagcaccuaaccuucaagagacuggaggugccagggaguuuagaggucagguggggguuggagugggggcauccacguggagguggggugggguggggaggggugaggaaugaaauauggacuguaaaaaaugaauuacaaauaaaauuaaauuuaaaaagaaagaaauaggagaagcugagugauugcuagaaggaauucugcguguauauuuucucuuccacauucaucagccauuaauugccaguagcuucucaucaagaagugggcuguuauugcuggaauauugacacaucagaaccuguaugugucuuguguagguaccacagcugcugugagaguuuuacuacauuggccuuguuauauccaaaagacaguauuucagagcacugcucccauuuccagcuuuuacauuuugcccaccucuucugcaaugaaggaaacgauuuaaugauaaaauuuuaauaucaaaagaaguagagauuauuuguuggaaaauaucuaacauuucuguauuauaaaaaugagaaaguguguuuggcagagaacacuaguauaauggccaaguggccauuugauaaaguaaguauggaucagccagaucuguucuuauaacuaagaauacugaagaauauauccaaaggcaauucagauacuguugguguccuuccugcugcuaacccaaagugcagggacuuggggucauuauuucaaaggagacauuucaggucuuugugcaacuucugugcuuaaugcucagugcuguccuacagaucuucugucccauauucuaugucacuucacuucuucaacaucucagguguggcucuaggaccccagguaugugcuauacccagcaacauuguggugaagugauuuagagggucauugggagaaaccccaaaggcugccagagucacagggacgagaggucagaguuuuuguucaagauuauugauauuuccuuuucucucuuucccuuaugaaaugauacuguuguauuuuggaaggacauacuauguuuuaugucauugguucauaguuggagaacaguuugucugcauauaaauuguacauugaaucugccucugauaaagguaguacuuagaugacacucaggacuuuaccucaagagauuuuacuguaauguguuaagacuauagggauggaaugaguauauuugcaugugaggacaugaauuuugggaaccaggaacagaauguggugguuuaaauacuuaguuucuucaaaagucacauauuaaaaucuaaucccuacuacaaugguguuuggagcuauggcaucaacgaaguguuuagggugagagugagugccucaugaaugagcucaaugccuuuauccaaagacgucccucccaucauggacucauggcagcgucuaugaaccaggaaauagagguccucaccagacacauaaucucacugccucauuguccuucugagccuccagacugguaaucagugagcucugucuaaaggccacacagccuguggauuuugcuaugacaaugcaaguaucucucuagccuuuuucaguauaugacaauccuuuuuccuuccuuguuuuuaaauggacuuggcaauuuugaagaaugccagacauuuauuaaauagauccuccauucuaguuugauugauguuuucuugugauuagacugaagcuuuaaauuugaggaaagaauaccacaaaugaaauuuacccucacaucagauaggggaaauuauacccacaaguauagugugaugucaucuuugcucaguaaguagguggguuucucacuuuuuagguuguguuccuugagaucuagccugugcuuggggguuugggaguuggaguuaagccuuaccuucuuuggugaggggugugugcauguucuguggaauuuuucauaagcaaaacuagccuuccuacauguuuguuuaugcaaucauucauuuacuuuguuuuaacaugaauucucaauaaucuugacuaaauacacacagacacacccuuuagaacuucugguucugccggguaugguggugcaugccuuuaaucccagcacucgggaggcagaggcaggcggauuucugaguucgaggccagccuggucuacagagugaguuccaggcagccagggcuacacagagaaacccugucuugaaaauuaaacaaaaagaacuucugguucuaccauuaugauuccuuuaugagaagacuuuguuucauguuuaucuuuguguccucugggcauuuaauauagcuucuauuaauugucaaauuaaacaaauaaaugagucuauuaauuuuaacuaagaaguacuguuucuucaguuaaauuacauaaagguauuagaaauuaaaaugauuuuagaauaaauaauaaacauaugcuugaucccuuuuuacuauauauuuuacaaaaugaagaauacuauggaaauagguuguuaacaugcgagaucacuauacuuacaauugcaugguuacuuaaauauuccuugccaaagauaugaguuguuuugucuuuuuuuguuguuguuaguucacaagaacagaguaagguuuccuuuacuacguccuuuggaaaguuaucaucugaugccaucacucagauaacaacagaaaguccagaaaagaccacauuuucaucugaaauuuuuauucaugcggaugaucguggacagggcauucuagaccccauggcccaaaagccauccagguuugccucaucauccucagugcagcaaaucccagcuucucauggcaaagacgguaagaggauauaacugaauuuuacaucauuaaaccaaccuauguguaauuaucuuuaaaauguuaauugucuuucucaucauuaaaccuaauuuuaauaucagcauuaugcuauaauauuacuguauccaguuuuuguuugcauaccugugaaaagaauaggauuuucaucuuuauuuuaaauagaguuaauaagaguauaugaaauucaugcugcuauggcuggcugacuuuguccagugauuuuuguaaaaauauacuuagcauguaagaacuguuggcauuugguucauaguaauauggcuuuaacuguguauaguaauagcguauuucuugcuuaugaaauaaccaucugagccagguggugguggcgcaagccuuuaaucccagcacuugggaggcagaggcaggcggauuucugaguucgaggacagccuggucuauaagugaguuccaggacagcgagggcuacacagagaaacccugucuugaaacaaacaaacacaaacacacaaaaaaaccaguguguaugaaauaauuaucuguuauucaggaauguuguuugcuguauggaaaugugcauacaugugaaccccgacacaugugaauaagaacaugcacauguacacauaaccauauacacacauauaugaaaagaaaacaaaucuccaauggaugcuggugauacagcucacugaugguguauacauaucuaacaugcacauaccaguucguaucauuaccaaauauauaugcauucacacauacucuaacauacagguguguauguauuuucaguaguuuaaaauaacagacaugucuuugagccaguugaaguuuugccccaggugguaaaagcauuuucggugugccuccaaugccuguuucugagauucaggcuaugggacaauuugugucuugccuagaauuuguagcugucaugaugcuggcagaaccacaagaagggagaccuaacugaaaaaaauuuaaaccuacauuuauaucagaguucucuguguaugaauaggguaaaauuaauacucuucuuauaaaacagaaaaauugaauugaaacuuuuacuuuaugaugaguguauaaacagaagaaaaauauggauagagucuacaucaaacugaugauuuuuuaaagaauuauuuauuuuaaguauaugaguacacuguugcugucuucagaaacaccagaagaggucguuggaucccauuagaaauggcugugagccaccguguaguugcugggaauuguacucaggaccucuggaagagaagucagugcccuuaaccgcugagccaucucuccagcccccaaacugaugaucuuugaauagucagaucuuuuucgcuuuguuuuuacuuugaugucuuuuuaacuuuuuaaaaugccagauaacuugcuuguauauuuuaauuaacugugucauguauuucccaucucuagaauucugucuucuguugaaagcaaaggugaauuuauguuuaguucauucauguauuuuaagaaaugugagcacugccuggcaggugaaagguauugguguguauuuggagagucauugcuuucuuacuaacagcucugauauuuaccuucucagcccagccugugcuguuaccauauaagccaucugguaguucgaagauguauuauguuccacuguuaaaaagaguuccuucauaucuggauuccaaaucugauaccacuguugagagcucacauucagguauuaugcaaaaauuauucacgauuuuauuuuuagaaacacugugugcuggcugguugauaaugaaauuuuuuuagucaaauauggauguuuucaugccuuaagcaaccucugauucauaauaagugaguuauuugagacuuuguguaagagaaaaaaaaaaaggcuaaaauugaguugacagcugccuguguagguauuaaagccccuuuagaauaagcacagagccaaagacuuggaagacuuacugguuucaguuguuucaagcagucuucauauaagcauuagcucacuaccacacuaauccaguaggaacuuuaauggccauauacaaucaaguguagucuuuaccccugguucagaggcuacuaaacaacauaaaacaauaacaaauccugaggugggaguagaaugugacuuucacauuugguauauuauauuauuuaaguguccaccuugcaacaaaaauuauaaaggaaaaacacaagauacaauaugauccauacacaggaaaaaagugcuugaggaaucccagacauuggacuuacuacacaaauacuuaacuaauuaaaguguuuaguaaucuaaaugaaacaacuuuugaagaaccaaggaaaaauauaaaaacauugucuuaccagauaauguucuaaagagauaggauuuauuagaagggacuauaauauaauuuuugacuugaaaagcacaaauuuauuuucuagaggaacucaacagaugaaguucaggcagaagagacagugaaccuaaagauagguccauugagaugauucuguguggugugugagaaauagacaaaacagaaaaagaaauaaaccccagaguucuauagggcacuauuaaguugccuguggagggacuaaaaguguaauagaaauggugcgccuucucagugagaaucacugucugcuuagaaaugaaggaagcgcuuccuacuaacgcaucugauaaauaggagcuggcacugagcaggagacguccuaacuucuguacacuucagguguacgcauccuauagacagucaugcucacaucccugcccaggcuaugaugaaaacaguuucaauagaaacuagagacugcaagucuggccauuuaggcagauuugcacacgcaaaguuauuacauuuugcaagauuuauuuuaaauauaccagugcucuuuuucaaguaguugcuacccacuguugucuugcucacccccaaucauaagauuauuuuuguugcuacuuuauaaauauaauuuuacuacuguuauaaauaguaauuuaauaguuuuggagauagagauuucuggaaggggugagacucacagguugagagcagcugcuuuagaggcaugccuuuguugugagaauggagccugauggcagccggucaauaauacugaguaaacauuuacauuguggcauccuaaauuuugcuuauuccuaacagaccuugguagcacauaccaaucuuagauaauuuggaggcuaaauucuacuugaauaacuuaagcaaauuuauuaguaaguuccuuauuacugaguuucuucuacaucaaacugaaaagagagacagaaacagagaaaagaauauuugaacaugugaugacccuaaauuucuuaacuugaugagaacugaaaaacuuagaccuccaaguaggaaaaccacaggacagcauuuagaugugugaaucaaacuguccaaacccaggucagagagaggcucaagagcauucaaagagaaguaacucugcuagauuuuguuaucaagacacaucagauaagaucuuaucagaaaccuaaagcuuaggagaaacuggaaugagauccuuaaaguguugacagaaaugggaagcagagagagagggaaggagggaugaaggauuaggcaguaaacccagugaaaaccaaacagggaaacuguaccuccaccaagauucaauaucuagcaaaauuagucucuaaaacaaagagaacguuuacauaggagauuuuguuguuguuguuguuauuguuguuuuuuguuuguuuuuaauaacucuuggcauuuacccaaauacauuguuguaaauuaaagugcaaaugguaauucccaagacaagacaauuuuaugaaacaaccaaaaaaugcauaguaaaaaaaaauucaguauuuaaaggccauaguagcaaauauucuuuuuugaacagaaaaauuucacaggagagaaauugagaaacaaaccuagacauacagcuuuauuaaacaggaauaaaauggacuuaaguuuuacauuaccuguaauuaaauauuagugcauuaaaguauaagacagauaucagcagaguaguuaagacaugaucugacuauagucuaauuuacagaauacucauguuaaauucagaaacaaauaggacaaaaagaagauggaaaaaauuaugccauagaguuuagcuguaguaauauuaaaugaaguggauuuuaaugaaagcuauuucuaaaagacaaugacauuuuauacuuaaaaaaggauccaaaauccaucaaggaauaacauauauguaacaacauaaagaaaacgaaaguuuaaaaaaaaccuaacauagugggagaacugagcaauaaauagucugagccauucacagucauguaaucuaugaguugaugugaacaaaaugugugaaauaaggcuguguggugagaauuacagaguuguugauugugaauccauuacauacugcuaaaucauacacacauuuacauugguagccuuuauguuaugugaauaauauaucuauuaaacuguuuuuguuuuugugacaagguucuucuguagcccuggcuggccuugaaggccagaagagggaguuuaauacccuggaacuggaccuaggcaugguugugagccaccaugugggugcuggcuuccugaaaauguaaaauuugacuucacauuuuuuuuuuuuuuaagauuuacuuauuuauuauaucuaagcacacugcagcuggcuucagacacuuuucuucuguuuccggccccacucucuucaaucccacucgccccgggccaaagauuuauuucuuuauuauauguaaguacacuguagcuaucuuuagacacccuagaagacaguaugagaucucauuauggaugguugugagucaccaugugguugcugggaauugaacucgggaccuucggaagagcacucaguggucuuaacugcugagccaccuuuccaacccuugacuucacauuuuaaaaucuuuuuuuuuuuuauauuaacaaaggguuaaaauuaacaugaaagaaauugaauuggugaugugggcaguagacaacaugaugugagcagaaguaauauucagggucuaauuggaaguguuuuucucucaaauaaaauaaaauaaaauaaaauaaaauaagaacauaacauguagauugaaacaucauuuauaauuccaacagaaaucaauagcaagagacugaagugcauauucuacauuuuaacuuaaaaaucuuguaaaucuguaagauuuaagauuuuaaaacauuuuuauuuuauguguaugaguguuuauugaauguuuggacaccaugugugugcaugguucuucaaugcuguaagagggcauuagacccccugggacugcagugacaauuaugagcugucaugggugcaggaaauugaacccaggucuuggaagacuggccugugcucuuugacugcggaaccaucucaccagcuucuaagcuuaaauuguauaguuacugggacaagauuaucuuuuuuuuucuuaaaauaauuuauaaaugagcugaaaaugaucuguauuuagugaagaaagaauauaaaucaaguauuuguuacuuuaaugcauauucaucaaacaguauggccauacaaagaccuuuucugcugggcgugguggcacacgccuuuaaucccagcacucgggaggcagaggcagggggauuucugaguuugaggccagccuggucuacaaagugaguuccaggacagccagggcuacacagagaaacccugucucgaaaaaccaauaaaauaaaaugaaaugaaaugaaaugaaaugaaaugaaauaaugaaaugaaaugaaauaaaauaaaauagaccuuuucacuaauguauguaagcuggaaaauauaaccuauuccugaaaagcucacuggaagacucauccaauugaagacucaggucagugaacuacacauccaagacagaugucagugugaguguguguguguguguguguguguguguguguguguguaccaguaggaaauuguugggacagaggggaaacaaacaaaacaaaauugaagauauuuugggaugaaaaacuuaagaagaaaagccaauuuaauuuuauuuuugucuuuaacagaaagcaacuacuaaagggauuuuauuuuauucaagacugaguucuggcugugguucaauaauaauagaugcuuauccuguaggcaugaggccuuagguuugauuccuaccuaacuccuacucccuaucaaaaacaaacaaaaacugaggcuugauaauuaaaaaaaaauuauuuaauccuuuucaaaagcuaacaugauauccaaaauuuagguaacaaagaagaaauagaaaauuaauucaaaguguuuguuuaccaaagauuaccucaucaacacaaagguaauucacuguguguggggggguuguuguagggagucuuacuacaucacaguggcugacggggagcucacuauguagauuaggcugacuaaacucacuaagauccuccugccucugccccucuaguacuggguuuuaaggcauauuccaccaaugugggacagauaaguuauuuccagaccauauguaugucugauaaggaguuaauauccagaaaaauaugaaaaauuuacuacuuaaacaacaaaaaaccaaauaucuuugauuuauaugugcuugcagaaccuaaauccacauuagcuuacaaauacaugaagaggugcuuuucuuuuuuuuuuuuuuuuuuuuuuuuugguuuuuugagacaggguuucuguguagcccuggcuguccuggaacucacucuuuagaccaggcuggccuugaacucagaaauccgccugccucugccucccgagugcugggaucaaaggcgugcgccaccaugcccgacaaagagguacuuuuuaucagucaucacaggcaaguaugacccagagccauaacaggucacacagcacacuuguuagaaucacuccuaauuccuuuaaaaauaaacaaguguugauggaggcuaugaagaaaucuaagauggugcuggugggaguguaagugcuuggccauuguagaaaacaacauggcaguuuuucagaacuauaaacacagacuuuaccauacguuugaguaauucugcuucaaagaaagaaaaacaggaucucagagucaccagugaacucacuuuuauagaugaaaaagguggauucuauaugccugucacuaugaguagaugaacacaauguacuuagaguguuccuugggcuuugucaaccaacagcauucugauaugauacauuauuuguuuuguuuuuccuuaagauuuauucacuuauuuguuguauaugaguacacuguagcuguacagaugguugugagccuucaugugguuguugggaauugaaauuuuuggggggaccucugcucgcuccaguugucccugcucgcuccagucaacuccacuucgguugcucaacuccgcuuagcucagucccugcuugcucuggcccaaagcucuauuuauuguuauacuuaaguacacuauagcaucagagggcaucagaucucuuuacgggugauugugagccaccauaugguugcuggaauuugaauuuaggaccuuuggaagagcagucagucugugcucuuacccgcugagcuaucucaccagccuucauuauuuguuuuuugacuuggugaaucuuaaagcgguugauacauuccagucaaaugccauuguacguaguauaguacuuagcaagcaugcaugagagccuuugguucaauuccugaaccacugagcuacaucccuaggccuucuucugcuuuugguuuucguuuuaacuuuuuauuuucagacagaaucucaccuaguugccuaauauggcuuugaagcuguagacagucuuugaacuuuugacccucuugacucagcgucccaaguagcuuugaugaguguugacuuauucuucuccagagccucucagcucugcugccagucauucuuuugcucauccacugcaacugucagaaaauaucuguugcucucagcccagcugacauggucaccacucuugugggaaaaggguaguggacugauuguucauguugcugcuccugacaugugcucugcuauguaaaaggauuggugagaaugaccagaaauuagaguuggguugagcuacucuauauacuaacuuaaaauuauaaagaaggaacaggacauuaauuucuguuaaaaugguauaagaacuacuuuuauccuuuauugcuagaauuagaagcauaaaagaaaggaaacucuuggccaguaauaagcuugcuugagggguguguguguguguguguguguguguguccuguaauucacuguguagaccaggcuggcuucgaacucagcggcuugucugucucugucucccaagugguggaauuaaaggcauaugccauuaggccugguuuaagcauuuccuuuuuugagccauuucuugguugucauguguaucuaggaagaguaaugguccauuucuguaggagaacugggcaguugguagaagaaaggauaauaggacuucccagagauccaagaggcaagggcuagaaaacgauaacagguauacugagaagaugcaugucauauguagacuugauccagaaggguugguaggaaacuuggaggcaguucugaaaacguguuaugccuuauuuauauugcauugaaccaaugagacugguacuuucucagcacuuaguguuauauacauauuauuacuauuacaaauauauuaauuacacaauaauaaauauacaaggugugggauccuggaguagaaagacaaacuuugauagaauucuauagugacuauaagcuguaguuauuauaagcuuuuauauguccagaaauguuuuuugccuaucagauguaacaugcguaacauaucaguuucucuugucaguauauauacgaauguugaaauacacaaguuuaauucuuuugaaucuuugucagguaaauuauuucuuucaguuuuugucuuuuucuaauuucucuuuugguucuggggauugaacuuggggccucauacaggccauauauaaacauguaugcucuuuucucugaguuacaugacuagcucucauucaguguuuuauaauguuggacaaauuuuccuaagucaaagcuuauuaauuacuuuaugauuaaaaaauacucuucacugauguuauauuccauauacaguaaaauuuaugguauuagauuaggauuucauauguugcuguuaugauuaaguauucuuauuaauguauccuguugucuagccugacuacaguguguguuauuucuauacaugccuuguguguguuuguauagugccaucugacaugccuuuuugccuucauggucauaucagaagacaucccccaauccuuuucccuuuuaguagcuuuccuggauagcaguuauccccuuaacuaucacuguuccacuuuuugugucaugucuuacgucauuugcuuccuugccugguaauuuuaccauuuauucuacugucucugauuuucaguuugauuuauaccuucuaauuggccugcaacauuucuugucaugguguucuuuccauggaagugaucuaagggaagaaaaagucuuucuugacuaaaauaguucaagccuauuuuaguguuaauuguaaugcuuucucauuuuuacguaggcucaaaugaugcuauugccccagacuuuccaccucaaaugcuaggcacaagagacgaugaccucuccaacacuguaaacauuaagcacaaagaagggauuuauagcaagagggcugcaacaaaggggaaaaaccccucucagaaaggugaugcagguaaugagugaccuugcguguuuucaaauuuguuucuugaaccuuugcauuugaagugagaauaguguuguauuuauccauauucugguuugucagaaaaugagacccugaguuuaaucccuacaacggaaaaaaaaaaaaaaaaaagaugaaaagagaaauaaaaaaaaaacaaaacguuaaaaacugaaaggaauaauuuaccugacaaagauccuaaagaauuaaacuuuaaguguauuucaacauucguguguguguguguguguguguguauacacacacacacacacacacacacacacacacaacaacacacacauacugacaagagaaacugauaugcgugucacaucugauagguaaaccuccuuacugcuacauuaaguaacacaggaaagugaaauuuuagaauauuuaaaauacuucagagagguuggaaaacugcaaacuucauucucaacauaaauaaaauguauuuuagcuguuaaaaggcaauacuaagucaagcuuauuuugaauacaaauuaucagauaaucuugauuacaauucuuauggauuuaucucugucagauguugcaaagugcaauuuuagacagaaugugacaagaaguuaagaguccacaugauguuugaaauuuuauuauauuuuauuuuuugguaccaacuugugaaaauucaguuuugggcuuguugggaaaaauaucugaaugucuggcuacuuuuggugccccuuccucuaugacaguagucaccuucaguggggcccuggcuguuuccuacauacaggaucuccauucucauguuugcuucacuccccauccaucucagaucccaccugcuucauucagacacccaaucucucugcucaaagugcugaguuuucagcauuuuuccucuagauugaggacagucauuuucuaaaagugcaauauauuuaaaauugcaggaaaacccauauuucuaggaaugcacuguuaaaaaaacaaacaaacaaacaaacaaacaaacaaacaaaccaaaaaaccagaccaaaacauagaggcauagguuaauagguaaauagaugaacagacagcuagaucuucuauaaggaaauggagagugugucuucuuaaucuuagaaaaggaaaaauuuuauuaaacuggauuuuucuccuaaaacaaaacaaaaaguaaaaccagcagccauauagagaucuauuguuaaauaagguauguuagaguuaaaaauuccauaaaaucuaaacaguaaauaaaagcaaaucacagaguggaagugaaaauuaugcauucuauacaagauaugcauguaaaaaagaaaccaugugaagaagauacucaacucaauagaaauugggcaaaaagaacuggauaauuauuuuauaaaaaagauuauguaauaccaaaucauuguauauaaauuuucacuuuguugacaaucugggaauacaaauuaagauagcaguaguuuucuauacucauuagaaugucugaagugaaaagugcuauaauguuacaagugcagacuaagaugucauucacugcuagugagaguauaaauuaguauccugacuguguugcugaguuuugaaucuagcgcuucaauuaaacuuagacauccacuuuaucacugagcuauaccuuuaaccccauacaaauucuucaagcccuauuuguaauaguuccaaucuagaaaccacccgaauggccaauauuuguuuaguagaauagauaacuuguaguacuguugaaaucuuacuggcacagagaaaaggguaaauauauguaacuacacguaauaaacuuuacaaauacagugugagugaaggaaggaaaucucauauguuguauuauccauuuauacaaaguucagacaucuacgaugaauuuguucuauuuaaaauuggcuauuauauacucugguuuccucuucagguuguauaaauccuuuuuuuaagauuuauuuauuuauuauauauacaguguucucccugcaauuaugccugcaugccaaaagagggcaccagaucucagaucuuaugagucaccauaugguugcugagaauugaacucaggaccucuggaagagaagacagugcucuuaaccucugagucaucucucagugcccagauuguaucaaucuuaaaauuuuuauaagugucgaaaaaauuaggaagaauaaggacucuguaggcuucuauuuuauuucuuuucuuguuuuuuugagacaggguuucucuguauagcccuggcuguccuggaacucacucuguagaccaguuuggccucgaacucagaaauccgccugccucugccucccaagugcugggauuaaaggccugugccaccacugcacaguucauauuuuauuuguugaccuggggaaggcuaugcacauauugucugauaauuagugauaauuccugcauuucuaugcaaauauuuucuaggacaguaaaaucuuuuuuaaaagauaugcaaauaauaagguucuuagaaaugagccuaaaguacauacaaggcuaccauagagaaaauucuuaaauuacacugaaauuuauuaguccugcauaauuagagaauuauauaauaguaauaauuaacuugucauuugucauuaaucucugaauucauaagagaaccugcucuauuugucaucaaaacuauguagcuuguuaaauauuauuuguaaaggauuaaacagaaguguaggaggcagccauguugguaagacuuuaaggaugaagugucugacauuucuaggagauagaaucucacagcaaacauccuuauccucugacucuuacaguccuucuauccucuucugcagugaucccugagccucaggugcaggaauugaauuauagauggaucaguugggacugugcuacacaacucugcauucugaucaguugugguuuucuguaauggucccuguuguaaagaguuuucuuuaugcgaaaugaaaacuauacuuaccuaugggcauaguaaagagaaugaaaauagacauuagcauggaaggaaagcuuauaaggccucaaccuuagacaaagaacuacaggcaaccaaggaguguugaaagcuggagaaacagucuuccccagggaagagcacagcaacugguuaucaacacuaagugcucagcccugaaaacauacacauacaaguaacagaagaaugaguagguuauauuuauacauuuaggaauagacauacacacacacacacacacacacacacacacacacacacaccccuacccacccaccaaggaggguuuggugagagggaaaggaaaggggaaaauguuguaauuauauuauaaucucaaaagauaaaauucuuucuaaaacugaaaaaguauagcagagugugacccagaaacaaguuuaugaauauggaaacugaagugagauggugugccagccugugaagcuugaggauggacagcaggaguccuuagaaaauugauaacguauguaagaaaaaucaggucaauccugucugcacacugacagaaauguaugacagccacaugcaauaaaaagagaaaaauuuuagaguuuauauacccuuaugacucugggguaauugagaauuucauccuuucauugagacaagguuucauauauccuuggcugauuuugaacuugcaguacagcuaaagcauaacuccccaccuugugauacccuugccuccaacuccacuccuuucagcaggcaucacaggcaugugccaccauucccaagaauucccuuuuacgugguacuaggcaagcacucaaccaacugagcuacaucuucagucccccguucagaauuucuuaagcaagucacaugaaauauagauccaaggggauaaaguuauuaacaugaaaaucuuggcauauaaaagauauaaaauauuaaaagacaagacagagauuuaaaaaaagauauuuucagcuuguaaaaaucaaugugaaauguuacaggaaugcucacacugcugcuuuucaguauaaacaaauacacagaaaaagucauauguugaucaguugaugaauugauggaugaagacaagaauauugcauauauuaagcucacauauuaauauguccaaaucucuaucaaauauugugagaaggcauauucuuaaagguauauccaguguugcauauuuuauauaauagauauuuaaguuaagauuauaaauuauuaguauagauuauuaguaguagcauuuuuaaauauuaaugcaaugugcuaaagaaauuaagagaaaguccaguacaaaggcugcuauuauauauuguuucauuuuuaagccaaguuguuaauaccuuguuaagguccuaauaugaaaaauguuagaaagcuaggagaaaaaauuuaggauugaauuaauagcauuaaggacaaaaaagaaacugaugaguaaauaaagccaagguuuauucuuugauguauguuuuauugucuguuaacguucugauuucuuugagaaacacagugaccagggaggggaaaaauaacauaaaauauuagguuuaaaaguuauaaguacacgagacuaagagaaggcaguauguaaaaucuagaugguauaacuauuuuuguugacuauaugguauauuaauuagcccugcaauuaauuaaagcuuuaaaaaggccaaagagguucaaggaguuguuuaaaucuauauuuuuacuuugaaaaacauaauuugauucauguuuuucugguugcauccgacuauugguauauuuuaaaguguuuauuuaaacuggugucauccagaaagauguggcaagcuuucugguucauauuagaguuucccaagacagagucuaagaggucuuuuuucucucauuuauaaagggcuuggggguggcuguguguuugggagggguggauggauaggaggacugcuugccaauuauuuacuaucaacuucuucucucugggaucgaugguucuuuuuccagcggccccaguucaaaugccuauaacuugggaugagaaugucuuggacgaaaaccaagaagaggucaucaguagaggaguugugaucaagauggcaggaccugaagaaaugucaucccuggagaaggaccuugcagguagcugaaacagauauccucuguucuccuaaaaacauuaauuugauguuggcuauuggcuugcuguauguugguugcuuuuauuguguuuagauaugugucuuguaucacugaucucaaaaagacuuuuaacaugauuuuaucaaaggcuuuucagcaucuaaugagaugagcaugugugugguuuuuuccugcaguuuguuucuauguuggguuacguugauggguauuuguauauugaaccuccccagcauccugggaugaugccuaccugaucaugguggaugaugucuuuguguucuuggauucagauuucgaguauuuuauugaguauuuuuacaucaauguuuauaagggaaauuggucugaaauucucuuucuuuguugagucuuuaugugguuuaggcaucaaggugacuauuuucauagaaugaguuugguaguguuuuuauuuuguggaauuagcuuugaaaccaucuggcucugggacuuuuuuuuuuuuuuuuuuggcugggagacuuuuaaugacugcuuauauuucauuacggguuaauaggcuauuuaaauuguuuaucugaucuugauuuuacuuugguaagugguaucuaucaagaaaaucauuucggaucugcgggagccaucuugguuccgggacuccgcagaaaguagucugcacaggugagaguguggacuacagaaacuaacagcuucugggacaggcaagagccccagaacuucugaggcagugccauuuucgggcuccagacauccagccaucuucccggcuagaggacagguguccgccccgccugggaggccuuugccucaggaucugcggaagccaucuugguuccgggacuccacagaaaguagucugcacaggugagaguguggacuacugaaacaacagcuucugugacaggucaaagcaacacagauucugggaaaggaccuguuuugggccuucauccauacaccagauaacuuugcaccuucccuguaagaggagagcuugccugcagagacugcucugaccacugaaacucagaggagagagcuagucucccaguucugcugauagaggguaacaaaaccaccagaggaacaaucucuaaacagagacaacuauaacaacuaacuccagagauuaccagauggugaaagguaaacguaauaaucuuacuaacagaaaucaagaccacucaccaucaucagaacccagcacucccacuucgcccaguccagggcaccccaacacacccgaaaaacuagacccagauuuaaaagcauaucucaugaugaugguagaggacaucaagaaggacuuaaauaacucacuuaaagauauacaggagaacacugcuaaacagguagaagacauuaaagaggaagcacaaaaaucccuuaaagaauugcaggaaaacacaacuaaacaggugauggaauugaauaaaaccauccaagaccuaaaaagggaaguagacacaauaaaacccaaagugaggcaacgcuggagauagaaacccuaggaaagaaaucuggaaacauagaugcgagcaucagcaacagaauacaagagauggaagagagaaucucaggugcagaagauuccauagagaacaucggcacaacaaucaaagaaaauggaaaaugcaaaaagauccuaacucaaaacauccaggaaauccaggacacaaugagaagaccaaaccuacggauaauaggaguggaugagaaugaagauuuuuaacucaaaguaccggcaaauaucuucaacaaaauuauagaagaaaacgucccaaaucuaaagaaagagaugcccaugaacauacaagaagccuacagaacuccaaauagacuggaccagaaaagaaauuccucccgacacauaauaaucagaacaacaaaugcacuaaauaaagauagaauacuaaaagcaguaagggaaaaaggucaaauaacauauaaaggcaagccuaucagaauuacaccagauuuuucaccagagacuaugaaagccagaagagccuggacagauguuauacagacacuaagagaacacaaauuccagcccaggcuacuauacccagccaaacucucaauuaccauagauggagaaaccaaaguauuccacgacaaaaccaaauucauacauuaucuuuccacgaauccagcccuucaaaggauaauaacagaaaaaaaacaauaccaggacagaaaccauacccuagaaaaagcaagaagguaaucccucaacaaaccuaaaagaagacagccacaagaacagagugccaacuuuaauaacaaaaauaacaggaagcaacaauuacuuuuccuuaauaucucuuaauaucaauggacucaacuccgcaauaaaaagacauagacuaacaaacuggcuacacaaacaagaccuaacauuuugcugcuuacaggaaauucauuucagagaaaaagacacuaccucagaaugaaaggcuagaaaacaauuuuccaagcaaauggucugaagaaacaagcuggaguagccauucuaauaucuaauaaaaucaacuuccaacccaaagucaucaaaaaagacaaggaggggcacuucauacucaucaaagguaaaauccuuuaagaggaacuaucaauucugaauaucuaugcuccaaauacaagggcagcuacaaucauuaaagaaacuuuaguaaagcucaaagcacacauugcaccucacacaauaauaguaggagacuucaacacaccacuuucaccaauggacagaucauggaaacagaaacuaaacagggacacagugaaacuaacagaagugaugaaacaaauggacuuaacagauaucuacagaacauuuuauccuaaaacaaaggauauaccuucuucucagcaccucaugguaccuucucuaaaauugaccacauaauuggucacaaaacaagccucaacauauacaaaaauauugaaauugucccaugcauccuaucagaucaccauggacuaaggcugaucuucaauaacaaaauaaauaauagaaagccaacauucauguggaaacugaacaacacucuucucaaugauaccuuggucaaggaaggaauaaagaaagaaauuaaggacuuuuuggaguuuaaugaaaaugaagccacaacauacccaaacuuaugggacacaaugaaagcauuccuaagaggaaaacucauagcucugagugccuccaaaaagaaacuagagagagcacacauuagcagcuugacaacacaccuaaaagcucuagaucaaaaggaagcaaauucacccaagaggaguagacggcaggaaauaaucaaacucagggacgaaaucaaccaaguggaaacaagaacuauucaaagaaucaaccaaucgaggagcugguucuuugagaaaaucaacaagauagauaaacccuuagcuagacucacuagagggcacagggaaagcauccuaauuaacaaaaucagaaaugaaaagggagauauaacaacagauccugaagaaauccaaaacaccaucagauccuucuacaaaaggcuauacucaucaaaacuggagaaccuggaugaaauggacacguuucuagacagauaccagguaccaaaguuaaaucaagaucagguuaaugaucuaaacaguccuauauccccuaaagaaauagaagcagucauuaauagucucccaaccaaaaaaaaagcccaggaccaaauggguuuagugcagaguucuaucagaccuucaaagaagaucuaaucccaguucuucacaaacuauuccacaaaauagaaacagaagguacucuacccaacucauucuaugaagccacaauuacucugauaccuaaaccacaaaaagacccaacaaagauagagaacuucagaccaauuucccuuaugaauaucgaugcaaaaauccucaauaaaguucucgcuaaccgaauccaagaacacaucaaaacaaucauccauccugaccaagucgguuucaccccagggauaccgggaugguucacuauacggaaauguaauccaguauauaaacaaacucaaagacaaaaaccacaugaucaucucguuagaugcugagaaagcauuugacaaaauccaacacccauucaugauaaaagucuuggaaagaucaggaauucaaggcccauaccuaaacaugauaaaagcaaucuacagcaaaccaguagccaucaucaaaguaaauggugagaagcuggaagcaaucccacuaaaaucagggacuagacaaggcuguccacucucucccuaccuauucaacauucuacuugaauuccuagccagaguaauucgacaacaaaaggagaucaaggggauacaaauuggaaaagaaguccucaaaauaaucacuuuuugcagaugauaugauaguauauauaagugacccuaaaaauuccaccagagaacuccuaagccugauaaacagcuucaaugaaguagcuggauauaaaauuaacucaaacaagucaauggcuuuucuccaaacaaaggauaaacaggcugagaaagaaauuagggaaacaccacccuucucaauagucacaaauaauauaaaauaccuuggcgugacucuaacuaaggaagugaaggaucuuuaugauaagaacuucaagucucugaagaaagaaauuaaagaagaucucagaagauggaaagaucucucaugcucauggauuggcaggaucaacauuguaaaaauggcuaucuugcuaaaagcaaucuacagauucaaugcaauccccaucaaaauuccaacucaauuguucaacaaauuagaaagugcauuuggcagauucaucuggaauaacaaaaaaccuaggauagcaaaaacucuucucaaggauaaaagaaucucuaguggaaucaccaugccugaccuaaagcuuuacuacagagcaauugugauaaaaacugcaugguacugguauagugacagacaaguagaccaauggaacagaauugaagacccagagaugaacccacacaccuauggucacuugaucuuugacaagggagcuaaaaccauccaguggaaaaaagacagcauuuucaacaaaugaugcuggcacaacugccgguuaucauguagaagaaugcgaauugauccauuucuaucuccuuguacuaaggucaaaucuaaguggauuaaggaacuccacauaaaaccagagacacugaaacuuauagaggagaaaguagggaaaagccuggaaguuauggguacaggggaaaaauuccugaauagaccagcaauggcuugugcuguaagaucgagaauugauaaaugggacaucauaaaauugcaaagcuucugcaaggcaaaagacaccgucaauaagacaaaaagaccaccaacagauugggaaaggaucuuuaccuaucccaaauuggauaggggacuaauauccaauauauauauaaagaacucaagaagguggacuccagaaaauuaaauaaccccauuaaaaauggggcucagagcugaacaaagaauucucaccugaggaauaccgaauggcagagaagcaccugaaaaaauguucaauauccuuaaucaucagggaaaugcaaaucaaaacaacccugagauuccaccucacaccagucagaauggcuaagaucaaaaauucaggugacagcagaugcuggcgaggauguggagaaagaggaacacucuuccauuguuggugggauugcaagcuuguacaaccacucuggaaaucagucuggugguuccucagaaaauuggacauaguacuaccagaggaucccacaauaccucuccuggacauauauucagaagaugucccaacagguaagaaggacacauucuccacuauguucauagcagccuuauuuauaauagccagaagcuggaaagaacccagaugccccucaacagaggaauggauacagaaaaugugguacauuuacacaauggaguacuacucagcuauuaaaaagaaugaauuuaugaaauuucuaggcaaauggauggaccuggagggcgucauccugagugagguaacccaaucacaaaggaacccacacaauauguacucacugauauguggauauuagcccagaaacuuaggauacccaagacauaagauacaauuugcuaaacgcaugaaacucaagaagaacaaagaccaaaguguggacacuuugcuccuuguuagaaaugggagcaaaacacccauggaaggaguuacagagacaaaauuugaagcugugacgaaaggauggaccaucuugugauugccacauccagggauccaucccauaaucagcuuccaaacgcugacaccauugcauacacuagcaagauuuugcugaaaggacccagauauaguugucucuugugaggcuaugccggguccuagcaaacacagaaguggaugcucacagucagcuauugaauggaccacaggcccccaauggaggagcuagagaaaguacccaaggagcuaaagggaacugcaacccuauagguggaacaacaauaugaacuaaccaguaccccggagcucuuuucucuagcugcauauguaucaaaagauggccuagucugccaucacuggaaagagaggcccauuggacuugcaaacuuuauaugccccagcacaggggaacgccagggcccaaaaggggguguggguggguaggggaguggggggaguggguaugggggacuuucgggauagcauuggaaauguaaacgaggaaaauaccuaauaaaaauuuuuuuuaaaaauuccaaaaaaaaaaaaaaagaaauucauccacuuuuuuauauuuuccaauuuuguggagaacaggcuuuuguaguaagagcuaaugagucuuuggauuuucugcuguuuuaaccccucccccuuucauuucugguuuuguugauuuggauaaugucuuucugccuuuuaguuuggcuaaggguuugucuaguugauuuuuuuuuucuucaaagaacuagcgccugguuucauugauucuucauguuguucuuuuuguuucuaauuuauugaucucagcucuuaguuuuauuauuuccugcuaucaacuacucugggguauguuugccucuuuuuguuguagagcuuucagauaugcuuuuaaguugcuaggaugagauuccuccaauuuuuucauggaggcacuuagugcuaugagcuuuccucuuagcagugcuuucauugugucucauaaguuuggguauguugugccuucauuuucauuguauucuuaauuuauuucuuacuugacccaguauucauugaauagugaguugacuugguaggcuuucuuuuuguuguuguugaaauccaugguguucugcuaggauacaacgaguuauuucuguuuucuuguauauguugagacuagcuuuaugaucaaguauauggucgauuuuggagaagguuccaugcggugcugagaaggcauauuguguuuggaugaaguguucuguagacauuuguuagguccauuugauucauaaucuguuucauuauuucucagcuuagcuucuaucuugaugacuuauccauuggugagagugggguguugaagucucucacuauuaaugugugggguuugauuuuuuauuuaagcuuuaauaauuuuuuuuaugaaauuggggcauagauauucauauugggggauuuuuuuccuucgaguaugacauguccuuucauaucucuugguuacuuuugguugaaagucuauuuuauuagauguuagaauggcuacuccggcuuguuucuugggucuuuuuccagcccuuuacucugagguaaucucugucuuugcugcugugguguuucuugugugccgcagaaugauggauccuguuuacacaucuagucuguuagccucuguguuuuuauuggugaauugagucuauugauguugagagauauuaauuaaugaccaaugauuguuaguuucuguuauuuugaugauguuggugugcauguauguuucucuuauuuugguuuugcugguauggaguuaaucuauuuuuguguuuucuuuggugcgguuacuccccuuguguugaaaauuuccuucuaguauccucucuaggguuggauuaguggaaagaauuuuuuaaagcuuuuucauggaauaucuuuuuuucucaauggugauugaaaguuugcuggguauagaaaucuuggcucacaucugugaucuuuuagagacuguaagacaucugccaggcucuccuugcuuuuaaggucucuguugagaagucugguguaauucuaauggaucugccuuuauuuacuacuuggccuuuauccccucuggcuuuuaauauucauuguuuguucuguacauuuaguguuuugauuauuaugugacaggaagauuuucuuuuuuaguccacucuauuuuacguuccguaggcuucuuguacauuuauaggcaccucuuucuuuagguuagaaaaauuuucuucugugauuuuuuuguguguguguguuuguuuuguuuuguuuuacaagacaggguuuccuuguguagcccuggcuguccuggaacucacuuuguagaccaggcuggccucgaacuuagaaauccgccugccucugccucccaagugcugggauuaaaggcguguaccaccaccgccuggcuaaaaaauaccugaauucuuuguuguucguucuuuuuuuaagauuuuauuuauuuauuauauguuaguacacuguagcugucuacagaucucauuacgggugguuguaagccaucaugugguugcugggauuugaacucaggaccuucagaagagcagucagugcuguuaacugcugagccaucucaccagccccucuuaugugauuuuguugaagauauuuucugggccuuugaguugggagucuucuucuauucuuauuauucuuagguuuggucuuuugauagugucccaaauauccuaaggguguuuuguguuagaaaguuuuuagcuuuagcauuuucuuuggccaguguaucaauuucuucuauuguaucuucuaugccugagacccucuuuuccaucucuucuauucuguugcugaugcuugugucuguaguucauguucucuuuccuagguuucccaucuuuaggauugccucagauuggugggguuuuuuguuuguuuguuuguuuguuuuguuuuauugcuucuauuuccauuuucaggucuugaacaguuuuauucauuuccuucaccuguuuaauuauaguuuccuguauuguauuuuccucuauuucuuuaagagaugcuuucauuucuuuuuuaaaggucuauaucuuuauaauaucauuuugugauuaagaugcguuaggauauucaggguuucgauaguaggauagcuggguucuggugguacuauauugccguggcuuuuguugauuguguucuuguacuguucagccaucuaguugucccuaugguuuggcaggccugauaguccuugauggaaguaggccucugugguugcaaguagagcugguuguaccugguggcaguuggcuucuaggaaugcaagcagagcugauagaccccugauagcuucaggcuccugguuauccuguggggacaggccucuugggauaaagguagagcugauggucccugauguuugcaggccucuguuuguccugggcaguagcaggccucccgggaugugggcagaguuguuucucuggaauuagaaugcaauggggcagggcagaauucaccacugcuggguuugcccagaggggccagaaggcagagaguugggauagagggucccaccugguagucacuaauggaugcaugugucugagauauuaguuagagguguggaccagaagaucaagucuggggcuuagguaacucacuugguuguuccugccagcaccaaggccuccagccacaauuuuuuuuuuuuaaaagauaaucuuacaccauuguuguacuaaaaguguuuacucuuuagaaauuuauuuuauuuacuuuggaucuauuguguuuaucuuacuuuaauaggauuaugcugaaauugccugugguagaguguuuaauuuagggucagcuuugauuaaaaaccacccuaaaaugacaagauuuaaagaagaaaacauuucucauucuguauuguugauauuucugaccuugacucuauagaaagagaaggcauauucuuuaguggagcuucucagaaauuucacucccuuuuugucguagaggccagcuugagucgugugaucucaucaaguuaucaccaaggaggugagauuauucugguaccaugcucagcucuugcagaggaagaagaaaguguauuaggggauggguguuaguuaggccacaguacggacaagagagguuuuacagcagaagacacuuuucuuucuuacacaccagcuuucucuuuaagauuuuagacuuguauucugggaaacacuccagaaugauaccguguuuuuuuuuuuuuuuuuaauuguugcaaaaugaaugucccugaaacuguuuugccuguuagucucuugaugcauuucagucuucauugucuucgggaauaaaaucguaggucuuuuagcagucuuccagaauguuaggaugagcuccaaaacagccuuuccugcucugguuuccccuuguuuccuuauuagaugcugcagucuguagauauuuaguugcuuuccugauuccucucuuguguuacacagccaccuuugcuuucagugacuucugauuuccauuucaaaauguuucccaucuugagagacucaaguguguugucuagaguauucuaugguacuguuugcuagaauuuguuuuucuuugagcacuuaauaccuuuucaucuaucucauggugauucuuuuuuuuuuaacuuuuaaaacagauauauuagauguuuuuaaucaauuuuauuuuaugaguaugggugcuuugccuauaugucuguguguaccacuugcauaccuugugcccguggaagucagaagaggaugucagaugcauuggagcuggagucgcagauguuguaggcuaccacaugggcuagaaacugaacucaugcucggcaagagcagcaagugcuguuaaccgcugagcugugucuccaccccugaugaugauucuguagcucuguacgacaugcuuguguaaauguacuuuuuuauuaacauuucccauuuuuuaaacaaugguaucgauauuuauguuuuccgugccacuaacaauggcuuucacauauuaaaaaauuagaagguuuuuauguauuuacugcauucauuuuguucucuuaggucccagugauaucacuguacaagacagaaaaacugaaaaucugccagacacuaaauccauuaaacagaaggaaggauccuuagagauagguaaugcaguauauguuaguaugugugccugagugcuagugcuuguguuucuggaucauucugacaaaaauaaaaugcuuuucuauuuuacuuaugaauaucauuucaauacugccuccauucucaguucagccaacucucugcagaaaauauuuugaaaaaaaguuaucauuuuugaccauguauagauuucuuuuuugucauuacuuuccacagauagcauaggauaaugauuauugacuuagcaguuacuuuguuucucguguugaaagcaauccagugacugcuuaaaguauagaagcacccaugcacaugcguaugcaagugucauguaaaguaguuggcaucugugagacguccaggaaccacuuccaccauacacugagggacgacuguaccccaaggcugcugcugcuggaagucuuaguucugaaucauggauaccugaagcuacucuggaauaaugagaaacaaggauagcaucaauauguaacaguaaaaagccaaauuaaaucaauuuauauauuuuuggcccuaauauuaugauaaaagagaagaacauacaaaacauaaaccauuauuauucagcugucaaauuuuaccuguuagaaaauaagaauuuccauguaagaggaaggagcagaagagagaguucuacucacacuguuuucugaaaaguuuccauuaacuacucacauauagaauguauaaaaccaguguuuacuaaggauauaacugcuaugcagugaggaaaggauaggcuuuccaacugagaguauagaaaaacuggauaaccacauuaagagaauaaaguuaaaucauuacauaaaacuuacaucaagaagaauuagagauauaaacacaagaccugaauuccaaaaacugguagaagacauaaaagaaaagcuucaagaaacuguauuugguaaucacuuauuugcaugacagcaaaagcggucauggacaagugaaacugaagcaaggcuucccaaaguauuugcugagaguuaaacauagaauuuauaaggagcaugugugccuugaaaacaaaaaacaaaccugacuuaaaaguguacaaggaguuaaacaaauaguucuccaaagaaaauagacauaacucaagaaaauauguaauacacucaacuaauugaagagaaaugcaguucaaaaccacaaggaacuaacaacucacacuauguaagaaaagcuaccaaaagaauuguuaggaaaaauaaggaauuccugcaucaccggcaagaacguuguacaaccaauuuaagcuuauccccgacuagcuuagaaauaaaugagccucagacuaugguuauuuuauuuggcuuugacaauuacugggggucaccccuaauauuuucuaauugcuggccuggcuccuuccccagugauguaucccaaguauuugcuguuuccucuggccaugugcucaugguaaccacuucucauggugccuucuugucugucucuucagggucucucuucucuuccucucuucuccacccccaccuggaaacucaaaacccaccuaccucuaaucccucuaguaauuugcuguagcccguuuuauuuaaccaauaguuuuaaauuaagggacaagguuugcacagcaaaggcuuguaaacaugagaauuccuucauaggccuaacccuuuggguacagaauuuaagcauuacaacacauaguuacagaccaaaccucagcaaaauguaaaaugguauaguuuuucuggagaacaauuuauucucucucucucaaaaaaaaaaaaaaaauuaaacaauuaccauacaaauguagcaaucccacuuuggggcauauauucaaaagaauuuaaaaccagaucucaaacaucacacauguuuauuauaguuauuuaucauaaccaagagguaggagugauccaguuguccaucagauaauuggauaaggaaaaagugaauucuuggucaaugaagaguuuucauagagugcuauaugcauguaauacaagcacucugaaagcagagcaggaggauuacaaauuagaggccacuguaaucuacauagucaauucaaggucauuauagaauacauaacuagaccuugccucaaacaaaacaacaauaaaaaaugugacuuauauuuuaaaaugguuauuaugccuucuucaugaggaaauugucagugugcuauaacauggauaaacuuuguaaggagauacacuaagccaaauagcccagccauuaagguugauuuaaugcuuugauccucuuguuaguaccaaacugacuugauuacuguugauucaugguaaaguuugaucuaggauguguuggacuuucaacuuuauuuuaugggguauauauauacacacaugcauaggguguuucuguguguauacuuauguauauuauauauguauuacauuauauaaauugcuuuucuuuuugauguagugaguagucauacugauaguuaaaaccacuuuuauuuuaguuucuuuucuauuguugugauaaaauacaagcaaggcaacuuaaagaaggguuuauuugggcuuauguuccagagggauaggaggccgucaugaucaugguagggaaguguggccacuugguggguguauuagucaggguucucuagagucacagaacuuaaggauagucucuagauaauaaaggaauuuauuaaugacuuacagucggcagcccaauucccaacaauuguucagucgcagcugugaauggaaguccaaggaucuagcaguuacucagucucacgcagcaagcaggcgaaggagcaagagcucgagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccggacuguaguucauuccaaauauugucaaguugacaaccaggaauaaccacuacaauccaccccuugucaacuugacacaaauaauaucucauguucacaugaaacaauaacaagguuguaaauacgccuaacaugauauaacuaucccucguacaaucgcaaacgcauuaguaaauuuacaaugggcauucauauuacuuuauaauccucguuucugcaacugguuacguggccuuaauugguauuuauaacuaccuuccucuacuacccauucuguauuuccuucaccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccugcacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaaugaaauguuuguuguagcuccugguaggagcacuccccucucuggagccaaaacuucuaagccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauauacugccuucugaagaacucugccccagccuuccaagcuguuuuucaaagggagaauaguugucugcagaugauggcagagcuuugcuccaaaaucccaaaggucuuuucugugauucaccuacaggggccugccagaggcuccaaacagcaucucuaucagccacagacaccucaaguaccaucggaucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauagacccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaacgaaacuacaucugguacagcagcugcaauuggaguuacuaccugauuuaguuuucgauaaucaacugucauucuccaugauccaucuguuuucugcacuggccagauaggagaguuaaacagagauguggugggaaccaccaccccugcgucuuucaaguccuugauaguggcaguaauuucugcaaugccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccuucccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucagcggaaccuggccaccccuucauucaagggguucuggaucugcaaacugucucaagucuggaaauugauucacuggccgagauugcuguuuaccacgaucuaauguagccuuucuuucauuuggcuguuuaccacgaucuaauguagccuuucuuucauuuguuugagaauuuuucugcuuauacagaucaaacaaauaugcaguaggcuuccuauguauuucauuccuggaaacaccaugauugguuagccaguaccaaagguccaaccgagucaugccauuauaaauuucaccucuccugugcugaccauuacuggguauguuauuauaaacauucuuuugucuacgcuguccauuauaauaacuagaaucaccuugucucgggcgauucaaugcugccaccuggcccuuguuaccucggaauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccauggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagcgaauuuccucauggacuacacuuucuaccuccccucuaggagccuguuuugcuuugagucugguuacaggucuagaagaaacuauuggugggccgugagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccaucccauguuguaggaucccauucuuugccaauuagagcccuuacuuuaacugucgacacacucugaggcugagacuugaauuuucgcuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauaguugaaagugcugguggaucaacaagccaauuccagaauuuuaaaagauucauccuuguacuucuguuacucuagaaccacuccugguaccaacuucuguauuagucaggguucucuagagucacagaacuuaaggauagucucuagauaauaaaggaauuuauuaaugacuuacagucggcagcccaauucccaacaauuguucagucgcagcugugaauggaaguccaaggaucuagcaguuacucagucucacgcagcaagcaggcgaaggagcaagagcucgagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccggacuguaguucauuccaaauauugucaaguugacaaccaggaauaaccacuacaguggggaaggcagguauagccaagagaacagcaaacuaugaugugaauuuuaaaugagugcgaauaggaagcguacagaaugaauugugaaugguguaaggccuugaaacuucgaagcuuguccccagggauauacuguaucuagcaaggccacaccuucuaagccuucuaaacagugccuccaauaacaaccaaauauuuauauauucauaggggacaaauauucauaggggacauucccuuucaaaccaccacaacacacacacauagcuauuuuugcuagguauccuuuguuacauguuuauguuugugcuagacaugcuuaguuucaguuuauuuacuguagguacauaaaauucaaauuauaaacacauauuuuuaucuugaaaccuuacugagaucuuguauucuaauuauuuuuauggcuuucuuaguaaaggcuagaauggaauucaguuaaagacauuuaaaaauuaaggugacugacuauacaucaaagugaugcauaugauacauagauaugaauugauugagagaaaucauggcuugaaauauaaaucuaagaguagauauugacacugaagugauuaaaaaaaacccaugaagacuggcauuugugucuuugaaagggaauuuagugcaugagcacacucuagauaagaguuggcucuaugaagagaccauuggucacauagagcuauuauaauuccguaguaauguggagagaaugguuugggaaagagaacagggaaauacauguuuucuacguuagcagcucaguugugaagaggaacagaggcaugaaugguccagcaaucagggaugaaauuugaaugugguucagagaaccacagucagccuaguaaacuauaacaugugcuuguauucaacaguacguacugugauacggaaugaugauugcucaaaagugaggauuuaaauuuuuuuuuuuuuuuuuacuucacccacuuaaugcugaugaugaaaccucaagguuuuuuguuuuuguuuuaagcuggaaauaaccaucucugucuuacuagcaggaugcaauuuuguuuuuuaaagauuuauuuauuuauauguaaguacacuguagcugucuucagacacuccagaagagggagucagaucuccuuacagaugguugugauccaccgugugguugcugggauuugaacuccggaccuucggaagagcagucuggugcucuuacccacugagccaucucaccagcccugcuauuuuuuaaagaaagaacauauacagaaaguugccuaaauagaauaagugguggauuuacaaagcaacuaacuaauuauaguguagagaacuaaaggggcugugcuugaggucaucuuugucacaugauuguagaguucaauccauauauacauuuuuuuuuuuuugagacaaaguauucuuggcuguccuagaacucacuguguagacuaagccggccuugaacucacagauguccaauggcuucuguacucucuaguacuuggaccacuuguuuuucauuuuugauauaggcuaccaaguaauuuguucaggcuggccuugaauugguuguguagcagagggugaccugaauccugaucauucugucucaauauucugagugcugggauuguaagugcaguuuagagcaugcuaggaauuuaacccagcgcuuugugcaugccaggcaagcacuuuuagagcugggguccagucccagaucugucauacagcauuggaguuuauccaaauccuuauauuuugacucaugccagucugauuguuaagcacauguucuuugucuaaagaaaaagcagaacaguauuuauaaggaaauacaaauauuucuaaauucuuucaaaaaauuucuuuucuuuuuuuucuucagaaucugaaugucauucugcauuugaaaacacugcucacucugucuucagaucagccaaguuuuauuuccaucauccagugcaccugccccaugagcaagacuucugccaugaaucuuugggaaggaguguuuucaugcaacauucuuggaaggauuucuuucaccaucauucaggacacagcugccuuccucccccuggcccaaguucggacaaguuggacaagaccaagauggauuacaccagaauuaagagccucagcaucaacuugaauuugggagagcaugagaaaauacauacuaucaagaaucaggccagagacccaaaaggcaaaagacaagcaaaugagcaaaagaaggaucagaaggucaccccagagcuaacaacugagugccccgugaguuugaaugaacucuggaacagauaccaggagcgacagaagcagcagaauccaucuggugcuugugauacgaaagagcucuccuugguggaacgacuugaucgcuuggcuaaacugcuucagaaucccaucacacauucacuccgggccucagaaagugcacaggaugauagcagagggggacauagagccagggaguggacugggaggaggcaacaaaaacagaaaggcaagcaacacaggaaguggaguaagagccuagagaggggccagaguacaggggacuuuaggaaaagcaaaguguuuucuccucaucaaggugggaaauccagucaguucaagauugagcagauuaaacuagauaaguacauccugaggaaagagccagguuuuaauaaugucagcaauaccuccuuggauucuagacccucagaggaaagcgugucucucacagauagucccaacauuuuuucuagcacggauucuccuguggacucagauguauugaccccaacugauagggacaugccuuuaaaugagaggagcagcuccauauccaccauugacacaguccgguugauccaggcuuuuggccaagauagacugucuuugucgcccaggcgaauuaaauuauacaguacugucacuagucaacggaggagauaucuggagcagccaugcaagcacaacaggaaggcauugaacacagccuguccccaaaugacuucugagcacagcagaaggaggcacauccagguacacggcuacaaauuccaacuggcaaugugacugccuuuuuuugaggacguuuuaguuaaucucuucacaacagguggaagaaaacagccauuugcccuuuccucacuaccucuaacguuucuccgagcuggaaaagagugagaaaguguaguccagugcuaucguuuguugucauucuuuccaccaacacaccccugccagccacgcuuugcacuauauguuuucagggucugugaaguaaaaggaagccccugacauggggagcugggagcuaagcauggcuucuguuuggcugggguggugggggauuuuauuuuauuuuuuaauuauuuucuccugguuauuuuugagaaguauuugaauugcuuuuaaacacucacacucaauacaauaugaucuuuuuuuuuuaaguaaaugaagcauuaggaucauaucguugaaaaugggucagccacaacaugauuuaaaguacauaacuaaaugaacuaagagauagaaggacaaauugaaccagagagguuagauacauaagccccaagugugguguuagauaugauagaagauaaguugugaucacuuagcauuguacuauaaaagcacuuuggaaucucagaauuauuagucauuucagucauauauacccuagcgagguuuccucaucugucuucauaaagaagacauuacagggucacaaguccuccaagacccucaugguacauggcacaagacucggagccuauucgggucacguuacauuuaggauuuguaaaggcagaugcucuacccaagagaaaacgacagccauguauagguggugcaccugcuaccucagcauuuaggauucugaagcaaaggggaccacaaguuugaggcuagccuccgcuaccuaguauaaaccugucucaaaaaaaaaaaacccaaaaaacaaccaaaguaaaaucuagagaaaugcucuccagggagaugcucuguccauugaaguagggaaaauggauuuuauauuuauucaaguuuucaaauuuucuauuuuuguauuacauaaaaaugguaaguaaaauaauuuauaaauaaauaucuauuuuggcaauuuguucucaaaaauauuuugucaguaggacugcauggagaucacaauacuagagggaaggagauaggagaugaaguuucucaugaucaauauuucccacaauugagauuuugguagauaugaauugacagggauuauguguguuaauagugguuuuuaaguaauaaaaaacuggaaacaaugcuggaaagaggggaaaggauccugcuuaaagauuuauguauggccaaauaaugcaaaguucauacuucgagaugagcaucaugguacagaucuguacucaaaguacucagaagcugagaccuagcuccagaggucagaugguuuucuccccccccccccaauuaaacaauuaaguaacauuuggggcuuauacuaaucauccauacucugcccuuccccuauccucugggagucaauaauuugcuucugucucuggggacuugucuguucugguuauuucauauaaacacaaucguauaauauaugauucuugucaggcuccccuguccccagggauugaacauaggacaacuccuuuugaggcaguucuaccauuaagcugcaguucuacccucuuuacauuuuuuuucaaggcucaccuaugccaaagcacaaacaguacuugaguuuuuccuguuguauauauaugacacacuuuuuaaaaaucuauucacaaauccaaugauagacacuugggcacuugcaaugcuucagcuauugugaauggggcugauccuggaaucccuguaugcaguucuuugagguacacccaagaauggaaauaacaaaucaugugguaauugugucuuacugagaaacugaccaacuggugagaccgcagugccuguccuuuuaugcuuuggccagcagugauuccugagggccccugcgggccucacugcucuuuuguggcugcuuauuuaucuuguuguuguugguuguuuugguuuuuguuuuguuuuugaauguuaucuacuagcuauacuauugaguauaaggugguuucucgcugugguuuauuuacaugccuaccggacauccugugugcauuuuaaccauuuguauaacuuguuuuuaaguccuuugaccuuuagaaauuuagcugcuugacuuuuuguuuuguaguuguuggacuuuucuauaugguagucccuuacuaaauguauauauaaucugaaaauacaucuugccacucuguaggcugccucucacacaaucacuuuguugauugugucuuuugacauauagcagauuuaauaguucagcauugcuuucuguuacccaugucuuggggggaucauaaccaggaaauuguugucagaucuaaugucauaauuuucuugucuuuuuaaucuagcuuuuauauuuaggaauucagucuacuaaugguauacagaaaaggucuacuuucauucuucgguauguuuguguauaguucuggcaagaucauuuguuuagacuuuucuccauuuguuccuuggcacugucguuagaaaucuugaucguguguguguguguguauguguguccacuuuggggcacuuaguucugcccuauugguuuguuuuccuuaucaugccaguaccacaguuuggauucaguuaucuucaucguaaguuuugacagcacgaaccgccguguuuucaagauuguuuugaccagagucccuauacaggacuuguaaauaucuacuuguaaauaucuuauucguucuaaucauuuuguaaguauaaaauuuaacuucauuuuuggauuauuuguugguguugcgauacauagcuaacguuuacauguugauuuuguaccuuacaauguuacugaauuaauuuguuaacucuucaauuuucuuguagaacguauagacuuuccugucaucugcaaauaaagacagucuuucuucuccuuuucaguuuggaagauuuugauuuuucccgcugauuuacagagaacuuguaguagaguguugaaugguuaaaaguaaaaaaaaggugcccuugugcauguucucgggaggaauacuuugucuuucacaguugagaauauguuacugugggguuuucucuugugacuuuuguuacauugaggaaguucccuuuugcuaguuuggauuuuauuuuuauuauaaaaagauuuugauauuagucaaauuuggcaucuauuaaaaugaucaucaacuuccuguucuccccauuuucuauugauguguuuuguauucauugauaaccacauguugagcuaaauuugcauuccuccugucauucccauuuugcuguguuacgcaguacuuuucaagugccauaggauugaguugcuagacuuugaagaagacuuuuucuaucaauauucuuguaaccuauagguuuuuuuuuuuuccugaugucuuugcugcuuuugcaaaaaaaggauaauaccagguuuguggaaugcguuugucgccuugcuguguuuugauaaugaguauuaggauuaaugcugcgaucuaauguuaauucuuuauguguuugauagaauuuaauugcuauaggucauacauuuuucuuuggaggccuuuuucuaaaaacugacucacuauaagucugagauaucuauuucuugagucaguuuuuauauuuuguguuuucugguaguuauuaaaaaauauuuauuuauuuauuuuauuucuuauggcuuugaacucaaaagaaaacugucugccuuuuuccuggaauuauagacuugugccaccauaccugacaguaaauguuuguucuuuaaauuguacauaaaagggaaauguuugaaaacaggaaauacaguaaggcuggcucuuaauuuuacuuaugucacuuggcuuugggaguauugcuuuagucaaguugugugaguccucuacaaacccugauuacaaaucuuucaauggggauaugguuugaaaaauauguucuuccuuuauuuuccuugaaacaaaguaucuguguagcucaggcugcacuggaacucacuacauagaccaauuagccggagugaaacucagcccucucugccucuccccacugagugcugacauuaaaggccuaugcugcaccugggcuuguucuucccuuuuucugcuuugcucuccagacuguuggcuucacuugcagugcaccccuuuuagcaaaaucuuauucugugcgcacgugcuccucagugucauaucugauggucaggcuuaacccgaagucagaacacaaaaguacuccuugguuuucuucuaguuagccuauaauuuuuuuauuuaguuuacgucagcuuuagcuucuuuuaaaagauuguauggguacagcuuuauuccuuuguguguugcuauccagcugaccugacaucauuaguuaguuucaaggacgauuguccuucaccaaguauuuggauaccuuugcccagauauauuuccuaaaaagaaaccauaaaacuuuguauguguguguguguguuuguuuuuauuguaugugugugaguguuuugccuacauguauguauguguaccaugggagcuugcccagugcccauggaagucaaaagagaacaucagaucucuaggaacuaaaguucuauaugguuaugagccaucaugcaggagcuggaaaucaaaccccaauccucugcagaaacaaaacguaccuuuaaccacugagccaccucuccaguuucccacccccaaccaaaacuuaguuugacauugauaggugagcagagacgguggauuuccaagucucauuaauuuuuauuuucugccugaaaguucaucugacucuccaguuuugucaugugacuccuuucagaacuggugacagagggugagagaaaggcuggccaguguccauaccauuucuuuuuuucccuucucuucaucaucuucaucuuuauuaauauauguguuucacuguguaacccaaagcugaucucaagcucauaguccuccagccucagucucccaacuaggacuauagguauaaacuguuaugcuugguagaaaaaaacaaaacaaaacauacaaaacccugccuuaguguaaggaugguuuaauuaaauguguucccagucauggccucccuuuaaaaaaauuucccugugcucauucucauuucgaucauaugacugaccuuuuggaaacagauuuugaauuacuuggguuuuuaaaaauuuguguguguuugucugugugucugugucuguacacauguguacauguacaugcauuucaguagguauaaaaggcacacugcuguuugauguuuuauguuuauaaaaucagaacccauugacaucuagucacagguauaucucucugacccagguguuuacucacugcaaaauauuccauggaguaucugaacacuugccugagcucugcugaacacucagcccaccuggccagcauguaaaucaagcagucagguguuuguccuucugugucuuuguuuuuucacuuuacauuccuuucgccuguccuccucuuuauccucugagaggauagagccuccccauccuggguauuccccaacucugauacaucaaaucucuguagggcuaggcacauccucucccauuggggccagacaaggcagcacgguuaggggaacauauuucacugacaggcagcagcuuuagggauagcuccaacuccauuuguugggggguccacaugaagacgaaguugcacaucugcuacaaauguguggcguacguagguccagccuguguaugcuuuuuggauggugguucagucucggggaacccucaagaguccagguuaguugacucuguuggucuuccuguggaguugcuauccccuucagugcccucaguucuuccucuagcucuuacaugagaguucccaagugcccuccaauguuuggcuguggguaucugcaucuguccaagucagcugcugggugaagccauugcuagucuucugucugcaagcauaacaggaguauuagcaauagugucagaguuuggucuugcccacagaaugggucucuaaguggacccauuauugauuggccauucucucaguuucugcuccauacuccaucccugcauuuuuuguagacaggauaaauuuugagauaaguuuuguggguggguuagugucccuuuaucuccaauaggguuccugcuuggcuacagggaguggccucuucaggcuugauauccccacuacuguggggcaucucaaggaugugucagagaccuaggauaggggaguucucugugagauuuuuacuuguauacuggaagugguuacauguauacuggaaaugggauucuuuggcuaagcugcacaauacucaaucucauauaagaguucaaaauuucuuuucaaaguauuuauuccugccugaauuaaagguguguguguuguuguuguuguuuugagugaaugcuauuugucuuuuaagugucugccauaguuccaaacucugguauagcacaguguacacuccuuccaagucaaaagaaagagaggcuuuuaagagauuugcuuuguaucgccacguguggugguguucaccuuuaaucccagcacuugggaggcagaggauuucugaguuugaggccagccuggucuacgaagugaguuccaggacagccagggcuacacagagaaacccugucuccaaaaaccaaaaaaaaaaaaaaaaaaaaaaaaaaaaaagagagagagagagagagagagagagagagguagagagagaaauuugcuuucuuuccaacauuaacacauugaccuguccauucacacacaguucuaauauucaauuuggcaugugggaugcuucuuugagauucauauucaugaaaagaggauggucgacuguaguauagucuuguaugaagcuuguuuucaauaucucuguaaaacuccauucucaagacauagcauccauacuuaauuccaaacaccuauagaacacuuauaguuauuguacacuaggcaaaauguuaagaaaucccaaaguuuuauaaguaaguccguuuuguaaccgcaacacaauaaaacugggcugaaguaguauaauuuuuaaauacaugagagucaaaaaaguuucuuauguuucaagguagcaaugguuugucaaaacuuagagguuugucuaacugugaugagaagggcguguccaugauaggaauccauucccaggacugacuaaucaggagcagauccuuuaaaagaauaguuccuuucugacugauguugccacagaagaagagugucaacacuagugauacagagacacaagcacagaugacagagguuccuuuguguacaugaaugguuuugccuguguauaugugcaagcaucaugugggugaccuuuuauagauuguuuugcauuguuuuauccagauauauuuuaaaaucuaaaugauaauugagcaaaauguaaauuaagcugaccaagagguuacaaaaccuaccuaguuaucuaaucaaaauuaaauugcacucuaaaaucuaugcucuacucucuucugucucuaagcuuguccccucuggaaagguuuuuuuuuaaaagauuuguuuguuuguuuguuuguuuauuauauguaauuacacugcagcuaucuucagacacuccagaagaaggcuucagaucccauuauggaugguugugagccaccaugugguugcugggauuugaacucaagaccuucagaagagcagccagugcucuuaaccgcugagcggucucaccagcccccuggaaaguuuuuaaaguucccauucagcaggccugagagauugugcuguguuaucucaggcccuugccaaggacucgccuuucuaauaucugccaauacucugaaguguguuuuuaaaaauauuucagaucugacauuuauguuucucaugucuuuuuugugguuuuuuucauuuuugucuuaggauuuuuuuuuguugauguuuaaacauuaguuggacuguaauugugcuguuauacacuauugacuccaugacuauggagcucuuauaagauuauaaacaaauuuccuacuuuagaaagaaguagagguagagaagcaguccauucaaacuguuaaguacuucaauuuauuuugugugugcucuaaauagucaaucaucaauagauaucuuagcaauauaaaguuccuaagaaaaucugguguccucuuaagcuggacucucuccaucauuaagacuuagcaauugaauagcuugguucuuuuggaauuuuaauccaaaacaauugaaauauggaggaccugaucaaauugaaaagaucugaagaggaaauugauucuggcugaaguaugaaguuuuauuuucacuaauccuaaaguugagucagagcuuccaaguaaaccuaacagguguagcugccaccugagucaaauaaagaugcagagucacccugugaguggucaugaucccuguggauauuuagagccaguggcagcaguguuucagggaggacaagggaaaaccacuuuuccaacuuggcagaaaaccuuuggaauucuacuauucugcucuccugcucugaaagguugucaugaucacgagucagcuuucugguuucucccaugcguugcuggaggaguuuauuuuaguucuuaguuuacuuuucuccucuguuccucagccuuccuguaucugggaaacuuuccugaccccaaccacaguggccucuauagcauguuagccaucuuaguagcuacagcucgaaugucgauguaacccaaaucuguuuugucuucaguccucacucacaugggcaccagagcaaacaaaaccaaaacccaaggaccucuucagauacgaugcccuuuucacauucuggggauugguuuauacgcacaaacaaacuuucuuuuucuuuuuuugagacaggacaugucuacauagcccuugcugucuggaacuuacuauguguaaaccagccuggccucaaauuuucaaagauuuacugccuauggcucccaagugcuagguuuaaagacaccugacauuuuucauaauuucccaaucucuaggaauuacaugucaagaguuuuuuuguuuuuuguuuuuguuuuuguacagaugcauuguaauuauauaaucaguuccucuggacauuccuaaagccuuuggacaagaagaaggcauguuuggugacaguuucucugacuuugacugacuuacuaguguauuucuggcauuuuaagcuuggauaauuauauuuaccauuaauccacucaucuggaaaaaaauuaaaacaacaaaaaaaccucucccuccccugaggugccuguuugauucaaggcuauugauacugaauuuccuacauaauaacaaauacacccuuccaagcucaauuuuauauucagagaaauuuuucuuauuuuggacagggcuccuuguagccaaggcuggccuuuaacuugcuguguagccaaagaugauuuugaacuccugauucuccugccaaccuccugugcugggauaugguuauacaccaucacaccugccaauuaaguggcuaguuuuuggcuagcaugauuaaugaaaacaauuagaaguaauuuuagacuuuaaaaggguuucaagaaaccugagcguaguggcaaaugccuggaaucccaguccuugggaugccgauacagguagaucagaaauucaguacacagccaguuaagagaucaugccuccauaaacacaauaguuaaggguucuucucuggaucuuaaugauguuaaucaauaaauguagaaaugggucucaucuaguacuuuuaacuuaaaagguacuacaaaaguccagaaacacuguaaugcuggcauuuuucucuuccuguguagaaccaggcaccagcaggugaguuuacuuuccaacauuagagagaagcagcaaacaucuucuuccaggaucguauccaacagaaaguuuacacugugguagcugguaucauuuaacucggaaaugcuuaaaucuuuauguggaagccccacuuuggaauacaguuagccaacucaaacaugccuggaguuugcuaaggugcuugugacccucauggacaaagggacguguucuguagcuugccagcaucugucaaagacucuuugaaaauguauucugugguggauccccaaaaccagcuggacacaaguacaggucuuuccaaggugacuuuggaaucuggguagaagucaguauucccugccuguccuguugcuugacuugggcuuuacucuaggauguucagcugcaccucaccuagugcuuucaugucaugcuguagcaugugcucacugucuuaugcauacacacacacacauacauacauauauauuuauuuauuucuagggauauuuuuaaaaaccaaccuucuaauacuaaauuccucugagaauguuuaauguuuucuuuguaugugaaauguuuuagaaacagucuuuaguauaagcauuauuuuuguuaguaaacuuggaagagccaucaugaggugagcuugggaaaauuccuuccaaucccaaauuccuguucaaacaugcccuuacacuuuacacccagaagcaguaugaauguuccaaguugugaacaucccuguuaguauuuguuuugucucauuugacuuucaccaucauagagguccuuucaugucauaaggacauuuguacauaagcacuuuuuguuggguggacuuuuuuuagacuauaguuuugaauguuugucuugucuuucuuuucuuucuuucauucuuccuuuuuugguuuuugguuuuuugauacaggguuuuucuguguuguccuggaacucacucuguagaccaggcuguccucgaacucagaaauccgccugacccugaaguuugucuuuucauagcaauuuaccaaaauaugcacuguaaaugcaacuggucuuuggaaaugcagaaggucuuugcuccuauccauggcuuucacacccugccugaagcaggacucaccagccuuugcuucagcagauccagagaccagugcauaugucuuagucccuaaguagcaacaguuuucacuauuaagauugcaaaaagccauuuccuuucugaauucuggcaugggaaauaggucgcuuucucuuagcgaccuuaggucgcuuaggucacaagaucuuuuucucuagguauccauucuaaccauuccucacacauacuguauggaagaacuuuccacuuccuuucucaaauacagcagccuucuuggggaucuguuuguggacaucagacuuugaaaguuggaucuuugaacuaagcaugauggaaucaguuugccacauuuauaggcuaaaacacuuuuacaaccuaacacaaucaagcuccuaucuucauugccacacucaccacuugaagucuuuuuguugagucucucuugagcugguaauacagccuagugaacccugagaacugauguagccugagcauucugugugggccccacucuuguucccaggccucagacucagcagaggcagcaguguuaagugucuagugcgagugaguugugcaguccucagcucucccaccuuuagagugucuguuuauuuauagucagucauuccuuauuuucagcuucuggaacccuuagccugucuguucugcacaguucacauagucacugaugauacagccuuuugcagaugacuuguuugcuucaguguuuucaguguuuacccaugugauaugcuuucaguauuuccucuuccugcugaguaguaguugauuauguggguguuuaucacauugugucuauuaguggauauuugaauuguuuuuuuuaauuuuucucucucuuuuuuuuuuuuuuuuuuugagacggguuucuguguaucccuggcuguccuguaacucgauucguagacuaggcuaaccucaaacugacagagcuacaucuaccucugccuccugagaguugggaucaaaggcauucccuaccacaccugccuuuagauuguuuuuaguuguuggaauacaacuaugaccauuugucuagaaguuuuauguaagcauuuucauuucuuuuaggugugaaaugguuugugauuuuuuuaaauguuuuuagaaacuuuuuuuuuaauucacuuauucauucacucagucauuuauugguuuuuuuuuuuguuuuuuuuuuguuuguuuguuuuuguuuuuguuuuuuuugagacaguguuucucuguguagcccuggcugccuuggaacucuguggaccagguuggccuugaacucagagaucugccugccucugccuuaaaggcauacaccacucacugcuucccagcccuuuuugggcuuguuuguuuguuuguuuguuuagggggauuuugguuugguuuuccguugcuacuguuuguggcuuuuugcccuuuuuucccccaaaguggcuuugcucuuuccugugccugugugcagaguguugcgcauuccaguuuuuccacaucuuaucagaacgguugccauacuagacgaugugaaggcucccugccaugauuuuaauccgaccuuccuggugacuggauagugaagaccuuugguguguuugucuuugcugacaaggauacucaauuuugccuauuuuuaaaccagguugucugucuuucugcucacuuaguaagaguuuuauguauuuggggucacuuuucugccuuuuggguauuauguuuuaacuauucuuaucagcucgguauucuuuaacaagucuuauaagauguauaacuugagaaugucuccuauucuggcacuucuguucauuuuaaaaaugaaauuugaaguuaagggcugaauaaugcaguuugguguaacaguuuuccccuuguggauugugcuauuuuuauuagaccugaguauuagaccugagguuuuguuucccuguguuuucauuuuaaaaguugaugcaggcauguucgaccuguagugugaguguaccauuggauaagauugcagugucagagcaaugucaaaaaagcuuggacauaucugcuggguuuaguaauucuuuagaucugcauccauguucagugcauguuuuguauguggugugguggcuggcgucacuuggcaugugaagauucauuuauucugagucccuagcugaccauaaucuuaagaguuuaccuuagcacucucaacucuguguugacugaugugucuacacgccagguuuuaucucuguuauacuguuguuaacuuuguuuugaaaugaggacaucuaauuuuuaucuguucuuuuucuuuuccuaauaauuuuuggcucuuaugauccuuugcuuuuuuauggaagcuuggaaucaucuuacacauucuuuucaggaaaguucauuaggaguuuuuagguuuauggagaaccugcagauuaauuuggggagaugccaucccagcaguuuugagucuuaacucacacauaagugucucuguuuauuuagguguauuucucccuuagagacuugucuugccuguacugccccuuuugugcuugugcauuuuagcacucuaaaaguuuuauacuaguuguguuuucauucucuuuuggagcccaccaucacccagcaaaccuuuauuuguuuguuuguuuguuuguuuguucugagauagcaccucauguuuugcccagguuggguuugaaaucaugguccucucgcuuuaauauguagaggugaaauuuuaucuuuuucuaguauuccuuuuuguugaauuuuuuauugcuauuuugaacacuuuuuugauauauguaugucuuuguucauugagacagguccucaccauauagcucaggcuaaccucagacaggcugcaugcaguccuccugcagccucccaaguguugggauuuaaguauaagccaguguguuuagccccuuucuacacuuccuguaguuucaggguaagaauuucaguuacauuguaagugagguaacugauacaaagagacaacuuugugucuugagaauuaauuaguaaagacaggaccuagcagugguucaggucuuaggauucuaggccuggagcugacuuugguuuuguuuuguuuuguuuccucuccuacaucaaauaucuuaccauucugucucuacagugcucugaccuuuaauuuauauaacuauccauacuaaauaucuuugauuugauuugggccauacuccuguuuuuaagagauuuucagccucucaggcacucuggguguuuaugacauagaaauucugcuuuccaaaaauccaagacauugauaugcaaaaaaaggcagggauggcugcaaccaaacauagagacagacacaggaggugcucuguggggauucauacaguacaagguaugcacucaugcaccgccucuuugagcuuuaaaaauaauacuagguaaauguggacuuaccauggucugccaguaugucauuuuaacccuuaggacucuaguccuuaaauauaaguauacuagacaugcugcuauucagugaccaugucuaccaggaaaaggcuaaucugcaagcuaguuuuugucaucuuuaccaugcuuggacauuugagagccuuugacuuucacauuccugcacauuagcagacccgugagaucaguuuuaaauuugacaggucgaugguguuaaacuuaccaguuuauaggacuuacuuuucugaaaaucaaaguuuuuccugcuuucaggugccuuaucaugucucccccuuuuccaggauucugagcuaaguuccuagaggccuuggagucuguccaguucaaagugcuugaacugcacuaugguucuaucaaacuugcuuauaaaaaugucauuuggcacuuagaagaaacgcugacgacuaaacuucuccccaaaagauucugucaucccccacccacccacccccguaggguucuccuucccccagacaguuuaugaugagcaggcuuaagaaacccucuuaggcuggggaaguaucucaguggaaaaggacagcugcugugccaucaugccagaucccagcaccuaccuaccaagcuaugcauccuuauaccccugcaaucccagauccaagcaaagcuggggcuuccugcuuccagucuaucuguggaaugugggcccaagguccagggagaggccuugccuuacaggaauagauuaagagugauguuggaagaugcugaugcccucuucugaucucuguguuuguaagcuugcuuacagacuuuaucucucucucucucucucucucucucucucucucucucucuauccauucauucauucagagacaggguuugucucucauccuuggcugucuuggaauuugcucuguagaacagacuggccucacacacagagauccucugccucugccucugccucugccucugccucugccucugccucugccucugccucugccucugccucugccucugccucugccucugccucugccucugccucugccucugccucugccucugccucugccucugcuucacacugggauuaacuagugggcuauuagcacucacuuauuauucuuuuaaacaguuuuauggggcauuugcucagcuauauuuugaacuuuuucucacccaccagugucagcuucugucccucaacucaaucuacuugcucugaauguaguuaaaaagggcuuuuguauauuuuucacuuggccuauuugggauuucuuaaggugcauuguagcucuuugguaucugucugauauauaagaucugcugauugauggaucugcuauggacuucaucacuuagguuagcauuucuuuuaccuccagaauuaucuacaaaugucagcugagaauuucauucuggagauguuuaagacuaagguguagcuaccagauucuuuggcuuccucagaucugagggacauucccaccucucuguugcaguagcuuggguccugucaucacagcaggcuucucccucucauagacacaugucacaucaucacucacaagcuuugaacuguguugcuggcuggcccugugaguaacuguaucucuggcugcaggucauucugagagagucucucuucauuuuuccagguggcaaaccauaugacuucuucugacucuguuucaucuccugggagcuuguugagcuuggacucugcucuuuccaaugaggaaacuguacgcauggugagcaaggguguacaagcugguaagucccuugaguuuaaguucugcauugauguagaccuaccucuucagcacacuuacuuaacuuuaaaaugauaaaagguguaaagauuaaaaguuaucugcauguguagaugcuauuuuuuuauguacuaauugaaaaauagcaaguuucuaaguaagaguuuagggaaaugaguaucuucauagcagguccaaguaauuccgccccugugaagaacaguuuggcaguucuuaucaaauuuaguuugacccagaauuuuuugcauuuggaauuuggccaguagauacacuuaaaaucaauguugacagccaucaguaucaauguugaaauuaauuauuguaauuucccauaaagaaauuuuauguagaaugaagaagcucucucuacgggcugauaagaugguugagagcagugguuguucuugcagagggucuugguucacuucccaauacacacauacauacuacaagcauacucaaacauguguaauuccaguucuggggaauucaguguuucugcaggaaugcuugucacacagacauacaugaagagaaaacacucauacucaaacauaaagaaaucuuauuuuaccaauacuggaaggucccaugcauauauacuuuauaacucgauguucagaaaagugcuucugugugcauuuugugaaagcagaauagggaagagaguggccugcgugacggugucugggguccuuuguugugaacaacuggagagcagagcuagacaguuucugauuuuauacaagucagucuuuuuccuucuuccuucaagucuugaguucgccaucgucaccgcuuucuuccucuuccugggugauuggcagcugggccagacauacuuacuguccuguuaucuugcugucagaguucaugaaagccugaaccagggaauccauauuucuucuuucugucugauagcuaaacccacuuaagaauuaaaccuucuuuccucugcaacagucugccuuuuuuccccucucuuccucuccuucuuuguccccucuccccaugcaguguaugguguuuugaguuauuaauaggggcucaccaucugucuugauuaagccugccagccuugcuuccggucugcuccaugauacaucugucuuucuccucagguaacuuggagauuguggcuggugucaaaaaauacacucaggauguuggggugacuuucccaacucccaguucuagugaggccagauuggaagaggacagugaugugacuucuucgucagaagaaaaagccaaagagaaaaaguuucuuuccaauuaucugcagaccaaaaacuuaaggaagaacaagccaaaucccugugcaggucgguuucuaacuccagguagccggaaacuaguaaaagacgugucugagucuguggaaagcucuuuguacuccaccagcugccagcuaccacauucgaaaaguuugaaaguaacuagaacuuuauguagagucuucuguaguugagaccaguuuaugggcacccuaaagauugucacccccaaccgaugagucccaugcaagucaguauuacauacauuucuuugauguaauugggugcaguuauuaaaauguuuguucuugaaaauauuuccuguaggagucucaugguuuguuccuguggaaaguggacaaucaggaucuaagaaggaaaaccugcccaagauuuacagaccuguuaucuccugguuugaaccaguaaccaaaaccaaacccuggagggagccacugagggaacaaaacuggcaggcccaaugcaugaacagucgugggucccugggaggcccaggcagggauaguggccagguuucucuucggccauuugugagagcaacucugcagguaggcacagugacaugagguugacuuuagccauauguguuugugggguguguggcuggcaugcuggggucuagucauuccaccguccucagcaucuguggacugggaggagaggaagggcucuguugcugugugcaggcuccccguguacagaucaggccgaguguuugggucacugugcagaguaaaccaagcgcucaucccugagcucugcccccuuggugguuaaaggaaauauuuaaugaggaauuuguuugaagugaaugaauugaccucuugucucaucaacauuuggaagaguugcaggugaccccacuuugguucucagcuuuuccuaaagguguuucugggcuuccuuugaucucccugggugugcccuccccucaggcucccuagaccugugguauaggugcugguuuuuuuauuaguuugcuuguuguucuggggacuuggaaaacagucugugucacuaaugcgaggcuuucucuccucuaggaaucacuucagcuucacagaccugauuucaucucccacucuggggagcgcauaaagcgucugaaguuacuuguccaggagaggaagcuccagagccuguuccagagugagcgggaggcucuguuccacucagcgaggccccugcccaggagagguaugcgcucaugucacuuugcugagagcggaugccaggcagcacgaggaugcugagcguggcuuugcuugcugagacgugagucuccuuagacuggcccaccuuagcuugucaugugucugugaccccaguaagccgguuccgcucgccuugccacugcaccucuaaaaggacaagcugccauaaggacggugccucuugugaacuaaccugguguuugugguuccagaguguggcaagaagugagcccuggugcacugaccugaggucugccuggcacuguucucacagcgccucucuaaggaaggccacccaugggcugcugcucguacuucacccccacuuacucuucuuagggaaagagcuggguuugcagcccaggucucugugugcucucucuguugcacugaguggcaagucuccaucaaaugacaaggaagcuggggguguaaagcacuaccgagagcuggcagccucaccgcucagcuggccaggaguuggggucccugccauagcagauuugggcgguggccucugaccccuaaggcaguucagaagugcgccuuguccuuggucuuagucacuuuccugugcuccaacucagguccgugcccaggcuccagcagcccuucacuaagcucuaccucuccuuacacuuacuguccccugauaagccuccucucuugucuaguccuccuggcuguccagaagaacaagccuauuggaaagaaggaaaugauucagaggaccagacgguaagucugaaggaacgggagugauuccgugcagcugcccgcagcucugcuucccagcacaugcccagauggaagccgguggggugagguuugauguugcuucucauggcacaagaaaggaagagaaaacagacgauaguaugaaccugguuccuguucagagggaaggggaacgccuagggugagcuucucugcauuagacauagagaugaaauuaaaacguauuuugaaacaaauuuucuuagcaagcucauuucuaggaguuuuucuaacagaguaagaaauaguggguugcucucuacaacauuagcuuaauaacuuggguuuccgaaguguguacaguuucaguccgcugccucauugguaguguuuaaaaacaaaugccuuugcuuuaauagcugugaggcccugagcauguguaaaguauuucuguccauugcaaaagaacugguaacagcgcuuaccucugggaagcaagggcugaguggcucugguuaggcgcgugagaggcuggggcuuuggucucuugugguuuuaagauugacuucuuuuuauuuuuuguuuguaugaauguuuugccugcguauauguuaguguaccacaggcaugcaguucccugagagggcagacgaggguguccgguuuucuggagcuggaauuacagacauuugugagcuacauuuugaugcuaggaacugagccuggguccuuccucugccuagcauccagugcuccuaaccacuggggcugagucauuucuuuagacgaguuuuucauaaagacuuugaauuuuauacaauugaagcauugucuacucauugguuaaucagcuugauaaacacauauugauuguaagaaugccauugaaaaacuaaguuacagguuucuggggcugauuagaagcuggcuuuaauaagaacagucauggaguugcugaaaugguggguuguugcugcugcuguuguuuuuagcagugaugguuuguuuggggcaaacaaacaaauauuuagauauagagagcuugaaacaaauauuuagauauagauagcuugaaagaaauauuuagauauagguagcuuggcuagcucggcgcuugcucuggagcccagcuuggccuagaacucucugagauccccgugccucugccgugcuucuggagagccagcguuacaggugcugccaccacucggcacugcguccuuuucaaggauuuguguuuuuaaaauuguaaaaaucuuuggaagauauuuuuaaaaguagaaagaagaaaauaaauauuacucaaaauccuucccuccauccugcaaacagucaucuuguggcuagagugggcuuuguagugauuguaguguuucuucugugugugcaggucugacugcugcuuucucucuguccuguugugaaugugucuccguaccgcuuagccgugguugagacauguucugcuuuauucuugcacagucuauucuguugggagucaguguucaaaugccuguuugugcucucucagcuugaaguuagggacacccagcccucuauaggaugaagcuuaacuuuucacauuagacacucggcucguggcugccuugccugaccugcuuccugccuggccucuguaccacaucucuacacauuuccccagcguggaugcccugucucucuuuuuuuuuucucuguuccugacagguuuuuuuauuuccaucauaagccuaagcucucugaagcuugcucugcccuuuccucagaauaaguuucucuucucucugaccucuaugguauuuuacaggugcaucuauucuaguccuuucuuuauuuccuguguuuuaaauacaguaguaacugaaaaugcuagaggcaaaacacaucaagguaacagcaauguccuaagacaugacauggaauuucauaaaauuaaaguuucguauagcaaagaaacagcagaguaaagagauggcuuuccagauggaagacagcuaugcaucugucuaguuauuuucuuguugcuuuguuaaaauauccuaauacgagccuacagcuccagccucagagaaggaggacguagugacaggagcaggaggcuagcucaaguagagugugacaggaaguagguccaagcucaagaccccucccuagggagccacuuguuccagugauguuccacaaucuucccaaacagugccaccaacuguguuccaacacgggagacaaaguggguguuucacaccaccacccacagaggauucuguagacucuauagagacccuaaagagauuaaucauccagcugaaaaaugggcuaauaagcugaguaggcuguucucaaaagaggaaacacaaagagccaauaaauauuagacaauguguucacacuccuuagccaucagggaaauacaaaucaaagcucuuugagauuuccucucacgccagucagaauggcuagcaucaaggaacaaaugauagcaagugcuagagaggacaugcacugugggagggaagaccacugccacagccacuguagacucagcaugauguuccacaaaaacaaacaaacaaacaacccccccaccccccuaaaagaacugaaaaugaaacugugauccagcuguggcaccucuggguguacaccugaaggccuuaugcugacacaucacugagaugcuucuguauucauggacugcagcaauagucacagcagucaagaaaugacgucagcuucaauagucaucagcagagacgugaauaaaggaaaugugaggcauauauacaguggaauuguauucagcugugaaaagugauauauuuucaggaaaauggguaaaucuggaagucaccguguuaagcaguguuuaagccauguuuucuccauuuguagaacauaacguagaaagucagccuugaugggggagauaaaggaggcaaaagaguagugucaugaaaccagacuuggguguguguccugaaaacauuuaaaguacaguaauuagcuaaagaugguguugcauacccauauagucuagcauuugauaagguaaggcuagacugaguuccagacuagccugggguaccccaauugauagugauauauguaaacauagagguaugugucuguguuaauguauguauguacucaguaauaccuguuuauuauauugacacuauacaguuugcacacggcauggaaaacaauauuaccuacucuauuuuauuauuuuucuggaaguaagcacuauugucaauguuuuguguuuuuauucaucucucuuucauacugugggcaccauacccaggcuaggcucuccauaucuauggacaugaauguuccacagggcuggcuuuucuagaggcuggaugccuaggcagcauagagcuagaggugugggcagagccauccugugccuucaugccugauaacuuuacugcuuuuugucuuuccauuuguggcauuucuaagaauuuaugagcagcuuccagaagugaagaagaagagagaagaggagaagagaaaaucagaauauaaauccuacuggcuacgugcucaacacuauaaaaugguuaguugaguuggcacugucuguggagggguggucaggcuuaucagcagaggaacuagaaauggccuggcuugcuuuugagaagcagugugacugcgugcugagguuucagcaguaggcagcugugaucagccuucaagugagagguagcugggagccgcuucccaugugucuacaagugccacacaggcaacuucucgcucgcagcucaacuguacaaaguaucaggcuuguaauuuccaaauggugauuaaguuccuguuguaauccucuggaaugaaguaaauaaacucacaggaucacgugagagucaucagggagugaggcaagagccuggagccugccaagaaccuccuagggcagauuuucuuggaagccacgcuggccaccagcuugaaggguucugucucucacaguucuuauuuuccucccaggcuauucacuacauucuagaggacccugaaagucagaaucugaacaccagaccagacuaugugagguuaagaaccaugucuagagcacccaggagccucagcacugggggagaccccaggaaccacauggcugccugcuguguuagcagcacucaggcucuggcugugcugggaugcagucagaacucuagaucaucugcuauggaggaggaauagguguggcuuauaaacucucuuuccaaaacacuuuuccucauugccacugucaguaggugagcaacacaagauuuagggaaagcagucugagucucuuccacagugugccuaggugaguuugagcagcuacccgugucugcaucugacuucugcccuguguuuucuuccacagaaagugaccaaucaucuccuggggagaaaagugccuugggacugacauaagacuacuuucuucagagccuaggaauccuuuuuuuuuuuuuuuuuaugaucccaaagagacuaauuuauauuugugugaauaugauuuaauaaagcauugucuuugucuau

SEQ ID NO: 3152 - RNA, 28447 nt, Mus musculus
uacguagguccagccuguguaugcuuuuuggauggugguucagucucggggaacccucaagaguccagguuaguugacucuguuggucuuccuguggaguugcuauccccuucagugcccucaguucuuccucuagcucuuacaugagaguucccaagugcccuccaauguuuggcuguggguaucugcaucuguccaagucagcugcugggugaagccauugcuagucuucugucugcaagcauaacaggaguauuagcaauagugucagaguuuggucuugcccacagaaugggucucuaaguggacccauuauugauuggccauucucucaguuucugcuccauacuccaucccugcauuuuuuguagacaggauaaauuuugagauaaguuuuguggguggguuagugucccuuuaucuccaauaggguuccugcuuggcuacagggaguggccucuucaggcuugauauccccacuacuguggggcaucucaaggaugugucagagaccuaggauaggggaguucucugugagauuuuuacuuguauacuggaagugguuacauguauacuggaaaugggauucuuuggcuaagcugcacaauacucaaucucauauaagaguucaaaauuucuuuucaaaguauuuauuccugccugaauuaaagguguguguguuguuguuguuguuuugagugaaugcuauuugucuuuuaagugucugccauaguuccaaacucugguauagcacaguguacacuccuuccaagucaaaagaaagagaggcuuuuaagagauuugcuuuguaucgccacguguggugguguucaccuuuaaucccagcacuugggaggcagaggauuucugaguuugaggccagccuggucuacgaagugaguuccaggacagccagggcuacacagagaaacccugucuccaaaaaccaaaaaaaaaaaaaaaaaaaaaaaaaaaaaagagagagagagagagagagagagagagagguagagagagaaauuugcuuucuuuccaacauuaacacauugaccuguccauucacacacaguucuaauauucaauuuggcaugugggaugcuucuuugagauucauauucaugaaaagaggauggucgacuguaguauagucuuguaugaagcuuguuuucaauaucucuguaaaacuccauucucaagacauagcauccauacuuaauuccaaacaccuauagaacacuuauaguuauuguacacuaggcaaaauguuaagaaaucccaaaguuuuauaaguaaguccguuuuguaaccgcaacacaauaaaacugggcugaaguaguauaauuuuuaaauacaugagagucaaaaaaguuucuuauguuucaagguagcaaugguuugucaaaacuuagagguuugucuaacugugaugagaagggcguguccaugauaggaauccauucccaggacugacuaaucaggagcagauccuuuaaaagaauaguuccuuucugacugauguugccacagaagaagagugucaacacuagugauacagagacacaagcacagaugacagagguuccuuuguguacaugaaugguuuugccuguguauaugugcaagcaucaugugggugaccuuuuauagauuguuuugcauuguuuuauccagauauauuuuaaaaucuaaaugauaauugagcaaaauguaaauuaagcugaccaagagguuacaaaaccuaccuaguuaucuaaucaaaauuaaauugcacucuaaaaucuaugcucuacucucuucugucucuaagcuuguccccucuggaaagguuuuuuuuuaaaagauuuguuuguuuguuuguuuguuuauuauauguaauuacacugcagcuaucuucagacacuccagaagaaggcuucagaucccauuauggaugguugugagccaccaugugguugcugggauuugaacucaagaccuucagaagagcagccagugcucuuaaccgcugagcggucucaccagcccccuggaaaguuuuuaaaguucccauucagcaggccugagagauugugcuguguuaucucaggcccuugccaaggacucgccuuucuaauaucugccaauacucugaaguguguuuuuaaaaauauuucagaucugacauuuauguuucucaugucuuuuuugugguuuuuuucauuuuugucuuaggauuuuuuuuuguugauguuuaaacauuaguuggacuguaauugugcuguuauacacuauugacuccaugacuauggagcucuuauaagauuauaaacaaauuuccuacuuuagaaagaaguagagguagagaagcaguccauucaaacuguuaaguacuucaauuuauuuugugugugcucuaaauagucaaucaucaauagauaucuuagcaauauaaaguuccuaagaaaaucugguguccucuuaagcuggacucucuccaucauuaagacuuagcaauugaauagcuugguucuuuuggaauuuuaauccaaaacaauugaaauauggaggaccugaucaaauugaaaagaucugaagaggaaauugauucuggcugaaguaugaaguuuuauuuucacuaauccuaaaguugagucagagcuuccaaguaaaccuaacagguguagcugccaccugagucaaauaaagaugcagagucacccugugaguggucaugaucccuguggauauuuagagccaguggcagcaguguuucagggaggacaagggaaaaccacuuuuccaacuuggcagaaaaccuuuggaauucuacuauucugcucuccugcucugaaagguugucaugaucacgagucagcuuucugguuucucccaugcguugcuggaggaguuuauuuuaguucuuaguuuacuuuucuccucuguuccucagccuuccuguaucugggaaacuuuccugaccccaaccacaguggccucuauagcauguuagccaucuuaguagcuacagcucgaaugucgauguaacccaaaucuguuuugucuucaguccucacucacaugggcaccagagcaaacaaaaccaaaacccaaggaccucuucagauacgaugcccuuuucacauucuggggauugguuuauacgcacaaacaaacuuucuuuuucuuuuuuugagacaggacaugucuacauagcccuugcugucuggaacuuacuauguguaaaccagccuggccucaaauuuucaaagauuuacugccuauggcucccaagugcuagguuuaaagacaccugacauuuuucauaauuucccaaucucuaggaauuacaugucaagaguuuuuuuguuuuuuguuuuuguuuuuguacagaugcauuguaauuauauaaucaguuccucuggacauuccuaaagccuuuggacaagaagaaggcauguuuggugacaguuucucugacuuugacugacuuacuaguguauuucuggcauuuuaagcuuggauaauuauauuuaccauuaauccacucaucuggaaaaaaauuaaaacaacaaaaaaaccucucccuccccugaggugccuguuugauucaaggcuauugauacugaauuuccuacauaauaacaaauacacccuuccaagcucaauuuuauauucagagaaauuuuucuuauuuuggacagggcuccuuguagccaaggcuggccuuuaacuugcuguguagccaaagaugauuuugaacuccugauucuccugccaaccuccugugcugggauaugguuauacaccaucacaccugccaauuaaguggcuaguuuuuggcuagcaugauuaaugaaaacaauuagaaguaauuuuagacuuuaaaaggguuucaagaaaccugagcguaguggcaaaugccuggaaucccaguccuugggaugccgauacagguagaucagaaauucaguacacagccaguuaagagaucaugccuccauaaacacaauaguuaaggguucuucucuggaucuuaaugauguuaaucaauaaauguagaaaugggucucaucuaguacuuuuaacuuaaaagguacuacaaaaguccagaaacacuguaaugcuggcauuuuucucuuccuguguagaaccaggcaccagcaggugaguuuacuuuccaacauuagagagaagcagcaaacaucuucuuccaggaucguauccaacagaaaguuuacacugugguagcugguaucauuuaacucggaaaugcuuaaaucuuuauguggaagccccacuuuggaauacaguuagccaacucaaacaugccuggaguuugcuaaggugcuugugacccucauggacaaagggacguguucuguagcuugccagcaucugucaaagacucuuugaaaauguauucugugguggauccccaaaaccagcuggacacaaguacaggucuuuccaaggugacuuuggaaucuggguagaagucaguauucccugccuguccuguugcuugacuugggcuuuacucuaggauguucagcugcaccucaccuagugcuuucaugucaugcuguagcaugugcucacugucuuaugcauacacacacacacauacauacauauauauuuauuuauuucuagggauauuuuuaaaaaccaaccuucuaauacuaaauuccucugagaauguuuaauguuuucuuuguaugugaaauguuuuagaaacagucuuuaguauaagcauuauuuuuguuaguaaacuuggaagagccaucaugaggugagcuugggaaaauuccuuccaaucccaaauuccuguucaaacaugcccuuacacuuuacacccagaagcaguaugaauguuccaaguugugaacaucccuguuaguauuuguuuugucucauuugacuuucaccaucauagagguccuuucaugucauaaggacauuuguacauaagcacuuuuuguuggguggacuuuuuuuagacuauaguuuugaauguuugucuugucuuucuuuucuuucuuucauucuuccuuuuuugguuuuugguuuuuugauacaggguuuuucuguguuguccuggaacucacucuguagaccaggcuguccucgaacucagaaauccgccugacccugaaguuugucuuuucauagcaauuuaccaaaauaugcacuguaaaugcaacuggucuuuggaaaugcagaaggucuuugcuccuauccauggcuuucacacccugccugaagcaggacucaccagccuuugcuucagcagauccagagaccagugcauaugucuuagucccuaaguagcaacaguuuucacuauuaagauugcaaaaagccauuuccuuucugaauucuggcaugggaaauaggucgcuuucucuuagcgaccuuaggucgcuuaggucacaagaucuuuuucucuagguauccauucuaaccauuccucacacauacuguauggaagaacuuuccacuuccuuucucaaauacagcagccuucuuggggaucuguuuguggacaucagacuuugaaaguuggaucuuugaacuaagcaugauggaaucaguuugccacauuuauaggcuaaaacacuuuuacaaccuaacacaaucaagcuccuaucuucauugccacacucaccacuugaagucuuuuuguugagucucucuugagcugguaauacagccuagugaacccugagaacugauguagccugagcauucugugugggccccacucuuguucccaggccucagacucagcagaggcagcaguguuaagugucuagugcgagugaguugugcaguccucagcucucccaccuuuagagugucuguuuauuuauagucagucauuccuuauuuucagcuucuggaacccuuagccugucuguucugcacaguucacauagucacugaugauacagccuuuugcagaugacuuguuugcuucaguguuuucaguguuuacccaugugauaugcuuucaguauuuccucuuccugcugaguaguaguugauuauguggguguuuaucacauugugucuauuaguggauauuugaauuguuuuuuuuaauuuuucucucucuuuuuuuuuuuuuuuuuuugagacggguuucuguguaucccuggcuguccuguaacucgauucguagacuaggcuaaccucaaacugacagagcuacaucuaccucugccuccugagaguugggaucaaaggcauucccuaccacaccugccuuuagauuguuuuuaguuguuggaauacaacuaugaccauuugucuagaaguuuuauguaagcauuuucauuucuuuuaggugugaaaugguuugugauuuuuuuaaauguuuuuagaaacuuuuuuuuuaauucacuuauucauucacucagucauuuauugguuuuuuuuuuuguuuuuuuuuuguuuguuuguuuuuguuuuuguuuuuuuugagacaguguuucucuguguagcccuggcugccuuggaacucuguggaccagguuggccuugaacucagagaucugccugccucugccuuaaaggcauacaccacucacugcuucccagcccuuuuugggcuuguuuguuuguuuguuuguuuagggggauuuugguuugguuuuccguugcuacuguuuguggcuuuuugcccuuuuuucccccaaaguggcuuugcucuuuccugugccugugugcagaguguugcgcauuccaguuuuuccacaucuuaucagaacgguugccauacuagacgaugugaaggcucccugccaugauuuuaauccgaccuuccuggugacuggauagugaagaccuuugguguguuugucuuugcugacaaggauacucaauuuugccuauuuuuaaaccagguugucugucuuucugcucacuuaguaagaguuuuauguauuuggggucacuuuucugccuuuuggguauuauguuuuaacuauucuuaucagcucgguauucuuuaacaagucuuauaagauguauaacuugagaaugucuccuauucuggcacuucuguucauuuuaaaaaugaaauuugaaguuaagggcugaauaaugcaguuugguguaacaguuuuccccuuguggauugugcuauuuuuauuagaccugaguauuagaccugagguuuuguuucccuguguuuucauuuuaaaaguugaugcaggcauguucgaccuguagugugaguguaccauuggauaagauugcagugucagagcaaugucaaaaaagcuuggacauaucugcuggguuuaguaauucuuuagaucugcauccauguucagugcauguuuuguauguggugugguggcuggcgucacuuggcaugugaagauucauuuauucugagucccuagcugaccauaaucuuaagaguuuaccuuagcacucucaacucuguguugacugaugugucuacacgccagguuuuaucucuguuauacuguuguuaacuuuguuuugaaaugaggacaucuaauuuuuaucuguucuuuuucuuuuccuaauaauuuuuggcucuuaugauccuuugcuuuuuuauggaagcuuggaaucaucuuacacauucuuuucaggaaaguucauuaggaguuuuuagguuuauggagaaccugcagauuaauuuggggagaugccaucccagcaguuuugagucuuaacucacacauaagugucucuguuuauuuagguguauuucucccuuagagacuugucuugccuguacugccccuuuugugcuugugcauuuuagcacucuaaaaguuuuauacuaguuguguuuucauucucuuuuggagcccaccaucacccagcaaaccuuuauuuguuuguuuguuuguuuguuuguucugagauagcaccucauguuuugcccagguuggguuugaaaucaugguccucucgcuuuaauauguagaggugaaauuuuaucuuuuucuaguauuccuuuuuguugaauuuuuuauugcuauuuugaacacuuuuuugauauauguaugucuuuguucauugagacagguccucaccauauagcucaggcuaaccucagacaggcugcaugcaguccuccugcagccucccaaguguugggauuuaaguauaagccaguguguuuagccccuuucuacacuuccuguaguuucaggguaagaauuucaguuacauuguaagugagguaacugauacaaagagacaacuuugugucuugagaauuaauuaguaaagacaggaccuagcagugguucaggucuuaggauucuaggccuggagcugacuuugguuuuguuuuguuuuguuuccucuccuacaucaaauaucuuaccauucugucucuacagugcucugaccuuuaauuuauauaacuauccauacuaaauaucuuugauuugauuugggccauacuccuguuuuuaagagauuuucagccucucaggcacucuggguguuuaugacauagaaauucugcuuuccaaaaauccaagacauugauaugcaaaaaaaggcagggauggcugcaaccaaacauagagacagacacaggaggugcucuguggggauucauacaguacaagguaugcacucaugcaccgccucuuugagcuuuaaaaauaauacuagguaaauguggacuuaccauggucugccaguaugucauuuuaacccuuaggacucuaguccuuaaauauaaguauacuagacaugcugcuauucagugaccaugucuaccaggaaaaggcuaaucugcaagcuaguuuuugucaucuuuaccaugcuuggacauuugagagccuuugacuuucacauuccugcacauuagcagacccgugagaucaguuuuaaauuugacaggucgaugguguuaaacuuaccaguuuauaggacuuacuuuucugaaaaucaaaguuuuuccugcuuucaggugccuuaucaugucucccccuuuuccaggauucugagcuaaguuccuagaggccuuggagucuguccaguucaaagugcuugaacugcacuaugguucuaucaaacuugcuuauaaaaaugucauuuggcacuuagaagaaacgcugacgacuaaacuucuccccaaaagauucugucaucccccacccacccacccccguaggguucuccuucccccagacaguuuaugaugagcaggcuuaagaaacccucuuaggcuggggaaguaucucaguggaaaaggacagcugcugugccaucaugccagaucccagcaccuaccuaccaagcuaugcauccuuauaccccugcaaucccagauccaagcaaagcuggggcuuccugcuuccagucuaucuguggaaugugggcccaagguccagggagaggccuugccuuacaggaauagauuaagagugauguuggaagaugcugaugcccucuucugaucucuguguuuguaagcuugcuuacagacuuuaucucucucucucucucucucucucucucucucucucucucuauccauucauucauucagagacaggguuugucucucauccuuggcugucuuggaauuugcucuguagaacagacuggccucacacacagagauccucugccucugccucugccucugccucugccucugccucugccucugccucugccucugccucugccucugccucugccucugccucugccucugccucugccucugccucugccucugccucugccucugccucugcuucacacugggauuaacuagugggcuauuagcacucacuuauuauucuuuuaaacaguuuuauggggcauuugcucagcuauauuuugaacuuuuucucacccaccagugucagcuucugucccucaacucaaucuacuugcucugaauguaguuaaaaagggcuuuuguauauuuuucacuuggccuauuugggauuucuuaaggugcauuguagcucuuugguaucugucugauauauaagaucugcugauugauggaucugcuauggacuucaucacuuagguuagcauuucuuuuaccuccagaauuaucuacaaaugucagcugagaauuucauucuggagauguuuaagacuaagguguagcuaccagauucuuuggcuuccucagaucugagggacauucccaccucucuguugcaguagcuuggguccugucaucacagcaggcuucucccucucauagacacaugucacaucaucacucacaagcuuugaacuguguugcuggcuggcccugugaguaacuguaucucuggcugcaggucauucugagagagucucucuucauuuuuccagguggcaaaccauaugacuucuucugacucuguuucaucuccugggagcuuguugagcuuggacucugcucuuuccaaugaggaaacuguacgcauggugagcaaggguguacaagcugguaagucccuugaguuuaaguucugcauugauguagaccuaccucuucagcacacuuacuuaacuuuaaaaugauaaaagguguaaagauuaaaaguuaucugcauguguagaugcuauuuuuuuauguacuaauugaaaaauagcaaguuucuaaguaagaguuuagggaaaugaguaucuucauagcagguccaaguaauuccgccccugugaagaacaguuuggcaguucuuaucaaauuuaguuugacccagaauuuuuugcauuuggaauuuggccaguagauacacuuaaaaucaauguugacagccaucaguaucaauguugaaauuaauuauuguaauuucccauaaagaaauuuuauguagaaugaagaagcucucucuacgggcugauaagaugguugagagcagugguuguucuugcagagggucuugguucacuucccaauacacacauacauacuacaagcauacucaaacauguguaauuccaguucuggggaauucaguguuucugcaggaaugcuugucacacagacauacaugaagagaaaacacucauacucaaacauaaagaaaucuuauuuuaccaauacuggaaggucccaugcauauauacuuuauaacucgauguucagaaaagugcuucugugugcauuuugugaaagcagaauagggaagagaguggccugcgugacggugucugggguccuuuguugugaacaacuggagagcagagcuagacaguuucugauuuuauacaagucagucuuuuuccuucuuccuucaagucuugaguucgccaucgucaccgcuuucuuccucuuccugggugauuggcagcugggccagacauacuuacuguccuguuaucuugcugucagaguucaugaaagccugaaccagggaauccauauuucuucuuucugucugauagcuaaacccacuuaagaauuaaaccuucuuuccucugcaacagucugccuuuuuuccccucucuuccucuccuucuuuguccccucuccccaugcaguguaugguguuuugaguuauuaauaggggcucaccaucugucuugauuaagccugccagccuugcuuccggucugcuccaugauacaucugucuuucuccucagguaacuuggagauuguggcuggugucaaaaaauacacucaggauguuggggugacuuucccaacucccaguucuagugaggccagauuggaagaggacagugaugugacuucuucgucagaagaaaaagccaaagagaaaaaguuucuuuccaauuaucugcagaccaaaaacuuaaggaagaacaagccaaaucccugugcaggucgguuucuaacuccagguagccggaaacuaguaaaagacgugucugagucuguggaaagcucuuuguacuccaccagcugccagcuaccacauucgaaaaguuugaaaguaacuagaacuuuauguagagucuucuguaguugagaccaguuuaugggcacccuaaagauugucacccccaaccgaugagucccaugcaagucaguauuacauacauuucuuugauguaauugggugcaguuauuaaaauguuuguucuugaaaauauuuccuguaggagucucaugguuuguuccuguggaaaguggacaaucaggaucuaagaaggaaaaccugcccaagauuuacagaccuguuaucuccugguuugaaccaguaaccaaaaccaaacccuggagggagccacugagggaacaaaacuggcaggcccaaugcaugaacagucgugggucccugggaggcccaggcagggauaguggccagguuucucuucggccauuugugagagcaacucugcagguaggcacagugacaugagguugacuuuagccauauguguuugugggguguguggcuggcaugcuggggucuagucauuccaccguccucagcaucuguggacugggaggagaggaagggcucuguugcugugugcaggcuccccguguacagaucaggccgaguguuugggucacugugcagaguaaaccaagcgcucaucccugagcucugcccccuuggugguuaaaggaaauauuuaaugaggaauuuguuugaagugaaugaauugaccucuugucucaucaacauuuggaagaguugcaggugaccccacuuugguucucagcuuuuccuaaagguguuucugggcuuccuuugaucucccugggugugcccuccccucaggcucccuagaccugugguauaggugcugguuuuuuuauuaguuugcuuguuguucuggggacuuggaaaacagucugugucacuaaugcgaggcuuucucuccucuaggaaucacuucagcuucacagaccugauuucaucucccacucuggggagcgcauaaagcgucugaaguuacuuguccaggagaggaagcuccagagccuguuccagagugagcgggaggcucuguuccacucagcgaggccccugcccaggagagguaugcgcucaugucacuuugcugagagcggaugccaggcagcacgaggaugcugagcguggcuuugcuugcugagacgugagucuccuuagacuggcccaccuuagcuugucaugugucugugaccccaguaagccgguuccgcucgccuugccacugcaccucuaaaaggacaagcugccauaaggacggugccucuugugaacuaaccugguguuugugguuccagaguguggcaagaagugagcccuggugcacugaccugaggucugccuggcacuguucucacagcgccucucuaaggaaggccacccaugggcugcugcucguacuucacccccacuuacucuucuuagggaaagagcuggguuugcagcccaggucucugugugcucucucuguugcacugaguggcaagucuccaucaaaugacaaggaagcuggggguguaaagcacuaccgagagcuggcagccucaccgcucagcuggccaggaguuggggucccugccauagcagauuugggcgguggccucugaccccuaaggcaguucagaagugcgccuuguccuuggucuuagucacuuuccugugcuccaacucagguccgugcccaggcuccagcagcccuucacuaagcucuaccucuccuuacacuuacuguccccugauaagccuccucucuugucuaguccuccuggcuguccagaagaacaagccuauuggaaagaaggaaaugauucagaggaccagacgguaagucugaaggaacgggagugauuccgugcagcugcccgcagcucugcuucccagcacaugcccagauggaagccgguggggugagguuugauguugcuucucauggcacaagaaaggaagagaaaacagacgauaguaugaaccugguuccuguucagagggaaggggaacgccuagggugagcuucucugcauuagacauagagaugaaauuaaaacguauuuugaaacaaauuuucuuagcaagcucauuucuaggaguuuuucuaacagaguaagaaauaguggguugcucucuacaacauuagcuuaauaacuuggguuuccgaaguguguacaguuucaguccgcugccucauugguaguguuuaaaaacaaaugccuuugcuuuaauagcugugaggcccugagcauguguaaaguauuucuguccauugcaaaagaacugguaacagcgcuuaccucugggaagcaagggcugaguggcucugguuaggcgcgugagaggcuggggcuuuggucucuugugguuuuaagauugacuucuuuuuauuuuuuguuuguaugaauguuuugccugcguauauguuaguguaccacaggcaugcaguucccugagagggcagacgaggguguccgguuuucuggagcuggaauuacagacauuugugagcuacauuuugaugcuaggaacugagccuggguccuuccucugccuagcauccagugcuccuaaccacuggggcugagucauuucuuuagacgaguuuuucauaaagacuuugaauuuuauacaauugaagcauugucuacucauugguuaaucagcuugauaaacacauauugauuguaagaaugccauugaaaaacuaaguuacagguuucuggggcugauuagaagcuggcuuuaauaagaacagucauggaguugcugaaaugguggguuguugcugcugcuguuguuuuuagcagugaugguuuguuuggggcaaacaaacaaauauuuagauauagagagcuugaaacaaauauuuagauauagauagcuugaaagaaauauuuagauauagguagcuuggcuagcucggcgcuugcucuggagcccagcuuggccuagaacucucugagauccccgugccucugccgugcuucuggagagccagcguuacaggugcugccaccacucggcacugcguccuuuucaaggauuuguguuuuuaaaauuguaaaaaucuuuggaagauauuuuuaaaaguagaaagaagaaaauaaauauuacucaaaauccuucccuccauccugcaaacagucaucuuguggcuagagugggcuuuguagugauuguaguguuucuucugugugugcaggucugacugcugcuuucucucuguccuguugugaaugugucuccguaccgcuuagccgugguugagacauguucugcuuuauucuugcacagucuauucuguugggagucaguguucaaaugccuguuugugcucucucagcuugaaguuagggacacccagcccucuauaggaugaagcuuaacuuuucacauuagacacucggcucguggcugccuugccugaccugcuuccugccuggccucuguaccacaucucuacacauuuccccagcguggaugcccugucucucuuuuuuuuuucucuguuccugacagguuuuuuuauuuccaucauaagccuaagcucucugaagcuugcucugcccuuuccucagaauaaguuucucuucucucugaccucuaugguauuuuacaggugcaucuauucuaguccuuucuuuauuuccuguguuuuaaauacaguaguaacugaaaaugcuagaggcaaaacacaucaagguaacagcaauguccuaagacaugacauggaauuucauaaaauuaaaguuucguauagcaaagaaacagcagaguaaagagauggcuuuccagauggaagacagcuaugcaucugucuaguuauuuucuuguugcuuuguuaaaauauccuaauacgagccuacagcuccagccucagagaaggaggacguagugacaggagcaggaggcuagcucaaguagagugugacaggaaguagguccaagcucaagaccccucccuagggagccacuuguuccagugauguuccacaaucuucccaaacagugccaccaacuguguuccaacacgggagacaaaguggguguuucacaccaccacccacagaggauucuguagacucuauagagacccuaaagagauuaaucauccagcugaaaaaugggcuaauaagcugaguaggcuguucucaaaagaggaaacacaaagagccaauaaauauuagacaauguguucacacuccuuagccaucagggaaauacaaaucaaagcucuuugagauuuccucucacgccagucagaauggcuagcaucaaggaacaaaugauagcaagugcuagagaggacaugcacugugggagggaagaccacugccacagccacuguagacucagcaugauguuccacaaaaacaaacaaacaaacaacccccccaccccccuaaaagaacugaaaaugaaacugugauccagcuguggcaccucuggguguacaccugaaggccuuaugcugacacaucacugagaugcuucuguauucauggacugcagcaauagucacagcagucaagaaaugacgucagcuucaauagucaucagcagagacgugaauaaaggaaaugugaggcauauauacaguggaauuguauucagcugugaaaagugauauauuuucaggaaaauggguaaaucuggaagucaccguguuaagcaguguuuaagccauguuuucuccauuuguagaacauaacguagaaagucagccuugaugggggagauaaaggaggcaaaagaguagugucaugaaaccagacuuggguguguguccugaaaacauuuaaaguacaguaauuagcuaaagaugguguugcauacccauauagucuagcauuugauaagguaaggcuagacugaguuccagacuagccugggguaccccaauugauagugauauauguaaacauagagguaugugucuguguuaauguauguauguacucaguaauaccuguuuauuauauugacacuauacaguuugcacacggcauggaaaacaauauuaccuacucuauuuuauuauuuuucuggaaguaagcacuauugucaauguuuuguguuuuuauucaucucucuuucauacugugggcaccauacccaggcuaggcucuccauaucuauggacaugaauguuccacagggcuggcuuuucuagaggcuggaugccuaggcagcauagagcuagaggugugggcagagccauccugugccuucaugccugauaacuuuacugcuuuuugucuuuccauuuguggcauuucuaagaauuuaugagcagcuuccagaagugaagaagaagagagaagaggagaagagaaaaucagaauauaaauccuacuggcuacgugcucaacacuauaaaaugguuaguugaguuggcacugucuguggagggguggucaggcuuaucagcagaggaacuagaaauggccuggcuugcuuuugagaagcagugugacugcgugcugagguuucagcaguaggcagcugugaucagccuucaagugagagguagcugggagccgcuucccaugugucuacaagugccacacaggcaacuucucgcucgcagcucaacuguacaaaguaucaggcuuguaauuuccaaauggugauuaaguuccuguuguaauccucuggaaugaaguaaauaaacucacaggaucacgugagagucaucagggagugaggcaagagccuggagccugccaagaaccuccuagggcagauuuucuuggaagccacgcuggccaccagcuugaaggguucugucucucacaguucuuauuuuccucccaggcuauucacuacauucuagaggacccugaaagucagaaucugaacaccagaccagacuaugugagguuaagaaccaugucuagagcacccaggagccucagcacugggggagaccccaggaaccacauggcugccugcuguguuagcagcacucaggcucuggcugugcugggaugcagucagaacucuagaucaucugcuauggaggaggaauagguguggcuuauaaacucucuuuccaaaacacuuuuccucauugccacugucaguaggugagcaacacaagauuuagggaaagcagucugagucucuuccacagugugccuaggugaguuugagcagcuacccgugucugcaucugacuucugcccuguguuuucuuccacagaaagugaccaaucaucuccuggggagaaaagugccuugggacugacauaagacuacuuucuucagagccuaggaauccuuuuuuuuuuuuuuuuuaugaucccaaagagacuaauuuauauuugugugaauaugauuuaauaaagcauugucuuugucuaugucagcuuagucccuguggggucuggggcagcggcagaggcacugggaguuuggaugcaggucuuccuuucuccacugcggccuugcccacggccaugccuuacgauggaacucuugacuucuaggagagagggagccccugcuuguguguguuuuuauacuuugcugcuugacucauagugaagcaagcacaaaagcucauuucuuuccuaucuggagaggagcagguaacucugaaaccuuuuucagcuccaaaaugcuaugacuucaugccuuguuuguuaccauucagaauagaaauaggaaguggugguuaucucaaaccccaguuugcaaggcaacuuaggcaagauggaaauaauaggauuucucgggcccagcacuggauuguucagaugcccugccagagcauucaggucuggcaccugagagggcauggaaacaggacuugaaaacaguucucagagcuggggccugccuucugcucccagaucacaagaugacaucccuacuguacagagauccagaggccccaucucuggcuucauuccucaggcagucagccugcccugcucucucucuaccagcuauacuugcccugucagcgugcugucagccucaccaggacccacccauaccucucucuuugcuggaagcccaggccagggcugcucaccuggugcugcugcugcuucuaacuuacuguggauuuacuuuagagcugcuugccugcugucuacuccuuauagagcccagccaaguccugcagugucugcuagggccuccaguuuguagugaggguaugggcgaagaggacauaaucuuaaugugagcccagggaaagagaggggaggucauuagguaccugaggcuggcuucagagucuacaacuguucacagcuagacacagcuucuuuucagggaccuucacuuacauugugagcugccaugugagugcugggcaccagcccagguccucuguaagagcaacaaguguucuuuaucauugagccaucucucuaguccucuccaaugaaauguaaaauguuaucaaccauaaagggagagaaaagacccccaugcugcacccgcccccccccccauugaagaauauaauugcaacacagguaaccaacagaagaucuauaugcaggguacauaaaaagcuuauaugaaucaaccuccaaaacugguaauguaaaaaggagcuaaauagugggcacaggcaauuucacagaaugacaaacauccggauccuaacuauggaaguuauccugcauuggaaaaugcauacuaaaaauaaaagacccuuuugugcucaguggauuggcaagucuggcacaccagaguuguccaggaaaggggcuuaaguggaauccaagugcaucuugaagagauuuguguucacugaacaacugagucucaacgaugcaccccacugcccacccaggaaggcuaaaggcagcagcuuccuaacauugcaaagggcagggacaacucgccuccuuucacaggagaauagguaaugacaaguuauauagucacaaaagcacucuaggcaaacucaccaacacuccagcuaugucugcaugccucaggguaaagucaugcacaccuguuuccaauggaaaggacgcuguccuacucacagucauucccacucccuucucagaauguccccucaccaugcacuauuugagugccgcaggugccaucuuugccaagcuauccccuccugaaggagccacagguuuuggauuuuauccaagugaggcuucuccuuccuguuucuuaguucccucagccaagagcacacucuccugauucugcucaccucugugaggcaggguugcugguagcagccugugccccucccuccuucacacagagccgagcuaagaugcaauggagaggggacauuagcugguaauagaagagccucacuuuaaccuucuccugcaguguguuugauuaaccugagcucugggcaguugccugcagaagccuuagcccacuguuuugucuagucaggcuaauuuuaaaguucuacccugcuaccuggccacaaauaucugcuagcucuacaauuguuccuaaaacaaacuugcuuuaacaaugugcacauuagcuuuuucuuuuuuuagagauaacaucucacaguguugcuaaagcugucuggcuauccuugaccuagaauuacaaccauguccagccauacugguaaaguuuaaucuggguccugucuacugaauacauccacauugauuuuguucaaaagauuaaccagggcuagagagagagcucagcaaugaagaacucuuguuacccuucuggagaaccuggguucaauucccagcaccccaaaugauggcuuacaacaguuccaggagaucugacacccuauucuuaccuucuuuugacacaaaucccccaaguucauggguuuccuugacuuucugcccaucccaauucuguuagaaguaacccuaccauucuuaccugaagauuugggguuccuaagacaagugcuaaacagcacguguuucuccacugcagagcagggugucaaacuggccaagaauaucccggagccucuggcaucaguggagcuguuuagaaagguacauuccacuuuccugaggcuaugugacugcaggaggcagagcagcaguuccccauagaacucaugcaggggcugggcagcugagccaguaaagugacccccccaagcccucagauuuccagaacccacauagaaaagcuggguguuggggcuuuuguuuguaauccuagcaaugaggaaucaagauaaauggauccuggggcuaccuggccagccaguuugugccagugagaaacugugucaaaaaacauuugagguugaguucugacauauuugcacaagcucacacacacacacaugcacacacacacgcacacgcacacacaaaagagagcacacauauucacaugcauucaugugacuccauggacagcauugcucucuuuaacuacuugugaacuugagaguuuuagacauagcuauaggcuucuuucauuuucccauuacugggagaaaacacuuucaggcuuuaaaguuaaccauuuuuuuuaaauuauuauuauuauuauuaagauagggcuucauuauguagcucuugcuggccuagauuuugcuauguagaugaaucugguuuuggaacucacagauagccuccugccucaccucugccuucugagugcugggauuaaaagcaugcagaugcuugggguuaauaacuauuuuaaaauacacaaaaaaacaguuggugucauuugauaacauuugcacugcuauuaugauauuaucacgacccuaagacaucaaggcuuacaggaacacauucaggccagaggcacuuagggaaaugaggaaucgcagggcaauguggacaggauggagcugugucccagggcugauguaugggagccuugcuaauccuauagcuuuucuugacuauaggaacacuccauguucagccuaucuuaagacaugcaugcugcuccacgaggucgaguccaaucaguugccacaguguguaaauaauuucuaaaacacccuguggcucaccuccacccacuguccuaaccuugugcugccuggcuagucacagggccauagccagucccuugguucugggacuucagucccucuaaagcagagguaggugagauuccaaccaagucuuaguucugcauguaacaccuucagaguuugggaaagaccuucacuuccuuaugcuucugcuuuuguaacucuacaaaaaccuggagcccugccugaaccagacugcuagagugagguaauaggcuucugccaacccaagguguccugagacccugacagcuggccugccaagcucaguagaugacccaaagauucacaagcuaaguaaaauuuuacuauuuuguguuacuguuuuuuuuucuuuucauuccuuuuuuuuuauuagguauuuuucucauuuacauuuccaaugcuaucccaaaagucccccauacccuucccccccaccccccuccccacccacucccacuuuuuagcccuggcauuucccuguacuggggcauauaaaguuugcaaguccaaugggccuccgaguaggccauguuuugauacauauccagcuagagucaagagcuccgggguacugguuaguucauauuguguuacuuuuuauacauggcguuauguuagcuaaagaauaccucagaaagccuagauaacacagaguaaccauugccccaagcccacccacaaaacacuuacucagaugugcuugagagugaggguuagugguuugcaccugaaguagcugggucugcuuguuacuauuacagaagcaaucagauccugauugacgcccagaggagagagaucacagguccccuucccaaggagaagugaggcuauacuuuaaguuuaucauuggagauuuccuuagucuggacaaauagguguagaaggucucgccagucuucuggaagcccaugcccugguagagagccagggcugcguacugcagcaugcugguggaaaggacaacuucacugaagcccugcaucugugcaaauuggaggacaguccugaccauagcuuucccuaggccuucucuucggugcugcaaugacacagagaggugaaguagcugcaguugcuucuucugcaagaggggguccuucacuggccgagcagccaccaugcccacugucugaccucuagacucagcuacccagaagcaggaggagugagaacucauguagguucuggugaugucagccaugucugugugcaaacaguucaucacaugcuuuucccauguguauuuugcaaggaaccacagggaaagaaagaggguaaggauggacagaagaaccagaagccaggagccugaggccaggaauagaguaagagggaccccgaguaagagcaggaggguucggggcagcagcagcauguggcgaaagguggcggggaugugcuccuccaugccucugcggaacaaauccaccacacuccuguggucgcuguccugguauuuucggauaugauaaggagccaugggagacuucggaggcuaagaucucaaagaccaaagacacagcugcuucugacuguagguuucccuguaacccugcugaagagaaaagaaaccaugcaagucccccaacuaaguucccagcuugccauuaaccuauucaacaugugucugugugugucuguguguguacaugcacaugugaccuaagaggaaaccauuaacagagagaauguauaaagccagacacacugguuggaauguuauuuucucugccugucuggaagugagacauugggcacaucacuuaaucucucuggaccuauaucuucaccugcagaacaugauaaagaaacacuugccuucuagacuccccuugaaguaccggcggcccccuucucuuccacccuccuggccccauuacuggcucucuaaauuucauggagcauugagauaguacccugaggccaccagucuucaugcccagcuccuuugaucucuuucucuagaguauauacauugcaaaugcaggauuuccaagaucaaguuucaacaaagccauuucccaucagcucugaacauuuagacuuuugagaaaacaugaacaagaagguccuguuacaggagaggaaugcagagacaccccccaaccccaaccuugcccccaaacauacucaccuaguugcucagagcucaggguccaaaucagccuuagugcugugcuugugacugauugugaggcuaaucaguggccuguuauuuauugagguagcagacuugguagaaaccucauuggcugaaagcuggauguuugauaauuauaaaccacagagucaaguagaugggcuguggagaggaacauucagguguagucaacugcgugacugccacagaaugaaccuggaagggaaucaggaucugagauggcucagggguccuuaaucucaugauggaaugcaggcaccucaccuccuugucccuucccgggugcaguggcucucucccagcacucuuaucccucucugaggcucucugcucccugcuccucucccaugagcucacuugucaucacaagcaggaguuauaccuacugucucaagugcaggagccuucauugguggacuucucccugcccaggcugcacuugccuccuuuucuaauggcuccugguggucuuugcugacuucuccaucccugccucaaacauguguugaugaaacuaccauggugcauuagucuucuuaggccccagacuuagagagacacccuuguauguuaaaauguccccauggaagagacccacuuaugccccucagcuuguggcuuucugccuagggugaagccaguauuuguaggauucaucugugugugugcugggggagagggguguagacuaaacuaggagcgcccccccccucacuauucacagagauagaucgacaagcagaggcuuauucuccaaauacaauccaguuugguggggaaucucagggcacugcaauaaauauguguuaccgcacacaggucccacuuuccaguggcuggcccaaauaaaggagaagacuuauguaacauccuuacauaaccucucuuggcaacaaagacagaaauggagagggagcacagguuagcagacagagcagcaccguucccacagugaacuaggcagagacgguucaagauuguggggaccuuuuggcaagaugcaauucuaguuuagucuucagugaguauugcuaguuuuggggcacacacccuccagaucucuccugugugaccaagcagccuccuuuggugacuuaugcaucaggggagggucugacugaagugagccugggcagaugaagauaacccacacagcaucucugcaauuuaccaacacaucuguguccuugugcauguuucaguggaauggaggauuuucacagagaugugggcugaggaugggcuuuagggccugucuguccucagcccuugcagucuggcccucagccucacuuuccagagcagaagcuuccaggcaaacuccuuccagauuggacagaauccaucuggaagaagcuggccaaccaggcuucccugccuccggggaggugauaaauuccuucuggccugaguuucuuuuuuuuuuuuuuuuuuuuuucuuuccauuuuuuauuagguauuuagcucauuuacauuuccaaugcuauaccaaaagucccccauacccacccacccccacuccccuacccgcccacucccccuuuuuggcccuggcguuccccuguucuggggcauauaaaguuuguguguccaaugggccucucuuuccagugauggccgacuaggccauccuuugauacauaugcagcuagagucaagagcuccgggguacugguuaguucauaauguugauccaccuauaggguugcagaucccuuuagcuccuuggguacuuucucuagcuccuccauugggagcccugugauccauccauuagcugacugugggcauccacuucuguguuugcuaggccccggcauagucucacaagagacagcuacaucuggguccuuucgauaaaaucuugcuaguguaugcaauggugucagcauuuggaugcugauuaugggguggaucccuggauaaggcagucucuacaugguccauccuuucaucucagcuccaaacuuugucucuguaacuccuuccaaggguguuuuguucccaguucuaaggagggguauaguguccacacuucgauaguauauauaagugacccuaaaaauuccaccagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagucacaaauaauauaaaauaucucggagugacucuaagaaagugaaagaucuguaugauaaaaacuucaagucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuagaaggagcaauuugcaaauucaucuggaauaacaaaaaaccuaggauagcaaaaacucuucucaaggauaaaagaaccucugguggaaucaccaugccugaccuaaagcuuuacuacagagcaauugugguaaaaacugcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucauguagaagaaugcgaaucgauccauacuuaucuccuuguacuauggccugaguuucuaaugaccuggaguuguuaauuaguguggggauaagcccccuugggggagugugggguuucuaagcauagcagagagagugcaaagguccugugcuuucuugaugcugagggcagccccaccccccacucugcugacugcugaacucacaguuuauaguuucagguugucuugcccccuaacuccagacagauucuacaucucuagugaaguuacaaagccaauuuuugagguucacuuuucuauaaaaaaaaaaaauccuuaagaucugugauacuaaaacgauugggccuauuugauauuuuacugcuuuugaccccaaaugucuuuucuuuuucuuuucuuuucuuuucuuuucuuuucuuuucuuuucuuuucuuuucuuuccuuuucuuucuuucuuccuuccuuccuuccuuccuuucuuucccucccucccucccucccucccucccucccucccucccucccucccucccucucucucucucucucucucuuucuuucuuucuuucuuucuuucuuucuuucuuucuuucuuuuuugaacagauaaggcugagugucaacugagcagcgaaggagacuucuauucugagcacaugcucuucuaagaaauucuauuuggacuuccugguuuauaggcugaggguaggaccuaaauucuccaccuaaauacugaggcuccacagagucaagagaaacgcugagcguggagcuuuaaauuggaggcaaugcagacuugcaauagaacacaucaggguucauauccuagcccugccucuaaugacugucuucagcuuucaguccccuacccuauuuguguaguuggggggggggggucaaaguggcaccucccacuggauccccaaaaagcacuguaugcacagguuuggucucuaccauuuuucuucuuuuuuucuuuucuuauuuugugacuuugauccuucuaaauguuuuucuugcuucuugcugaaaucucuacaacauaaaauuaagcuuuugcacuaugagacuuugcagcauuuggcccacuggcaauguuuugguagcugacauuucucaaaugcuagccauucccaguacagaugccacccgguauuccuacagcagcggcuuccuggucugucucuguaaacccugggcaccagggcacagucugcacucgaucuaagguuuugucucggcucuucuggcacaguuccuacuugcuacgaggacuucagcagccugaggcaccacugaaccuccugcuacuccuaacucaccgugcgacccaacaacccagucugcccauccaggcauggguacaggcaccugcgcagcaucucuccacccuucaggaagagcugagcuagccauacuagacuauaauuggauccaagaccucuuuggagaugcuccacucauacaacauccuggaaaacgaccucagguuuccagaaaaacucaaaucauguuacuugccuuggggauugaagaugccuuguauccacuucuggguugaacgggucucaggcacuuuggcagcuggugucagagacgaggcuuucaggaacacaggccucaaucucaaugacugccacgaugcaaguuggacacaguaug

SEQ ID NO: 3153 - RNA, 33246 nt, Mus musculus
ucugccugaaaguucaucugacccuccaguuuuguuaugugacuccuuucagaacuggugacagagggugagagaaaggcuggccaguguccgugccauuucuauuuuucccuucucuucaucaucuucaucuuuauuaauauauguguuucacuguguaacccaaagcugaucucaagcucauaguccuccagccucagucucccaaguaggacuauagguauaaacuguuaugcuugguagaaaaaaaaacaaaacaaaacauacaaaaaccccucuuaguguaaggaugguuuaauuaaauguguucccagucauggccucccuuuuaaaaauuuucccugugcucauucucauuuugaucauaugacugaccuuuuggaaacagauuuugaauuacuuggguuuuuaaaaauuugugugugugugugucuguacacaugcguacuuguacaugcauuucaguagguauaaaaagcacaccgcuguuugauguuuuauguuuauaaaaucagaacccauugacaucuagucacagguauaucugucugacccaggugucuacucacugcaaaauauuccauggaguaucugaacacuugccugagcucugcugaacacucagcccaccuggccagcauguaaaucaagcagucaggucuuuguccuucugugucuuuguuuuuucacuuuacauuccuuucgccuguccuccucuuuauccucugagaggauagagccuccccauccuggguauuccccaacucugauacaucaaaucucuguagggcuaggcacauccucucccauuggggccagacaaggcagcacgguuaggggaacauauuucacugacaggcagcagcuuuacggauagcuccaacuccauuuguugggggguccacaucaagacgaagcugcacaucugcuacaaauguguggcguacguagguccagccuguguaugcuuuuuggauggugguucagucucagggaacccucaagaguccagguuaguugacucuguuggucuuccuguggaguugcuauccccuucagcgcccucaguucuuccucuagcucuuacaugagaguucccaagugcccuccaauguuuggcuguggguaucugcaucuguccaagucagcugcugggugaagccauugcuagucuucugucugcaagcauaacaggaguauuagcaauagugucagaguuuggucuugcccacagaaugggucucuaaguggacccauuauugauuggccauucucucaguuucugcuccauacuccaucccugcauuuuuuuguagacaggauaaauuuugagauaaguuuuguggguggguuagugucccuauaucuccaauaggguuccugcuuggcuacagggaguggccucuucaggcuugauauccccacuacuguggggcaucucaaggaugugucagagaccuaggauaggggaguucucugugagauuuuuacuuguauacuggaagugguuacauguauacuggaaaugggauucuuuggcuaagcugcacaauacucaaucucauauaagaguucaaaauuucuuuuuaaaguauuuauuccuuguggaaagccacaugugccguugcagaguggcgcuggcuacugcuggccaccacgcauaaguuuggacaaacaacuaauguguauauaugcaguaaagguuuuugccaagauacugccuguccugggcaugauaaugagguucugagaguauaaccaaucagaugaggaauaugcaaaugagguauagugcauaaccaauccgggugugagacacgcaucuccuaggccuauauaagcagcaccaguucugggcucggggucucuucaccucugcaaucaagcuuucccaauaaacgugugcagaaggauucuguugcagcgucguucuugcuggcgagucggacgcgugcaagaaguggugccaaaaacccgguaaaagaaacaucuucaggcacgagcgaagacccccugcuacagggaggauucagaacugcaucacggggaaggagcgguuaauaaaguguucucauaaaacagacugcugagaaggauucaacugcguggauucagaacucuucagcuggggaacagugguaccgguaaguaaaaagaaauuaaugugagucucugagagguaugcuuuccuacgcaguagguccgguaauuauugcuaggguugugaagggcagcgacuuuugcaggaguaccaagaaggcauaucagaaacagagagaaaugaaaaaaaagacgcacacagaaaaauauauaacuuaagaaauauaaagagagaaaaagaaaggaagcuaaaauauaaagauacaaaggauacaaaggauaauauaaaauauaaauuuacaaaggauaauauaaaaaaugaagaacaaaaaauuaaguuaauuuacccuccuuucgaggacuuugacuaaagaggcagcuuucaucaaaggcuuaaagauagcucucaggaaaagaggaguaacuacuagaagcagccacuguguagaauuccaagaaggagaaaaaaugaaaauaagcuauuucagagcucucacagggacagaaggaaaacgggagacguccugcuuccucucuggcuccuauggagauguuuuuagcuccggauaggauaucugugucccuuugagacaucaaggucuauugucuguuuuuggugcaccaaauugucuauaugucugucaauucauguuuguuuuuguuuggaugauugagugauuguuguucuguguuucauguugaaaauuauaaaaggcagucucagucuacacagcagaaacugauaaguuagcugcacgauggcugggagucaaguacagcugaaaaagccccacugagggcugauugcaaauggagcucuuaaaggggcaggcagccuuuugcuuguaacagaaaguuagcuuaaaauuggaaacucaagguuggagucauucuaaacaacauguacgaauccaagaaaacaguucauaugcaaaaucaguguacaaaggguagaaagaguagguuugaaaagaaaguacauaucuuuacaaauagaaggaaaacccuuucaagguauaauggauacaggagcagauaaaagaauucuauccaguaaauuauucucagaaaagcaaggaaaugaugaaagggaugggauauauaccuggacuaggucuuggaaaaaacguacaagguagaauuucaccaguuaaagccacagaaaaagcagacaagaaagggcuggguuuuuucuaggggccgcugaggagccuuugcccauuccgugguguacagaggacacggugugggugccucaguggccuuuacccucugagaaguuaaaagcagcuaaagaauuaguacaagaacaauuagaccuggggcauguggaacccaugcaaucacccuggaauaccccuauuuuuguuguaaagaagaagucagguaaauggagauuguuacaugaccuaagagccauuaaugcacaaaugcaaguuauggguccuguacaaagaggacucccccuacucgcagcucuaccuaaggauuggagaauuauaguaguagauauuaaggauuguuucuuuuccauuccauuaaauaagacagauaaaccuagguuugcauuuaccuugccuucuauuaaucauauggagccugauaaaagguaccaauggcggguauuaccccaaggaauggcaaauaguccuaccauaugucaguuauauguagaaaaagcuuugcaaccaguuagggaugguuuccucuccuuaaaaauuugucauuauauggacgauauugugauuuguggaccugaagaagaaaguauacagcaagcuuaugucuugcuuaaugaaacauuaaaaaauaauggcuugauuauugcaccagaaaaaguacagcagucuaauguuagucauuuuuuaggagccacuauuacuuuacggugugccaccccacaaaagauuaguauaagaaaagaucaucuaaagacacuaaaugauuuucaaaaauuauuaggagauauaaauuggauuagaccuuauuuaaggaucccuacuuuggaauuaaaaccuguauuucaaauuuuagaaggagaaucacauauuaccucguugagacaauuaacaccugaggcuucugauguucuuaggaagguagaaaaagcaauccaaacagcacaguuaaaucauauaaaugagcaagagccuuugugccuauaacgcaccaucaauuugccaacugcuguguuauggcaagaugguccuuuaguauggauacauccacauauauccccuaauaagacuauagagcauuaucccaccauaguagcaaauauggcccacaaagguauaaaaacuucaauuacucacuuuggaaaaaugucugauagcauaauugcucccuauacugcugcacaaaugcaaauauugugugcuacuauagaugaaugggccauucuuagaugcaguuuuucugguuuaauugauaaucauuauccuaaacaucuguuauuacauuuuaugcuauugcauccagugauauuuccaaagguaauggcuaauacuccuauaaagggagccaaugauauuuauacagauggauccaaaacaggaauuggaaguuauguuaucaaugaaaaggcuguaagguugcaauuuacaccaggagccccucaauugauagaauguuuggugguuuuagaaguuuuuaaaagauuuccuaugcccauaaauauuaucucugauucuguuuaugugguuaaugcgguacuagcauuagaaacugccggaaauuuuaagcagucuaguccaguaucugaaaauuugaugaaaauacaaaauuguauuuugaugcgugagcaucccuuuuauauucaacauauuagagcacauacaucauuaccuggaccuaugguuaagggaaaugcaauugcugauucagccaccagagacaugguuuuccuaucacaaaguucuauagaaagugcaaagaauuuucaucagcuuuaucaugucccugcuucuacauuacgacaaaaguuuaagcucacacgaauagaagcucgagauauuguccuacagugugguaaauguguagaauuuauuaaugcaccuuccguggguguuaauccucgcggauugcaaccccuagauguuuggcaaauggacaucacacauaucccaucuuuugggaaauuacaauauguacauguauccauugauaccaguucugguguccuacaugccucucccuugacaggggaaaaagcaguucaugucauaucucacugcuuagaggcuugggccgcauggggcaagccccuagugcuaaagacagauaaugguccugcauauacuucuaaauuuagccaauuuugcaaacaaaugcaagugaaacauauuacuggauugcccuauaauccacaggaccaaggcaucauugagagagcccaucgcacucugaaacaauauuuguaaaaacagaaagggggaauagaggcuaugaugccaaagauggcucuaucccuuacaauauuuacucuuaauuuuuaaaauuggaugaugcuggaagaucaccagccgaaagacacggacaauggccucaaucgcccaaugaaauggucaaauggaaaaauauccuugauaauaaaugguauggcccggauccuaucuuaaucagauccuggggagcuauuuguguuuuuccacaaggugaagaaaauccacuuuggauccccacgcgacugacaaggacugugaaagagcaagaugaaccccaagaugauccucuuacuccugaugauugagaccgggauaaguauacccuugugguccauaguaagaucauggccaguaccuuuaccgguacauuccaauucuucuaccuugccuuuguuuuuugcaacggaauguuauuuggaugcgccuuaugcacgacaaacuccucaagagccacggguguauaauaguacuaguuuucauuuaaauuauacacuaugcuuugugcauaauguggauaaaccuuuuacacccuguauaucuuuuaagaaaaagauuaucucuaauugggcagaucaaauuaauacugcugacaccauaagucagauagcagaaaaaucgucugaagcauugcuuacccugcaaggguggauucucauaucaccucaggguuaauguuagugaaucagaguggauauuuuacaacaugacauggaacagaugauggaugucauacaaaugaguuguguggcauccacuuugcaugugugcauuacucccaauagguacacuaauaauccuuuuauuaaaaguacagaccuaucgaauuaccugaaggcaaacuggucgcaggagcuggaaagguugcagacaaggcugcagauacagauccugaaccuuaaugggaccagaguggaaccagugaccucuuggcuuaccucuguguuuucuuacuuuaaggaaugggugggagugauuuuguuuggugcugccauaugcuguggacugguguucaugcucugguugguaugcaaauucagaacccaacaaaaacgugacaaggugauuauaacucaggcacuuuuagcuauugaaaacggugccucccauuucuaugcucaagaauuagucggcaucugaguucucugcucuugcaccccacggauuuauggauccauugcacugggaugagagagacucaacaaucauugaucagcccuugcacaucgcugagguucccucauugcacgcgauagggugaucaugauuuccccacuaauucauuuuuuggcuggccucuuuugcagaguucgcccuaggucauuuagcaguuacugucacacagcacugagguaugcagagacgggcaacuuuccucgugcucagaccaaccuaagacacggggcccgguggcgauaggguuacccuaugacggguaaggcugugacauuagaggaaugaccuaaaacaggagccacggccaauggacauaauugcacaggccuaguccagcaucauuuuauuaaaacaaaaagggggaaaugugggaagccuuugccguugcagaguggcgcuggcuacugcuggccaccacgcauaaguuuggacaaacaaccaauguguacauaugcaguaaaguuuuuugccaagacacugccugccccgggcaugauaaugagguucucagaguauaaccaaucagaugaggaacaugcaaaugagguauagugcauaaccaauccgggugugagacacgcaucuccuaggccuauauaagcagcccaguucugggcucggggucucuucaccucugcaaucaggcucucccaauaaacuugugcagaagaauccuguugcagcgucguucuugcuggcgagucagaugagcacaagaauuccugccugaauuaaagguauguguguguguuguuguuguuguuguuguuguuguuuugagugaaugcuauuugucuuuuaagugucugccauaguuccaaacucugcuauagcacaguguacacuccuuccaagucaaaagaaagagaggcuuuuaagagauuugcucucuaucgccaggcgugguggugcaugccuuuaaucccagcacuugggagccagaggcaggcagauuucugaguuugaggccagccuggucuacaaagugaguuccaggacagccagggcuacacagagaaacccugucuccaaaauccaaagagagagagagagagggagagugagagagagagagagagauugagauuuccuuucuuuccaacauuaacacauugaccuguccauccacacacaguucuaacauugaauuuggcaugugggaugcuucuuugagauucauauucaugaaaagaggauugucgacuguaguauagucuuguaugaagcuuguuuuuaauaucucuguaaaacuccauucucaagacauagcauccauacuuaauuccaaacaccuauagaauacuuauaguuauuguacacuaggcaaaauguuaagaaaucccaaaguuuuauaaguaaguccguuuuguaaccgcaacacaauaaaacugggcugaaguaauauaauuuuuaaauacaugagagucaaaaaaguuucuuauuuuucaagguagcaaugguuugucaaaacuuagagguuuugucuaacugugaugagaagggcguguccaugauaggaauccauucccaggacugacuaaucaggagcagauccuuuaaaagaauaguuccuuucugacugauguugccacagaagaagacuacacuucaacacuagucauacagagacacaagcacagaugacagagguuccuuuguguacaugaaugguuuugccuguguauaugugcaagcaucaugugggugaccuuuuauagauuguuuugcauuguuuuaugcagauauauuuuaaaaucuaaaugaugauugaggaaauguaaauuaaagugacgaagagguuacaaaaccuacauaguuaucuaaucaaaauuaaauugcacucuaaaaucuaugcucuacucucuucugucucuaagcuuguccccucuggaaagguuuuuuuuuuaaagauuuguuuguuuguuuguuuauuauauguaauuacacuguagcuaucuucagacacuccagaagaaggccucagaucucauuauggaugguugugagccaccaugugguugcugggauuugaacucaggaccuucagaagagcagccagugcucuuaaccgcugagcggucucaccagcccccuggaaaguuuuuaaaguucccauucagcaggccugagagauugugcuguguuaucucaggcccuugccaaggacucggcuuucuaauaucugccaauacucugaaguguguuuuuuaaaaauuucagaucugccauuuauguuucucaugucuuuuuugugcuuuuuucauuuuugucugaggauuuuuuuguugauuuuuaaacauuaguucgacuguaauuaugcuguuauacacacucuuuauugacuccaugacuauggagcucuucccaaccucaagauuauaaacaaauuuccuacuuuagaaagaaguagagguagagaagcaguccauucaaacuguuaaguacuucaauuuguuuugugugugcucuaaauagucaaucaucaauagauaucuuagcaauauaaaguuccuaagaaaaucugguguccucuuaagcuggacucucucaaucauuaagacuuagcaauugaauagcuugguucuuuuggaauuuuaauccaaaacaauugcaauauggaggaccugaucaaauugaaaagaucugaagagcaaauugauucuggcugaaguaugaaguuuuauuuucacuaauccuaaaguugagucagagcuuccaaguaaaccuaacagguguagcugccaccugagucaaauaaagaugcagagucacccugugaguggucaugaucccuguggauauuuagagccaguggcagcaguguuucagggaggacaagggaaaaccacuuuuccaacuuggcagaaaaccuuuggaauucuacuauucugcucuccugcucugaaagguugucaugaucacgagucagcuuucugguuucucccaugcguugcuggaggaguuuauuuuaguucuuaguuuacuuuucuccucuguuccucagccuuccuguaucugggaaacuuuccugaccccaaccacaguggccucuauagcauguuagccaucuuaguagcuacagcucgaaugucgauguaacccaaaucuguuuugucuucaguccucacucacauggguaccagagcaaacaaaaccaaaacccaaggaccucuucagauacgaugcccuuuucacguucuggggaugguuuuauacgcacaaacaaacuuucuuuuucuuuuuuugagacaggacaugucuacauagcccuugcugucuggaacuuacuauguguaaaccagccuggccccaaauuuucaaagaucuacugccuauggcucccaagugcuagguuuaaagacaccugacauuuuucauaauuucccaaucucuaggaauuacaugucaagaguuuuuuuguuuuuuguuuuuguuuuuguacagaugcauuguaauuauauaaucaguuccucuggacauuccuaaagccuuuugacaagaagaaggcauguuuggugacaguuucucugacuuugacugacuuacuaguguauuucuggcauuuuaagcuuggauaauuauauuuaccauuaauccacucaucuggaaaaaaacaaaaaacaaaaaaucuuucccuccccugaggugccuguuugauucaaggcuauugauacugaauuuccuacauaauaacaaauacacccuuccaagcucaauuuuauauucagaguauuuuucuuauuuuggacagggcuccuuguagccaaggcuggccuuuaacuugcuguguagccaaagaugauuuugaacuccugauucuccugccaaccuccugugcugggauaugguuauacaccaucacaccugccaauuaaguggcuaguuuuuggcuagcaugauuaaugaaaacaauuagaaguaauuuuagacuuuaaaaggguuucaagaaaccugaacguaguggcaaaugccuggaaucccaguccuugggaugccgauacagguagaucagaaauucaguacacagccaguuaagagaucaugccuccauaaacacaauaguuaaggguucuucucuggaucuuaaagauguuaaucaauaaauguagaaaugggucucaucuaguacuuuuuaacuuaaaagguacuacaaaaguccagaaacacugaaaugcuggcauuuuucucuuccuguguagaaccaggcaccagcaggugaguuuacuuuccaacauuagagagaagcagcaaacaucuucuuccaagaucguauccaacagaaaguuuacacugugguagcugguaucauuuaacucggaaaugcuuaaaucuuuaugucgaagccccacuuuggaguacagucagccaacucacacaugccuggaguuugcuaaggugcuugugacccucauggacaaagggacguguucuguagcuugccagcaucugucaaagacucuuuaaaaauguauucugugguggauccccaaaaccagcuggacacaaguacaggucuuuccaaggugacuuuggaaucuggguagaagucaguauucccuguccuguugcuugacuugggcuuuacucuaggauguucagaugcaccucaccuagugcuuucaugucaugcuguagcaugugcucacucucuuauacacacacacacacacauacauacauauauauuuauuuauuucuagggauauuuuuaaaaaccaaccuucuaauacuaaauuccucugagaauguuuaauguuuucuuuguaugugaaauguucuagaaacagucuucacuauaagcauuauuuuuguuaguaaaccucaucaugaggugagcuugggaaaauuccuuccaaucccaaauuccuguucaaacaugcccuuacacuuuacacccagaagcaguaugaauguuccaaguugugaacaucccuguuaguauuuguuuugucucauuugacuuucaccaucauagagguccuuucaugucauaaggacauuuguacauaagcacuuuuuguuggguggacuuuuuuuagacuauaguuuugaauguuugucuugucuuucuuuucuuucuuucauucuuccuuuuuugguuuuugguuuuuugauacggguuuuucuguguuguccuggaacucacucuguagaccaggcuguccucgaacuuagaaaucugccugacccugaauguuugucuuuucauagcaauuuaccaaaauaugcacuguaaaugcaacuggucuuuggaaauucagaaggccugugcuccuauccauggcuuucacacccugccugaagcaggacucaccagccuuugcuucagcagauccggagaccagugcauaugucuuagucccuaaguagcaacaguuuucacuauuaagauugcaaaaagccauuuccuuucugaauucuggcaugggaaauaggucgcuuuuucuuagugaccuuaggucgcuuaggucacaagaucuuuuucucuagguauccauucuaaccauuccucacacauacuguauggaagaacuuuccacuuccuuucucaaauacagcagccuucuuggggaucuguuuguggacaucagacuuugaaaguuggaucuuugaacuaagcaugaaggaaugguuugccacauuuauaggcuaaaacacuuuuacaaccuaacaccaucaagcuccuaucuucauugccacacucaccacuugaagucuuuuuguugagucucucuugagcugguaauacagccuagugaacccugagaacugauguagccugagcauucugugugcgccccacucuuguucccaggccucagacucagcagaggcagcaguguuaagugucuagugcgagugaguugugcaguccucagcucucccaccuuuagagugucuguuuauuuauagucagucauuccuuauuuucagcuucuggaacccuuagccugucuguucugcacaguucacauagucacugaugauacagccuuuugcagaugacuuguuugcuucaguguuuucaguguuuacccaugugaugugcuuucaguauuuccucuuccugcugaguaguaguugauuauguggguguuuaucacauugugucuauuaguggauauuugaauuguuuuuucuuuguuuuuauuuuucuuuuuaauuuuucucuuuuuuuuuuuuuuuuuuuuuugagacggguuucuguguauuccuggcuguucuguaacucgauucguagacuaggcuaaccucaaacugacagagcuacaucuaccucugccuccugagaguugggaucaaaggcauucccuaccacaccugccuuuagauuguuuuuaguuguuggaauacaacuaaacuaugaccauuugucuagaaguuuuauguaagcauuuucauuucuuuuaagugugaaaugguuugugauuuuuuuuaauguuuuuagaaacuuuuuuuuaauucacuuauucauucacucagucauuuauugguuuuuuuucuuuuugagacaguguuucucuguguagcccuggcuaccuuggaacucuguggaccagguuggccuugaacucagagaucugccugccccugccuuaaaggcauacaccacucacuguuuccagcccuuuuugggcuuguuuguuuguuuguuuguuuguuuguuuugggggcuuuugguuugguuuuccguugcuacuguuuguggcuuuuugcccuuuuuucccccaaaguggcuuugcucuuuccugugccugugugcagaguguugcgcauuccacuuuuuuccacaucuuaucagaacgguugccauacuagaugaugagaaggcucccugccaugauuuuaauccgaccuuccuggugacuggauagugaagaccuuugguguguuugucuuugcugacaaggauacucaauuuugccuauuuuuaaaccagguugucugucuuucugcucacuuaguaagaguuuuauguauuuggggucacuuuucugccuuuuggguaucauguuuuaacuauucuuaucagcucgguauucuuguaacaagucuuauaagauguauaacuugagaaugucuccuauucuggcacuucuguuuauuuuagaaaugaaauuugaaguuaagggcugaauaaugcaguuugguguaacaauuuuccccuuguggauugugcuauuuuuauuagaccugaguauuagaccugagguuuuuuuucccuguguuuucauuuuaaaaguugaugcaggcauguucgaccuguagugugaguguaccauuggauaagauugcacugucagagcaaugucagaaaagcuuggacauaucugcuggguuuaguaauucuuuagaucugcauccauguucagugcauguuuuguauguggugugguggcuagcgucaauuggcaugugaagauucauuuauucugagucccuagcugaccauaaucuuaagaguuuaccuuagcacucucaacucuguguugacugaugugucuacacgccagguuuuguuucuguuauacuguucuuaacuuaggauucuaggccuggagcugacuuugguuuuguuuuguuuuguuuccucuccuacaucaaauaucuuaccauucugucucuacagugcucugaccuuuaauuuauauaacuauccauacuaaauauucuuugauuugauuugggccauacuccuguuuuuaagagcuuugcagccucucaggcacucuggguguuuaugacauagaauucugcuuuccaaaaauccaagauauugauaugcaaaaaaggcagggauggcugcaaccaaaccuagagacagacacaggaggugcucuguggggauucuauacagugcaaaguaugcacucaggcacagccucuuugagcuuuaaaauaacacuagguaaauguggacugaccauggucugccaguaugucauuucaacccuuaggacucuaguccuucaauauaagcauacuagacaugaugcuauucagugaccaugucuaccaggaaaaggcuaaucugcaagccaguuuuugucuuuaccaugcuuggacauuugugagccuuugacuuucacaugccugcacauuagcagauccaugagaucaguuuuaaauuucacaggucgaugguguuaaacuuaccaguuuauaggacuuacuuuucugaaaaucaaaguuuuuccugcuuucaggugucuuaucauggcucccccuuuuccaggauucugggcuaaguucccacaggucuuggagucuguccaguucaaagugcuugaauugcacuaugguucuaucaaacuugcuuauaaaaaugucauuuggcacuuagaagaaacgcugaugacuaaacuucuuuccaaaagauucugucuucccccccggcccccccccauaggguucuccuucccccagacaguuuaugaugagcaggcuuaagaaacccucuuaggcuggggaaguaucuccauggaaaaggacagcugcugugccaucaugccagaucccagcaccuaccuaccaagcugugauuccuuauaccccuguaaucccagaucuaagcaaagcuguggcuuccugcuuccagucuaucuguggaaugugggcccaagguccagggagaggccuugccucacaggaauagauuaagagugauaugggaagaugcugaugcccucuucugaccucuguguuugugaucuugcuuacagacuuuaucuaucuuaucuaucuaucuaucuaucuaucuaucuaucuaucuaucuauucauucauucagagacaggguuugucucucagccuuggcugucuuggaacuugcuccauagaauaggccggccucacacacagagauuugccucugccucugccucugccucugccucugccucugccucugccucugccucugccucugccucugccucugcuucacacugggauuaacuagugggcuauuagcacucacuuauuauucuuuuaaacaguuuuauggggcauuugcucagcuauauuuugaacuuuuucucacccaccagugucagcuucugucccucaacucaaucuacuugcucugaauguaguuaaaaggggcuuuuguauguuuuucacuuggccuauuugggauuucuuaaggugcauugcagcucuuugguaucugucugauauauaagaucugcugauugauggaucugcuauggacuucaucacuuagguuagcauuucuuuuaccuccagaauuaucuacaaaugucagcugagaauuucauucuggagauguuuaagacuaagguguagcuaccagauucuuugguuuccucagaucugagggacauucccaccucucuguugcaguagcuuggguccugucaucacagcaggcuucucccucucauagacacaugucacaucaucacucacaagcuuugaacuguguugcuggcuggcccugugaguaacuguaucucuggcugcaggucauucugagagagucucucuucauuuuuccagguggcaaaccauaugacuucuucugacucuguuucaucuccugggagcuuguugagcuuggacucugcucuuuccaaugaggaaacuguacgcauggugagcaaggguguacaagcugguaagucccuugaguuuaaguucugcauugauguagaccuaccucuucagcacacuuacuuaacuuuaaaaugauaaaagguguaaagauuaaaaguuaucugcauguguagaugcuauuuuuuuauguacuaauugaaaaauagcaaguuucuaaguaagaguuuagggaaaugaguaucuucauagcagguccaaguaauuccgccccugugaagaacaguuuggcaguucuuaucaaauuuaguuugacccagaauuuuuugcauuuggaauuuggccaguagauacacuuaaaaucaauguugacagccaucaguaucaauguugaaauuaauuauuguaauuucccauaaagaaauuuuauguagaaugaagaagcucucucuacgggcugauaagaugguugagagcagugguuguucuugcagagggucuugguucacuucccaauacacacauacauacuacaagcauacucaaacauguguaauuccaguucuggggaauucaguguuucugcaggaaugcuugucacacagacauacaugaagagaaaacacucauacucaaacauaaagaaaucuuauuuuaccaauacuggaaggucccaugcauauauacuuuauaacucgauguucagaaaagugcuucugugugcauuuugugaaagcagaauagggaagagaguggccugcgugacggugucugggguccuuuguugugaacaacuggagagcagagcuagagaguuucugauuuuauacaagucagucuuuuuccuucuuccuucaagucuugaguucgccaucaucaccucuuucuuccucuuccuggaugauuggcagcugggccagacauacuuacuguccuguuaucuugcugucagaguucaugaaagccugaaccaaggaauccauauuucuucuuucugucugauagcuaaacccacuuaagaauuaaaccuucuuuccucugcaucagucugccuuuuuuccccucucuuccucuccuucuuuguccccucuccccaugcaguguaugguguuuugaguuauuaauaggggcucaccaucugucuugauuaagccugccagccuugcuuccggucugcuccaugauacaucugucuuucuccucagguaacuuggagauuguggcuggugucaaaaaauacacucaggauguuggggugacuuucccaacucccaguucuagugaggccagauuggaagaggacagugaugugacuucuucgucagaagaaaaagccaaagagaaaaaguuucuuuccaauuaucugcagaccaaaaacuuaaggaagaacaagccaaaucccugugcaggucgguuucuaacuccagguagccggaaacuaguaaaagaccugucugagucuguggagagcucuuuguacuccaccagcugccagccaccacauuggaaaaguuugaaaguaacuagaacuuuauguagagucuucuguaguugagaccaauuuacgggcacccuaaagauugucacccccaaccgaugagucccaugcaagucaguacuacauacauuucuuugaugucauugggugcaguuauuaaaauguuuguucuugaaaauauuuccuguaggugucucaugguucguuccuguggaaaauggacaaucaggaucuaagaaggaaaaccugcccaagauuuacagaccugguaucuccugguuugaaccaguaaccaaaaccaaacccuggagggagccacugagggaacaaaacuggcaggcccaaugcaugaacagucgugggucccugggaggcccaggcagggauaguggccagguuucucuucggccauuugugagagcaacucugcagguaggcacagugacaugagguugacuuuagccauauguguuugugggguguguggcuggcaugcuggggucuagucauuccaccguccucagcaucuguggacugggaggagaggaagggcucuguugcugugugcaggcuccccguguacagaucaggccgaguguuugggucacugugcagaguaaaccaagagcucaucccugagcucugcccccuuggugguuaaaggaaauauuuaaugaggaauuuguuugaagugaaugaauugaccucuugucucaucaacauuuggaagaguugcaggugaccccacuuugguucucagcuuuuccuaaagguguuucugggcuuccuuugaucucccugggugugcccuccccucaggcuccccagaccugugguauaggugcugguuuuuuuauuaguuugcuuguuguucuggggacuuggaaaacagucugugucacuaaugcgaggcuuucucuccucuaggaaucacuucagcuucacagaccugauuucaucucccacucuggggagcgcauaaagcgucugaaguuacuuguccaggagaggaagcuccagagccuguuccagagugagcgggaggcucuguuccacucagcgaggccccugcccaggagagguaugcgcucaugucacuuugcugagagcagaugccaggcagcacgaggaugcugagcguggcuuugcuugcugagacgugagucuccuuagacuggcccaccuuagcuugucaugugucugugaccccaguaagccgguuccgcuggccuugccacugcaccucuaaaaggacaagcugccauaagaaaggugccucuugugaacuaaccugguguuugugguuccagaguguggcaagaagugagcccuggugcacugaccugaggucugccuggcacuguucucacagcgccucucuaaggaaggccacccaugggcuacugcucguacuucacccccacuuacacucuucuuagggaaagagcuggguuugcggcacaggucucugugugcucucucaguugcacugaguggcaagucuccaucaaaugacaaggaagcuggggguguaaagcacuaccgagagcuggcagccucaccgcucagcuggccaggaguugaggucccugccauagcagauuugggcgguggccucugaccccuaaggcaguucagaagugcgccuuguccuuggucuuagucacuuuccugugcuccagcagcccuucacuaagcucuaccucuccuuacacuuacuguccccugauaagccuccucucuugucuaguccuccuggcuguccagaagaacaagccuauuggaaagaaggaaaugauucagaggaccagacgguaagucugaaggaacgggagugauuccgugcagcugcccgcagcucugcuucccagcacaugcccagauggaagcagguggggugagguuugauguugcuucucauggcacaagaaaggaagagaaaacagacgauaguaugaaccugguuccuguucagagggaaggggaacgccuagggugagcuucucugcauuagacauagagaugaaauuaaaacguauuuugaaacaaauuuucuuagcaagcucauuucuaggaguuuuucuaacagaguaagaaauaguggguugcucucuacaacauuagcuuaauaacuuggguuuccgaaguguguacaguuucaguccgcugccucauugguaguguuuaaaaacaaaugccuuugcuuuaauagcugugaggcccugagcauguguaaaguauuucuguccauugcaaaagaacugguaacagcgcuuaccucugggaagcaagggcugaguggcucugguuaggcgcgugagaggcuggggcuuuggucucuugugguuuuaagauugacuucuuuuuauuuuuuguuuguaugaauguuuugccugcguauauguuaguguaccaagugucccugagagggcagacgaggguguccgguuuucuggagcuggaauuacagacauuugugagcuacauuuugaugcuaggaacugagccuggguccuuccucugccuagcauccagugcuccuaaccacuggggcugagucauuucuuuagacgaguuuuucauaaagacuuugaauuuuauacaauugaagcauugucuacucauugguuaaucagcuugauaaacacauauugauuguaagaaugccauugaaaaacuaaguuacagguuucuggggcugauuagaagcuggcuuuaauaagaacagucauggaguugcugaaaugguggguuguugcugcugcuguuguuuuuagcagugaugguuuguuuggggcaaacaaacaaauauuuagauauagagagcuugaaacaaauauuuagauauagauagcuugaaagaaauauuuagauauagguagcuuggcuagcucggcgcuugcucuggagcccagcuuggccuagaacucucugagauccccgugccucugccgugcuucuggagagccagcguuacaggugcugccaccacucggcacugcguccuuuucaaggauuuguguuuuuaaaauuguaaaaaucuuuggaagauauuuuuaaaaguagaaagaagaaaauaaauauuacucaaaauccuucccuccauccugcaaacagucaucuuguggcuagagugggcuuuguagugauuguaguguuucuucugugugugcaggucugacugcugcuuucucucuguccuguugugaaugugucuccguaccgcuuagccgugguugagacauguucugcuuuauucuugcacagucuauucuguugggagucaguguucaaaugccuguuugugcucucucagcuugaaguuagggacacccagcccucuauaggaugaagcuuaacuuuucacauuagacacucggcucguggcugccuugccugaccugcuuccugccuggccucuguaccacaucucuacacauuuccccagcguggaugcccugucucucuuuuuuuucucuguuccugacaguuuuuuauuuccaacguaagccuaagcucucugaagcuugcucugcccuuuccucagaauaaguuucucuucucucugaccucuaugguauuuuacaggugcaucuauucuaguccuuucuuuauuuccuguguuuuaaauacaguaguaacugaaacugcuagaggcaaaacacaucaaggugacagcaauguccuaagacaugaacauggaauuucauaaaauuaaaguuucauauagcaaagaaacagcagaguaaagagauggcuuuccagauggaagacagcuaugcaucugucuaguuacuuucuuguugcuuugcuaaaauauccuaauacgagccuacagcuccagccucagagaaggaggacauagugacaggagcaggaggcuggcucaaguagagugugacaggaaguagguccaagcucaagaccccucccuagggagccacuuguuccagugauguuccacaaucuucccaaacagugccaccaacuguguuccaacacgugagacaaaguggguguuucacaccaccacccacagaggauucuguagacucuauagagacccuaaagagauuaaucauccagcugaaaaaugggcuaauaagcugaguaggcuguuuucaaaagaggaaacacaaagagccaauaaauauuagacaauguguucacuauccuuagccaucagggaaauacaaaucaaagcucuuugagauuuccucucacgccagucagaauggcuagcaucaaggaacaaaugauagcaagugcuagagaggacaugcacugugggagggaagaccacugccacagccacuguagacucagcaugauguuccacaaaaacaaacaaacaaacaaacaaacaacaacccaccccccuaaaagaacugaaaaugaaacugugauccagcuguggcaccucuggguguacaccugaaggccuuaugcugacacaucacugagaugcuucuguauucauggacugcagcaauagucacagcagucaagaaaugacgucagcuucaauagucaucagcagagacgugaauaaaggaaaugugaggcauauauacaguggaauuguauucagcugugaaaagugauauauuuucaggaaaauggguaaaucuggaagucaccguguuaagcaguguuuaagccauguuuucuccauuuguagaacauaacauagaaagucagccuugaugggggagauaaaggaggcaaaagaguagugucaugaaaccagacuuggguguguguccugaaaacauuuaaaguacaguaauuagcuagagaugguguugcauacccauauagucuagcauuugauaagguaaggcuagacugaguuccagacuagccugggguaccccaauugauagugauauauguaaacauagagguaugugucuguguuuuguauguauguacucaguaauaccuguuuauuauauugacacuauacaguuugcacacggcauggaaaacaauauuaccuacucuauuuuauucuuuuucuggaaguaagcacuauugucaauguuuuguguuuuuauucaucucucuuucauacugugggcaccauacccaggcuaggcucuccauaucuauggacaugaauguuccacagugcuggcuuuucaagaggcuggaugccuaggcagcguagagccagaggugugggcagagccauccugugccuucaugccugauaacuuuacugcuuuuugucuuuccauuuguggcauuucuaagaauuuaugagcagcuuccagaagugaagaagaagagagaagaggagaagagaaaaucagaauauaaauccuaccggcugcgugcucagcacuauaaaaugguuaguugaguuggcacugucuguggagggguggucaggcuuaucagcagagggaaguagaaauggccuggcuugcuuuugagaagcagugugacugcgugcugagguuucagcaguaggcagcugugaucagccuucaagugagagguagcugggagccgcuucccaugugucuacaagugccacacaggcaacuucucgcucgcagcucaacuguacaaaguaucaggcuuguaauuuccaaauggugauuaaguuccuguuguaauccucuggaaugaaguaaauaaacucacaggaucacgugagagucaucagggagugaggcuagagccuggagccugccaagaaccuccuagggcagauuuucuuggaagccacgcuggccaccagcuugaaggguucugucucucacaguucuuguuuuccucccaggcuauucacuacauucuagaggacccugaaagucagaagcugaacaccagaccagacuaugugagguuaagaaccaugucuagugcacucaggagccugggcccugggggagaccccaggaaccacauggcugccugcuguguuagcagcaaucaggcucuggcugugcugggaugcagucagaacucuagaucaucugcuauggaggaggaauagguguggcuuauaaacucucuuuccaaaacacuuuuccuaauugccacugucaguaggugagcaacacaagauuuagggaaagcagucugagucucuuccacagugugccgaggugagguuaagcagcuacccgugucugcaucugacuucugcccuguguuuucuuccacagaaagugaccaaucaucuccuggggagaaaagugccuugggacugacauaagacuacuuucuucagagccuaggaauccuuuuuuuuuuuuuuaugaucccaaagagacuaauuuauauuugugugaauaugauuuaauaaagcauugucuuugucuaugucagcuuagucccuguggggucuggggcagcggcagaggcacugggaguuuggaugcaggucuuccuuucuccacugcggccuugcccacggccaugccuuacgauggaacucuugaguucuaggagagagggagccccugcuuguguguguuuuuauacuuugcugcuugacucauagugaagcaagcacaaaagcucauuucuuuccuaucuggagaggagcagguaacucugaaaccuuuuucagcuccaaaaugcuaugacuucaugccuuguuuguuaccauucagaauagaaauagaaaguggugguuaucucaaaccccaguuugcaaggcaacuuaggcaagauggaaauaauaggauuucucgggcccagcacuggauuguucagaugcccugccagagcauucaggucuggcaccugagagggcauggaaacaggacuugaaaacaguucucagagcuggacccugccuucugcucccagaucacaagaugacaucccuacuguacagagauccagaggccccaucucuggcuucauuccucaggcagucagccugcccuggucucucucucuaccagcuacacuugcccugucagcgugcugucagccucaccaggacccacccauaccucucucuuugcuggaagcccaggccagggcugcucaccuggugcugcugcugcuucuaacuuacuguggauuuacuuuagagcugcuugccugcugucuacuccuuauagagcccagccaaguccugcaguggcugcuagggccuccaguuuguagugaggguaugggcgaagaggacauaaucuuaaugugagcccagggaaagagaggggaggucauuagguaccugaggcuggcuucagagucuacaacuguucacagcuagacacagcuucuuuucagggaccuucacuuacauugugagcugccaugugagugcugggcaccagcccagguccucuguaagagcaacaaguguucuuuaucauugagccaucucucuaguccucuccaaugaaauguaaauugcuaucaaccauaaagggagagaaaagacgcccuugcugcaccugcccccccauugaagaauauaauugcaacacagguaaccaacagaagaucuauaugcaggguacauaaaaagcuuauaugaaucaaccuccaaaacugguaauguaaaaaggagcuaaauagugggcacaggcaauuucacagaacaaggaacauccggauccuaacuauggaaguuauccugcauuggaaaaugcauacuaaaaauaaaagacccuuuugugcucaguggauuggcaagucuggcacaccagaguuguccaggaaaggggcuuaaguggaauccaagugcaucuugaagagauuuguguucacugaacaacugagucucaacgaugcaccccacugcccuuccaggaaggcuaaaggcagcagcuuccuaacauugcaaagggcagggacaacucgccuccuuucacaggacaauagguaaugacaaguuauauagucacaaaagcacucuaggcaaacucaccaacacuccagcuaugucugcaugccucaggguaaagucaugcacaccucaguguccaaucgaaaggacgcugugcuacucacagucauucccacucccuucucagaauguccccacaccaugcacuauuugagugccgcaggugccaucuuucugccaagguauacccuccugaaggagccacagguuuuggauuuuaucaaaguugaggcuucuccuuccuguuucuuaguucccucagccaagagcacacucuccugauucugcucaccucugugaggcaggguugcugguagcagccugugccccucccuccuucacacagagcugagcuaagaugcaauggagaggggacauuagcugguaauagaagagccucacuuuaaccuucuccugcaguguguuugauuaaccugagcucuggguagaugccugcagaagccuuacuuagcccacuguuuugucuagucaggcuaauuuuaaaguucuacccuucuaccuggccacaaaucucugcuagcucuacaauuguuccuaaaacaaacuugcuuuaacaaugggcacauuagcuuuuucuuuuuuuaaagauaacaucucacaguguugcuaaagcugucuggcuauccuugaccuagaauuacaaccauguccagccauacugguaaaguuuaaucuggguccugucuacugaauacauccacauugauuuuguucaaaagauuaaccagggcuagagagagagcucagcaaugaagaacucuuguuacccuucuggagaaccuggguucaauucccagcaccccaaaugauggcuuacaacaguuacaggagaucugacacccuauucuuaccuucuuuugacacaaaucccccaaguucauggguuugcuugacuuucugcccaucccaauucuguuagaaguaacccuaccauucuuaccugaagauuugggguuccuaagacaagugcuaaacagcauguguuucuccacugcagagcagggugucaaacuggccaagaauaucccggagccucuggcaucaguggagcuauuuagaaagguacauuccacuuuccugaggcuaugugacugcaggaggcagagcagcaguuccccauagaacucaugcaggggcugggcagcugagccaguaaagugaccccccaagcccucagauuuccagaacccacauagaaaagcuggguguuggggcuuuuguuuguaauccuagcaaugaggaaucaagauaaauggauccuggggcuaccuggccagccaguuugugccagugagaaacugugucaaaaaacauuugagguugaguucugacauauuugcacaagcucacacacacacacacacacacacacacacacacacacacacaugcacacacucacaugcacacgcacacacaaaagagagcacacauauucacaugcaugcaugugacuccauggacagcauugcucucuuuaacuacuugugaacuugagaguuuuagacauagcuauaggcuucuuucauuuucccauuacugggagaaaacacuuucaggcuuuaaaguuaaccauuuuuuaaaaauuauuauuauuauuauuaagauagggcuucauuauguagcucuugcuggccuagauuuugcuauguagaugagucugguuuuggaacucacagauagccuccugccucaccucugccuucugagugcugggauuaaaagcaugcagaugcuugggguuaauaacuauuuuaaaauacacaaaaaaacaguuggugucauuugauaacauuugcacugcuauuaugauauugucacgacccuaagacaucaaggcuuacaggaacacauucaggccagaggcacuuagggaaaugaggaaucgcagggcaauguggacaggauggagcugugucccagggcugauguaugggagccuugcuaauccuauagcuuuucuugacuacgggaacacuccauguucagccuaucuuaagacaugcaugcugcuccacgaggucgaguccaaucaguugccaaaggguguaaauaauuucuaaaacacccuguggcucaccuccacccacuguccuaaccuugugcugccuggcuagucacagggccauagccagucccuugguucugggacuucagucccucuaaagcagagguaggugagauuccaaccaagucuuaguucugcauguaacaccuucagaguuugggaaagaccuucacuuccuuaugcuucugcuuuuguaacucuacaaaaaccuggagcccugccugaaccagacugcuagagugagguaauaggcuucugccaacccaagguguccugagacccugacagcuggccugccaagcucaguagaugacccaaagauucacaagcuaaguaaaauuuuacuauuuuguauuacuguuuuuuucuuuucauuccuuuuuuuuuauuagguauuuuucucauuuacauuuccaaugcuaucccaaaagucccccauacccuucccccccaccccccuccccacccacucccacuuuuuagcccuggcauuucccuguacuggggcauauaaaguuugcaaguccaaugggccuccgaguaggccauguuuugauacauauccagcuagagucaagagcuccgggguacugguuaguucauauuguguuacuuuuuauacauggcguuauguuagcuaaagaauaccucagaaagccuagauaacacagaguaaccauugccccaagcccacccacaaaacacuuacucagaugugcuugagagugaggguuagugguuugcaccugaaguagcugggucugcuuguuacuauuacagaagcaaucagauccugauugacgcccagaggagagagaucacagguccccuucccaaggagaagugaggcuauacuuuaaguuuaucauuggagauuuccuuagucuggacaaauagguguagaaggucucgccagucuucuggaagcccaugcccugguagagagccagggcugcguacugcagcaugcugguggaaaggacaacuucacugaagcccugcaucugugcaaauuggaggacaguccugaccauagcuuucccuaggccuucucuucggugcugcaaugacacagagaggugaaguagcugcaguugcuucuucugcaggaggggguccuucacuggccgagcagccaccaugcccacugucugaccucuagacucagcuacccagaagcaggaggagugagaacucagguagguucuggugaugucagccaugucugugugcaaacaguucaucacaugcuuuucccauguguauuuugcaaggaaccacagggaaagaaagaggguaaggauggacagaagaaccagaagccaggagccugaggccaggaauagaguaagagggaccccgaguaagagcaggaggguucggggcagcagcagcauguggcgaaagguggcggggaugugcuccuccaugccucugcggaacaaauccaccacacuccuguggucgcugcccugguauuuucggauaugauaaggagccaugggagacuucggaggcuaagaucucaaagaccaaagacacagcugcuucugacuguagguuucccuguaacccugcugaagagaaaagaaaccaugcaagucccccaacuaaguucccagcuugccauuaaccuauucaacaugugucugugugugucuguguguguacaugcacaugugaccuaagaggaaaccauuaacagagagaauguauaaagccagacacacugguuggaauguuauuuucucugacugucuggaagugagacauugggcacaucacuuaaucucucuggaccuauaucuucaccugcagaacaugauaaagaaacacuugccuucuagacuccccuugaaguaccggcggcccccuucucuuccacccuccuggccccauuacuggcucucuaaauuucauggagcauugagauaguacccugaggccaccagucuucaugcccagcuccuuugaucucuuucucuagaguauauacauugcaaaugcaggauuuccaagaucaaguuucaacaaagccauuucccaucagcucugaacauuuagacuuuugagaaaacaugaacaagaagguccuguuacaggagaggaaugcagagacaccccccaaccccaaccuugcccccaaacauacucaccuaguugcucagagcucaggguccaaaucagccuuagugcugugcuugugacugauugugaggcuaaucaguggccuguuauuuauugagguagcagacuugguagaaaccucauuggcugaaagcuggauguuugauaauuauaaaccacagagucaaguagaugggcuguggagaggaacauucagguguagucaacugcgugaccgccacagaaugaaccuggaagggaaucaggaucugagauggcucagggguccuuaaucucaugauggaaugcaggcaccucaccuccuugucccuucccgggugcaguggcucucucccagcacucuuaucccucucugaggcucucugcucccugcuccucucccaugagcucacuugucaucacaagcaggaguuacaccuccuaucucaagugcaggagccuucauugguggacuucucccugcccaggcugcacuugccuccuuuucuaauggcuccugguggucuucgcuuacuucuccaucccugccucaaacauguguugaugaaacuaccauggugcauuagucuucuuaggccccagacuuagagagacacccuuguauguuaaaauguccccauggaagagacccacuuaugccccucagcuuguggcuuucugccuagggugaagccaguauuuguaggauucaucugugugugugcugggggagagggguguagacuaaacuaggagugccccacccgucacuauucacagagauagauggacaagcagaggcuuauucuccaaauacaauccaguuugguggggaaucuaagggcacugcaauaaaguauguguuaccgcacacaggucccacuuuccaguggcuggcccaaauaaaggagaagacuuauguaacauccuuacauaaccucucuuggcaacaaagacagaaauggagagggagcacagguuagcagacagagcagcaccguucccacagugaacuaggcagagacgguucaagauuguggugaccuuuuggcaagaugcaauucuaguuuagucuucagugaguauugcuaguuuuggggcacacacccuccagaucucuccugugugaccaagcagccuccuuuggugacuuaugcaucaggggagggucugacugaagugagccugggcggaugaagauaacccacacagcaucucugcaauuuaccaacacaucuguguccuugugcauguuucaguggaauggaggauuuucacagagaugugggcugaggaugggcuuuagggccugucuguccucagcccuugcagucuggcccucagccucacuuuccagagcagaagcuuccaggcaaacuccuuccagauuggacagaauccaucuggaagaagcuggccaaccaggcuucccugccuccggggaggugauaaauuccuucuggccugaguuucuaaugaccuggaguuguuaauuaguguggggauaagcccccuugggggagugugggguuucuaagcauagcagagagagugcaaagguccugugcuuucuugaugcugagggcagccccaccccccacucugcugacugcugaacucacaguuuauaguuucagguugucuugcccccuaacuccagacagauucuacaucucuagugaaguuacaaagccaauuuuugagguucacuuuucuauauaaaaaaaaauccuuaagaucugugauacuaaaacgauugggucuauuugauauuuuacugcuuuugaccccaaaugucuuuucuuuuucuuuucuuuucuuuucuuuucuuuucuuucuuuucuuuucuuuucuuuucuuuucuuuucuuuccuuuccuuuucuuuucuuuucuguccuuccuuccuuccuuccuuccuuccuuccuuccuuccuuccuuccuucccuuccuuccuuccuuccuuccuuccuuucuuucuuucuuucuuucuuucuuucuuucuuucuuucuuucuuuuuugaacagauaaggcugagugucaacugcgcagcgaaggagacuucuauucugagcacaugcucuucuaagaaauucuauuuggacuuccugguuuauaggcugaggguaggaccuaaauucuccaccuaaauacugaggcuccacagaaucaagagaaacgcugagcguggagcuuuaaauuggaggcaaugcagacuugcaauagaacacauaaggguucauauccuagcccugccucuaaugacugucuucagcuuucaguccccuacccuauuuguguaguugggggggggggugucaaaguggcaccucccacuggauccccaaaaagcacuguaugcacagguuuggucucuaccauuuuucuucuucuuuuuuucuuuucuuauuuugugacuuuugauccuucuaaauguuuuucuugcuucuugcugaaaucucuacaacauaaaauuaagcuuuugcacuaugagacuuugcagcauuuggcccacuggcaauguuuugguagcugacauuucucaaaugcuagccauucccaguacagaugccacccgguauuccuacagcagcggcuuccuggucugucucuguaaacccugggcaccagggcacagucugcacucgaucuaagguuuugucucggcucuucuggcacaguuccuacuugcuacaaggacuucagcagccugaggcaccacugaaccuccugcuacuccuaacucaccgugcgacccaacaacccagucuguccauccagguguggguacaggcaccugcgcagcaucucuccacccuucaggaagagcugagcuagccauacuagacuauaauuggaucccagaccucuuuggagaugcuccacucauacaacauccuggaaaacgaccucagguuuccagaaaaacucaaaucauguuacuugccuuggggauugaagaugccuuguauccacuucuggguugaacgggucucaggcacuuuggcagcuggugucagagacgaggcuuucaggaacacaggccucaaucucaaugacugccacgauggaaguuggacacaguauguaucuuggcucaagaguuggcaaucuuccucugcccuugaagaguucuugcgucagaguucucguggugagacagucuucacauuaucccccuucuuagggacuguagagcucgcucccuggccccugggagcuucccagagaacuccacugagggugaagggaagaccacuuuguucuugugaagcugguguugccacccucagauucuaaaguuuagaugcagggacgacgccauugucggguuccaaggagccuccugugg

SEQ ID NO: 3154 - RNA, 11596 nt, Mus musculus
ccucaaacugacagagcuacaucuaccucugccuccugagaguugggaucaaaggcauucccuaccacaccugccuuuagauuguuuuuaguuguuggaauacaacuaaacuaugaccauuugucuagaaguuuuauguaagcauuuucauuucuuuuaagugugaaaugguuugugauuuuuuuuaauguuuuuagaaacuuuuuuuuaauucacuuauucauucacucagucauuuauugguuuuuuuucuuuuugagacaguguuucucuguguagcccuggcuaccuuggaacucuguggaccagguuggccuugaacucagagaucugccugccccugccuuaaaggcauacaccacucacuguuuccagcccuuuuugggcuuguuuguuuguuuguuuguuuguuuguuuugggggcuuuugguuugguuuuccguugcuacuguuuguggcuuuuugcccuuuuuucccccaaaguggcuuugcucuuuccugugccugugugcagaguguugcgcauuccacuuuuuuccacaucuuaucagaacgguugccauacuagaugaugagaaggcucccugccaugauuuuaauccgaccuuccuggugacuggauagugaagaccuuugguguguuugucuuugcugacaaggauacucaauuuugccuauuuuuaaaccagguugucugucuuucugcucacuuaguaagaguuuuauguauuuggggucacuuuucugccuuuuggguaucauguuuuaacuauucuuaucagcucgguauucuuguaacaagucuuauaagauguauaacuugagaaugucuccuauucuggcacuucuguuuauuuuagaaaugaaauuugaaguuaagggcugaauaaugcaguuugguguaacaauuuuccccuuguggauugugcuauuuuuauuagaccugaguauuagaccugagguuuuuuuucccuguguuuucauuuuaaaaguugaugcaggcauguucgaccuguagugugaguguaccauuggauaagauugcacugucagagcaaugucagaaaagcuuggacauaucugcuggguuuaguaauucuuuagaucugcauccauguucagugcauguuuuguauguggugugguggcuagcgucaauuggcaugugaagauucauuuauucugagucccuagcugaccauaaucuuaagaguuuaccuuagcacucucaacucuguguugacugaugugucuacacgccagguuuuguuucuguuauacuguucuuaacuuaggauucuaggccuggagcugacuuugguuuuguuuuguuuuguuuccucuccuacaucaaauaucuuaccauucugucucuacagugcucugaccuuuaauuuauauaacuauccauacuaaauauucuuugauuugauuugggccauacuccuguuuuuaagagcuuugcagccucucaggcacucuggguguuuaugacauagaauucugcuuuccaaaaauccaagauauugauaugcaaaaaaggcagggauggcugcaaccaaaccuagagacagacacaggaggugcucuguggggauucuauacagugcaaaguaugcacucaggcacagccucuuugagcuuuaaaauaacacuagguaaauguggacugaccauggucugccaguaugucauuucaacccuuaggacucuaguccuucaauauaagcauacuagacaugaugcuauucagugaccaugucuaccaggaaaaggcuaaucugcaagccaguuuuugucuuuaccaugcuuggacauuugugagccuuugacuuucacaugccugcacauuagcagauccaugagaucaguuuuaaauuucacaggucgaugguguuaaacuuaccaguuuauaggacuuacuuuucugaaaaucaaaguuuuuccugcuuucaggugucuuaucauggcucccccuuuuccaggauucugggcuaaguucccacaggucuuggagucuguccaguucaaagugcuugaauugcacuaugguucuaucaaacuugcuuauaaaaaugucauuuggcacuuagaagaaacgcugaugacuaaacuucuuuccaaaagauucugucuucccccccggcccccccccauaggguucuccuucccccagacaguuuaugaugagcaggcuuaagaaacccucuuaggcuggggaaguaucuccauggaaaaggacagcugcugugccaucaugccagaucccagcaccuaccuaccaagcugugauuccuuauaccccuguaaucccagaucuaagcaaagcuguggcuuccugcuuccagucuaucuguggaaugugggcccaagguccagggagaggccuugccucacaggaauagauuaagagugauaugggaagaugcugaugcccucuucugaccucuguguuugugaucuugcuuacagacuuuaucuaucuuaucuaucuaucuaucuaucuaucuaucuaucuaucuaucuauucauucauucagagacaggguuugucucucagccuuggcugucuuggaacuugcuccauagaauaggccggccucacacacagagauuugccucugccucugccucugccucugccucugccucugccucugccucugccucugccucugccucugccucugcuucacacugggauuaacuagugggcuauuagcacucacuuauuauucuuuuaaacaguuuuauggggcauuugcucagcuauauuuugaacuuuuucucacccaccagugucagcuucugucccucaacucaaucuacuugcucugaauguaguuaaaaggggcuuuuguauguuuuucacuuggccuauuugggauuucuuaaggugcauugcagcucuuugguaucugucugauauauaagaucugcugauugauggaucugcuauggacuucaucacuuagguuagcauuucuuuuaccuccagaauuaucuacaaaugucagcugagaauuucauucuggagauguuuaagacuaagguguagcuaccagauucuuugguuuccucagaucugagggacauucccaccucucuguugcaguagcuuggguccugucaucacagcaggcuucucccucucauagacacaugucacaucaucacucacaagcuuugaacuguguugcuggcuggcccugugaguaacuguaucucuggcugcaggucauucugagagagucucucuucauuuuuccagguggcaaaccauaugacuucuucugacucuguuucaucuccugggagcuuguugagcuuggacucugcucuuuccaaugaggaaacuguacgcauggugagcaaggguguacaagcugguaagucccuugaguuuaaguucugcauugauguagaccuaccucuucagcacacuuacuuaacuuuaaaaugauaaaagguguaaagauuaaaaguuaucugcauguguagaugcuauuuuuuuauguacuaauugaaaaauagcaaguuucuaaguaagaguuuagggaaaugaguaucuucauagcagguccaaguaauuccgccccugugaagaacaguuuggcaguucuuaucaaauuuaguuugacccagaauuuuuugcauuuggaauuuggccaguagauacacuuaaaaucaauguugacagccaucaguaucaauguugaaauuaauuauuguaauuucccauaaagaaauuuuauguagaaugaagaagcucucucuacgggcugauaagaugguugagagcagugguuguucuugcagagggucuugguucacuucccaauacacacauacauacuacaagcauacucaaacauguguaauuccaguucuggggaauucaguguuucugcaggaaugcuugucacacagacauacaugaagagaaaacacucauacucaaacauaaagaaaucuuauuuuaccaauacuggaaggucccaugcauauauacuuuauaacucgauguucagaaaagugcuucugugugcauuuugugaaagcagaauagggaagagaguggccugcgugacggugucugggguccuuuguugugaacaacuggagagcagagcuagagaguuucugauuuuauacaagucagucuuuuuccuucuuccuucaagucuugaguucgccaucaucaccucuuucuuccucuuccuggaugauuggcagcugggccagacauacuuacuguccuguuaucuugcugucagaguucaugaaagccugaaccaaggaauccauauuucuucuuucugucugauagcuaaacccacuuaagaauuaaaccuucuuuccucugcaucagucugccuuuuuuccccucucuuccucuccuucuuuguccccucuccccaugcaguguaugguguuuugaguuauuaauaggggcucaccaucugucuugauuaagccugccagccuugcuuccggucugcuccaugauacaucugucuuucuccucagguaacuuggagauuguggcuggugucaaaaaauacacucaggauguuggggugacuuucccaacucccaguucuagugaggccagauuggaagaggacagugaugugacuucuucgucagaagaaaaagccaaagagaaaaaguuucuuuccaauuaucugcagaccaaaaacuuaaggaagaacaagccaaaucccugugcaggucgguuucuaacuccagguagccggaaacuaguaaaagaccugucugagucuguggagagcucuuuguacuccaccagcugccagccaccacauuggaaaaguuugaaaguaacuagaacuuuauguagagucuucuguaguugagaccaauuuacgggcacccuaaagauugucacccccaaccgaugagucccaugcaagucaguacuacauacauuucuuugaugucauugggugcaguuauuaaaauguuuguucuugaaaauauuuccuguaggugucucaugguucguuccuguggaaaauggacaaucaggaucuaagaaggaaaaccugcccaagauuuacagaccugguaucuccugguuugaaccaguaaccaaaaccaaacccuggagggagccacugagggaacaaaacuggcaggcccaaugcaugaacagucgugggucccugggaggcccaggcagggauaguggccagguuucucuucggccauuugugagagcaacucugcagguaggcacagugacaugagguugacuuuagccauauguguuugugggguguguggcuggcaugcuggggucuagucauuccaccguccucagcaucuguggacugggaggagaggaagggcucuguugcugugugcaggcuccccguguacagaucaggccgaguguuugggucacugugcagaguaaaccaagagcucaucccugagcucugcccccuuggugguuaaaggaaauauuuaaugaggaauuuguuugaagugaaugaauugaccucuugucucaucaacauuuggaagaguugcaggugaccccacuuugguucucagcuuuuccuaaagguguuucugggcuuccuuugaucucccugggugugcccuccccucaggcuccccagaccugugguauaggugcugguuuuuuuauuaguuugcuuguuguucuggggacuuggaaaacagucugugucacuaaugcgaggcuuucucuccucuaggaaucacuucagcuucacagaccugauuucaucucccacucuggggagcgcauaaagcgucugaaguuacuuguccaggagaggaagcuccagagccuguuccagagugagcgggaggcucuguuccacucagcgaggccccugcccaggagagguaugcgcucaugucacuuugcugagagcagaugccaggcagcacgaggaugcugagcguggcuuugcuugcugagacgugagucuccuuagacuggcccaccuuagcuugucaugugucugugaccccaguaagccgguuccgcuggccuugccacugcaccucuaaaaggacaagcugccauaagaaaggugccucuugugaacuaaccugguguuugugguuccagaguguggcaagaagugagcccuggugcacugaccugaggucugccuggcacuguucucacagcgccucucuaaggaaggccacccaugggcuacugcucguacuucacccccacuuacacucuucuuagggaaagagcuggguuugcggcacaggucucugugugcucucucaguugcacugaguggcaagucuccaucaaaugacaaggaagcuggggguguaaagcacuaccgagagcuggcagccucaccgcucagcuggccaggaguugaggucccugccauagcagauuugggcgguggccucugaccccuaaggcaguucagaagugcgccuuguccuuggucuuagucacuuuccugugcuccagcagcccuucacuaagcucuaccucuccuuacacuuacuguccccugauaagccuccucucuugucuaguccuccuggcuguccagaagaacaagccuauuggaaagaaggaaaugauucagaggaccagacgguaagucugaaggaacgggagugauuccgugcagcugcccgcagcucugcuucccagcacaugcccagauggaagcagguggggugagguuugauguugcuucucauggcacaagaaaggaagagaaaacagacgauaguaugaaccugguuccuguucagagggaaggggaacgccuagggugagcuucucugcauuagacauagagaugaaauuaaaacguauuuugaaacaaauuuucuuagcaagcucauuucuaggaguuuuucuaacagaguaagaaauaguggguugcucucuacaacauuagcuuaauaacuuggguuuccgaaguguguacaguuucaguccgcugccucauugguaguguuuaaaaacaaaugccuuugcuuuaauagcugugaggcccugagcauguguaaaguauuucuguccauugcaaaagaacugguaacagcgcuuaccucugggaagcaagggcugaguggcucugguuaggcgcgugagaggcuggggcuuuggucucuugugguuuuaagauugacuucuuuuuauuuuuuguuuguaugaauguuuugccugcguauauguuaguguaccaagugucccugagagggcagacgaggguguccgguuuucuggagcuggaauuacagacauuugugagcuacauuuugaugcuaggaacugagccuggguccuuccucugccuagcauccagugcuccuaaccacuggggcugagucauuucuuuagacgaguuuuucauaaagacuuugaauuuuauacaauugaagcauugucuacucauugguuaaucagcuugauaaacacauauugauuguaagaaugccauugaaaaacuaaguuacagguuucuggggcugauuagaagcuggcuuuaauaagaacagucauggaguugcugaaaugguggguuguugcugcugcuguuguuuuuagcagugaugguuuguuuggggcaaacaaacaaauauuuagauauagagagcuugaaacaaauauuuagauauagauagcuugaaagaaauauuuagauauagguagcuuggcuagcucggcgcuugcucuggagcccagcuuggccuagaacucucugagauccccgugccucugccgugcuucuggagagccagcguuacaggugcugccaccacucggcacugcguccuuuucaaggauuuguguuuuuaaaauuguaaaaaucuuuggaagauauuuuuaaaaguagaaagaagaaaauaaauauuacucaaaauccuucccuccauccugcaaacagucaucuuguggcuagagugggcuuuguagugauuguaguguuucuucugugugugcaggucugacugcugcuuucucucuguccuguugugaaugugucuccguaccgcuuagccgugguugagacauguucugcuuuauucuugcacagucuauucuguugggagucaguguucaaaugccuguuugugcucucucagcuugaaguuagggacacccagcccucuauaggaugaagcuuaacuuuucacauuagacacucggcucguggcugccuugccugaccugcuuccugccuggccucuguaccacaucucuacacauuuccccagcguggaugcccugucucucuuuuuuuucucuguuccugacaguuuuuuauuuccaacguaagccuaagcucucugaagcuugcucugcccuuuccucagaauaaguuucucuucucucugaccucuaugguauuuuacaggugcaucuauucuaguccuuucuuuauuuccuguguuuuaaauacaguaguaacugaaacugcuagaggcaaaacacaucaaggugacagcaauguccuaagacaugaacauggaauuucauaaaauuaaaguuucauauagcaaagaaacagcagaguaaagagauggcuuuccagauggaagacagcuaugcaucugucuaguuacuuucuuguugcuuugcuaaaauauccuaauacgagccuacagcuccagccucagagaaggaggacauagugacaggagcaggaggcuggcucaaguagagugugacaggaaguagguccaagcucaagaccccucccuagggagccacuuguuccagugauguuccacaaucuucccaaacagugccaccaacuguguuccaacacgugagacaaaguggguguuucacaccaccacccacagaggauucuguagacucuauagagacccuaaagagauuaaucauccagcugaaaaaugggcuaauaagcugaguaggcuguuuucaaaagaggaaacacaaagagccaauaaauauuagacaauguguucacuauccuuagccaucagggaaauacaaaucaaagcucuuugagauuuccucucacgccagucagaauggcuagcaucaaggaacaaaugauagcaagugcuagagaggacaugcacugugggagggaagaccacugccacagccacuguagacucagcaugauguuccacaaaaacaaacaaacaaacaaacaaacaacaacccaccccccuaaaagaacugaaaaugaaacugugauccagcuguggcaccucuggguguacaccugaaggccuuaugcugacacaucacugagaugcuucuguauucauggacugcagcaauagucacagcagucaagaaaugacgucagcuucaauagucaucagcagagacgugaauaaaggaaaugugaggcauauauacaguggaauuguauucagcugugaaaagugauauauuuucaggaaaauggguaaaucuggaagucaccguguuaagcaguguuuaagccauguuuucuccauuuguagaacauaacauagaaagucagccuugaugggggagauaaaggaggcaaaagaguagugucaugaaaccagacuuggguguguguccugaaaacauuuaaaguacaguaauuagcuagagaugguguugcauacccauauagucuagcauuugauaagguaaggcuagacugaguuccagacuagccugggguaccccaauugauagugauauauguaaacauagagguaugugucuguguuuuguauguauguacucaguaauaccuguuuauuauauugacacuauacaguuugcacacggcauggaaaacaauauuaccuacucuauuuuauucuuuuucuggaaguaagcacuauugucaauguuuuguguuuuuauucaucucucuuucauacugugggcaccauacccaggcuaggcucuccauaucuauggacaugaauguuccacagugcuggcuuuucaagaggcuggaugccuaggcagcguagagccagaggugugggcagagccauccugugccuucaugccugauaacuuuacugcuuuuugucuuuccauuuguggcauuucuaagaauuuaugagcagcuuccagaagugaagaagaagagagaagaggagaagagaaaaucagaauauaaauccuaccggcugcgugcucagcacuauaaaaugguuaguugaguuggcacugucuguggagggguggucaggcuuaucagcagagggaaguagaaauggccuggcuugcuuuugagaagcagugugacugcgugcugagguuucagcaguaggcagcugugaucagccuucaagugagagguagcugggagccgcuucccaugugucuacaagugccacacaggcaacuucucgcucgcagcucaacuguacaaaguaucaggcuuguaauuuccaaauggugauuaaguuccuguuguaauccucuggaaugaaguaaauaaacucacaggaucacgugagagucaucagggagugaggcuagagccuggagccugccaagaaccuccuagggcagauuuucuuggaagccacgcuggccaccagcuugaaggguucugucucucacaguucuuguuuuccucccaggcuauucacuacauucuagaggacccugaaagucagaagcugaacaccagaccagacuaugugagguuaagaaccaugucuagugcacucaggagccugggcccugggggagaccccaggaaccacauggcugccugcuguguuagcagcaaucaggcucuggcugugcugggaugcagucagaacucuagaucaucugcuauggaggaggaauagguguggcuuauaaacucucuuuccaaaacacuuuuccuaauugccacugucaguaggugagcaacacaagauuuagggaaagcagucugagucucuuccacagugugccgaggugagguuaagcagcuacccgugucugcaucugacuucugcccuguguuuucuuccacagaaagugaccaaucaucuccuggggagaaaagugccuugggacugacauaagacuacuuucuucagagccuaggaauccuuuuuuuuuuuuuuaugaucccaaagagacuaauuuauauuugugugaauaugauuuaauaaagcauugucuuugucuaugucagcuuagucccuguggggucuggggcagcggcagaggcacugggaguuuggaugcaggucuuccuuucuccacugcggccuugcccacggccaugccuuacgauggaacucuugaguucuaggagagagggagccccugcuuguguguguuuuuauacuuugcugcuugacucauagugaagcaagcacaaaagcucauuucuuuccuaucuggagaggagcagguaacucugaaaccuuuuucagcuccaaaaugcuaugacuucaugccuuguuuguuaccauucagaauagaaauagaaaguggugguuaucucaaaccccaguuugcaaggcaacuuaggcaagauggaaauaauaggauuucucgggcccagcacuggauuguucagaugcccugccagagcauucaggucuggcaccugagagg

SEQ ID NO: 3155 - RNA, 1552 nt, Mus musculus
cuuccuuuuuucuuuuuuucuuuuuuuuuuuuuuuuuuaaaucuuccaacaguuuauuagaaagaauguagacauuuaaaaaaauccccacugucaugaacauaaauugagguuuuccagccagggcauaagcugaaaucaaaacagaaaauaaaaaaaaauccaauaguguauuuaacauuguccacucauuugccauacugacugugcaaauacaaaucuggucuaaaauguacauacucucaagcaacaauguacagcuuucuuuguccuccaugcuaagagauguaaaagcuuaagggccaaacaauaccaaauguauaggcuucaaaaaccaucuaaguuagggcauccacuaguuuuugcuaaaauacaccugaacacugacaagugaucacauacaaugauguaaaguacauuuuuuuuuuuugaaaaauaaacuuuaguggaauaauuuugaaagguauccugaaagaauggcaggguaucaguuuaagguauuagccaauuuguuuccgccuccuuuaaauccauggucuaggaucuaaaacuuucaucuuucccuaagcugagagcuuuccuaauguguaaguaauuguguuaugaugaaagacuuagaugaaaugcaauuauuuguccgagcugcuggagcaguugccuaggaucagcugccucauggaauccugggaaauguucaugcauaaggauacugccuuagcugacuuaaaucgccccacacaaugguacauaaucaacccuuagugaagccuuucaaaaaaaaaaaaaaaagaaaaaaaaagaaaaagaaaaaaaaagguugacaacuggguuagaggaggcaaguacagcauaucugccuuuagagcuaucgacucagggguuuucucaauugugaaaucuugcagaaguuauuuuccuuucucaaaauccaggcgaugacaacagcccuuacuccagaucuggcaucuuuucaucaucacugucuugugaaucaucaucugcuccaucuacuucugguaaaucuacauccucaucaccacccaugugauccaucaucucagagaaacggucaaaauucgacaugucuucaucugagucauccucccagucuuuccaauuauugaaguccacacugagccaauuaagcuuugcccuuuccuuuguuaaccuaggccaugacuggccggauucuccuuuucgcaaacaacauaaaaucgaucugucuguucuuuuaugcuuggaaucauuuggaucgauacaaugaaaaagaucaauuucauuuaaaugcuuaaaauuaucgcuuccuccaagacaacugaaaguaaguuuggauuuuucaaaguuuacauuaacaucuuuacugucuucaacacaaaauucaaugaauacauagucccuucgaucguaccacuuugcagaagcaggcugcauggugaacggggcagagggccagacaaacgggugggcgggccucgcuggcggcggcuggcgagucgacuccucuccggcggcgacuccggcggucucugcccggucgcggccucuccucccc

SEQ ID NO: 3156 - RNA, 897 nt, Mus musculus
cggcaaaaugaaaguggguuccgcccagccggagccccaccucuuucccugcggacaguuuugcgggcgaaguacgcgugccuuugcccguguuugucgcgagccccgguggagagcgacauggucucaggagcgcggcuccggacggaaggccgcucggcugcgcgcgccggggcgcccccugcaggcgaugcccgaggcugaggcuggaggagccgcgugcggaccgcacagccacagccaggcccagcgcugggagggaggcguggcggagagcggagucgccuccaccccaggcuuuaccggggccagcgagcggccuuggcaggagggacccaggcaggaagcccugaggguaguagggacgcccuguuggaaagccugaccagccuaagccgagggcaggccaugccauccggguuggagaggagucaggcaggguccagacucuacaugcuggucccagugacauaaaguuagugcuuuagcuucagccugacuuccuccugaaggacccugugaccacugcgauaggcuagaauuguauauugguggccugauauuguguaucaggaaacuauuuacaaauagacccugccccuuuuguguuaaaaaaucuuaggcaauuccagcaagucagaaaugaacauuugacuuugguauuuguucucuucaauauuuuuucuuuguguacagguuuuuaaaaauacuauaguuggggcuggagagauggcucagcaguuaagagcacuggcugcucuuccagaggccccagguucaguucccagcacccacacggcagcucacagcugucucuaacuccaguuccaggggaucugguucucuccuacaugcaggcuaaacuccaauucauauaaaaauaaauacaucuuuuua

SEQ ID NO: 3157 - RNA, 19703 nt, Mus musculus
guuuggcaaaguuugauaauuuauuauaaaguuaaacauacacggcagcauuccacuccaaggggagggggaaggaaagauguuuacauaaaaugcuauauaaaaaauuuauauuuaaaauuuaaauuaaaaaaccccuacagaaaaccuaaauaucuuuuaacugguugaugauuaagcaaagugugagacaaccauauacaagagcaacucagcaacagagggaagcgagaccugucgauccauuuuguaacacagaccuuaaagccaguagccaaacaagaaaccccacucagaagcccacauccuaauuucaccugcacagcauuuuagagaugguaagaggaaaacuguaucaguagcugccaggggcugggcugaugggaggggcugugacccagagaaagcuggaaggguggagucuggggcugcgguaaauuccuuggucagggugcacaaaagccuauccuagagaggaauuuguuguaguuucuuuucuuuuaaaaaaaaguuauuucagagcuaaugacccuccuuccuccagaauuaagggagaccacuauauagcauauggaaguuaguucagaaugcaugacaggguguuaugcugagacaugggacuugcauaaacagucauagcuguccucacuguuaaagugaauauaaucuuaauccagauucuaaaauuuacccccaugucaugcaaauauaaccucaaaugaaaccuuaauuauugauaaauuguuaugucgaaauaacugauaaugguauuuucaaaugcuccaaguuuuugugguaugucaagucaggaagagaccagguauaucauucauguguaaggucaaaccauuaagagugcauggcugccagauccauaagacacuugagguccuccaggaagcaggucuugaggcgaggauuaagaacuaagucacugguguuuucuuugacguacacauacauacagaauggugaggaaaggucuuaagcaggaaacagcaaagccacgugauacaauaugcugcccugcuucaguaagccaagaacacgccaggcucccuggcaugacagucucagucuggacuuucucuggaagcucauuaaugaaacuguacaagugaucuacagcagaacaggaagaacgucgucugcuugcuaggcgccuccuguccucugcagggggaguagauuauccaccucacucucuggcaagcagcucaaggagccugaugccauggccuagugugucccaucccccuuuaguugaaagugggguuucauauauaaauaaauaaauaaauaaaagaaaggccagagguaccacgugugaccagucaaugcgucccacuuggcugggaauguuuuuuuugcauuuucaugcuaaguuuucucuagguagcucuggccguccuggaucucccucuguagaccaagcaggucuggagaucugucugccucggccucccaagugcugagauuaaagauuuaguuugggauuuuaaagacacauuugcaaagauaagacaggguguauccuucccugcaaaaagguacugucauacugugcuacuugacaugguggcacagaaccugaaguaguauuuuagcacaguguacacaaaguacacuguagaaaaagagaucacucgcuggggcaggcuuucuaaaaagugguucauacauggaugccuggcucagaucacagcacagauuacagccaaagaacaacuuucaagacagacuguauggccacaaaauggcuaguauucagacagaggguaaacaaaggacuugaaaagucaguuuacggccagauacagaaagccuuggcagucccugccccaaggccguaagccauuugucucuuccaagaggaaaggaacacaggaauuuguuuucugggaagcuguaaguuuugcuggaaaggcuauuuaauuaggauuccacaugggaccucccuccauaaugugaguguagcaaacauguaauagucaagauauauacuguaguuauuauuguuuuuaaagaaaaaaaugaguuaacucuuagaaauuaaaaucuagagccaggcaagagagcagguaccugacguccuacuugcucuggagccuggggcagaugacugcuggagcccuggaguucaaagcuagccugcggaauauacugaagcccugugucuguuuuuaaaaaaucauguaacauacuuaaauaucagaaaaugcuuuaucuuuuguauuuuuauuauguuuauacaaaugacauauauaggucugaagaaggcuggaggcacagcucaauuacagaguacaugccuggcaugcucaaggcccuggucaaucccagcaucuacaaccccaauguaucagaagaaaagugcuagauaguaacacgaaaagguuaaauaaaaauaaaaacagauaauuaaaucagauguaauuucaggaaagaaguccaacauccuacuagaagcugcacuaggguuagggauuaaugcuaauauaauagcauuaaauaaaaacuucuuacaauuugccauauugaaaggacucagcugguauaugucaugguggauagaaaauacacuaugacaugugagauaaagacccuaagacuucaagagaagaauuacaggucccaaagaucugagauuaggagacaggguuucaacagccaacagcaaccgucugaacaccaugaacuaggacucugaaaagugccuaccuacugcucaucaaaggacaggagcagagaagcaaacagauccacuucuguggcucggcuguuacacccucccagcccugagaggcugcugaaggacauaaugagcaaaugggaaauuauagucauggaaguagaacccugggacccagguucuaagaaauaaaugacaagagggaagagagcucagaugggagcuuugccccacguguaaggaacagccaguuugccuccuauggacaguuguguuuccucaaauugcugguaaaguucuaagccccaguaucugaaauaucaccgcauuuggggagucuuucaagaggcaaaugaggucuccacagugagucugagucuaaugaccuggcaucuuugagaagacagagcuggcgaugcaucucagcguaucauaagggaaaaaaggaaagggggggagggacgaguggaggagauguuaagacacagaagaccgcaagaagacagugaaguaccagucaucuacaagaagaaauucuugcugacucuauccuucccagcuucuaaaacuaugagacacaaaaaguuccuauagauguucucccucagucugugguacucuagcauggcagcccuaccaacgagaccuggcaccugacuggggcauuuaaagaagcuccagaaaaggagucaaaucaaagggcgcaucauucacugagacgguuuauaaugcuaucagauggagaagaugaauuugugacauaaucaacagaaaauggccaaaugaaugaggcaaaaacguuaaggaaagaggaaggccagaaagaacccacagccaugaacacgacgcgcgugaugaccacacuuaucuaguaacuucaucaaaggcugcaaagggcuguggagugaguggguaggcugagagcuaaauccucauuugccaaaggaagaauucaucaacgcauguuaucauaaauuggaaaaugaagcaauggugaucuguaagaguauuuaaaaaaaaaaaaaggaggaaaauacauagcauaagaaauccuuaggcgggcuaccucugagacugacaaucaagaaacaugcagggugccuuuccaugggaauuucaggaaagcuaccugagaaaauauucauguauguuucuaaaguaaaauauaacuuaagaauacuaaauagaccacuagaaacuuuaaaaaagaaguguccuuccacuaggccuuuguauugugugacauggacagaagccagacgaguguguaagaaugaaaguuaguuaugaguuauccaaugauaaaggugguuuucacuagguguuggcaauccaauuccugguagaggaacagggcagguggcaggaacaacuccuaaccguggcagaacucacgcagugacccuaccuggcaguguccuccagaggcugcuugucaauguguucuuugcaccguccagacugggugcauucuguaccugucccagcuuuguccucuuuugguuccuaacugucuguuccaguuucuuacacuggacaauacacugacccaguauauucuggggaagaauuccucggggguggagugggggggucucacaacaagaagcacuuugaaucuguuaaugugauggguagagaaaaagccaucacuggagugcagagcaacuugacuaaaguuugggcaaaauuagcugcaagcuggaauacaugaucugccgggacuucauuagggaaaaguucccuccacauguucauacaugagagagaaaacuacugugcauagcaaaaacuugcuguggacuugauguguuaugaggagcaacuuccugagugaguucuaaggacaaguaauuagcaccuccauguagccugaaguguguccuagagaaagagcaccauucuagugugggaggccaguggacagagauccugaauugagguccucggagucaguauaacccucagcuuucccagauauccaaggaugucuguucaaccuuuaaaaucuacagaggguuucuagccuccuggauaguucuacccuguugguggcaguuacccaacuuggcaaucaaccaguaccuaaaguuugaaccuucucuguguuagaugccuuagcuggcaggucagcaagaagcuggucaaaucccaacacugaccaccaaggaaaaaacgcugaucagagucccacgaggacaaagaacaggugcaaagaaaagaacuguccccuggcuagaguuuuaguagaaaauuugaacagucauggaaaacacacccauaaagauugucaguaaagaacaugugguaaaaacacuacgaaucucugcaccuacacaacacauuacaagcaugagcaaaggaaauauacagggaaaacagaaggcaauuuagaauuuguuaucuauucagaacucugagaaaaguugaggccuggaauggaggugcucuagacugccggagccaccgcguccgccagcacagagcaguguaacauauaucaggacaguacaacaguuugaacaguuaaaaauguucagaaaguuuucuaaauucuuuugaccugauuuuauuaaauucauucagcugucuucuguccagcucuggucucagguggcccugacgacaguccagccacagcgugccucacagguuccauucccaguaguauggguagaaaggucucugguaacucucagcaguccacuuauuuggccucgcacuccagaagaaucuucuuugugaauaguccucuccggcuggaccaggaggagggacaaggccucucugguaaacacucugauuuugugaccauuuucuuaaacaagaagcaauaaaucauuaucaagauuaacauauaauaacaagcuucauaaaauauuacagacacucuaauuucacucuuuccucccuggaugacccaagcagauaaucacuuaucuuucucuuaaauuuguaugaaauggagcugggauuggggagauggcucagugaguacagcucgugccagagacaugggaggccuugggggcugcauccccagaacccacagaacgcugagaaacaguagcaugugucuguaaucccuaugauaauaugggaggaucccugaagcaaauacagaaguggaugcucacagucaucuauaggauggaacacagggccccaauauaggagcuagagaaaguacccaagagcugaagggguuugcaacccuauagguggaacaacaauaugaacuaaccaguacccccagagcuugugucucuagcugcauauguagcguaagauggccuagccggccaucacugggaagagaagagaggccccuuggucuagcaaacuuuauuuucccuaguacaggggaacuccagggccaagaaguggggggaaggggaaggggaaggggaaggggaaggggaaggggaaggggaaggggaaggggaaggggaaggggaagaaaagaagagaaaagaaaagaaaagaaaagaaaagaaaagaaaagaaaagaaaagaaaagaaaagaaaaucuccagcucagagaauggaaauuaaggauguggucucacccaugauugcacauagugugaauggcagaguaaggagacaaauucaaacccagccugacugguacaacccucaaacgcucauaaaaaccuaaguuaaauuaacaccaaaacauuuugcaagcuaguugcuaauuuuauguagcaucuugacuagagaggaacagcuacagagcucaugaggcuuuauuucugcaucugucaacaagagcauuuccaaaaacgauugcagcaugaacagcagagugaguaaagaaggccuagaauaaagaaggccugcuugcaugugggcgggcacugaucaccuaucgggaaagcggucccaguacaaagaacagcacaggcgagccugcccucuccugccucccacucccauccaaggcuccucuggcuccugauccuagagagaaucaccaggcucacccuguuaaaggcccaucucaucuaccugcccacccucucuccuccucuagagaauucuagcagacaauuuugacugaacagagaauuuucccauuucccaacugaaauucuuuuauaacuuaaucugcucaaaucauguguaaaugucucucuuaggacuuguacucucuuccccucagcccucucucucugagacagagucucauguagucuaugcugaguccaaggauggacuccugacccucccgucucuacaucccagugcugggagcacaggcacacuacccugccuggcuuuguauuuguucuuuaaaucgcagccuuccuuauuccaaaaacuagagucuuaaagcacagggauagaccucagagauagaaucuuaggucucgucccuagaacgcagauuuuaucuucuaguagaccuaucuaacuccucuuagauuaagcuaacuaaaauaaauagauaaauaaaguaauaaaguaacauuuccaaucuuuagcugugucugaagagcuacacauuccccauccaguguuugauuugcuaagcagcaugacugacccugaucaggaaggaaauaccaacugcuggucauuaucacaacggacuuucccuuggcuuaacagacaguuuccaccucggcucuaaaacgggagcagcacagguaccugagugaguacggugagcucugcgucuggugcuggaaaugcugggaaggugccagaugaccaccacgccgguuuuuccuaggcuuuuuuuucacagguuuguuguugguguagacuugcuccguaggaucugcugagucuucaaggccaucuguccuaggugcacuaacauuccgguuccugaaaaggaagugugccacagcgucaccagacuccaguucccguggccaguuuaguaacuuuguauuuugauuugugaacauuugaucucguuuccccacuccuggcuguuuagguuuuacucagaaagugagcucgcugccagggaaaugugccgcuugaauuauaccuaagaggcuucccuagccacaaaucucgccuaagaaaaugcaagacuuacuuucugacaugacguuucugcagguuuucaauguaguucugccuuucuaugcagugcccccggcagcuguugaacacugaggagcagaugaagaugagccguuagaaacaggggcacgagaaggaaucuagcccagagcacgcagaccagagcucguacucacugacuggucauaggcuggcacagcucacuacugcacacauguuccucauaagcuuuguggcaagaggcugccuuagacucuuccuauccuugcucuuuccucccucuggugcuggagaccacacucaaguuccauacaugccgagcagauauucugccgcugagccacauccccagccccacaggcaacuccuuccuucucucucuucucuuccucucugucaucuuauauugcaucauauucauuauguuuuccaaaaacugaaaagugguucuaccauuuccaccuuuugcuuuuauaggaagggaaaaaucguggcccccucauacuuacauucaauugcaucaucuggccucaugccuucuacaucaaucaaauaucuaacaaaacaacauaauucgggucacuuaaauauacgaaaagaaaaaaaucaaaacagguccaauuucacuuacaaguggagacauacaaauccuaagaaaauacuacacaucuaauccaacaggcacagaaugacaugccaugaccauacaccagucccaagauugacuaauuuagaaauauauuaauaaagguacuuauauuaauauaacaauauaauuaauaaaggaaaugcacgaccaaacuggcaaacguuuaaaagguagauucagcaguccuuuccacaaauggcuuugugaacuaaaacccaggaggcuuccuucauauuacggaguguucaucaguaaccaacacacagaacaacugggaaauagugaugcagccaaacgcuaugggccagaacaggagcuacugucacugucacccacuuuuccugauucucaccuucauuuccccaccagcguccugacagugaugacagcaugcuucuaccaaaaugaccuugacacccgguccaagugaccaucaacacuucaauucauacaaaaaccuaugaguccugccucugccucuguugaauauucuuuacucagcagaaauggaugggguucaacacccccccacaaagugcaacaacaaaaaacccaagcagcugaaacagcacuuugcauggccuagcacugacucaaugccauacuugccgcaucgcccaccgccccggcaguauauggggucccacucugggcucuuggcugagccuuaagaccauagucucuucugugcccuuacucagccaguacuagguaaccuucagaaagucacugaaacccuccucggaaauguacugucuuuuugaugagacaggucaaagccucccucacgagguaccauguuccuuacuccgcagcacugacaaugauaguucgauacuccucuuccuauuuuaauuauucuagucuuccuauuccuucagaggcagguuaaauaaguaucucugccagccccacacugcucacacaaacuauaucucaguaaguugggcgugggggcgcacgccuuuaaucccagcacuugggaggcagaggcaggugaauuucugaguuugaggccagccuggucuacaaaagugaguuccaggacagccagggcuauacagagaaaccccaucuugaaaaaaauaaaaaaaagaaaaaaaaaaaagaaaaagaaaaaagaaacuauaucuuuguaaggauuuuuugugugaaugaacauaaagucacacagcacagcaauuccuuaagaagcaccagaaugcaccugaacuuagcgcacagcugauccaaagacgcucagaccauuuuaauguuuuaucaacccccaaacuucugacuuguauguucaucagcaugcaaaaaaacccaaccaaccaaccaaccaaccaaacaaacaaacaaacaaaaaaaaacaaaaacaggguagccuuuaaaaaauaaggucuccaaauacuuccacaggaagauuucuacggcauauuaaauugcaaaacugaaugucuauugcacuuuaagccacucagcuaugcuuauaccugcaucugagaagucuauaaugguauugcugauggcagucucuggguagaggcaacacugcuuucuacuuaacccauuucuauuaaguuuagauuaucauuguaaaacacacacacacacaaacacacacacacacacacaccacuauuugacuuuuggguuggcaacucaccugcaaaugagguagccaguccuauuuaagccaugggugcaguggacaccgauaaguuugucuauagaauaggaaaugcagaaguaagaaacaagauacaccaaaaauaaguucuacacuauucugagaaguaaggcuuacaaguuaccaaaauauugcagcuauguugaaaaguaaaguggcuuuaaaaacacguuaucaagaauuaucaagaauaaccuaccaaaagcucaucauuguggguauuuugcaaguacugguuagauaaaaugaugcagaguguagagguaacaccaggucgaauuaagacgaaagagagcugucuuaauaugaagaggaaacuggaauguguguaugugugugcaaugcugaagugugaaacucauguaagccaugcaagugcucugaauuuaagcuacagcccucaguccggccuccacuugugacagugaauaaaaaccacaacuauacucaagauggaaggacagcagagacaccgucaauauuuuugacaaggacaaguuuccuggcccacugugcugcuuccuagucucugccuucuacugucucuuuauggaacuuuuggacccuguguuucuaaucuucuaccccucacuccuaagcuacagggaaagggaaacacuuccauuauacuacacaguucucacucaaguuuuguuucuguguggccaacaagaagaaaaacacuuuauuacuaccagcugacauuuucaaagacaacagaccuaauauuaggucaguaacaauaucaaacugcccuggagagacggcucagugcuugggagcacaucugcucuugacaaggacccaaaugcaguuugcagcacccaugauggauggcucacaacugcucagaacuccagcaugauggaaucugaucccucuggacucaaguaccugcauucguauguacauagcuacaagcacacacacagaauuaaaaauaagagauucuuuaaaaagucucuaaaccuauucagaauguacaauagagucagacaaggaaagcaaacaaacaagcaaacaaaaaaccauaaggacuuaccauuguuuuuauuuuucuuuaaaaauucuuuaacugcacauuugaauugaaagauagugucauuaucagguauuugaugaccaacuguaaauauuuuuauguaagaaauaguuucuggcaaauccuagaaagcaaaacagagacaaauauacauuacuucauuuguaagcagauagugaaagaugugaggagccugaauauaaacucaugaugaugaacucgcuaugacagcgcuucugacuaaagagcuacuucuuacaaagcuguuucaaccaggaaacaacuuguuucacauuaagacuauaggacagucacuagguauacggaacacaccaaauucaaugugaauaaggguguauaugugguaugauuaaacauuaugugaacaguucuaccuaauaauuauuucacucuucugugccugcacaaagaggcaaugagcugggcaaaaggagccaugacuaacagacagaaccggggaggaggggcuggagagauggcucagagcucagcggugccugcuguucuucccgcggacgcaguucaguucucaacacccaugucugauggcucacaacagccuguaacuccugcuccagaggaucgggcgcccucuucagacccagccggcaccuacauacauguggcagacacuaacacagaaaaacacagauacgcacacagauacacaaacacacacacacuaaaucucagggaaaaaaagagagguuagaugaaaaucuguaacucuggguguaauuggaaagcacuaucgugaauuuuacagaguuccuggcucuuucuacaaaaaagcuucggaacaaugucgucuauuagcaauaaauacacuccacacucauauaucugaaaaaacugucaacacugaaagcagaccaagcuucgagucagcuugggacaggaaauagcuaagaugagccuggaacuucuuucaugcagacaaagugaccacacgugaucaggguaucuuaaaaggcuagcacugagaaaugguuuaaucuagccgaggaucaaucggcagcauuuaauagcuaccuggggagggagaucaguuuuccucaggaguguggcccuggguaguuggccaugcuccaguagauggcuuuaaugcaugugcacuugagcaccacuaauuuuggacuugguggauuacuuuuaaaaggcaaagugggggugggguagagaaauggcucagaggguuagagcuuaagaccuggguuaaguucccaguacccacaccaggcagcucacagcuauccguaacuccaggucuaaagggucugacuccuccuucuacccuccauggguaccaucaagcauguggugaacuuaauauaaaaaacacauaaaaaaagaagacacggccggaugugguggcgcacgccuuuaaucccagcacuuaggaggcagaagcagguggauuucugaguucgaggacagccuggucuacagagugaguuccaggacagccagggauauacagagaaaaccugucucgaaaaacaaaacaaacaaacaaaaaaaaagacaugacauuggaguguaaaucaggaggaauuagcugugguacuggaguaauugugaucagaaaaguguauuauauguguaugagguucuuaauaauauugucugaaaaagguuuuaggagccaaacugagaagccccaaguauccaaagagaggcccuccaccugugcuccaauucaaaaaggcaacuacaggggcauuuguaaugacagaaaaaauuuaacuaacaaaauaaaaucugacuagucacuauuggcagguaucagggagccaagcuauucuuuugaaagcugucacacagaggaaaggauccuguggacaucaccgaguaaauaaacaaacagaaacuucauuaaauaaaacaugaacgauaaaauucaccuuguaaagccugguaagguggcauacaccuguaauccuagacccugggaggcugaggcaggauaaucuugaguuugaagucagccugggcuacacagcaagagccugucucaaaagaaaaaagaaaaagaagaucaacuuuuugaagccucaaaggaauuaauagaucagucauuaauuaacuaguaauaccauaagagacaaccacucacucuaugcccuccuaacugaaggauacaugaccacuugugugaaagcaucucacagcaggcaugguuguacacccuuguaguccuugugucucaguaggcugagcacaggaguuuaagaucagucagggcuacauaacaaaaacccaucucgaaauauacagaaaugcucaaaaucgccauguuaaaaggaaaauuaggcucacaguuaagagccuuuacuguucuugaagagaaugaggguuuaauucccaagacccagagagccaaucacacugccugcaacuccaguuccaguggaucggacacccuuuucuaaguucuguaggcuccagcaugaauguguugcacauaaacucaugccagcacacacacacacauuaaaacaaauaaagacuuuuuagaaaaggaaaucaagcuggguguggugguccaugccuguaaucacagcacuugggaggcagaggcaggaggaucaggaguuuaaggccauccucgguuuaaguuuaaggcugggcuauaugagauacuaacgaaagaaagaaagaaagaaagaaagaaagaaagaaagaaagaaagaaagaaagaaagaaagaaagaaagaaaggaagaaaggaagagagagagagagaaagaaagaaagaaagaaagaaagaaagaaagaaagaaagaaagaggaggaggaagaggaggaagaaggagagggagagggaggggggaaggggaggaagaggaagaagaaggggaagggagggagggagagagagagggagggagggagguggguggguggagugcuauauaguuauaaucccagcauuagagagacggaggaggaagauccugaguguuaggucaaccagggauacauacuaggacucuguuucaaaagcuaaaccccaacaaaacaauaaggaagagagggaaggaggguaggaaagggaaaggaaagggaaaccagggguuaggggaucaaaaggagggaggagggagaaaaggagagaggaaagcagaauccugaaucuggcugugccagcccacuggcagagagagaacuaaccagcgguacuagcacguggaggcacagagcuaacauuuagaugguacagccuggcuggauuccucaaagcaagaacucaagggagggacaaaaagagagagacacggacagcaauguguagacuuaaucagaacugacagacaaccaacugcaaacuaacaauucuuaugacaguuaggaacuaucaaguuguguaucugauauaaaagaacugauguuaaggaaaaaguauuauaucuuaaauacacauaccaaagauauagagaugaauucuauaauauuugaguucuuuaaaauaagacaaagcaugcugugugugguggugcacacaagcaaucucugcacauggaggcaggaguaggcugccuuugugggcuggagaccagccugguauacauaauaaauuucaggccagcuagagccacaccaugagacucuuucucaugaaaacaaaacaaagaauaacaguucccccaacccucccgcaccccaacauacacagggguaagggaauucagaagacagcaugggguaaaauagauaggaccauaucuauuauagaacauauguacauaacuuaauauugagccagaaaagaaaaagauucugauauaugcuuuaauaaaugucagagacauaauuacuaaaaccauucagucacagaaaggcaaguauuacaugauacuggggcuggagagauggcuuaaugguuaagagcauuggcugcucuugcagaagacuuauguucaauuccuagcacacaacaguucacaaccauuuguaauuccaguuacacgggacauaaugccuacuucuguccucacaaacaacugguaugucuguggugcacauauauacaagcaggcaaacauucauacaaauaaauaagaauaaaccuuaaaaaaauuacuccacagauaacuguaacuauccuaacucaucaaagaugcuuuuuuccuccugcagcauacaguuuacaaaaagccacaucuagccaaaaugcagaaaacaauugacugcgagcugcucagcccuaacugauacaucuaaauacaacucucccaucuaagguucugagaacagcucaggagagggaggcagaaauauuauaagagcucaaggaccaggaggucagcugcaagauuauauuucauaugaaugucaaggaaggcuacaacaaugaaaugucaacacuaugagugcuuacacaagaucugaacaguacccaucagcugccaugccaacauggaugggaggaacugcagagggcccuaccccuggauaaagaacuacaggcaauuaaaaaugucugagaaagggagaauuacucuucagauauaaguaccgucaaguggucagccugaaaaaagccacacacacaagcagaacuacacggacucagcaggcugcauuuguuuacuugcauguacaugcaacaauaauacagaguaggaggcuauggaugugaaggugggguaaggagagguuaaaggaaaugacagaguucuauuuuaauuaauuuaaaauuuaaaugcauguuacauugagcuacuucuguaagauaccuagaucaaggaaauucauuguaauaaagcagauaagagguuuacuaggggucuggcauauaggagaagggagaauuaauguucaaugguuauagaacuuuugcugauuaaagagacuaauaauaauuacuacauauuauaguuuaauucaugucgccaaccuaguguguauguguuuugcauugcugaagacuuauguaguccaagguggccuugaguuugugauccuccugucuuagacuccuaagaucugggauuauagccauuaacuaccauccaugccuggccuccaaucucauuucuacaugaaauuaggaaaacuauuugcucuucuuuaaaaguuaguuauugcuacccaugaaugaaguuuagucuuugcaucagcauaggaugaaaacuguuaaauuacuaugaauuuuggguuuuuuuuuuauucagucagagggccacuuaccucuacuuuauaauagcgcugaguauauguuaaaucgauuaucaauccaaguucuucauuuuguucuuguauuuuauuaaacagauccaaaggggaaaagcauucuucuggcauaagcuuugcuucaaauuucugucagagagugaagagagagcaaacccacuugaagcccuguagcacacgaugcacuuacccagcccccugaggugaggacagugagacucaagagcuguuccuguuccccuggaagcucgcaacaucucuccuccauuagugggaagagaugcucacuucaauauauacauauuccuguguuugugucucccugccugaaaaacuuuagaauguccuauucaacauuaaauagguaagaaaacaaaaaacaaauagaaacuuguuccuauuugccuaagccuuaaaaucucaaugcaauucacaagugaacaccucccuccauucuacugaauuuccagcacagcaacuaccauaucaagacagugaauacugaaugaucuagcuuagucaggcugacacaaaauauaacacauuauaauuauucuugauugagagccagcauucucucaaucaagaauugauauuucugaaaagauccuaaauuaauuuucacuuacuuuuugcaaaggaacuuugaaagcaaugaaacgagucccaggcauccgcugcccaacugggagauagucuuuccaccugugaaacaggguauuuguuagucaaacugaaugccaaccuugucuccaagaauaaggcuccgagauacugggcaccuaacacauacagaaugucucuuaaccuauuuauuccacacaaguagcaaccuacuauguuucuuucugucuccccaucuugaaaacagauacaagacaacaaaagagcacacaggucuccacaaacaauaucuaaaaccuagaaaugccauagcagaacagccuaacaaacccagccucgugucaaauacuaagguaauauuagacaugaaaauagaagggggguuaugacggagugggaagggggcuaagggagggaggggcaacaagaggcagaaaaggaaagacaaauaguguauauuuccccuccuguguggaaucuaguuuuaaauauauaauguacauacauauaauauacauauauauaauauauacauacauacauauauauauauauauauauauauauauauauauauacacacacacauauuugagacaugaaaacuguggugaauuauuuagggggaggaaagaaacuagcaaaaugugggcaggagaaaggggaagguguaugugugugggugaacaugggcaaaguagaaugccauacauauagaaaauaucaucaugaaacucauacuuuuuaugguaacuaaaacuauuaaccagcaaggaguaaugaaugccuacacacuggcugacagaccucaaauucaauacuuucacugcauauuguuuuuaguuuccacaccagugaaucaacucaauauguagaaaucucccaguucuuacaacccgaaauucaguucaaucagaagucaguguggagagucacagcugaguuggucuauggccaugaauuacaaauaaguccgguucauucacaucccuggaguagagagugagcacagaguggugacagacuggagacauagugggccccagagcaauggaaccuagugugacagaccaugacaagaaguuggcuucuuauucuuuuuuuuuguuuuuauuuuucaagacaggguuucucuguguagcccuggcuguccuggaacugccccgaagguuuuuauucuuaaagucaagcuuuaucuuacaucuaugagcugucucacaauuacuacuugauauuuaucuugcuuuaucuccacaaauaagcaauagcuaaaauuauuuuuaauuuuuaguuaacaauuuuauauccaauagauaauuuaauaaugaaauaagcuacauuaaaauaucaauaaacaauuuauuuauaacuuacuuauacuuuacuuaguaauuaauaguuaaauaguuaacuauagaagguauguuaaaaauggauuguccaguggacagacagcugucuucugcaagcugucaggcaaguucuacacugggaugauguuggagguuagcugacaggaucuaaagauauccacucugggaagggagagaggccaucacguccauccugaauuuuagauagugcucauuuguagacauaaaaaagaagugcuuacugaaguccgggaagucggggcagagcauucugucgauccugaguuuuagguauuguuuauuuguggagauuaaaaaaaaaaaaaaaggauuugaugaauucuaggaaggggagaggccggucuagccacguuuuuuguggagaugaaaucggagaggggaagcaaacagccgcaaguaaaggguucauugcaccagugagcaaaauccuaaaacuagcccuuggcccaggcaggguuaacucccucaaaggacaccuccgcuuuccgaauccugaaagcaagagaaccccucgagccgguaccgagugaagggugucgacagcucgggccggauccuggcacagcgccuacacaagcagaagccuguggcuucggagaucaagggacgccucaauacaggcagccgcgccccaccgcgcacuuccgcccaggcccgagcuccacagaguccugucgggacagacccaagaccccagaaugcgggguggggagguguggugggguucggcgcggaggacccugggaggcggcggggcgcgaggccagggaacacucggagacucgaggccaccgaggcagccggaacgccaagcccggaaccaaagcgcuuaccuuucggggaugugguuucugcccuucuucuuggguggggcacaggcagcaaagucccggccccguccacgaccaugucggccauaaugcugguucaugugggcgcagagaugccgcccacccaacgccaggcgugccagagcggccaaaguggcgacuucagggaggccagaagaggccgcgggauccagaggcgcccgcaaaggaacgcgacgcgucgacgucucgcuagggcgcaugcgccuugccccgccgugcugacgacacacgucgcacugaaaguaggguuugucagccugccuucgguuucgacugugcugcacuuagcuggaggccgguuuuguagcuaugugaauaauugcuagcgcuguaagacccccgaugcugggccucugcucaaguccugggaugaacuggccaacaccccaacaucucgagagaaaagaugcaccugaugcaaacugcaagagguuuuauuaucagcuagcugaggagaagucccucugucgugcagggcagaggaguucaaccc

SEQ ID NO: 3158 - RNA, 1010 nt, Mus musculus
cuuacuccuuggaggccacguaggccaugagguccaccacccuguuacucuagcuauauuccuugucauaccaggaagcgagcuuuacaaaguugucauugagaacaaugccagccccagcaucaaagauggaagaaugggaguuguuguugaaguaguaggagacaaccugguccucaguguaguccaggaugcccuucagugggcccucagaugccugcuucagcaccuucuuaaugucaucauacuugucagguuucucuaggcagcacgucagauccacaauggauacauuggggauagggacaugguaaggccauggcaaugaacuucccauucagcucugcgcuaaccuugcccacagccuuagcagcaccaguggaugcagggaugaugcucugggcagucccauugccaucacgccacagcuuuccagagggaccauccacagucuucugaguggcagugauggcauggacuguggucaugagcccuuccaugaugccaaagaugucauggaugaccuuggccaggggggcuaagcaguugguggugcaggaugcauugcugacaaccuugugaaaugucauauuucuccugguucacacccaucacaaacaugggggcauuggcagaaggggaggagaugaugacccuuuuggcuccacccuucaagugggcccccggccuucuccaugguggugaagacgccaguagacuccacaacauacucagcacuggcaucaccccauuugauguuagcggggucucgcuccuggaagauggugaugggcuucccgaugaugacaagcuucccauucucggccuugacugugccauugaauuugccauggguggagucauacuggaacaaguagaccauguaguuaaggucaaugaaggggucguugauggcaacaaucuccacuuugccaagugcagagcagaaggcagcccugguaaccaggugcccaauacggccaaaucaguucacaccgaccuucaccauc

SEQ ID NO: 3159 - RNA, 949 nt, Mus musculus
gaugugccuucugcacggagagcaggaggccauggccucucacugugaacacaugaacaaauggcuccaaaauagcaagaaagaagugugggcaugucgggauggaugagagcccuuguccccucugcaugcuccucagcuuauccaccacuggaacuccaagcuggagaacucccaguugcucccagaaguaaaggucugauuuuccuguguuauuuuucaguauguuuggcacacaaaaaaaguaaaugcccccaaaacggauggauggaugaauggauggauggauggauggagacaguuaacuagguaagcucugggggggaggugggggaagcagggacagcaggagggacacuggcuagauuucagacuugcuuagcccagccccugcagagguaugggcagcuuaagggagcuggcgguuuguucuguggcucugauccuguagcuggguauggcuauauauuccuccuacugcauugcucucuauggugggguacaagaauauacucucuaggaaguaggaaagugaguccaguaaugagacuagaaucugauuauugugggggcaggggguagagugcaugccggcggggcucagauagagauauguccuaucacuggagacucugccuguaaacacuugacauuucacucaagguugucagcaaugcauccugcaccaccaacugcuuagccccccuggccaaggucauccaugacaacuuuggcaucauggaagggcucaugaccacgguccaugccgucacugcuacucagaagacuguggauggucccucuggaaagcuguggugugauggccauggggcugcccagagcaucaucccugcauccacuggugcugcuaaggcuguggacagaaaaggcuuugcagcagcucuccccagagucaaccucuaugcagagccaaagccucccaagugag

SEQ ID NO: 3160 - RNA, 340 nt, Mus musculus
cguguauuuacuugauuuuuuuuuaauauaaaugcuuuauuuaacaguugcagaucauuccgugggcuaaguaguggauauccagaacccagcugcaagauuaacgcaaccuucgagcuucucuuucugacuccaauagggugagcacgucacccucucgaacggggccuuugacauuucggaugauagagcggcuggugucauccaugaauuccacucgcaccugcgugcacugucccugcgaaccgguccugcccagcacuuugguuacccuagccagcuugaugggcugcacgcgacucguguccaugauggcggcgaucuggcggggaucuguuua

SEQ ID NO: 3161 - RNA, 8027 nt, Mus musculus
cuguuuuuaaagugaccugccacuucaauuuuacacaaaggaagcuuagccgaacacagccucuccgucguggccugucacuggcgacgcaaccggaagcguggcucugguccgcagguucagacauccccaucaauaucgcgagaugaaagguaauguucuccgaaggcgauuggcucgcgcggcggugacgucagacaccagcgccaagccugccuugcgcgcguuucugagccugcucacuccuucgccguugugccgagcccgcagaggagucgccaugagcaaagcccacccucccgagcugaagaagugaguagagucggcccuaucgagacuucugucucgcucgggcugccgccgcuggucccgacggucgcgggagccggaaguggcgcuaagguccggucggcaugguuacugcagugccggugccucugucuucccaaagcuggggcucuccuaggcgggcagccaaaggcaaccugguuggggaccagggcagcggucgaggugcaugguugugaggaaccggagacucgugggcuuaaaaugaucgauuggagucggacgugauuggcugugaucuauggggccaauauucaggaagcuuaggcaggagaauuaccgcgaguuccagaccagccuaggcuuaaaaaaaaaaaagacacugugucucaaaaaguuuaaggugagguagcguuuuguguuucaauaaaugugcgcguucauuugcguucaucaagagagcuagguuuaguuuugggguuuuuuuuuccccuuuuuggugcucagagacauguuuaguuauauguuugugcacgugggugcagcuccugcggaggccaaagcgggcauuggaucugcagaaacagaacuuguaggagguugugagcccucuggcgugguuaauaauagcuggacucguguccucuggacaagcaauaagcgcugggccaucugcagccccaagaacuagguuucugauacacuguccuuguauucaaguuacauuuaaacguuguguaauaucuugcucuggcaauaaauccauggaaggacauccauuuucuacuuguaaagagcuaauuucugaagaauuuuauucuguacccaguaaaaucagacagacccuuuggucucagacacuucugacuggccugaaccugucgcauaugcacauagucauuggguugcucaauacaagauuaauacugggucuuuucugguguagccagaaaauaaucugucuuguguauagccuguuugcuacuguaaaguucugucaagaccccaaugcaggggaaagauaacaacauuugcugauuuuuguauuugagugcacauuuuaaucaaagcccucugugugaaaccccugcaguuuuguuugaaucugaaucuguuaaaccgggccuagagaguuggcucagagguugagagcacugacuucucuuccuagagguccugaguucaauucccagcaaccacauggugacucacaaccaucuguaauaggaucugguacccuauucuggcuugcaggccuauaggcagaacacaacauaauaaagauguauuaagccauaagucugacauuuuaaaaagaaguuauucugcacuguuuguuuugaugaugagcuaauaaaugaggucuggauuuagcaggaauuggcaaaauggcauugguuuugaacaaaagcacuguucccuaccuguaaucuucaguguccucugauucuuaacagauauacuugggccuuucagagacuggaacuagugauuguguccauauuuuuauuggcguguuuggagcagagccugugugagcuacuuugucacugaacuucucuucucugaguugaugccuuuuucucaucccuacauuuuaucaaauuugaaauacuuuuagauccgccuccuuauuuucucauaaacaccuccuuuuacagcuauucacuccuaguuuagcauaacuccauaguucuuaaucauuucuggucccgugucucaguaguuucaaaguugagcuccucccaacuccuaaaauguguugccacagaaagucuuaaccacugaugaauucugcuauacuaguuuauaucaccacaaagucaaguccagacuuccuaacccagcuuugaagccccaccccaucugcaguccagcagccauauuuugcaugguauaugacuaaaaacaauuuucugcacauuagugucucaguuacugaccucuugcuguauagaggcaucgugaccaagacaacucuuauaauaaagaaagcauuugauggggacuugcguacaguuuuagaggccaugaucaucauggaagaacaggcaggcaguaguugagagcguuacaugcugaaccgcagcagcaggcagggcagagagacacuaggcuggcuuuugaaaccucaaagcccacucacucccagugccaccuccuccaacaaggccacaccuccuaauccucccaaacacuuaaucagcugcgaacuaaacaugcacauaagugacuccauggaggccauucucauucaaccuccacacugaaugucaguucuccaucuguauaacaugguaauaauaguaccggaaucguaaguguuaaauauguuccucuguugauuuacaaaauaacuccuaguaauuuauaaauguuauuuauaaaucuauuuccaccuucagauucuuauggcuuaaauuuauauuuaaauucuaucauggucuauacauuaaaacucagugaagcagccgagcagugguggugcacgccuuuagucccagcacuugggaggcagagucagguggauuucugaguuugaggccagccuggucuacagagugaguuccaggacagccagggcuauacagagaaauccugucucaaaaaaaaaaccaaaacaaacaaaacaaaacaaaaaacaauucaaugaagcucagccugguggcauaggcauguaaugucugcuacuugagaagcugaggcaaagaacuacaaaaccaggguagcuaagaaacacugucuuaaacugaaaaauagaagagaauauacuugagugguagaguauuugccuagaaugcuugaggcucuagauucagucgucaguacaauaaggaaagaaaggaaaggaacuuugauauuuucuagccuguugcugaaagacagcagauuuaacaggcugaugagauugcuccaaggguaaaggcacuugccuccacacuagucaaccucugggaccacaugguugaaggagagaaccaacuccuugaaguuguccucugacuucuguauuggcaccauacaaacaaauuuaauuuuuuuaaacauuuauuuuauuuauuauauucuaccuacauguaugccugcaugacagaagaggaugccaaauccccauuacagaugguugugagacaccauaugguugcugggaauugaacucaggaccucuggaagagcagucagugcacucaaccucugagcuaucucucuaaucucuguaauaacagagaucucuguaauaacacacacaaauguaaccaaaucuuuguaauuacauuaguguaaguucccuagcccaugucaacaguuccggauuugaggcugggaagauaacuuggcaguuaagggaccugaguucaguucccagcaucugcacugggcaaaucacaacugccuauggcagcuuuaggguaucugaugacaacugcccugguacacacacacucauauccaaacaguacaagauccuuacugcuuuaaauguuaugugucugggguacaaauuguagguuugguuugguuuggauuuuuacauugguuguguaaguguguacauaugccagguauggaagucaggacaucuuaaagaauucauucucugcuuccagcagugaguucugggaaucaaaaucagacuuggcagcaaauguucuuacccacugagucaucucaccagcccagauuuuagcaauuuaagaaaaggaaaaagacuuaacuuugccugguggcacaccuuuaauuuuccacacuggggaguugaaggccagccuggucuacacagugaguuccaggauagccagggcuacauagaaaaacccuaugucucaaaaagacauuuuauuuuguaugugagggugugugcauuugaguguaggugcccugggguacccucaagcuaaaguugcaggagguggugagucaccugacauggauauuagaaagagaucucaggcccucuggaggaacaucgaacccuccuaacaucucaucccagcccaagcaaaucacuuuaauuuuacugauucugugcuuguuugugcuuagaacuuuuuacauaaguccuaauuuuugcucuugcuuuuccagguuuauggacaagaaguuaucauguaaguuugcauccaccucagcuaacuacuugguuucuuuuuguugucuuggcaauauguaaucuuuggaaauguguuauagaaauuuaauauauaagacaucuaauucuucuccacuaaucagauuugucagaguucuaauuagacuuuuuuucuuugccuucuaauugcauuaucuuuaauuacauuaucugugccucccuggccuugaauuagcaguguccuacguuauaauauuuaaaacuuuaucagccccuuuccuuuaaauauguuaccagggaguuggacaagcagcacuugauguuucuuguggauguguagguuuaacuagaaaccuccugacccaugcaauugaaguauacugaaauuuuaggauuucucuucucuaccauucaacagcucuaaacucuuguaacugguucauuuguguaaagauacuacuuuacguauaaauuuacuuacaaauacauuuauguauaaauguugaggcgguuuuacuuggggggggggggacagucauugagaccagaucucguuaugugacccugucuggucucacaguccucuugaagcagcccuccucuguuguugccaagugcugggauuacagccaugagacucacagguaaugucuccagggucuuaaaggcuaagauauaggcaaagaagaacuggaauauuaggauagaauuagcccaugguuaggcagauaguaggagugguggucacacaucccaccugaucuaugauggaugguugaacuugguuuacugagacuucuucuuucucuuacagugaaguuaaacgguggcaggcauguccaaggaauacugcggggcuuugaucccuuuaugaaccuugugauugacgaguguguggagauggcaaccagugggcaacagaacaacauuggcaugguggugaguaagggcagcaucuccagggucuucuccucccuccuucacauuccucauaucaaagucucagauuaaaaccaaguuaguuaccgaggaaagguaaaugaaagggaagacugggcauuugcaccucccccuuccuuuuaccuguggacacacccagcugugguacuauuccagguaccuacagacaagcucucaccugcaggacccucucagcacaggucuuggaacagcuagcugaagggauuuauuuuugagcuuugcccuguaagagaugggcacgcauaugcagacuuugacuacaguacaaauucucuagcaugcuuuugaugccccaggauaucuuguuaaggguuucaagagcuggagaagccgcgugguggugguggcgcacgccuguaaucccagcacuuggggggcagaggcaggcagauuucugaguucgaggccagccuggucuacaaagugaguuccaggacagccaggacuacacagagaaacccugucucauaaaacaaaaaaaaaaaaaaaaaaagcuggagaaaauggcucggcuguuuuaguuuguaauuauuuucuguggauggguguuuugccagcacauaugucuguaccauguaugugccuagugccuguggaguccagaagacgguguuggagucucuggaacuggagguguagauagagcccauguuguuaaucacuggcccaucucuccaggcccuggcucggugauugagaguacuuguugcucuugcagaggucuggaguuugguucuuagcauccacacuacagcucacaaccaucccaaagcccaguuccaggggauccagugcccuccucugaucuccuugggcaccagccacacauaugcugcauguagaugcaugcaggcaaauuuuccauguauauaaaauaaauacaucagaaaaaaauguacagguuugggggcuaggaguguagccugcuguuccccugcuugccuaguacacaggccacuacuuugcauaggcuuuccuggcauaggcauauaucauaaugacagccguucaugacagaaaauaagguaaaccagaaggaaaggcaaagcuuugucagggcccuccugucaggcuuugcaagugcuaauacagucuuacgcagcugagcuuucauagcagacuuucuuuccugcauucauuaagcaauggcucuggccacaaaaggaagguuuuguuauuccgcaauaagaacuggauuuuaaauugcuguuugucuugcaagacacguaugucuuacauacuguaaucuucauaaagugaugagcacagauguauugacaggauuaaugugaagacuuuguugugguagugagaggucauaucucucuuccccuucaucccugagcugagugcccaacaccuuggacuuuaugguuugucaagguuguguguagaaggguaaaaguaggcccuuauuauuuuacucauguaugucuguguguuuucucaagacaagggucucucuguagccccagcuguccugaaagacacuguagacuaggcuggccuggaacucacagagauaucucuaccugccucaucauuucaaaucaaaaguuuaugguauuacuuauuucagaguuaaguguguugauguauaucuguaaugccaccucucggaauuggaggaggaggaggagggcggcuauucucuguaacagagauuuauaauccuugugugaagaaauagcuggcagauguccccaaccaguaacccugguucccaaaagcuaggucacagagacuuggcaucuuauaaaguuagucguuacuuugcagucuuggaaccaaucucuucuaauuagccugggaggcuuccuuugucuuuuuccuuaaaaugggauuucccugugcacuccugacuggccuggaacuccccgagauccuucugccuuugaguuacuggaauuaagggcaugugccaccaugccacacucaugucuugauuuaaaaacuaaguugguccuuguggcuuguugugguccuugagaaaagccucacuggugugucauguugggaaauuaugaguugucuuuuaaaugaauuauuaucaacugacuucuuucucuaggucauccgaggaaacagcaucaucauguuagaagccuuggaaagagucugaccugugcucagcaagcaguguccacaucccuccccaaaggccuguuugauugugauguagaauuaggucauguacauuuucauauggaacuuuuuacuaaauaaacuuuugugauacucagaagugcguuucugcuguuguggauguagggguuaauagguacucuuucucaccacccuuuccaaggaguuuaugcauucaaguagaagcaucuugcccggugugaaggaagacaagaauucuauaacauugaggagaugagcuacagaugugugguuuguacacauuaguuuuagugccuuugaccuccugugacuucaaacuugaguuaggcuccuaauguggaauucuugggaagggguguuuaaguuuuagaauauuuauuuguaugacaugagcugucuugggauggaaucugccucuugcuuuucuauuucugugaagagacaccaugaccaagucaauuuauagaagaauuuagaaaaagacaaguuuauugggggcuuaucauuuagaggcuagauccaggaccaucaugacaagaag

SEQ ID NO: 3162 - RNA, 11181 nt, Mus musculus
ugcucuguauuuauuuauuuauuuauuuauugcuacuccuacuauuauuaauuuagacaaggacucaguguguuacccuggcuguccuggauggaacucacuauguagaccaggcuggccuugcacucacaaagauccaccugccucuauauugaacucaggagauuugucugccucugucucccaagcccugggauuaaaggcaugugccaccacaucuggcuaaagauuuuucuuaauuuuuuaaauugacauaaauguguacuuugccuguagcucuaaaccacugagacaacucucuggcccaccagcaaaacuuuaaauuacaagccuaaguauaucccauugcaaaucaaguccacaaacgguagaaacuuaguuauccuguaugucccugcaucugcagcgccccccccccgcuuaggugcugcugcuuuugcuggucugaaaauacucaguggaaaauaccagaaagagcugguggaugugaaggcacacaccuuuaaugccaggacccaggaggcagaagcaggcugucuguaugacuugaggccagccaacgcuacauagugaggcccugucuacaaaaugaaaaagaaaaaaaaaaaagaagaaagaaagaaagaaaagaaaaagaagagaaacagaccagaaguuguaaguuuuaauugacuuccaauuguuacaauucuucuauuuuauaauuauuguuguuaaucucuuacugugccaaauuuauaaauuaacacuuuaccacagguauauuguacauguggaaaauagaacauguggggcucacugcuucccaguuccgggugcccacuaggggucaugaaacacucccgcucugaggaggcgcgcugcacaaauccaccguacgaauccacgagagugcuauauuucugaguguuguguuuuugacaaaccacauuccuuaacaccacagcagaaaaaaauacaaaugucucuaaaugaauuagaaaaaagccaaccuucugauuaaacuaugaauuuaauuucugucaccauaucaaauauaucaccgcugcuuucuccacacauuauuaauuccuacagcuagaguagggaaaaauaauuuuuaagaaucaggcuuuuuaagaccgcuuuauugaagcaacgcuauaaccuggugaagaguuuugauuuuuauuccuugagauaggguguugccacagcccaggcuggcucugaacuuuugauccucucgcuuugucacaaagguauggaugacaggcaaguaccaccaaagcaggcaaaauuacuuuuuuucccucuuaauacuaguggcuaugauagucacuggagaccuaugagcaguggacuaaacaccagauuucuugagcuugucuacguaagagaaaucugacucccaugugcagcuacaacugagcgccacuguauuaagauuucagcaacggccccucacugcgcaugcccagcaucugauacgcgucccucugaacucacgcagccaugaagaccugguucuaaggccaacugcucugggcucacucaggccgccucugcucuaguguucguucccuuggagaccacagcugauuaaccaucgagcagccagucaccucuggcaccggucugcugugguuuugauuuguguugcuuagcacuuuuaaggcacucaaagcucucuaucugacacccaggaccugcucacccuuggcugcaugcgaggaacuugaucuugacaaagcuuuagagccaagaccccaucuucaaccuaggaaauuccauucucuggaugucgauccugaagcucuugaggcuggcaauguagcucagugguagagcauuugucugggauacucgggguccuggguucaauccccacaguauagaaaaacagaccuccucaaguuaauaguuuauauauuaaauaguuucucaaguuaauaguuuauauauuugguuccaaaucacaggcuaucucugcuucuaucucugaaucuaucccugauaaagccgaggcagaagcaaucaaaagucacauucuuaaagucaggacuucaggcuuugagaacauucucaucaaaagaguauaaacugccaggaacugggaaacaucuguauuccagcacauaggaggcugagacaggaggauugcugugauuucaagaccagccugggcugcauaaugaguuccagccuggggugcagacuaagacccuaguuguaacaucccccaaagaagaaaagagagacaagaaaagauuacaaucuaaacaaacccaggcccacaccagcccaaugaccuaacccagauguuuaugaaguuccaggugacucuuaaaaccagacaagccugggaaaauccaauguuuccccaguuauccagccacgccucauguggagggccuggaaucaaaucccaggcucuccggagacugaggcaggaggauuccaccuggacaacuuagugagacccagucucaaaagaaaaaccacaaaggagggcuagggauauagcucagcucaagaggggaacacuugcccagcaugcacggggccucagguucaauccuccuguaccgcccccaaauccagagugaugacauucugacagaagaacacauucuccgaggaacaggaacgcuguguuuucucaugacccacaugaggaguaccaggaaagguucaaauuccucucugcugacucgguccuucgagagcaggacgcucgggggaggggcagugcucaguuacagcuccgucuuaagccuuucauacaggucguccugaucaaucauguccucauugccguuccagcggugguaggcgaggagagcugcguuguagccggcaauggcgcucauuuccaugcagcuggccgcaaacucgaugccauugagguaauagagccggucguggaggaugauggagggacauuucugaggaggcucauagugaggauaggacagccauggcuuccgcacagcauaaucauaggacaggaagagcuuugaaauuuguucuuuggugaggaugucccuggagaaggucuuccacacgugcaugccauccaccgcgggugggggacccuccuucugucuuacagaggccacaauggacagacuguuaauaaacauaucggagucaucagugacaagaauugccgagaggccaaacugauccuugggucuggagcugaagagaguggaauugaguucuccuuugaugaaaguugucaccagcuguugauaugggucauugaauuccucgaugggcggaucaaaauuucggaaaguuauguuggacaucuuccgguucaaaggagcagccacgaggacaaugucauagaagucagaaugggucucagauccuguuuuauauaccacuucauacaucuuggugggguuuccuagagggcaugguaaaacaugcaguuuuuagugcuucuaacacuuaauuucaggccuucuacaaauaauucugcagcauucuuggucuucuuuguguacacguacaagagugugucuguauuuggaggccagaggcuaaccucaagugucacccccaggaguuacccaucuugaauucugucuuucucuuuuuuucaagauuuauuuauuugggcuggagagauggcucagcaguuaagaaugcugacugcucuuccagagguccugaguucaauucccaggaaccacaugguggcucacaaccaucaauaaugggaucugaugcccucuucuggugugucuaaagacagcuacaguguguacuuuuuuuuuuuuaagauuuauuuauuauguauauggaguuccgccugcaugugugccugcaugccagaagaggguaccagaucucauuauagaugguuaugagucaccauauggucgcugggaauuuaacucaggaucucugaaagagaagacagugcucuuaaccccugagccaucucuucaucgcccaguguguacucuuauaaacaaaauaaaucauaaaaaggauuuauuauuauuauuauuauuauuuauagaaauguuugucuaugugaaggucucuguaccaaguauaugucugcugcucguggaggucagaagagggugucggguccucuggaacugaaguugcaggccacugugagcugccaugagggugcugggaacugaacuuaaguucuuucaucaagugcucuuaacacugagucaucuccccagcccccccuuguuaucucucacuguagcuccccaauuaggcuaagcuggcuaccagugagccccaagaauuccccugccucuacuccccccggcaccacaauuacaagcacuuaaccaaaugcucagcuuuguaugugggugcugggaucaaagucaaguucccaugcuugcauggcgagcaaguacuuuacugaaaaggcucucaucuucccagcccuguuuguguuuuugagacagugucucguguugcucaggcugccuucaaacucgcuauacugccaaagauagccuucaacuucugauucuccugccuacaguucuggaguauuggaauuauaaggucugugccaucaccuaauuucuguggugcuggagagcaaacccauggcuucaugcuugcuaggaaagugcucuaccaacuaagauacacacccagccugugacguguguguguguguguguguguguguguguauguguguggugagcacucagguauauaugcacaccuauguauguacguguaugcaucuggguaugcacacaaaggcuagaggaacacaugggauguccuguucuauugcccuuugccuuauucccuugagacagggucucucauuaacccguagcuagcagcaagccccaguguugucuauacucuugggauuccaagcacacacaagggacaucuagcucuuuuuuaagcauagguacuaaggauuugaacucagguccucauguuuaugcaacaagugcucuuaccaacugagccaucuccccaggccaggaaaucuuuucuucugccaucuuuuacaaaguucccaagcaguggaacuucacacugcucaugcagaaacauucucagcugugcuaaagggcaugaccguggcucaugggauauggaaaaaaccucauccucuaagggaauguuccaaguuuuguucucacuaaauagaagcuaugagaaguuauagacuuguggaacuugacaucaaaucuccacuacccaugcaaaaagcuaggggucuuuuuaguuugguuuggcuuugguggcaacaacuuuaaugccagcauuugggaggcagaggcagguggauuucugugagcucgaggcccaaccuaguccacacagugaguucuaggacagccggaguuacuuuagauagaaaagcccuaucuuuuaaggaaaaaaaaagagggggugggagggugguuggagagauggcucaaugguuaagagcacuggauguucuagcagagggccuacgauggauuuccagcaucuauaaggugguucauaaccaucuguaacuccaguuccaaaguaucugaugcccucuucuggccucugagggcauuacaugccugugguacacauucgauaaaacacacccacacacaugaaauaagcuuugaaaaaauuguguguguaugcaugugauauuuucuggagcuauuuuuuuuucuuuaggaauaauggaaaaaucaaaguucggccucaccugucuguuugguccucgucuucuccucuauugacauuacggagccagauauaagauugcugcuagaggccugaaggagccccgagcaaacaauuuuauuaccaccuuccacugcccagagguuggaaucggcagccgucaaugacaccgccccugucaggagggugcaaaaacaugcuuuaauucugucuuggucagguaaaucacucucuccugaccacuuagauacucugccccaaaugccuccagacgcugucagaugacccucggggcaaaggucuugcucaggugaaagccacugaaacuaacagaagcacaggacccuccgcugcuaacaacucacagacagaaauaaacuaugucgguaaaaaugcccgagacacuaagaacuagacuccccaccgguggcucagucccgaugggacuacggcuagcucggauuucuuccaauucuggcuuacccacaaaggcguugaugucugugcucuggccauaauugaccuucaugacaggagcaaucaucucguugagaaacgucucggagaagccugcuuucuucagguuuucacggagaguuugguuaagcagucugacguagucauccccuccgauggcgugcaucaacuuuucuacacugcuaaaggcauagucaugggacugguaacgguagauccuugcaaaaaagagaaauggcuauuaaacgccacucaggacauggagcuacaaacagcaucagaagaugaaacugauaccaggcuuugcaaauuguaggacacccugggauacacagugaaauucuaccuaauacuaauaaugauaaugacaaugauaauggggcuagauauggcucagcaguuaagagcacuugcugcucuugcagagaacuuggguucuuguuugguucugcuugagacagaguuucucugaacaguccaggauguucuagaacucccucuguagacuaacuagacuggccugaaacgcagagauccugccucugccucugccucccaagugcugggauuaaagguuugugccuccaccaccugauuuaggacuagguucuguucccagcauccacauggaaacucacaucaucuguuaacuuuuuuuucuuucuuuuuuuuuuuuuuuuuuuuuuuuuuugguuuuuugagacaggguuucucuguguguagcccuggcuguccuggaacucacuuuguagaccaggcuggccucgaacucagaaauccaccugccucugccucccaagugcugggauuaaaggcgugcgccaccacgcccggcuguuaacucuuuuuccaagagaucugaugccuucuucugaccucuuuggacacuaggugugcaugugaucguggacauacauacagacuaaagugcacacaauuuuuuuuuaaaucaugaauugaauuccauguuuccuuuugaugaguuccuaccagacaagggaggcacaguuuaaucucagcccucugcccuccccucugccuucuaccucaagacaucugugcucuuaaauauguucaaugggacauuuucaaagagaugugcauaucuuggggauauagcucagcugacagagugcucaccuugcaaacacaaaauccugggacugacaccccuacccccacccccagcaccacauaaaacuuaugccuauaauuccaacauucaggagguuggccagccugaaauucacaauuucaauuauaggugaucugaugcccucuucuggccucugggggcuccugcacacacuugugcaaauuuauacacaugggcucacacacauacacauaaauuuaaaaaaaaaaaaacuuaaaaaauuuuacaaaaaggccucacucuagguucaguggagauggcucagugggcuaacagugucggcuaugcaagucuagagaccuaaguucacuccccugugugugcauaugcacuuguacacacacacacacacacacacacacacacacacacacacacagagaagauaaagacauggcugaagaagauaaagacauggcugaggaaaauacuguaugccgacuccugugugcacucacauacacagaggcaaauggauggauacaccuacagagaagugcacgcacaccaaaccccaaagccacacuucaccucaguuuaccuuuccuccaagcucuugugcucaggaucucacucaccagcacgaggcaggcacugagacugagucuccagucagccugggaggcagcuccagcuuuggcauuuccuagguggguggcuuuccacacuuaaagccuggacaucuccauucuccccaugugcagaaggcugccgagccgacugacugccaugagaacucaugcuuuuuuuuuuuuuuuuuuuuuuuuuuuuugguggucauugucguuguucagacuaaacuuccgaaucaugcuuugcccauguuucuuuaguguugccagacacucugagauucuacacaaagucaacuccuuaaaugagauggucgggcgugccaggcaaguguccuaccacugagccacaucucagcccucgccaaguacaauuuagaagcaaacacguaugauauauucagaucccaaguaggaugaugaucuguaugaugucugcgaaaacguuuugccuaaugagguggugaugagguagagcuggugcaggagacuaacccugucacgcucccgggccgacagaucuuagauccaccagaggcugaauaguuaccucaugaacuuguccaacaagucuucuacccacaugugcauucugagggacugaaacccauagcgccacaccagcuuaaucacguugauuacaaaccagcugcucuccucaaacaccagagacuuuccauuguacacgcccaccaggccaccugaagcgggaacacuggagagaccugccaaaacagagggaggggcuccagacacggcucugugguuaagggcccuugcugcucuuauagaggaccuggguucaguuccgaguacccaugucaggcggcucacaaccaccuguaacucuugcauggauauauccccccaccaccacccacccaccccccccccacacacacagauacauaauuuuaaaaauaaauaaauaaaucuugaaaugauacaaaacaagacaaagcuagaggaaagguaggccagugauuucuacacugguccaaugaaaagggaauuugggagaccuguuagggacuuucuggacugagugacuuaggggccauucccaggucucaggaaacacauuagaguucuauuuuuagaacaguguggacacaggacugacugcucgauccacaaacugacacagcaggagaugggucagaaaaucucauaccuguaccaaacuaaacccacuagucucagucauggagaagaaagccucugccagggcugggaagggcacccgaggaguaagagaggucccauccuacgcaagccucaacuuugcaaaacugggaaacucagguaaaugggaaacggccagaguuacacaauauucccuaagagaaggcuugcacaggccugccagccuuccccgaacauggcccgcuccucugccgacaacgugucagucauguguccccgugaguacaugucugaacccugucugaacgacuucaagccaaguguuggaagcccauggaucucauuuucucagcagcagaaugagcuaaaaacacucugcuagcucaaagcacucugauuucucaacccaaagccugaaguuuaagaacugacaacagggggcugcaacauggcucagccccaaauggacugcaccuggguucaauuccugagacccacacaguagaagaaaaagaacugacuggaucaauuguccucugaccuccauacacacccuguggcacucagaccaacacccccaccccacaguuauacaaaauaaauagcuaaaauauaacuuuuaaaaaaauuuuuuuuaauuuuuuuuuuaaagaauuaacagcaacagccacccucacucaaccccauggcuguaauuccagagagcugaugccacacagauagcuuagagucucauuacaggagaguggcucgaugcuaagcugggaccaacugcuaaaccccacagcaagagaaacaguuucaccaacuucucuguagaagacaaggcagaaacaucaguucucuguguuaggaaaacacauacggccagucacacauaguguugcuuagugcuaugaaaucacauacccagcucuuugacaaaucgcuucaugugcaaauuuagggggugaaugacugaacccccugccucguagucaugaccuugcaccuucaaaguggccaaacggcccccgaccucuucucucucaaacacgucaaucuucacguccuucccaaauuucuuccuuagauaauaggcggaggaaguaccaccgauuccagcaccgacuauugcuauacggagggggggaaaggaaaagaggaaccguuuguuuccccuccuaucaguguugcuuuuguuuuugaaaagccauuaaccaauaauagccauuacucaagacuaaaacuaacagcuuggggaaaccugagggaagggguucucuuuaaagacagacucccugaaccuagacaggugcuauagaugaaguuacaaacugacaguuggucaaaagaugcccaaagguucucccaggucuuuguggaggcaccaccggacccagggacccugcugugcccaauuccuggggaaguaugaaugggccccuccagcacgcauuuuaaauaaagcagacgccaucuucgcccagcuuuguucuuugucucucuauggccccaacaccauuaacgaucccgaaagacacagcuucagaugggaauagacacccaggaaugaaaacccgaggcaaccaaagccacgaagagaccggguucuccagcuagcugcagcaguugcaguaagcagagcgcaggugcggggaggcggucccaguccuucucgggggaggggaucuggagguaggggaagagagacuggucccagugcagagucugcgugccccaaucggccggacaaacagacuuagcuccagggacagcuagaggcgggcucuugagggcguucagcugcuagagccgagggccucccaggcuggagcugcacggauaccgagucccuggcuagcacacgccuccaguggcacuccuccagacucggagcgcacggcccggucuccggaccccgaucuccacccagcccugggaagaccgaccuaggcaucgccgcgccucuguaucccccgcaccuaccgauccuguucggcggggcccggggcucggcgcucgccagacugcccagaccacauagcagcagccccagccagaacagugagcccaccaaugcagcggcgaagcgccccauggccucccgcagcugcagacugaccgcggguccgccagcagacccugcucuaugcgucugcgcgcuuucgc

SEQ ID NO: 3163 - RNA, 69284 nt, Mus musculus
aggagggugagcaugcuagcuggcugugcgcaugcgcggcacgggucacucggcugccggcuccuaggcguccggcucgccgccaucuuggaucgggguuucauuguucgcgguaggccgggccuuuuuuuguguaaucgcugccaaagaagaaagcgaaguagccuccggucaagcgaggaggccggcucuuccgcagccauagcccgccucaaggauuugggagguagcgaagggcagggagcuggacccugaggugccgccgcgaccgcagcagccauggaggacgagaugcccaagacucugugagucuggagcagcguugagggaggcgggaugguggucgccccguagggaggccgcggcccugcgccucucugcagccuauuguucuccguggacgccgcgcuguggugguuccucccucccgugcgcacgccaggaugcuuagagccgagccgggccgagaggacgauggcgggagaggggcucggccccugucaccccucggcuggcugcacccgcggcccccagaccuggaggaaggacuuuucauucaaagcucuccucaggacucggcacguccuccuggagucccaugcuugcguccuuuuuuuccccgcccccucuuuucgaugaaucuuuuccagauuuccaucuggaacguccuuucucuuuucuuuugguaggauuuuuuucauuuuuaauucuugaaggcugagguuaaaaacuuuauacuugcaguugagaacuggaaagaaaaaaaaaaaaaaagccagacaucuuucucgaaggucuucggcuuucccucuguaguacuccccugacccucgaccaaaaaaccuaacuggacacccaaggauguugaaaccguucuuaaaaaauggaaaucucacucggagggaugcaucuaccgagggaaaguggguuucauuaaaacauauuuaccaccauuugcgacuagugguugacauuuuuauuaauggaguaacuguggucagucagguguaagcaucuuuagugaauauuuuguaacucgagucuaggauauugucuuugucauguaacuuccccuugcauucuuuguuuuucaacgcacggguugaggcgguugugccuuuguuggguuucacagggcaaaaaagaaaagcucaagaaauuguggguuuugguuguuguuuuuuucucccgguauauuugaagauugcaacuugauguaucgugcauauaguucauauaaaugaaguaggaugaacauguaucauguuacgggccuuaacucugcaccuaguuccugccauagcuuuuuauuucuagaauccugguacuuuuagagcuauguacauuuaggguucuuuuugacauuuucuaguuauuaaaauuguucugaaguacagauacguuauucuuuuuccccucgcccauuuucaauuucuuuuuucuuuuguuuguuuuguuuuauugagacaggguguaucucuggcugucccagacucacuauuacagaccagguuggccuaaaauucagagauuugucugccucugccuucugaacacugugauuaaagucugugccauacacuuugccccaauuuaaauuucaaguugcuauuuuuaauguauuaugugaaauauacuuacuuuuuuuuuuuuuuuuuuuuuggaaacagggucuuuuauauaacccagguuauccuugaacuauaccuauacuggcucagaacuguuaguucugucugagucccaggugcuaggauucagauauugccuacccaguuugcauuuuuguuucuucucccucccuccccauccuggcuggccuggaucuuccuuuguauaguaggcaggcuugcaaacuugugaagguucucuuuccucuguuucccaagugcugggauuacagacuugucccaccaaaccacauuuacacucuucuugauauauuaaauaucuuguuaguuuaugggaccuggaaguagcuuuuuaguaaggaugcaauacuuagggcauggccauuuuuuuuuuuuuuuggaaagauuauaucuauagguaaauacucccuaaaaccuauuaaauacauauuuauuggaaauuuucccuuuuucaucuuagcauuuuagaauucaugcugcuaugcuuuuuggugucuuuauaagauacuugaacacuuuuuaaagcuucauuccuguuguaaggguauuuugccugcauguguauaucugccuucagaagucagaagacauuggaucuccuggaacuggagucagguguuugugagccaugugggugcugggcaccaaaccaaggcccucuucaagaacaggugcuauuaacugcugagccaucuccaaccacacuaugaaaaucuuauauuuuuuuuauuuuaaaaauuugcagaaauauauggaugauaacauuaccauuuuaguauguacauggaaauaugcaguaaggacauguuaucauuuccaaagcaggcauuuaaauagcacuauauugagaccaggaaaguauugauuggaguagauucaucccugggaaguuggauaaauccuuagugugugucagaugcuuaccaugcucgcuucgucuuuauuaucacuaaggggaaaggcauuuuauaaccaaaggaaagcuaagcuuaaugucccaacaacuggcucaaaagcauauacuuuaauuaaaaaaauucuugucucacucgucuuucauuucagcaacuuguaaggcagaggcagacggauuucugaguuagaggccaguuucugguacagagugaauuccaggacagccauggaaaaagagaaagagacccaaaacaacccugcaauuuuguuaccuguuacagcagugccuacuuuuucuugauguccuucaguaaagcagccuauugaagaguuuccuucugaaaguguccgugauuuaaaguuccccauuaucccuucccuggugcuccaccccuucugucaaaaccuccauccuuccacucagccaguacugauuaaaucuugguagguacuaacucuaaaaauguucccaauaguguuuuuaaguuuuaagugcucacauuagugauccuggaagccaggguuuucugauuuaauguguauucuuagccacagucuaguccaugggaaguaaucacacuuguuuuaaaaauccgguacaguugaagaagucaagcuguuccuuugggaguagccugguuaccucaccuguguuccuagugacuccgaggcagcugcuuccuaagcuuaguuuucagccacaacaccuuguuaaguuagagauugucagcaauacuuuuaaaauauauuguaagaaaaaucaaaugauuauucagcaagauaauuuucaggaauauucaaaguauaguuuagagauuuauagugagugguuggguuauguacacauuuugguuuuuuuuuuuuucgagacaggguuucucuguauagcccuggcuguccuggaacucacucuguagaccaggcuggccucgaacucagaaauccaccugccucugccucccgagugcugggauuaaaggcgugcgccaccacgcccagcuauguacacauuuuauucuucccauguguaaguuuuaauuuguccauaauaaaaaaauuaaaaauauguauaguuaagucugaguuggcuuuggucacuuuaaaacuuugaauuuguaaacuagaaacuguacaccaaaguagaaaaacauaguguuaguguuagcugauggauuuccuuggauccaccugaacaucuuuuguguaauuuacugucaaaugcagaugguacuuuugagacagcuauguaguuauuguuuggucuuuacagcugcuaggaucguaggucuauacauuuuauagcaucacuaacagccugcagcuaaguaauugcugaacgcugaucuggacuuucucuuucuaccccccuguguaguuguaauuuuuauccacgcccacuucucugcauacaguuugacgauauaaugucuaugaaauagcaucucuuuuucucuuuugggcuuaguuguauuuucuuguguuuuuccacuucuuuuuuauucuuuuuuuuuuuuuuccucucgagacugugccuuacuauauagccuagcuuggccuugugcuuguuuauucuuuuuuuuuuuuuuuaaggauuauuuauuugggcuggagagauggcucagcaguuaagagcacugacugcucuuccagagguccugaguucuauucccagcaaccacuugguggcucacaaccacuuguaaugagaucugacgcccucuucuggugcaucugaagacagcuacaguguacuuauguauaauaaacaaauaaacaaaucuuuuuuaaaagaucuccauuaaaaaguauuuauuauauguaaguacacuguagcugucuucagacucuccagaagaggggaucagaucucauuacagaugguuguaagccaucaugugguugcugggaauugaacucagaaccucuggaagagcagucagugcuguuaaccacugagccaucucucuaacccuacaguuucuuuccuuuugagacaaaaucucacuuuuguuugaaagguugccucaaacuugugauggucgugccuagccuccaaaacguugggaguaacauuuuauuuggggugggagauggaagucaaaggacauccuuuugagcagguucucccuuuuauacgugaguuccagugauugaacucagauguuuggcagcaagcaccguuaccuacugagccaucuugccagcccucacccucacgguuuuuuauuauuuuuguuuuguuuuguuuuguuuuucaagacaagaucuuacuuuguagcccuugcuguccugaaacucccuguguagaccaggcuagcuucuccugucucugccucccagauuaaaggcuugugccacucugguuucuuuuucuuaucuucuuuuuugguuuuucaagacagggcugucccuggacucacuuuguggggcaggcuaaccuccaacugccucugccuccgaaaugcugggauuaaaaggguuuuguuuuauuuuuaagaugucuuuuacuuauauauauauaugcauauguauguauacacacacacacacacgcauauauauauauauacauauacauacauacauacacauacauguauauaugaguacacuguagcugucuuuacacaccagaagagggcauuggaucccauuugguugugagccaccauguaguuucagggaauugaacucaggaccucuggaaaagcagucagugcucauaaccacugaucaaucucuuuggauguuucuaguucuugaaagaaaacuacaaguuuucucauaaaguuuaggaaucaggcaaaauaaaaaauucucuagcaaacugcaaguguucaagcaucauucuaaggauuaaauguaucagacccuguuuuucuuccucagcagugcauaaauaaccaaccaagguuuaagguucaaggccugcuuuggcuauaagagaccuugucuuaaaacaauuauacagaauuuacaaagaacuaauaaaauggaaaacacaagucuuggagagggaaucauugaucucuuuuaacccuuuuuccacuugcuuacucucuguaucaauguuuugccugagugcacauacucacacacaagcaggccugcacaguucagaagaggacauugcgucccuggcagcuagagccugucagagaguuguaagcuaccaugugaguucugagaauugaaccugucuucuguaagagcaacaagugcuuuugacuucugagccaucucuagccccucauuagggcuugauauauucuagucaggguucuucuagaccagugguucucaaccuuccuaaugcugcuacccuugaaaugaguucuucauuuuauggugaccuccaaccauaaaauuauuuucuuugcuacuauauaacugauuuuguuacuguuaugaaucauaaauaucugaugcucaggauauuugguauuguaucccugagaaaggguuguucagccagcaacgagucaugaaccacaggcugagaaccaaaguuuuagacuguaguuaccuaacccauuuuucaaaaucucugcuuaaaaagaauuuaucauuaguuuaaaaucuacuuaaugcuuuucccucaaauuuccagguuuuccauuauaaaauaaaauauuuuaauauaauguaccaaaagacaaauucaguuuaauguucugcuuuguaaauucuuuuguaaauuaacuaucuagagcuguauaaauaaaaaugaauauuucaagaguuuuggauuccauuuucauaacuucgauuuuagacgggaguggggaauguugagacagggucuucuagagcaguugucgucccuaaacucugaucuuucuaccucugccucccaaaugauggguuuacagaaguguuccuacaccauauugauuuuuacaacuaccugaaaacuuagcuuuccacuucaaaauuccauauggcucaggggauaaaguugcuugccuagcacauccuagcuucaguuguggcacauugaguugacugaacucuguccugacagagcuggccuguugucacuaguaguguuagugcccuuacagucaaaucuagcuuguuagucauuuagaaaagcuacagaaaaauuacaggaaagguauacugaaaacuagcugccuuuccuguggaauuaccaguuaguucccauuuagccagcugugcauuauuuauguuuccauguggguuuuuggucgguugguugguuuuuacauuuuuagauugcauucauuuauguauuuggugugugauguguuggggggggugucaaagcaaacuggguuggauuuguucuucaucauguggguuccaggaaucaaacucggguggucagacuuuaugucaagugccauaacucacugagccaucuugcuagcucagguuugguuuuuugaaucucucucucucucucucucucucucucucucuuucucucucuguguguguguguguguguuucagucuuuuucugucuccuuccuuccaucuuuccuuuuucacuaaagugucuuaguucaaaauggugacacuucaaucucaaauauuguauaagaacaagaacauucucuuagguaaccauaauaugcuuucaucuugagguuauauucauacacugauguguaugcauaugcauguuguauguauugguaacacucaaaagcagggguucuaguagugccuuucccagcuucccagcuugguuagaucuucagcuccagauacaguguuaccuaauauauucguuuacccaagugugugugugugugugugugugugugugugugugugugugugugugugugugugaacccuuguaugauuguguuaggagauuguagacccuuuaagaggugaguccuugugccgggugugguggcgcacaccuuuaaucccagccagcacuugggaggcagaggcagguggauuucugaguucgaggccagccuggucuacaaagugaguuccaggacagccagggauacagagaaacccugucuccaaaaacaaaaacaaacaaaacaaaaaaaagaggugaguccuguguguguguguguguguguguguguguguguguguguguaacuccagcauuuuagagguggaaguaggaagauuaggaguuccagacuagucugaacuaucuagcaaaaccucguuucaaaaaaaucaaaacaaaagaagugaguccucguuaaaggcuguaaagucauaagagcacuaucuugggaaaagauuaguagacuuaguuguuaccagcaaaaccaacccagguucaacaugugauacagucucaaaaaugcuagggugguguuuaaacuuccaccacuuggaagcugaggcagacagaucuccugugaguuugaggacagcuugaguuccaggacagcuagggcuauauagagagacccugucuaacacacacacacacacacacagcuuucugcaggaagaguguggaacuuugcuuagaaaauauuuuggaaagagacaacuuuuagcccacauucagaaucaaaugauagucugccucaucccaucccugaaaagauaguacuccacaccuucccagggucaggcaccucagcacugcuccuguuguugcuuauaugcugccagcuguguuuucuucaggcuuuguuucuuuuguuuuuccauuucagggucucacugaguagcccagccugcccuuuucucacgguucucuugccucagccucauuagugcuaggauugcagaucugugcuguuaaaccuggcuuaaggaaacaguucuaaguaaaaauaagacaagauauagacuauaaauucuuucauuaaaggccagauaugauagggcaugccuguaagcuagcacacagaagacugaagcagaauuaauggcagcuugagaacaccaugguccacauuaucauaauccuaucuuaaggaaaaaaaaacauagaaaagaaagccaaacauuuuaaaguacaaagauguucuuacuuuuuugcuccugcacaggaaggaucugcaguuugcacauuuguucgugcuuucucuucagaacuaguauuuguucagcuaauagacuugacacagcaaacagcauuguuuauaaaaauuugagggcaacuuuagcaacuaaauuuauugggagaauugguucagucccuaugcuguuugcauaaggaagacuuguccugugauuucuuugcucucccuguccccacauuugagacaguguuuucuuauguguuccauacuggcuuugaacaccucugccucacaagggcuaagauuacaggcaugugccaauacaucugacugccuuccuccuccucucccuuacucuuuuuuucuuccucucuuccucccucucugaagcaagauuuugcauaucccagacugaccucaaauuguguagacaugaauuucagaucuuuuggcaaagagggggccccuuggucccuaaggcuuagcauugcagcucuccugaucuccugcucaaaaggcuuggaaagugcuucgcuguccucuuguaggucucauuuuuggaguagucagcuccagcaugaccaaauugccauuagauauauggucuccuuccaaguccaucuuuucuacccacuccuuauucuacccacuccuuaguguuacuucucagugcuucucccuggccuucuuccuccagcauccucauggucucagcggcucuguccugaacacuaggaggaaagaaaccauuuuuacauuuuguggacaugcagagguaccuuuuaucuugaaagagucaaagauauaucuuuggcugcucccaacauuuauuuuucaaaaagcaaaauucaacaaaagauuuuucacuccugggacaggagcucacucuguaaccauaacuggcuuagaauucagcauguggacuagacuggccuugaacccgugcauguugggauuacaggucugaggcaccaugcuuagccauaaauaaaucuaaaaugguaaauuguuuguuucccucuguuccagauacgucgguaaccuuucucgagaugugacagaagcucucauccuccagcucuuuagccagauuggaccuuguaaaaacugcaaaaugauuauggauguaaggguauuucacucagucacuguucuuccuuccuuccuuccuuaagauuacuaaugaaagcugucauuacugcagaacuucuucauuaaugucuagauucaugaggaucuuagugaauuuguaauuaaccuguuuaguaggcaaccaaguuucuuuugcuaagugaauggugugugugucuguaugcacucuucuagguucuauugaggcaucagaauuguuuuaguguuaauuggcugaaugaucuauaaguucaguuauuagauugggaauugggguagacuuauaaugaaaaaauauauaaugaaauacauuuuuagcuucauuuuuaaagguuuucuugaaugccuuucagacuuuaauguguagaaaacuuauucauuugguugguguuaacuacaaauaaugagcuuuuaaaacaaaguuaauuguacacgugagcaggugaauggauauguauguggaggccagacgucaacauuggugguuccuuguguauacauaguagacagggucuuacacuguaauccaagaugacuuggaacuugcuauguaagcuauagucuuccugacuuagcuucucaagugcugauaggccaccacagccuggaaaauaucuguuuguuuauuuauuuguuuuuugagggauggucuauguaauuaauucagacugcccugaaacuuggacuguucugcuuuuugaguaaaagaaugauaaaugugcuaucgccccgcagaaucucaauuauucuagaauacaagaguguuuacugaaguuuaugcuuaucucuauguucugaauuuugaauuaguuuccuuuaauaauucuuaaaaagucuuagaaugaaauacaugcauuauaaagucauuuauuauucugcacuuuuaaauccagauuauuagauguauuuuuugcuuuaauuuaucauaaaauaucuugaagccaggugucauagugcgugccuauaaucucagaacucaguaaacagggaacagaggaucacugcagguugggggccacucugacuaccauaguaaguucuagacugcccaaggcgcaauagaaaaacugucaauaaauacauaaacaaacaacauuuugcuuuacgcugaagguuuucucagugauugcuuccuuagcaugcacaaggcccuggauuuugggccccaacacuaaggggagaaaguccagguuuuguuuauuguaucccagucaccagcagaaaagaaggguuuguuuuuuuguuuuuuguuuuuguuuguuuguuuguuuguuuuugucuuuugagagaucuuacuaaguauccagacuggcuuuagacuucaccaagaugucagcaucccugauccugggauuacagauagagagguuuuuuuugguuugguuugguuuggcuuuucgagacaggguuucucuguguagcccuggcuguccuggaacucacucuuuagaccaggcuggccuugaacucagaaauccaccugccucugccucccaagugcugggauuaaaggcgugugccaccaugccuggcuggauagagauuuuuuucucucagauuuaaaucuuuuauuuuguaugaguguuuucaugccuccugcccaaggaagugagaauaugguguuagaucccuuacauuggaguuuauggaugguucugagccacuguauaagugcaggggaacaaacauugguccucugcaagagcaacaaguacuuuuaaccucugagccaacucucuagcucccaaaggaggaaauuuuaaaauucuucucaauaggcaaagaaucuguaccagaaguucauauucuaaaacauauuguaaauauuaucagaaccuguuaguguccagagucuaguuuagucuggaaaagauuaguuaagauuuucuauuguuccacaaauuagaagcaguaagaugucuuaaguuuguaauaauuaaaaaguaauauagaggguggaaguacaccuuaaggaagagcguugauacaguggcucuaaggcucugggucugacauagcacugaaauaaucauacuuuuauuauaugaaauaaucauacuugguauuuccuuguuuuuaguuuuuaguuuuugguuuguguguuuuuugagacaggguuucucuguguagccuuggcuguccuggaacucacuauguagaccagacuggccuuaaacucaaagaucugccugccuccguagugcugggauuaaaggccugugcugccaucaccugguucugguauuuauuuauuuuuaucugaaaauguacguauggaaugaguaggucauucuccaugccuugcuaacuguagaaguuuaugugacaaaggggacauuuuuauuucaaaugggagaguaaagcccaaaacugacuugugaauuucuuguucaauagacagcaggaaaugacccauacuguuuuguggaguuccaugagcaccgucaugcagcugcagcccuggcugccaugaaugggcggaagauaauggguaagguaagcugucagaguuagagcaggugacuugcgcuggagaacaguuuucuucaucaucuuccuacuucugccucccagguggaacuacuaguguaugccaccacaccccaccuuaugcaguguguggcuuugaacagcacucuacaacaaagcuacauacccaggucuuggaauagaaaguuuuaaauuggauuuuaccguguuucuguuuuagaaccauuauauuuccuuuguagcaaagggucacuuuguauuuguauuaaaaagguaaaauuuggcuggagagauggcuuggcguuaagaacauuggcuauuccagaggaccuggguuugagccuugccaccugcaugguagcucacaauucucuguaccacuggucauaggggcuguaauguuuucuucuugccuuugaggauacugcacacacaugaugcacagauguacauguggcaaagcacccauacauaaauaaauagaaacuguaaaagaggagcucagcacaguggcacauacaguguucuugauucuuuguaaacuucauaucaugugcccuaauccuacucaccgccccaccccuccacaugccuucuacccuuggaaccuuacccccaaaagaaaacaaaacaucaaaaaacauuaagagaaaagaaaucucacuauggaagcuaugguacaucucacggugucguggaagcugugcuaugucacacagugucacccuuuugcccacacagcuuuacuugcaaauguucguuacagugagucauuggucuggucugaggccucuggcuucugcuacacuaucaauacuggauccucacuagguaggacuccucuaggauauccuguuuuagagauccuacaacugugguccuacaggcccagccccuuccuguccuccagcaguucauagaugggauagauguuggaauggaccaacucaaggcccuggucugagccuagugguggcuguguuguucagccugccaacucuccuuuaccaggaccaccagggccagcucuucagcuuggccuggaugaggggcaaggccaaaucuccugcuuauagccaaaagucaggacugacucacauguucaggacuggcucucagggccagcuugcccuucauggccaggugagguauggggccuagccuuuuaaucaaaacagucaggaagcagaagaaggcagauuucuaugaguucaaggccagccaacacuacagagucuagaaugaaugagagaaggaaagaaagaaacaaauuaggcuaaagccucuagaaacuggagaccuauguuaccuccuuuuccccauggugcugugcacaugcuaacuaccagauaguuauggaacuacucaaauuugaaugaaacauaacaguaauauggaaaacuaauggagaggaacccaggggaaaugaguggauaacuuuaaauuguggcucggagugguggugcaugccuuuaauccagcacuagggaagcagaggcagguggaucucuugaguuugaggccagccuggucuauagagggaauuauaggacugcacagagaaacccugucucaaaaacaacaaaaaacgaaaccaaacagaaaaacaaacaaguggugcacaccuuuagucaaagauuggagaggcagaggcagguaggucucagugaguuggaagccagcuugguccacacagugaguuucacgacaguaagagcuacauaaugagaccaugucucaaaaaaauaaaaagacaaaacagaacuaaaagguuaaaaaaaguuauuuguacauuagcagaaauaugcagagauuaggauuugucaaauauaccuaaauuagcuggaccuacauucuuaggcaagagaauugcuaguucaaggcuugccuaggcuauagagugaauugacacuuagccuggcugaguuggugacuuaucuuagaguaauaugcagagaggagcagagccaaaaaugcugcucaguaguagacugcuugcuuguauacuauuugugaggcuuuagguuuaauccccagaccuagccuacuccccccauaaaaagaaaggaugaaaagcauguuggcuauauggagagcucagugaugaagaacacccuugaugcuaauccagagggucuagaugugauucccagcacccacgugauagcucacaaucaucuauaacuucaguuccuggggauccauugcccucuuuacuucucuacagguguguauaucugguagucgguacaaaugugcauagacauaaauuaaggcaaaccaccuauacacauaaauaaaaucuuaaaaaagaacagaaagaucuguacuuacaaguuauaauuugucacacuaggccagaagaagaauguugaaacugugaugagcacagguguccccugcaccaucucucucugcugugucgcaggaaaacgugauuuugagcuuuaucuuuauggaauauauauaugguuuuuuuuaggaagugaaagugaauugggcaacaaccccuagcagucaaaagaaggauacgagcaguaaguacauuugaugcccugugggcguuuguugucuuauaccccauaguucuguuguaaagcauauaacaucauacauguuugcaguaauauuuugaucguuauccugauaugauugaauguguuuguguuaauaaauuuaagaacaaaucuaaucuuugucaucagguaguaccguugucagcacacagcguucacaagguaauuguaucuucuuaaacauaaaaaugaacucuugaaaggguauucacuaaccaccucaaguuuuuuaauuugauauugguuggggggagcggggcggaaauauauaguauuuuuauuuguuucuggcaauauuuuuuccuucuucccauuguugaccaaguguggcuuguccacgacuuuguugcuaguucaagcucucuaucccccuugguagcagcugaugccuuagaaauacuuucaccaccuaaagggcaagauccccuacuucccugaggucaccugggcuucauacccagaucuuccagugcucaaguugcuccugaaacaguguuugcggaagagcaacccaggguguugcuuaaggccugcaaauagggguaacuucucuuuccaaaucuacuuugucaaaguugaugucuguguucauuguaaaguguuccucagcaagguuggcuuuccaaagcuucacguaugggaugguuauuuucucuccaaugcuuucuuaauggugccgauauaaagugaagggauuacuguuuuccuucuguugccuucagucugaguucacuugcacauggauucacauaaacugaaugguguaaugucugggcaaccaaaacuguuggcuuuugagaaaacugucaaauacuuuaacaucaaacuguugcaaugcaagguauuucuuugauuguucuucacaaaauaauggcuaaaccaaguauuucauguagcuagcuucaguaaguugccuuaaauaaggcaaaucuagucuucauaacucucaguacaacuaguuaauuguaauuuauaaagccuagauguaguaauaaaaugaguaacauuaaauaauuacuguuagaauaacuaaguuuuacuuuuuuuuuuuacagaacugaaaguuuuuauguuaguaguuuguuuccuagacccuuauaauuauuguaauaacuguaaauagacagugacuaccagcuucugguagcuaucaguccuuuuagaagacuacuguguuguuaacuuugauuuguuauguuuaagauugauaggauuuuauagcgaggauaguauuuuauuuauaccuaauuauauagucugugcauuauuuuaagaauacuuuauugggucaguugucguauuuaaguucugaaguuguauuuuucuuuucacuccccuccuuccuuuguaagaucauuuccauguguuuguuggugaccucaguccagaaaucacaaccgaagacaucaaagcagcguuugcaccauuuggaagaauuucguaaguagcaaaagauaaauauaacacuuaauuagcagugauuuuuuuuguuuauguaauaauaacuauaacuuuguuaugacugugaaccuuaauuuuaacacuuuaaauauagcauauuccauuguuuagagaucauccaagagucugaaagcaaguacagucccacuaaugaguaauggucuucaguaaccuuaggcccugcucagucagaaacgcuuccucagacugcugucacacacuucagccuccuggaggcgcucagucagaaacgcuuccucagacugcugucacacacuucagccuccuggaggcgcugugcugugauugaaggacuuauucaggcgcuuguaugauuccaugcaguuuauguuaauuuaacaacacaaaaccugaacaguuuagauugaaaaaaacagauguuaaauauuccuuccuuggcauuuaaccccucuucccuuuuaaaaacguaacaguaguguuuuguacuauauuauaaaauacugucgccauuaaauuugcuaguauccaugcacuuuaggcccuuugucaguauuuauucagggugguaguuaccauaggagagcuuuaucacaguaagaguaauaagccauuucaguacugacucaggaucaguugcugaguguagggaaaguauugaaggguuucuaauuccuuuguuauugugucacuagaacaaaaaccaaaaggaauucuaucucuagcugguuugaacagagcagcagguaaaggugaggggauugagaaguagacacccugagcauugugugaguuuucaguggagaguugcaguuggcuggugggagaacuacugugaggguagggcagcuuacagauggacucugcuguuacaugacauuuuccuuugagagaacuggcuaagaaaauagugaggcuuuaauuucuugauuguuuuuuauaaccugcguuaggauuucacuagugguugguuucuuucaaguaucuagacuaggcacgucugacuaacuuugccucucaagcucugaggguuccgcuuugcagaaucuuguguguuuucaguuugguguagagaaucuuggucaguuucauccugucuucagugacagaagacacaaguucugaucugugugcugcuuucugugugagucauuuuagaaagaaguaagcaucgacugauaccucagggcagacacuuccaauuccaaggcauuggaaagaaaacaacuccuucugauauugugaaccaauaaaguaacuacucugguggauuuuuaauuuuuauugaauuaaccuuuucuaauagacuuuuagauuaagauuuagauaaggaguguuuaauagugauugaagggcuacuagagugguucagcagauaaggugcugcuaccaaaccagaugaccugaguucaguccccaaauugcaugugguaggagagaauuaacuccuaaaaauuguccucuggggcuggagagauggcucagcgguuaagagcacugauugcucuuccagagauucugaguucaaaucccagcaaccacaugguggcucacaaccaucuguaaugggaucugaugcccucugcugggugucugaaaacagcuacaguguacuccuuuacauaaauaaaucuuuuauaaaaaaaaaaaaaagaaagaaaaaaaauuguccucugaccuacacacacacacacacuaaauguuuuauaaaaaaaaaaaaaaaaaaaagccagaggugguggcauacaucuuuaaucccaucacuuaggaggcagaggcagauggaucucuugaguuugaggccagccugaucuacagagugaguuccaggguagccagggcuccacagaauaaauucugucucaauaaaauaaaauaaaaauaaagaauguaauuccuuagcaaauagucuuagaaagggccuccgucaguaagguuagaacagaagggcuuagaaagcucacaggggcaggggcucacaccugugaacccagcagguaagagaaauagguaaaaucaaaugacauucagacuuagcaguuccaugucuuuuaguuauaaacuagucuucuuguuacuauaacuacaucauauuuuagucuaguuucuuuuacauguuuguguauguguuuuuuauaugugugaguguaugugugcuccucuuagacaagagauugauaucaaauauuuucauccguuacuuuccagcuaauaaacugaggcagaguucucacuagaaccuagagcuuaccaguucuacuagucuugccggcuuacccugaguacccccugccucugccccccaugcauacuuacugucccggcauuuaugugggugcuggagaucugaacuuagguccuuucacuuugcaugauagcacgcucucugcugagcgugucccuagccccagcauuuggguuuucuuauagguucacaguuguuagcauauuaauucuuuucuugauaaaaccuuuucguugaguuaauauguguuugaauguuagcuuauauugguaguuagcuuuccuaaauguaaaagaacuauuuggcaauugguaacacauaacauguuucuauuuuuguuugugugguuguuucuugucuuaaggagacaggcugauagcaguguugaaagguuucuacaguagaugucucuauaggugguuuacaccaugcuuaauuuauagaaggugugggguaaaugugaucuauuaaauauuuaauaugaaaauaaaaauauuuucccuaauugauauagcuuaaacccuuucuguuucuugaguucagggucauauagaaauuuuugauacaggaauaaaucaacuaccaaauuaaaugcauguguuccauguagguaauaguuacugagaagugacuuauaguagcuuuaccuaaucaucagaaucuuuuugauuacacuuaauaaaucacuucuaaacugaucuaaaauaugcuuguguauacuuacaauuaccuugcauggcuuucugacguggguucguguuguaaacaugccuguuuuguucauaugucuugagagaacaagcauugugacauauacuagguugauuuaaaguagauugccugugaaacacaguuugaguccaguuuuuuuuuuugagguauggaguuuuagcuaucguggcuggguuuuuacucaaucucaaauaauagggcucugguuauuuugcagagugucucugaagaauggacagaauugcccuggcuaacuacaagcuacgguucacaguggauaaauguuggcgugcuuuuuuacuuucugacuuuuuaaaacuuuguuucauaucuuguaguuuccaaucaaucuuaauauaaaugcuguuaagaaauucaguauaaaaucuuaguuuaaaaguaaaauguguuuguguauccuucgaugauuuagcauuucuaaaaaugucaaguucucaaaauuuacccuagcccagaauguggguguauauucaucugagaaaaugaaguaauuagccuagggaauauauacagcuuuuuaauccuuuaguuuucaauuuuguauuuuaauuuuuuuaaaugacuauguaacauauggugccaauuaguaaauaaauugcaugguuaaagaaagccaaaguagcuaagaacuuuguaauugcuaagugcuucauaggaacaucugcuuucaccaugcuuaauauugagauguucauaaaacauuuugaaauggaaaacucucuuuauacuauagauuuauauuuaagacauugauuugcaugucuauaaaauuaacccucauuagccaauaaauacguuuauuagaauaaaaggugaacuuuuauuaacgguuuacuguuagugaaggugaaauguaaaagugaauuguauuuggcucucauuuuaugccuagaggaugguuuacaaaacucaauuucugguggcuucuguuucagagaugcccgugugguaaaagacauggcuaccgggaagucuaagggauauggcuuugucuccuuuuucaacaaaugggugagcacaaucauaagugcauauccaggaccauagaggagggugaaggaaagcgucagcuuguuaucugcuaguguucaguucacuaagaguaagcaccuucacuagaaaacagccuguucuauucugguugguucuuuagucauuuagcaccaacacaugcaaaaugcugauacuguauuucaaacugugcaaaguaaaaaugcuuaucaccaaaaagaaaaaaggaaaaaaaaagcccccaaaauguuuugucaagauaucugaccauuuguaauugcucaguuguaccccaaacugugagguauauauacugcugcaccuacguauccuuacccuuuguagcauucuccaaaccuauuauccaggaaaugaaauuuaaaagcaauguugcaauuuuggaaagcuacuagguauuguguguucccuaaggacuuuuucauuuuuuaacaucuucaaaaagcaucauguuuucuuuauguaagcuguuuguaauguuaacuaaucggagcuuuuuuguugucucugauauguggaacaggaugcagaaaaugccauucagcagauggguggccaguggcuugguggaagacaaaucagaacuaacugggcaacccgaaagccuccagcuccaaagaguacauaugaguguaggugcauuggagaagagaagcaaagguggcauuguggagagaaaauacacuagauuguaaauguuagcgcuguccccggagacuuauugcagaaauagaugagaagcagaucaagacuacuguucaaaauguacuuaguuuucauucuugugauuuuaaguaauuaucuuuaaugucaagucuccuguuaaguagagcauauauaugggguaauguuuaugcauuuuguggugguggcuuaaucuuaaaauaaaauguaauguguuuuauagguauuuugauugagaaaaacugccauuguaguaguguaguuaaugaguuaauccuuccacauaugggugaugauuugaagauagaaaauguucucucuccucagcgaacaccaaacagcugucauaugaugagguugugagucagucuagucccaacaacugcacuguguacuguggaggggugacgucaggacugacagguaugggaguuugccuggguggcaccuugaaacuagcuuaaacugaaaagcuucauauuuauagguuuuaauagugcgaauucuuuuuauguucuuuguuuuuguuuucuaacagaacaacuaaugcgucagacuuuuucuccauuuggacaaauaauggaaauucgagucuucccagauaaaggauacucauuuguucgguaaggguagucucuuuuaaagcuuuuuuucuucagaaauaauuuugaacauuuaauauagugguuuucuuaagaauuugucuugaucacuugagaccccagcucaggugucuauaccugguaauacuaaaaucuugagagagagagaaaugucuuuagcagauagccauguacucauuuuuacuauucacuuuuuuauagacagcaucucacugcugcccaggcuggccuugaacucacagagcuccacuugccucugccuugaacucacagagcuccacuugccucugccuuuuaaacucacagagcuccaccugccucugccuuccaagugcuguauuuacaagcuacuuacugguacauuuuuauaagucccucuuuccaacucaacaccaagaaaacauacgcauuguuaaaacaaauuucccaugccagguguggcgguacggaucuguagucacaguacuuagaaugaguacuuagguucauggucacccuuggcuucauuagagaauucagcuuggccuacaugagacccugucuuuuuauuuaaaaaaaaaaaaaagaagaagaagaaagaaagaaaaaucuccaaucuccacagcuguaaggucuuugaaaaaaaauauagcaaaggaaauaugccacuuuugggggggggguagguugggauuauuucagaauccucuauuucuuccauguuugcuuugcuuuuuuuucucccaaaaugguccaguuuauuuuucuugauuuuaaaaauuguguucauaaauacuuaaaagagaauuuauauugaaaauucuuaauauuguuuccaauagguucaguucccaugaaagugcagcacaugcgauuguuucuguuaaugguacuaccauugaagggcauguggugaaauguuauuggggcaaagagacucuugauaugauaaacccugugcaacaggugagaggguccuugacugugggauggaauuacugggcuaguauugagcuugcuuuaaaaugaugcuuauugcuaauccuuguuaacaaguuucuagcucaacuucaacuucuauaaggguucuuccuauguguauuauaguuccgaguggugcagucauggauugcagaggugacaugaugaguguaagcacuucaguugacucauguucacaaaguggauuuuuaaaaugcucggccaaaccuaacaggguauuaaaucuuuucuuaauacuuaguaaauauguccacauugauauggaaaacccguaagcaugcuuaacccgacugaacaaaacauaaagcuauaaauauauguaggcauuaguauuguugcuuuguuuucuaagcaacuuuaaugguccaagcucagccccagagucuucuaugagggcauuguaaauggagcauaaagauaccaaugagaaaacccuaaacuuacauuuccuuuucuuuuuuaauguuuauuuauuuauuauauguaaguacacuguagcugccuucagacacaccagaagagggcaucagaucucauuacagaugguugugagccaccaugugguugcugggauuugaacucagugcucuuaaccucugagccaucucuggagccccugagcucuuacauuuccaauccaaaggaaacaaucauaaacaguuaugaacagcaaguccaaucuuuaucaugaguuuuugucugagccuuucaaagacugcaccacauaguuacaguagcauauguacauacauaauggcacuuuuuugguggucuuucucugugugaugcugggcacucguucuagcacugagcuguguuccccaguccuauccuaauauuucaguugugguaauggcccuaugcuuugacugugugguguauuaagacuguauauaaaaagaacuucaaguaauacucaauuaucuguuguaauuuuaauugauagcaaaaucaaauuggauauccaccaacauauggccaguggggccagugguauggaaaugcacaacagauuggccaguaugugccuaacgguuggcaaguaccugccuauggaguguauggccagccauggagccagcagggguucaaguaagcauauucgcgcuuugccuuucuuaaccguggaaaacaguaaaaggaaacuugcagguauugaguaaaccaugugaccucagcguuaaguguggugauagccuugaagguuuaccccuggccuccauaucuucuauugugcuuguacaucuuugccccaguacacgcacacacacaugcaaacaaaauaagauauuuuuccuagaaauauuuugccuugaaauguaaucacaacacuauauauuuugguaaauguuuaauaaugaauuaacauuuuuaaauuauaucuuauuuauuuguguggcacauacaccacuacauauucauagugaccaggggaaaacuugggaguucucuccuucacuguaugagucguggggaucaagcuuagguuguuaggcuuaguggcagccuugacccagugaaccauuuuacccggucccuauuuuuguuuucugaggcagagaagcccaugcuggcuuugaacuugauauaaaacuggggaugaccuugaacucuuaauccuccugcuucuacuucccaauuauagggguucgauaccacaucgaacuuaaaucaacuuucuagugaaaauagcugcuuaucuugaauacacaaguguuuaaaaggugugguucuuugucugugaguuucuugccugcauauauguuuaccgcccuggucccuugcagugaucaggagagggcaucagaucccauggaucuggaguuagagguagucguaagccaccaugugguuacugagaaaugagccuggucuucuagagcaacaaaugccccuagccccugaaccaguucuugcagccccugaauauacauuguucacccauggagaaagacucucccuccaugucugugaguuguggcaguccagagaugccccuuucucucugggugucugcucuucuggaaugaaggcugcucuaggagcuuuccucuccgcuccccugugccguguagucuauugcauaagcucagucugugugcaauguuaugucugucugcccacugaccagguuccaguuuaugaaaggcauuugagcagcaagauugaguccucauucucaaaguaaccagugucucacagguaacauuugucagaacugaucacgugaugauauagaacucuagcuuuucccuccuguguuucugguguuugccagugcagcccugaccaugcucacaugucccugcguguucuucaggucuuccuugugaacagaugaaauaaaggaucaaaacaaguauuuagaugcauucauugugcauauauaacuguauauguacauauacauauuuauauguacuuggaaguacuuggaaggcacaggccagagcaucucuaauuuggaggccaaccugaucuacauuucaggcucaggauacguggaccuuuucuuuaaagagagagagagagagagagagagagagagagagagagagagagagagagagagagagagagagaagaaagaaagaaaaacauugugugucagauuaaagauauuuuuuuaauuuauuuuuuuuguuagauauuuucuucauuuacauuucaaaugcuauccugaaaguccccuauacccuccccccgcccuaaagauauuuuuuaaagagcugagaggaugguuaaguaguuaagaucacuugcuguuccugcagaggaccaggcuacaguucucaacacccacaugauggcucacagccaucuguaauuugaguuccaagacauccaaaacccuuuucugcccucagucagcaccagguaugcagugcacauacuuacauacaugcagguaaacucaaaacacauaaaaauaaaacauaaauaaaaacaguaaaaguaaacccuuaagaaacauucuuuuuagccgggcgugguggugcacgccuuuaaucccagcacucgggaggcagaggcaggcggauuucugaguucgaggccagccuggucuacaaagugaguuccaggacagccaggucuacacagagaaacccugucucgaaaaaauccaaaaagaauaaaaaguauuuucuuagcuguaauuucuaguaaaaaaaaaaaauguagaaacccacccagagguguguggugaugcuuuucuucccacugugccguccugacuccagcucuguagaccaggcuggccucccagccugaacucagaaaccugccugcuaugccucccaagugcuguuguuacaggcauaugccaacacuccugacggaggauccuuauuuuuaagagaaaauacuuuuguggguuuuuuccccuggcuuaacaguuuuccucauaucuggguucagucagguauguccuguguauguguuacccguccugaccugacaaugucuugacaauggauucccuucccucugcuucucucgauuucucuaacagucagacccagucuucugcaccguggaugggacccaauuacagugugccaccaccucaagggcagaauggcagcauguugccuagucagccugcuggguaucgaguggccggguaugaaacccagugaaaacagacuacagaacggaagccaguggcuugaagccacagggaggguaggaaaacuguuguuuacguaaagauuuaucaaaucagucaguacaaaugccagauacaauguauuuauuuaaaagauucauuuuuuuaaucaugaaauuacuuuucauccacauuguuuuaaaaaggaacacgaugguggauguuugccaauuuuugccuucauuaucuuuuuugauaaaguuucucagauccuuguuucaaagacaaaugcagggauuacugccacuuuuuuaaaaauaagaggcagaaaauugcacaauguugaacuuuucuccacuaaaaucgugugcaguuuuaguuugcauuccugauaggauuuaaaacauguaauauagauguaaaaaaaaaaaaaaaaagccaaacuugugcaaagucuagaaguucucuaugacuuucaguaugcacacaguugucuuagguuuaaagaguaauagacguuucgugaacuauaccaucuccacuauuaucccuuuggaauuuuuaaauguaaauuauuaguuuauaucauuuuauauccacauuuuuucacaaauuuguccugccuuaugaaauaucuguaaaauauucuuaaaugaaaaaaaaugauguucacuuagauugaaaacuuuucucagauggaccgauaauugcauucaucuuguuuuuauaagagaaggugccucaaggauucccuguuggauuuguuuaaaaggacuuuuuaucuucugugauaaccuuugccauguaccaggaacuaggaaaacaagaaacuuguucuaaagagaucugcaaugugauaaguccucgccgcaucagucucgugcgucagcauuuauguuuacacgcauuguugucuaagauacuucagcaagucauguugugcaguuagcaaacuuuguaugucauuuccuccuacaggugucaugaagaguugacguaagacagauuuuacauuugcaugugaauaucacauacauacuuugguagucuuugauacaaacucaucugcucuucuuuuucaagcauuuugagacacaaaguuguauguaaaggaauauauuaauuagauuuuuuuuaguuagauuuacuuuaaaaaguaaauccacuuuaauguguacaaaugauagcugugaaacuguagaguuuuucucugucaggcuugggauucacuaagaacuccaaaacuagccugaaggaccagccgggcaaaacauuuuuuaaauauucagaggccaaaauaugagcaaacaaauaaaaaaacucuuaaaaguccuaccuccuuaaacagccuucaaggcaaagccccugcgcacaggcauggcuuuggucuuggucccuggucucuuggagcccccauaguacuauugagguuuacucuucacuggcguuguucuagccuugggguuccuaauauauuucagagucucuugguuuggugugguuuuagugaugaccacaccuucuccucacaguagagaggaaggagcccugugcacuguggguuugaggccugcagagagcucccagcauuuuacuugggccuauggaauuggaagcauuuccuggccuguaucuuucagguaggagcacacaacucuaaccuguuuucuaagccaguccccuuguacaacagagcccaggaagacagucucaaaugugugcuucucuggagcucaauucuaugcaguugugcuaauguuucauuaagucacuguguauuuuuaaguacuaaaacauugaaauuugcuuuauggaagaugaauaaauuuuuuaaauacuuggaauuuuauuucuuuguaaacuucuacagaucaggacagacaauaaaagcagcuuaaauaaaauacuaaaaacaaaaagacaaaacccacacaccaggaugcuaucuuuaaguuuuucuggauuugucucuauuuuagcauccuuaguauaugucuuuguuuaagaauuuuacuuccuuuguaacuuuaggcugcaggaucuuuugggcacaaguaauuuauugugugcaaaaguguaguuucucucuucuuuugacucuuucaaguacuaaggacuuuuauuaguagcauauucuuauugcacagaucuuaaaauucauguugauuugcuguuaagaaggugguggugcuguguuccugaugaaagacugacauaucaggaacauagcuguuguuaguuuaaauaaaucauuuaagucauuucucaaccuaaaaaacuucauccugguauaaguaucagguaaggaaaugaagguuuuuaaagugaacuuccuugcaauaugcauucagguuuuauucucugguacuguaaagaaccugagugacucucagugggucauggagccaguauucuuuauccugacuguuuggauauuaaaauuccuuuauguuuuauaugaccuguggggucuucuugcagugauuauugugugugagauuuuucccccggcgcuggcguauucauauuauauuguuaacacucagguucaccuuaucccagaagccauggucugcauggguuccagaggaucugcacucugcagacuuagccaacugugaagucagaguuuggucuuccugguguaaaggagacuccccgucuagauuguccuucucuugcuuuucccugugcucaucuuccuuuuagauuugugcuagaggucccuuucauugucaggggacuagauuacaucuacagaaggaguagacagacuuaauaagggcuauccaugcuacugagaugauaguuuaguuagacaaacaaaauauauucauaggaaaauuucaaaagcaaaacuuuuuaaugagugaugauuucuaaaaacuaauuuuuauuggucuagugaccugguuuagcagguaaggugauuguugccaagccugaugcccugaguuugaacauacuagggagaaguagagaauuaauucucacaaguuauccucgucccuccacauguguacacccucccaccauggccacguauaucaauaaaucuuuaaaacugccauuucuuaaaguucuuuuuuauuauaugcauuacauaugugugugcuugggggugcaggugcucacggaugccagaagaaaggguguugaauuccuggagcuggagcucugggugcuugaaagcuacuugacauuugugcuaugaauugaacuauucaaaaacaguauaugcucuuaaccgcugagccuucuuucuaaccucucuuuucugcuuuuuguucauuuuguuuugagacggggucucacuauauagcccuggcuugcuuggcacucagagcucugccuuccucugcuuccgagugcuggaauuaaaggccuguccuagugugaggagacaccaugaccaaggcaauuuuacaacagaaaacauuuuauuggagcuugcuuacagaagguuaaguucugcaaacaauguggcaguuaguuguguugcuggagcaguagcugagagggagagggccuagcauggacuuuugaaccucagagccugcccccagagucacaacuccaacaaggccacaccuauuucuuccuaaacaguccaccaauaaauccaaacagccaggugugugcaccugugagggccagucucauucagccuggcacagagagcuauuccaucuuauucuguuugcuguagucugacuggaauuuuuaggguuucaaaaaaaaaaucauccaaaaacuugaguuuucaguuuuaauaaaauguagguguuagccgggcaugguggcgcacgccuuuaaucccagcacucgggaggcagaggcagguggauuucugaguucaaggccugccuggucuacaaagugaguuccaggacagccagggcuacacggagaaacccugucucgaaaaccgccccccccccaaaaaaaaauuauagguguugcagcugagcaggauuuucuuccuuuacuugggaccuuagucauugacuuaugguaagggaggucugcuuaucauccagggaugcuaguaagagcauguagucacaguauucaggaacuugagguaggaggauggccaugagcccuagaccuggccuccacgagcaccugcacauacauacacguaacuucauagacauacacguaacuaaacuuuuguuucuuuguuguuguuguuguuagguuuuuauuauauguuuauggaguugauacauuucuuuuaggggcuggagagauaacucgguggucaagaguacuggcuucucuuccaagguucaauuccuagcauccauauggugacucacuaccaucuauaacuccuguuucagggaauucaacaccuuuuugaacucugaagagcaugcacaugguguguagacauacaugcaggucaaacacccauacacaugaaaaugugugggugagcgagaaagaaauggguauaagaagcuaggcaagauguuauacaccuguaaucccagcagcacucaagaagcugaggcaggagaaucaaaacauuugauugagucucugcagauuuuuuuaaaaagugguuuugacuuagaagcuauagcgacauuguucuacuugcacuguacuuccuguauacuguucauagagagcaucuuuccguggguuucucacaaagcagagaagugucccuucagccuccacauaaaucuccaugucccggcuucuguaguucugaggaucaaaggcacccugugucaacugagcugcaucccagcccauauagcauguauuuguugggcuuucuccagggacccucuagggugcuugugcuguguugccauacauuuauuaguguaucuuuguacaagugcucuucauugcugucuguuuacuccuacuuggaaguuaccuuagcuugaccaaguacuagcaggaguaugaacgggaggugcugccauagcucugggcauuaaaccuuacuggggaugcaagggaaugaagaaaagacaaacauagaugcacagaaaagcugcuuguccugugggauggacuuauaaauuaacaccagcuccccagaaacucgggguguuuauuauaugcaagugggcagaaaggcauggcuuauggguuacaggggugacaaggagacagguuuagcucauacugguaggaagagucucuauagggaacaguucaagggguaaauaccaggggaaagagcuaugguguacauuucucugugcaccaagccucagguccccaagaaagcuuugucauccuugaaccucauguggauuggggagacagcuuugccauuuuuuccaugggauuaugccuggggcccuugacauuaccgugucagcagcucacacauucagggcuccagccacuuccuucaaaggagggaucuucuccagauuucauacuucuuuccuuuugggcuaugauaaugaauucuugauuucuuuuguucuguuuuguuuuguguuuuugagacagggucucucucuauaguccuagcuguccuggaacuuacucuguagaccauguuugccucaaacucaaggaucugccucucucugcuuccccaaguguuggaauuaaaggaguguaccaccacccccggcuuucaauaaugaagucuuaaagaagcugggugaggauagggauauggagaggugggucagcaauuaagagcacuugcugguuuuggagaggacuuggauuugguucccagcacccacauaggaguauacauaugcaaacuguucucugcuguuccaggggcucuggugaccuaugcaggcccaacaaucauauaaaauaagugauccuaaacccaaaggggcugaggucacccccuagcagugugaucaggaggcuagcccuggguccgcauaggcucaggccuacuuggaaaggguucugagcuccccuugcucccucaucugcuacacaaaggaauccaacuccuguccuccaguuuguuucuuacaacgugugucuggaugcgugggacugacaccacacugcucucuggucuugcagcccucacauaagguuugggcuauauuuaccuuuuucaaauggcacauaggagaucacugaaacuacagcaagccuuacagugucugucaagucauaguuuagguuuauccuagaaucccaucuccauucuucugcaaacccuucagugccacacugacuuguuucuaaaugaacaauuauuaggguggagacagaucaaagguugauauuggggcuggagugguagcucagcuguuaaagaacuugcuuccaagcacccaagugguagcucacaaccaucuguaauuccaguuccagaggaucagauguacucucuguccuccaccagcaccagguauguacaugcaggcauaauaccuauaugcaguuuugaaaauuguucaauuuuuaagggaaaugacaaaagauuaaacuaauacagguuggaacaaaguaaacacuggcuacuacuaguagguugacaggagucaaagaaguccagugugcagaaagcaacuacuauguguagucagagcagggagagaaggaaaaaggguaaggaaaacaaacuugaaaucacagcugaacuccugauccuuagaaggagccagguccuagaggaacaggaauaugcaggccugugaggaaacacuugaggaggagguccacuaacuagcgggcagcuggcguugccugauaccacugggacauacaaugcaaugaauggcuuaacuuaauauccuguuuuuuguuguuguuguuuuuuguuuuuauucgagacaggguuucucuguauaguccuggcuguccuggaacucacuuuguagaccaggcuggccuugaacucagaaauccgccugccucugccucccaagugcugugauuaaaggcgugugccaccacggcccggcuuuuuguuuuguuuuguuuguuuuuaucugcuuuuuuuguuuuguuuuguuuuuuguuuuuuuuuaaaugucaguugaaaauugcagccugggagagcuuggugugaggacacccaaguuggcugguucugaagacagggaggugaggaucacaaggucuuucaugaaccacugcacacuuaaugagaaaggagagaaacagcauccagaaagauguugucugcaugucucucuauuggagggcuugacauugaacuauagaacaaaggagaaacacuucccaaugccaggcaaagaaaugaggguugaugcucucuggucaccacuugaggcaguugcuaggaacuaacuagccaugugauccagguauaaauaugaaugcuuuugaacuuaacagcaaauaaaaauuguggcgagaggaaacaucucuuuuuuuaguuccuucaguuucugaaacaauauuagaaaaaucugaucccagaaaagggccacuguaacggagaaaaguaaaauuuggcuagagcaaagcaauugugccuacagcgcaccaccaguagguguccaagcuaugggaacacaccggccucaccuaaggcaccauagcuuuccgaguguuucugaagugcggugguggcacaugucuuuaaucccaacacauuggagggaagaggcccgcggaucuauguucgagaccagccugaucuacagaaagaguuccaggaaacacaauauuggugccggggauuuacgauucugaagaacaaauauacauaaagucuauuucggcucuuuccaaggggggagucguucaauaauguguaagagcgaagcgagagaaaaccauacaagcucaggcgagcucugcuuccgauuccaguaaaacuguuuucagcacagaauuguucagguucgauguacuagggaccaccgggaagcccuugcugguguguucuguacguuuagguaaagccacaaagugucagcacccugagccuucucuguaguuuuccaaaagagagcacuccccugaaauacuacaaaucccauggugccacuucagcggaggugagcgggcccuuggcgcacgugggcugaucugaccaauaacgaccgucguuacaagcaaacaguuuggacguguuuguaaaaguccguuuguaaaaggagaagagacgcggcgagggucgucaccaacgagauuccuagaguugcgaggcagguaagggggcaaagugggagaggccaagcaccggcggagcacggcuuagggugggaacagaggcggaaaaaguguucggggaacugcgugucggacugcugacauuuuugcugggcccucaguuugacgccgccggaagugggcguuuugcgcaggaugccgggaagcgggucgcaugggaagugcguuuuccagccggccguucccggaagcugagcuuaggcgcgcuccccuaaacaacaccgaggaauuguggcccggacucuguuauuugacagugaccgggcugauucuacaaucaguaaaggucugcgagcugugacgucucgauccaaccagacaguuuuauuccuaaaauggguaaauagcgccuccacaggaucccuugugugaaugcaugcacucgaauacuucuuucuuacuuggggcgguguucacgugcccaaaacagcguccccacaccgaccagcucagcggccgcaugggacagggggcagccuaccgcgccucggguucccucagccagcgccaggcgcugcucacccucuugcugagaagagacaaucaucgggagacccuucagguuuccagcggagcuccuucacaagucgcguuccuuguguauccuuuuuuaagacagagucugcaagccgggcgugguggcgcagccugucaucccagcacucgggaggcgaaggcaagaagaucucaaauuccaggacagcuaggcuacauaacagaccuugucucaaaaagaaaagaacaaacuggguauggugacgagcuccuuuaauaccagaacucuacaggcagagacuggcgagucucugaguucgaggcuuccccgguccaucccaggacagccagagcgauacaaagaaauccugcccccuaccucccgccccaccacaccccaaaaaaggaaaauaagaaaaaaacucuguaauaauucguagugauacauguuuucaaauucgaauaguaaaaaaaaugagauuaaaccuccauuucucgggucucaaauuacugcugaggaaauagacaacuaugcuguguccuuaaagucuuuucuaaaaaaagauuuuuguguaugcauguguguauauccagugugucaaaggaguuggacuucccagaauuaagaguuuuaggcagaugagcccugauguuacugcuuggaaccaaacuugggcccucuaaaagagcaauacacacuuuuaaccacuagccaucucugcagccccauuuuccccuuuccuuuccuuucaaaaccaagcauagcauacacaaagcacuaagcuuuguuacugguauacagaucucaacuguuuuuaauggcuuuacagucgcaucuuacucagcacacuguacuuaguucuuuaauggaaguccuuuuccuauucugcagguacaaaaucucauagagggauaucugugauuuggaugccagccugguccacauauugaguacagccagguguacauaguaagacccuaucuucaaaaaagaggugggagcuggaaagaccacccaguaguuaagaauacauacugcucuugcagaggaucugaguugaguccccggcacccaugucuaguagcucacaagcaccuguaacuacaguuccagacauaugcagugcagccuguuggcuauggcugccuguacucauaugcacauagccugacacaggaaauagguuucagccccuuuggaaacaguuuuucagguuccgaaaauguuaaguguacaaaggaaauagcuauguuuacuaugauauuuacauuuauugaaauauauggcucaacacugugguccauacauguagcccuaucacuuaggaggcugagauaaaaggauuaucuagaguuuaaggcccgccucagguacauaauaaguuucaggucacagaguaaaaccuuaucuuaagaauaaauaaaagaaauaguagccgagcgugguggcgcacgccuuugaucccagcacucgggaagcagaggcagauggauuucugaguucaaggccagccugaucuacaaagugaguuccaggacagccaggacuauacagagaaacccugucucgaaaaaccaaaaagagagagagagagagagaaggaaagaaagaguacaugggucucaguauauauauggggggggggguggucuuacuggggaucaagucaggggucuucuccagacugagccaguguuagaacucggcuguacugccuucaacccugugcaaguuuaugggaagacauuuuucuauacaaauacuugucccagugaucugagcucuguguauuguagccagaaacuugggacuaaacuaauauucuguggcugauaaguggacaaacaagacaugacuuaccuauacauugaaauacugaauuuaaaaaaaaaaaaaaaaagacuuuacagggauuagagaaguggcccaacaguuaaaagugcuugcuucucuucagaguuccguucccagcacucugggaugucauuaucaggcagcuuuucaacugccugugacuccagcuuugaaggaucuuacacccucucuggccuccacaggcauuugcauucacgugugcauauacaggcagauacacaacuaaaaauaaaucuuaggaaacauuuuaaggaacuggguguagaggcuuuuaucuuuaauaauuaagcuaaucccagcacucaggaggcaucucuuuagaugccagucuaaucuacauaggccagucuggucuacauagugaauuucaggccagucaggauuccuuggugagacuuuguuccagaaacaaaaccaaaauacuauguguuuuauuuauaagcuaguacaaauauucauguauauguguauuuggaaauuuguuucuccguuguguauuauacauucuaacuuacaucuaaauauuuuuucaagaauuacaagcaaauugccuuuuccaccacuuagugaaaaagcauuaagaggcagagaagaugguucuuaaguaaaguuccagccuuacaagcacgagggccuaaguucugauccucagaagccauauacacagccaggcacagagacgaacccuguaauccaagcgcuuaaggggcccuaggcuuugcuuuccaaccacucaagacaaaucagugaaagacccugucucaaaaacugagguggaaagcaagaaagauagcucaguguaaagagcauuuuguucucgaggaggaccaggguacauuucccaggacccacacagugacucacaaccaucuggaacuucacaggcacuacacauagguauagcgcgcacacgcgcgcacacacacacacacacacacacacacacgcgugcaagcaaagcauucauauacauaaaccuuaaaaaagugaagcaguugugguggcacaggucuuuaaucccagcgcucaggaaacaaagacaggcaaaucugggagcuguuccaggacagccagacaaacagagcuacaaagacccuguuuccaaaaaaagaaagaaaacauaugaagcaauugaggacacccacugucagcuucuggacuccuuacuugggacugcacacacacauuuacauauaacacagaaguauugagucaaguguaggggguggagagauggcucagcaguuaagaacacugauugcucuuccagagguccugaguucaauucuuagugaccacaugguggcucacaaccaucuaaaauaggaucugaugccuucuugugugucugaagagagcuacaguguucucauaaaaauuaaauauuuuaauuuuuuuuuuuuuuugguuugguuuuuucgagacaggguuucucuguauagcccuggcuguccugaaacucacuuuguagaccaggcuggccucgaacucagaaauccgccugccucugccucccaagugcugggauuaaaggcgugcgccaccaccgcccggcaauauuuuaauuuaauuuaguguagaaguacaugccugaacccaggccagccagggcugcauagcaagauucugucucaaaaaauaaaaaaaggccaggcaguggaggcacacgccuuuaaucccagcacuugggaggcagaggcagguggauuucugaggccagccuggucuacagagugaguuccaggacagccaggacuacacagagaaacccugucucaaaaaaaaaauuauauauauauauaguguuaaaaacauugaacuuaagaggcugaggaaguaaugagaacaguacuugcugaguacucucagggcucuggauuugcuaccacgguacuguauaaacuguauaaacugagugugaugcugcauaccugugaucccaguaguuggaagugaacgcuagaggaucagaggugcagagucaucauaggcuguacagggagauugagaccagccugagauuaugguagcacauaccuuauaauccugccacucaaacauuggaggcagaaagaugaggcguucaggucaucuuaggcuacauagaugucaagguggagugguuaagagucagaggacccagguuugguucccagcacuuccacggugccucaccacacagacauccauaacgccaguucuaggggaucuggugcugucuucugacuuccaugggcaccagaggugcaauuggugcacagcuauagacgaaagccaaauaacgacucauauacguaaaaaugaaagcugggagguagugacucggaccuguaaucccagugcuugagagacagaggcaggaggaucucugugaguucaagggaagccugguccacagagugaguuccagaacagccagggcuacacagagaaacacugacucaaaaaauaaguuuuucaaugcaaaaauaauaaaauauaaggcacuaaaaacauuauguuuuaccauuagguaaagggaaugggaccaguucuauacuguggcuucuguuucgucaaccuugugcaguggcaugacuguuacuuuacuacuuucuuguugaaagucuaaaugugaaauuuccacagcaauaucugacagcuauuucucaaaugucagaauuucagacauagaccccauggggccuuugcgugcauugauguucuggcacuguagacuggccccggggacuucccauggacuaagcagucgucagcuaaugagcuagcccaguuccuacucugccuguuucuaaguagaaagauccaucuuugccauaugacaacuguccucuuguuuugcuauaggcugccaagagcucuaccuagaggaguuggaaucuggaacccugagcaagagcuuugcuagaaggggauggaaugucugcaauguuacaucagaacucagccuucagaggacuuaggccaaguggcacaccucacugcaaaugagcaugccuggguuugugcugucugaucaucacaagcuaaugaaccgcguuaggucucacagacacagcuuccacuguucuccgggugccuuggcagcugguacagguaggacugggaaggacugggcugugcuucaagggaccaguagaagugaaguaacccaucuuuccugugcucugguccuuucugagacagguucucauguagcccagguuggccuuugauugccuucguagcugggacugacacugaauucauaauccuccugcccugccuccugagugcugggauuacaggcaugugccaccaucuccaguuuaugugcugcugaggcaucauuauagucccaacaauuaggagccuaaggcaggaggcucugugagaguugaaggcuagccugggcuacugucuuaauuaggguuacuguugcuaugacaaaauacaggaccacaaagcaaguugaggauaaaaugguuugcuugacuuacacauccagaucacuguucauuuuuggaggaagucaggacagaaacucaaacagagcaggaaccuggagccaggagcugauacagaggucauagagggaugcugcuuaccagccugcucagccugcucucuuauaaaacccuggacugucaucccagggauggcaucagcuggaauggucugggcccucccccaccaaucacuaauuaagaaaaugccuuauagccauaucuuaggguuguauugcugugaagagguacccugaccauggcaagucuuauaaaggacaacauuucauuggcuggcuuacaguuucagagguuuaauccauuaucaccauggugggaagcauggcagcaugcaggcaggcauggugcuggaggagcugagaguucuacaucuugaucugcaggcagccagaaaaagaccuacucaacacuagguguagcuucagcauauauauugacauaaaacuggccagggcagcuacacagcuugcucucucucucucucuccucucucucucucuccuuucucucucucucuccucucucucuccuuucucucucucucuccucucucucuucucucuccucucucucucucuguccucuccuuucucucucucuguccucucucucuccuuucucuaucucucucugucucucuccucucucucugucucucucucuucucucucuccucucucucucucuguccucuccuuucucucucucucuguccucucucucuccuuucucuaucucucucuguccucuccuuucucucucucucuguccucucucucuccuuucucuaucucucucugucucucuccucucucucucucucucucuucucucucucucuccucucucuccuuucucucuuucucucuuucucucuccucucucccucucuccucucucucccucuccucucucucucucucucucucucucucucucucucucucucucccucucccucccucucucucucucucucucucucucucauucucucugcuaacucuguauacauguguucuccugcugauggucuugucuuucuuaggggcugugaacaauggaaccaaacucucagaggacuaaagucccagcuuucuuaucugacuuggggaaggccacacugaggggaaucaggaaguguccccgaugugguacguucaauggaacccguggguugagcuguaagaacaagacauguggaaccauauuucgcuauggugcccgaaagcagccuagcauugaagcugucaaaaucaucaccggcucugaucuacaggucuacucugugcgacagagagaccgaggccccgacuaccgaugcuucguggagcucgguguuucggagacugcaauccagaccguggaugguacaaucaucacucagcugagcuccggccgauguuacguccccucguguuugaaagcugccacucaaggcauuguggaaaaccagugucaacacaucaagcuagcggugaccugccaggcggaggccaccccucugacccugaagagcucaguccugaaugcucugcaggcugccccagaaaccaagcagagccucuggcagcuggccaccgagcccacggggccccugguacagagagucacuaaaaacauuaugguggugaaaugcaaagccagccagaagcacaacuugggcuacuugcacgcguccuucaugcagaagaucagcuccagaagcuugccggagcgccgcuucuucugcuccugccagacucugaggccacacaaguccagcguccccaaggcugaggcagccccaaagugcauccauuucuuugcuugucucugugccuuugccagcgaugagacauuggcucaggaguucucggacuuucugaacuucgaugccagugguauguggagauugacaguuacuugguuguucuaaaauggcagugaaggcgucccaucagcaccuuugggauguucuaagagcccguagauucaggugcuagauagcacagaugcaaaggacugccuucuuuuuaacuggaugugugauguguguagguguguguguguguacuguggcauacauauacacaccucagacaacugugaugucacuucuuguacauuuacaaggacuucaggguuugaacucagguccaaagcaagugcuuuuaccugcugagccaucucacuaguagugcaccuuaaaaaaaaaucauaguguuagauaggcagcaguggugcaagccuuuaaucccagcauuuaggaggcagagacaggcagaucucuaaguucggggccauccuggucugcagggugagcucugugugucucugugugugucucugugugugugugugugugugugugucuaugucugucugugugucuaugucuaugugugugugugucugugucucugugugugucugugugucucugugugugugugucugugugugugugucucugugugugugucucugugugucucugugugucucugugugugugugucucugugugucucugugugugugugugugugugugugugugucucugugccugugugugugucucugugugugugugucucugugugugugugugugugucugugugugugugucucucugugugucugugugugucucugugugugucugugugugucugugugugucuguguguguguguguguguguguguguguguauacuggagauggaacccagaaccuuaugcauucuaggcagguccucugcucccaaaccacuuccucauuccuaacuagaucaaaauguuugggggaguuuuuucaagcaauuggucuauccuuuuuucuggagucagacuuuuauagaugacuuuuucuuuauuuagggguccauacuuccucuuguauaguagcaguaauucagaaaccuuacuuuuuuuaaggucuuaaggagauaauugugccccauuuaggcugccaugcagagucaucugucucagcuugugagucugcugccucuaagccccggaagaggaagaaggaugaagugucuggugagaauuuuacucauuucuuuaguguguagagauugucuuguuuuucaccaagucugaggaaucaugggaaaagacucuuguuccugaguuuuuuggguuguuuuuuuuaaagauuuauuuauuauuuuauguaaauacacuguagcugucuucacacauuccagaagagggagucagaucucguuacggaugguugugagccaccaugugguugcugggauuugaacucuggaccuucggaagagcagucgggugcucuuacccacugagccaucucaccaguccccauuccugaguuuuuaauaacauuguuuuuuaaaguaaaagccaggccaggugguguacaccaggaacagaggcagguuugaggccagcuaaucuaccuaaagaguucuaagccagcgagaacaacauaaugaaacccuguaucuaagaaagagggggagggacaaagggaggaagggaaaggggggaaggaagagaugagaaggacaggaugaaagaaaagcaagcugggcagugguggcacaggccuuuaaucccagcagaggcagacagaucucugugaguucaaggcuaaccuggugcacagaguaaguuccaggacaacuagggcuauacagagaaacccuguugcaaaaaaaaaaaaaaacaaaaacaaaaaaacaaaaaacaaaacaaaaacaaaaaacaaaagcccaucauguuggggacaugguucauugguaaaguaggugcuuagcauauacaaaaucuccaacaccacccagaucguuauggcuaguggagaacuucaggucaugggagcaagguagaaugcaauauaaaaagauaucuaacauccuguucuggcugccacggucucaaaguguguucaccccaccaccaccucacacacacagacauccaagcaaagaggaaaugagcuagcuggaguguuguaugcaaguacacuggacacucagcggcggaggcuggaggaucagcauccaaaaucagccuuagcuacauccaagguugaggcuaucuugggcugcccugugugaaaaacaaaaaaaucaagcaaauaaauaucauaaaauuacucacagagaagaaacuggaaaagagcucaccacagagcucacucacagagaagaaacuggaaaagagcucaccagaaagcauguugguuaaucagacagguaaaaacugcggguggauuccuuucuuccacuucuguuuucugucccaaucucuuauaaacaguacaaaaaguuaaaauuuuguguuucaugguugauacugguucauucuagaaacuguaaagccauccuggauguuaccaaagacuguuuauguuuuauguaugcuagaaauuuugaucaagucaacucuuauaauuuuauggaauuaaaaaugauuauuuuaugcuugucuugccuauguaugcacgugcauguauguauguucauguauguuuaugcaccauguguguuccuagggaauaugaaucccccagaacuggaguggcaggaggugugagcuauugugugggugcugggaaacugagcccggcuccucugcagaggagccauugcucuagccccaguuuugcagacuccuuuuaagacuuuuugucugggcuggagagauaacucaguggguaaagacucuugcuaucaaguuugaagaucugaguaauuggggacuuuuaucccuaggaccccaugguagaaagaaagaacuaacucgcacagauugucuucugaccucuauguguguccuguggcacacccacaugcacagaaaguaaaaaugucaggagacauggcacuggaugcucucccaaaagucacuguugaguucaauucccagcacccacaugacagcucacaacuguccguaaugccaguuccaggggucuggcacccucacagacauacacgaaggcaaaaacaguaagcagcauaguauaaaaacaaauaaaucaucaaaaauaaauuaaaauguaacaacaaaguuacuuugucuuguguguagguaaguuuaccuuuaacuccugauccugucucuaccucccaucugcuagaucacaggccuggcuguagacauggcguccuguugugcguuguuuugucucugagacaggaucucacccuaggccugaggcucacuuugcaguggaggaugaccuugaauguauuccaccuccacugccugcuggcacuacaggcuuuugccauugcucucguuuauugggcacagggcucaguccagugcucagugcguguuaggcugaguuccaccucauucccaaggcauggcuuaacuauuggaaccuauuugucaucuaggugcacaggugaacagcucacugaugccgcaagaugcaguaaacagcaaucuaaggaagaguggccugaaaaggccugugguuacgucaucauugaaaaggcacgguaaguuucccuuccuagaaggggcuucagggguggaaaccacccaggguagucagaaggagaacucagaagaaauguuguauauugucuccuaugauguggugcuaacauaaaagcaucgaauggaauccccgcagcuaaggucucuccuguuccccuagguucaaauccugcucagaguuaugcuaggauagacaggugguccagcaguuuuugcugcucuguugugaguucagaucucagcucucuauuggacaaguuacaaacaccuguaacucuagcuccaagggauuuuauguugucugaccuuggaaaaacacauacacacaaaagaaaaacaaaucuaagacuaaauugauggcucagugguuuagagcacuuucuguucuuucagaggacccggguucaauuccuagcaccuacaccacgcagcucacaacuguaacucaguauggagaccuggcuauuuggaaauugugguucagcucugcaaauaacuccaucucuaggcaauacaguaccucucuggccuccaagagcccugagaagacacaugguacauauacauguuggcaaaaccccauacauauaaaaugaaugaaccucuaaauuauuguuuuguuugucuuugucuaaauacaccuguuguuuugccugcauguaugucugugcaccacuuauauucaaugcccucaaaguccaaaagagguuguuggaucuccugagacuggaguuauggacagcugugggcugcuguguggguccugggaacuaaacccagcuccuuuugaagaacagcuaaugcuucuaacugcugagcuaucacuccagcuucuaaaauaaaaucaaaaaauaauaaauuaugcugcccauauggugguguauuccugcaaucccaguacucaggaagcagaaguauaaccccagcggaaagucaccuggucugcauccugagcuucaggccagggagagcuacaugcaagaccuuaucucaaaagaaccaagacaagggacuggagagauggcucaucgguuaagaacacugacugcucuuccagaguccugaguucaauucccagcaaccacaugguggcucacagccaucuguaauggguguccaaugcagucuucugcugugucugaagacagugacaguuuguccacauaaacacgacuggaacgagccaguggggccggagugauggggcgacagagagggccagcgcuuaccaggaguuagcagaaugucuugccuguggcugcacauaugauaaaaugcagagcuggguguaugacaugcaaguuugugcaaagcugguaacagcaaauggggccauuagguugugucuguuucauuuucccagguaucuauucuagacaucuuaaaacuuucuucuggaagucuuggcaaaagguauacaagcuccuauuuuauuuucugagauuggcucucacuauguacgccaacauggcuucuaacugcagcucugaccaccuuagccuccugagugaacaaucaggcuauaggcgugcgcuaucacacccagggaaacuuuguauuucguauaaugguauaagaauacacaccuuuaaucccagcacuugggaggcagaggcaggcggauuucugaguucaaggacagccuggucugcaaagugaguuccagggcagccaggacagagaaacccuaucuugaaaaaagcaaaaaaacaaaaaacaacaacaaaaaaagaauauacacuuaauaucaaagaguugaauauacuuuuuuuuaagauuuauuuguuuguuuguuuguuuauuauauguaaguacacuguagcugucuucaggggcaucagaucucauuaugggugguugugagccaccaugugguugcugggauuugaacuuaggaccuucggaagagcagucgggugcucuuacccacugagccaucucaccagcccuugaauauacuuuuuuuuuuuguuguuguuuuguuuuucgagacaggguuucucuguguaguccuggcuguccuggaacucgcucuguagaccaggcuggccucgaacucagaaauccgccugccucugccuccugagugcugggauuaaaggcgugcgccaccaugcccggcuuugaauauacuuuuaaagaaaaaaagaacuuuaaaaaauuacugaagacaaaauuuuaaaguccuaaauuauacuuuuauuuguuuuugugauacaaaaaguugaaucaggaccuccagauggcaggcaugcgcaccacacugagucccguggacgccgcucuucauucuggucucauuaaccucuaucccuuguuacuuaucucucagaaguuuauuccaggcuuuuagauuuuugccauuucccuuuuauuugaggauguuuucauuccuuuugcauuuccaaauacaaacauuuacucuuaagugugaagagacuauagcaacucauaaugaauuaccucccuuuuuuuauuuuuuaauauuuuuguuuuaucaagacaggguuucucuguguagucuuggcuguccuggaacucccucuguagaccaggcuggccuugagcucacagagaucugccugccuuagccucuugagcagugggauuaaaggcaugcaucaccacuaccuggucaguaccucccugauuuuaauuacuauuuguacuuaaugugaacaggaguuuugccuguguguaugucuguauacuguaugcaugccuuaagccugcagagaccaguggagcaucugaucuccuuggaacuagagcuguaagcugaacaauuguaagcugccaugguucugaauaucaaacccaguuccucaggagcagccacuggauuaaccuccgagccaucucucuagacccuggucugcuuugccuugguuuguguugcccuuguaaaucaggaugaccuugaacucagaacagucuacuugcuucugccuccugaccacuagaauuaaaggcgugcaccaccacaccuggcuaaucaacuuauuuuucucaaaacucccugaguagccacagauggcccuggacuccugcucccccugccucuguuucccaaaugcugacauaggcauauaucaucauuccuguguuacagccacguuuauuacaaggauguacuguuaacacccaguauacauggaccuuuuuuguuuuuuguuuuuuaaguuuuaugaagcuggagagauggcacaguggguaagagcucuugguacucuugcaaaggacccaaguucaguuccagaauucacacuggguggcuuacaagcaucuguagcuccagcuucaggagauccaguggccuugcuggccucagaggccacugcauguacaugauguauauguauauagagagauauguaguuagggguguguguguguguguguguguaaaaugaauauuaaaauauaucuguuauuauacuggauaucauaaaauauaaaguuguugaaugucaauuaaaaagaaaaggcccuuaaaccuauuucacuuaauuucucuguauuuaauuuuuguggguuuuuuuucuguauaaacuacuugacuauuucaagcuucaguuaauuguuuauuuugagccaccaugugguugcugggaauugaacucaggaccucugggagagcagucaguguucucaaccucugaggcaucucuucaacccauuuauuuugaaagaaaaguaaaauuaaugaaaaauuuuguuuuguuuuguuuccuuuuucuagucuguggucagcuguuagaugaggcacaagugacccuguccuuccaagacuggcuggccagugucacagagcgcauccaucaaaccaugcacuaucaguuugaugguaaguagccugaagugggagaucccccagugguauguggcaguucuucucugauuuguaggaaagcuaagugagcgugggucccgagcacugagccacaggaaagacugguguggccguccuggagcuggaggguugcccugaggcugaggacagccugaguuacagaccaagaccuugcucuguuguuuuaaagacgagugaaguagcgauguagcuuuauguuaaagcacaagucucuggguuccuuccccaguacuaaggaaagaaacaagcgaaccagacggcuuaaugguaaaggcacucaaggcugucaagcuggcaaccugaguuugauccccaggacucgugagguuaaaggagaaaccaauucccacaaguuguccuuugaccuauacauguacacuguggcccacgucuuuuccucccccauaaauaaauaaauguaauacaaaaacagcaaacaagcaaaugaagaagacaucaaaguugaaagaaacaaagaaucauuaucaaaugauuaauuuaaucauaauuggacuacaggaccaacaaaguggaguuagagauagaagaaaaaaagagcagcagauaaaaccuguaagucugccugggucuuugucuuuguguuugugucuggugugccaaagcuuuagauuguaaaugaauaccucucaagucugcuggaaccccggugaagucagagcagaggugggcgagacuuagugcucauuccucgagcacauuguagggggauggaguggcaguuuaucugcauugucaacuugacuagauuuggguucacucggaaacacagcacugaguguuucugaggaugaugacagauuuguuuguguuuguuuguuuguuuguuuguuuuucgagacaggguuucucuguauagcccuggcuguucuagaacucacuuuguaggucaggcuggccucgaacuuagaaauccgccugccucugccuccugagugcugggauuaaaggcgugugccaccacgccccgccugaugacagagauuuaacugaggugacagcaucccaugggcacuguaccagcauucaccucucugcuuccugacacugguugugaugggaccagccaccucacacuccugcugucgaaccucucuggcugucaugccuuugcuacugugauccuauacccuuaaacugugagccacacaggcccuuuuuuccuuaagcuacuuucauuaguauuuguccaacagaauucuuaguaccgguuuccugauuugucaggagaugaaaagcuccaugcuuuuuugaggcaucuugauuauguaaccacuagaacccaccuaaaaaagguucacucuggguuugggaggcacucaaacccaaacuuguaaucucaaugccaaaaggguagccacccgcucuagucuaauuggcaaguuucaaguuuugaugagaaaacuugucucaaaaauccaguugugggugggcagugagaugguucaacaaggaaagacacccuucccaacaaaccugauggucugaguucaaucccuggagcucaugguagacagagaaaacuggcuucugcaggggauccucugacacugcacccuccccccaacacgugugccauaggcugcaugugugcacgugcaaacacacacacacacacauucucucucucuuucucucucucuaaauuaaaacauaucaggacuggagugauagcuuagcaguuaaaagcauuuauugcucuuucagaggaccugaguuccauucccagcauccacaugguggcuccaucuccccaguuccaggggaucuaacaccaucuucuggcuucuucauguacauacuuauuguacauacaaacaugcaggcauaauacucauauacauauaacaaaauuuaauagaauguuuuaauaagcaaaaagacacacagacaacaaagacgaaacacaguccugagaaaacuugucaguucaccucuggccuccacauugcuuucaaauacauguauaugccccugcacacauaagcccacaacacaucuguacacgcuaaacacugagguuuaacauuggcauucuacagucaaauaaaaguaggcagagccagcugggugugaugaucugcagcuagacucugacagaagagaccauucagagucuuacucauaggugguggugcacaucucuaauccuagcacugggaaaacaagcagugggaucucugugagcuccaggacagccagggauacacagagaaacccugucucaaaaaacauaaaaacaaaacuuaguaacacuugggaaacagguaguuugacgucuaugcuuucuagguugaggaaagccacuuauagugacucugucucaaaaccaaaacaaaacaaaaauaucgaaaaaaaaagugaauauaagucuuuucuauucuaacucuauuauaauuguuuugucuuuuuuuuuuuuuuuuugcuuguuuggaguuccuguuuuuugguuuuguucuguuuucuuuacauguauguuuaugacucuguguguguguguguguguguguaugcaccauauuagugcaguagaucacagaaacugaaagacugugucaggcuucccagaucuggaguuccaggugaccaugagccaccugucaugggugcuuagcgccagcucagguucucuggaagagcagcaaggguugagcuauuucuccaguccucuucuuuacauuuuuguuuuuuguuuuugaaagcuauauagccagagugaccacaaacucagaacccugccucagcucuaaaaaugcuggcuuuauagugucccaccuugccuaacaacucauuuaauauauauuauuuaacauuuuagaaaaaauagauuuauuuuauuugaauggguauuuugccugcggguauguauacauccacaugcaucccugguaucuacaaaggucagaaagagauagucagaccucauaaaacuagaguuauggaugguugugagccaucaugcugguacuagggaccaaaccuagguccucugcaagagcaacaaguguucuaaacuaugaacuaaauuucuuuucaaguuaaccaguggucuuucucucagagccaggcaugcugacgcaccuguaguucuagcacucgugggacagaggaaggaggagcccuaaggguugaggucagucuggucucuguagugagucaaauccaaacccugccugugcuacagaauaagacuaugucuaagcaauguccaaagcucugugcuucuccguggagcucuagauguuuauaaugucuagaugucugcuggaauuaagaaaagcucugagcucagcugccucccugaaaaucuguugacuuuuucuuauuucaaauuacuuuaagagauuaggauguuuucuuauauuuuugugugcccuggaguuaugguuaggcugaugcugauuggaccugcagcaaccuaacccuauaaucuuagcacucauguccuggccaugcaggggaaagcagcuuccugcuuugcuuagacugaauauagcuagcaagugcgugggcauagaggccaggagucagucaaguggaggaggcaaccagaggcucuuuagcucuucuggcauguucucauuucauacgaccuucaaggggagaagucugcucuggugguggcugcacagcuggggcucugaaaagucauccuggguggagaauaggaguguuacacgcuagggaugaaggacaggcugauagagcccguggccuucgaggacccaucagucuuuuaccuuugaauaaagaaaccucaagggaggggugguggugguauuacaucuuauuugguugggagaggaaacauguaugccauggccaguguguggcagucagaagacaacuugcagggauugguucucccuuuucaccauguggguuccagucaggugaucaagcugugcaacagcugcccuuacacacugaugucuccccaagcugcccacaccagauacuuaggaucacagcccauccacuccuuuccuuccuccuguccuuguacaucaagaaaacaaccauguuuauuuaaaugacauucuucuuuuuucugcaggcaaaccagaaccccugguguuccacauuccucaguccuuuuuugaugccuugcaacagagaauauccauaggaagugcaaagaagcggcuccccaacuccacuacaggugcgggggucucccuggggaagaguaauaguaauugugacuagagaacuaugugugggaaaaaucucuguggaacuuucaguguuagcaugucugggcaaguuaauggggacaugaaacuuuuggcuauuagcucuuagaacagugaguaucccuccaaagacagauacuucucccaguuagaguaaaugggaacauucaggagauguuggccugggaaaugaugagcaaagacugguugauacuucucagugugguacaguuuccacaaaaacaucugaagccccagcagccaaaaccuaaggagguauccauagauaugguaucugucaguaugcagauggaacugagaccccacucucucggcagagcccuaacugauauucaagacaugauuguuccuuagcaucuuccagugcguuuccagaggggagcuuuucagaaacuuuggucuagacaaagcauuuccaguaguacauuaagacuauaauuccagcugggcagugguagugcaugccuauaguuccagcacuuggaaggcagagacaggugaaucucugugaguuagaggcuagucuggucuguagagugaauuucaggacagucagggcuacacagagaaacccugucucaaaaaauaaaaacaacaacaauaaaauauacuuccaaccuggcaugguaguaccuuucaucacagcagacaggaggcagaagcaguuggaucucuuaguucgagaccauccugguguacagagcaaguuccaagaccaccaagcuacacaaaagaaacugucucaaaaggaaaaauaaauaaauuaaaaagauauacacaauauauauuccuuagcaaauacuaauagaaugagccuccaccuguaagauugaaacgaaauauccucagaaaguucacaggggggcuggagaaauggcucggagguuaagagcacugacugcucuuccagaaguccugaguucaauucccagcaaccaucugugauaccauccaauuuccucuucuggugugucugaagacagcaaaaguguacucauauaaauaaaauaaaauaaaauaaaauaaaauaaaauaaaauaauucuuuaaaaaaaaaaaaaaagguugggcaugguggcgcacgucuuuaaucccagcacucgggaggcagaggcaggcggauuucugaguucaaggccagccuggucuacagagugaguucuaggacagcuagggcuacacagagaaacccugucucaaaaaaaaaaaaaaaaaaaaaacaaagagagagagagagagagagagagagagagagagagagagagagagagagaaaguuaguucuuucacagggagaggggagagcacacacgccuuuaauccaagcacuggggagccagaggcaagugacuuucugagaguuugaguccuaccugaucuacaaacugaguuccaggacagccuggacuguuacacagagaaacucugucucaaaacagcaaaacaaaaacaacaacaaaagaaagcucauguaggaaaacaacagcuaaaaacauuauuaauucuuucuucugguugcugugacagaauaccccaaaaugcagcuuaggagagaaaggcuuguuuuauguuaccagggugaggaauuuguggcagcaguaggugacuggucacauggcauccacaggaagcagggagaaaugaguguuggugcacagcucagucuccuuuuuguuuuguuuaagacucuaaccauaacaugguacaacccauauucagauguggucuuccuaacugguuaaucuaaauucccugaaaaacauaugcagagacuuguuuccauggugauuguaaaucucaucaaguugacaguguuaucagucacaagacacccauugguaacuugacaccagugcacaucacuauaaaccuugacauucaucucuaguucccaaagguacauggccaucucauuuuacaaaaugcuuuugggucaacgucauaaauucccauaggcucuugacagucccagugggucucaucaaagacucaagucagucuuaacuguggacaccuauaaaaugagaaccuacacugaguaugcgauagcauagaauaaacagccguauucuaagauggaagaauuagggcauagcaaggaaugauuggaucaaagcaagacugaagcucaucagggcaacacuaaauccuguacuuucauuggacaucugggacuccaaauggccuggggagccucaccucuccagcucuguugccugaggacacacagccucugucuugagccagguccacucuacuucugcagcuuuccccaacaaaugcuggaugguacugcugucugugacuuccuggguucucacggcagcuagcuaggcuucaccuucacaccucugcucagcagccucucacgauaccaggcaugccacacuucgccugacuucagugcucuccagaacuacggcacaagacuccgugacucccucagucuugcaacuuuacuauccgcagaaccgauaucuuaaacagugccgcuagcucaagauggaccugaccuccuucauccacagaugcaguggccauugugugcugacucuggggacacuccuuaggcagggguuuaccugaccuucuucauccacaguugcaguggccauuguguggcaacuggggggagcacuccuaggcagguguuggagcagggaacccuuuccuugccacccucaguuuagacuauacuuucuagugaaguuuuacuuucacaacuuggaggcuuggauguguggggucuugcccucaagaccccuuuccuguugucccagugcagacugccauguugcuuucuaguggcacuaaccuaaccuaacaguuacagcugcugucaacccugccuugucucuaacuuucaacuugcuggugcuuuuguugcuugaaacacugcacgcuuugaugucaucucugcuccuuuucugucuuucucgcccaggaaccugaguaagcacugagccauagccaugguguacagucugaaugccaucugucuuaggcgaacaucauguuguccauuccuuaauaauccaccuucacccaggcucuugggacacagccaaaaaaagccagguucuuugcuugaauauaacaugaguaucuacuggccugguuccugagaguccucauuccccucugaaggcacaugagccaggccucucuuggcacuucagucucccaaguccccaucagagugcccguugggugggcucuauuuacagcaccguaggccacagagcuuccacauucuucccacaaaccaguuccaaaggcccaauaaccaaauagucacgauugucagagcaacagccucacuuaauaauucuguguuaguuacuugucacugugaugaaacccugauaggaaguaccuuguggaaggaagccuuuguucuggcucaccguuuggauacaguccaugugguagagaaggugugacaccaggaaggugaggcggccaucgcacuaucuacagcuagcaagcgcagagagaugaauucuggagcuuagcuugcauucucuuuauucaguuugggaccacagccuguggagcgaugcccaccucagcauaaucuagaaacugucucauacaccugccuagagguuugugcugugucguugauucuaaguccaaacaaguugaucaucaugauuaaccaggcaugauagcaaauauguuuaaucaaagcacucgggcggcaguggcaggcagagcucugggaguuuguggccagccuggucuaaagagugagcuccagcucagucacagauacacagggaccccaucgcaaaagacaccagcaaacaaagauuagccacaauuuuggaaaaagggagacuuuaaaaaaagauuuauuuauuuuuauguaugugaguacacuguagcuaccuucacauacaccagaagagggcaucggaucccauuucagauggucgugagccacuaugugauugcugggaauugaacucaggaccucugaaagaguagucagugcucuuaaccucugagcugucucuccaguuccaagauuuuauuuuuagaguaacuuuuuagaaauaaagaugggggaagagagaaccaucagguggucaacaaccaaaaguaauuacaacuagaaaagagcggcguguccuuaguaaguuguuccgugauuuaacagugacucugugaggcucaagucuagauuugaguaauguaagcuaugaaugcacacugcuuugagacccgaagaccuucguguucauagcuuaucuguguaauuuuaaaggacucugauuugacccauuagaucucauguuguaagagguuuuuagaauggaauucugugcacauaacucuaccacacauaggaacaguaaguagcccacgggccuggguuuauuugaaaagaagccagaacaacaaacuauguaaacaaauuucuaaggucuaaaaagccucagccuucugcguuggaaguucauuuccugugcucagccagugccugccagacuugcggaugguagggguccaaggagaaugacugcacugcagugagcugccugcacacugggaggacacugccucaguacucacaucugucccucccuucucacugcagcuuuuguucggaaagaugccuugccacugggaaccuuuuccaaguacaccuggcauaucaccaauauucugcaagucaaacaaaucuuagacaccccagagguaagaguuuauuccucaggagcuguguguguguguguguguguguguguaggcacauaugcccacuuguacaucuggauacggaggcuuagagguucacauuagauaucuuuuuuuuuaaaagauguauuuauuuauuauauguaaguacacuguagcugucuucagacacuccagaagagggcaucagguuucauuauggaugguugugagccaccaugugguugcugggauuugaacucgggaccuucggaagaguagucggcacucuuaaccacugagccaucucuccagcccuagauaucuuuuucaaucacacucgaccuuauuucuugagacauggucuuuugccauuguuuuuuuuuuguuuuguuugagauagaguuucuguguguaguucgagcuguccuggaacuugcuuuguagaccaggcuaucaucaaacucaaagagaucacuuguucugccuccuaaguacugggauuaaacgcacaugucaccaccaccuggcaagagacauggucuuucauuagccuaaagcucaaacaauuuagucagacuagcuggccagcaagcccaaggacccagcucagcugucucuccugccccaccuuguuguugagucagcgucuuucuuuggccuggagcucaccaaguagguuagcuggguggccugugagccucaggguuccauaugucucuguguuuccagcacugaaauuacaagcaagucccaccaccccugaguuucuaggggcagaacugaaauucagguccuucugcuugcaugcugaaugcuuuccucaccaagccagcucuugaaguuccuuucucauguuaaaggacuauuuaguuauagucuguauaguucugagucugauuugguaacucuuaaugccuuaaaaaguauguguggggggagguuugguuguucaguuguuugguuguuugguuggguuuuuuuuuuuuuugguuguuguuuuguuuuguuuuuguuuauuugguugguuuuucaagacaggguuucucuguauagcccuggcuguccuggaacucacuuuguagaccaggcuggcuucgaacucagaaaucugccugcuucuagaaaguaguuuuuaaagggccagugagaucacucagcugguaaaaguuugauggccuugaauaugaccccagccuauauaacauggaguugagggggacagaccuucaagcccaggucuaagauagaggcagaagaaucaaauuucaaacuuaccuucagcugcacaucaagucagaagccucagcugugugagauccugcguggaaaagcaaagcagccgcagcgaagcaucucaguuuaagaugcuggguuuugccuuuggggucagaaagcaggauuuggggccaugcauaugcauaguugguguaguccuuuaaucccagcacucagaagucagaggccagccugucuacauggcaaguuccagauuagccagagauaccacguaagacccuguccuccuuaucccugccuccccuaaaaaacaaagcaguauuuuccuugugaauucaugauacucuggugucuaugaagauccuagacuccacugguuguugcgagaauggguauucauaauaguagaugacauucuaucuaugaagucacuaggucuuguuuaagcgcuccuccucaaacuguaacuugauaaccuggccuuauucucuuucgccaggacacacugaauauuuuacuacaucuacuugcuugcuugcuuauuuauuuauuuauucauucauucauuuaguguguguguguguguguguguguguacacgacuuggcucccuccuccuauugucaauucuaggguugaccucaaguggucacccucaccccaggccucauuacccacucagcugucucacagacccaacacugcauuuuaaaauagucuguugaaguagaucggaaguuuugacagaucacucccuuccuacagaaguagaauauuucagaaaauucaccacagugugacucugauacaugaagguuuauuuagccagccuuacuagcucauacuuacaaucuaguacuugguaggcaaaggcagaaaucuggaauuucagggguauacagugaaauugucucaaaaacaaacacaaaaagaugagcagcaaagcaucauuguguuuagaaguaaggugacagcugugcagcuuacgcaugagcccugaagacagggucagugagagaacaugucuugagauugagugugauagaguagugcucuuccuccucuacucucuguguacauguuauaggcacauguaucuguacgcauguucacauguacaaugcauacauacauggaauacaaaacuauuuuuaaaagaaaguuuauugauuugccugcacuuaaaauaaaaacaguaucauggaguuggagaaaugacucggugauuaaaagcacugguugugcuuccagaggaccgagguucaauucucagcaucuacauggcugcucagaacugccauguaacuguaacaauaacuucaguuccacgguaucuaacacucuuccucugacuucucaagugccuacauacaugggaggcacauguauacacacacacacacacacacacaaugucaggucccaaagaagccugaggcaggccuuaguaccugccgcucuucccugcacccucgcccccuaaauucuccagcccaggacugggcuucccuucucccaacgucucuuuucuauguaacucggccauuuugguuacgaacccuguuaguucugcucuugguucuucucuugguucccauguguucucugagccucuucgcccaccaccuuucuuuuccucuccugcuccccacccccuccucucagggccugauucggucugguucagagccuuccaggugccucuggcuguucccucccucauagcuacauagagcuucagcaauaccuaggugcagucauguccuuguuuucauucacacacauauauaugaauaauaaaauuaauauuucuaaaagauagaaucauaagagaccuaguggcaccaagauacacguaugucaaguuuucugugucucccuuucuugcugucuguguccagaugccccuggaaaucacacguagcuuuauccagaaccgggauggaacuuacgagcuguuuaaaugccccaaaguggaaguagagaacauagcggaaagcuacggccgcauagagaagcagccugugcugagaccuuuggagcugaaaaccuuccucaaaguugguaagugacuuuccgagcaccucugccugagcuccguucugaggcucugggucugguccuucaucaaagcacaugcacucauuuuguaagaaccugaaaagcauguucgucccuuucgagcuggugauuucuagacagcagaggaauguguguguguuuugaagagaucaugaaagaauuaguaaaccaucccccccugcagccugcccuccccccagaaguaucacaaguacugcuauguaacacccucccccaucuuacuguguagcccuggcuggucugaaacucacuguguagacugaauggagagggggagaugcggugagugggggagggugguagcuagagagauggcucagagguuaaaagcacugauugcucuucuagagguccugaguucauuucccagcaaccacacaguggcucacaaccacuuguaaugaaauuuggugcccucuucuggugugucugaagacagcuacaguguacucauauacauaaauaaaucuaaaaaaaaagaaaaaaggacgguccuuacugcuccuaaguaacgugaaggagguuuauuguagauaaaaggaagagcuagucugcauauuuuaucacacguaaauguuugauccucugaaguuuauucuuguguauguuauuaauauugccaaccaucuucuguuuucuuccagaucauuauugguugguguuuuauauaugauauaagacacuuuuacuaagucagaugaggugggacuugcuuuuaaucagaugcauucagauggcagaggcaggcagacuugugaguuccaggcaaccaagguuaccaaaacccugucucaaaaauaaaacaugcuuccuuguguuuuuguuccugauaggaaacaccauuagguuguguccucuucagccaguacugcagugcauggugggugggguuugggcuguaccauggaaccuugcagauuugacuuuaugucugugucaccccucuugccaaucucccuccccagugcugccugcugucacugguuaugcugcucuguaucaaagccagcagugggggagggcugugcguuucacagugggcauguagagagaggucagagggcaaucugugggaguugguucuccuugcaccaugagggucaggucauucggcuuggaagcaagugccuuuaaccuagccaccucacuggccccugaaguucucuucugaaguuacagcagugcccuguucuuccuuucauuccccuacuucuuuccuuuuucaaccccaucagggcuacuuauucucugguugguacagguuccacccgggcaguuaauaccaggcacuuguuucuaauuuacuuuccuugcauuuaauauauguggggaugggauagagaguacugugggacaugggauagagaguacugugggacaugggauagagaguacugugggacauggauagaggacagcucacaaaaguugcuucucuccuaccaccaagggcucccugaaagugcccuuagccccuaaagcaccuuguuggcccucuucuguuuguuucuuuuucagcauugcuugugacagggucucacuguguaacccuggccuagaacuugcuauguaggccaggcuagccuccagcucacagagauucaccugccucggcauccaaaaagugcuggauuacaggcaugggcuacuaagcccagucuugguuucuuaguuaaagcugaagagaauaaauguucugcauuagaauuuuggaaaaccucuguuaagaaugugcaacaagcggggcgugguggcgcaccaugugguuguuucuauuccugaacaaacaucaugaccaagaagcaaguuggggaggaaaggauuuauucagcuuauacuuccauacugcuguucaucaccacaguaaaucaggacuggaacucaagcaggucaggaagcaggagcugaugcagaggccacggugggauguuacuuucuggauugcuuccccugguugcucagcuugcuuuuuuauagaacccaggacuaccagcccagggauggcaccauccacaaugggcccuucccccuugaucacuaauugggaaaaugccuuacagccagaucuuaugaggcauuuccucaagggaggcuccuuucucggugauaacuccagcuugugucagguugacacacaaaaccagccaguacaggggguuuacagaacucagauuccaagcauguggauuucuauguucuucuauagcuguccucacgcaaacugcaucuuccugagaguucugacuuuguuagucagcuucaaccaugcuuuuucagucaucaguugagcuuccggaauuuucuauuuucacugacauuuaagugaaguccuagcagcucuguaucuugaaauggaagcuguaaugucugccaaaugagccggacaguaccuugacacacacaacucugcagccccaugucacaaaccucagguucaucuugggagugcuuccuuccugaccacugugagaagggaauagcugacagagugaagggauggggcuaagaaaggccgccuguuugggaauaaaaucaagaguaaagacuauauaugcauuacugucaggguauuuugucuuucuuucucuuuguuuugcauuuuuguuuguuugguuuugguuuuucuguuguuuguuuguuuguuuguuucaagacaggguuucucuguguaacccuggcuguccuggaacucacuuuguagaccaggcuggccucgaacucagaaauccuccugccucugccucccaagugcuggaauuaaaggcaugcgucaccaccgcccggcuuguuuuacauuuaguuguguuuaaagggugguuuguauuucugugugcucaguugccaucaaugguucccugggagcuggagcuguuaagugguugagagccacugaagcugcugggaaacagguccuacagaagcagcagacacugcucaucagucacucagccagcucuccagccccuaggugacuuuuuuuuaaaaaagcuuuuucuccugaaagacuuccuuuuaaaaaaagauuuauuuguuuguuuguuuaaugcauaugaguacacuguagcugucuucagucauaagagaagagggcaucagaucccauuacagaugaaugugagccaccaugugguugcugggauuugaacucagaaccucugaaagaacagccagugcucuuaaccacugagccuucuucucuccaggccccaagacuuccuuuuuauuuuuuguuuuguuuguuuggguuuuguuugccuuugcagaauggacuugaacccucaguccaccuccagaucgcaggagcuggguacccuggcauaugcagugcccagcuaaacucuccauuuuaucuggcaaagggcagucauuucauuucaaauccagcugugagucuagccuucaacaccaguaaaaccugaauuguucuuaacucuguugucauaguaaaggaguugugugugccacagcaugaaugcguagcucggaggacaacugggagguggaucuuucuggccaaccuucuguagguucaggagauuuuacucaggucuccaggcuuguguucccagugccuuuacauugaaccaucuugccagccacaucuagaguuauuaucuacuacacaguaaauaugaguacauccugagcuccagugaagacccugucuaaaaaaccauaaaagccaaaacaaagaagggaauaaguugacucauacuaaccggccucccccuuucacucuguagguaacacuuccccagaucaaaaggagccaacgcccuuuaucauugaguggaucccagauauccucccacaguccaagauuggugagcuucgaaucaaguuugaguauggucaccaccggaauggacauguggcugacuaccaggacccaaggccacccauggaccaaccuuuggagcuggccccucugacuacuaucacuuucccuugaggcaaaucaagaguauuuugcagaguuugcacaucccaaucccugaggacuauaaauccuaguagcacuuauacgaucccugcuaacgaaccacacuuggcuaagaugcaguuacucagcccauccauguguguucuguagaagaaacucuuguaaauagccuuguguguacagucuucauacaagucgggcacuuauuucugaccagaguuuuagaagaaacaacaaaaauccagcucacuggcuucucauggauucaccugcagcuuguuuuucuguaauucuccaaaagucacagcacuggaucuuagccaacaguguuggaaaguuaacgaugcccugggccgagcaggguccucucucucugcccaagagcuccaaucacucuuuauucugauaacaaaauaaaguacagugucacuaguuuuuccaaauggugccauugaugucaugauuuuacaauuagaaccugugggagaauuuaucuugucaacaggaaaguaggcagugccaggggaucagcaacacauauucaccaccaccuccacccacccaccccacacaacaagguuucucuguguagcccuggcuguccuggaacucaguagaccaggcuggccuagaacucaagaaauucaucugccucuaccucccaaguucugggauuaaaggcauuuuuaaauuuauuguuauuauuuuaucauuauuauuauucaaaauuaagagcagcugagcacucgggaggcagaggcagacagaucucugaguuugaggccagccugaucuauacagugaguucuaggacagcaagaacuacaaagugagaaccuguuuuuuuuuuuuguuuuuuaaaagcagcugauaaaauucaaaaguucuagguucacucauccuagaacuaagaugguggaggaagugaagauuugccuucuaggagaggaggaagcauuuucuacacaccugccaugacuucccuuuacacuaucaugccagucaguuuucccacugagucuucauuuuucccuggguucuaggaauuacucuuccugaagucucacuggggcuacagauugaguucuacacaguacuaaaauuauguuuaguuuacuucuacguauauauucuuucaacuugaaauacauugguuugauaugcagggguuuuuuuucucucucucucaugcuuugccaacauguauauaugaacacaugggugccuggugccuugggaaaucaggaaagguuguuggagcgccugcaacugaaguuagggaggauugugaaccaucauguaggugcugggaaccuagguccccuggaagagcagccaauacuccuaacugcuguaccaucuaucucuccagccccuugauaggaaugucuuauaacugauaacucuguuuuaauuguaaaugacgaaacacccagcuccaaccugcuuggaggggggggggggugccuuguguuuacaguaaaggcuggacaagcaccuuguggaaaugggguguggccaggccauacaagcccuugggacaguucuagccaacuguccauucaguuggggcuuaacuuggggcaggccugugacuuugauauuaccauuuucacgguagggcuugaugcacaguaaucugucaaaccaguacuuauaggacucacucugggaucuuguugaaauguauauucuagcuggucacuauggugcacaccuucaagggcaaccuugucuacauagaaccaggucagccaaggugagaccccgugucaacaaaagugucuaucugaauuguaagcuuuaaggcaagguccaagaccugcauuucuaggaagcacccugacacuguacgaagugcuaugugaaaaacugccuuucaaauaacaagguugguucccaaaaggauuugugacuuccuuccugccuucccuucuacggcuugguguggguccagcagcuauggcugaggccuggacugcgcuccugaaugacucgggauacucgggauacucuggacuaguucguaaacuccacgucugcauaaugacacagagcaucacaugcgaucugcugauguggcugaagauggugcuuucuggcccauccugagacacaauuucgguuaaugacaagggcagagaaugaguaugauccucaaacuucccaugacccgcagcgcgaccaagcagccaggcaguuucaggagaccaaguagagcaaguaaagaagccacguuucugcccacaccgguagaggggagaagccggaacagcacgcggucacguggccccgcgaggugacgucaccacgcugccgccgcacgucgcuuccagccacaccgccacuguucuuccgccaggcggcgccgcagguuggucacgcgcuuugugcacagccgcgcuggcgcuccggacacgucaccaccuucgcguccuuucuggagagcgcgggaaggagggcgcugcggguggugacgucaccgggguucccugcgagcucgcgugggcggggcuggggacguggcgaccgccgagugucgagcuggaggggaggagacaagggagacgagggggauggguaggggagaagggccgaagggaguaggaagggguggaagauguaaaagaggugggggguagaggaaaguggcugaagaugggaagggggugcggagaggggguaggggagagccgggaaggaaggaaguguggagacgaggggaaggccggaagaguugggggaggggauuguuuaaggggagaggcgagaaggaggggugggagagaaaggaggagauaguaggagggacuuagaaagccugcccuccuuuccccuccaacgcaccuuacacuagcacagcucuugaggccuccaaggugucuguggcuccuucccgcaguagaccuuccuccagggcagccacguucugccuccuuuaaccaccaucaaucaccucaggaacaaaaggaaugguaccucaaaagacuugguagucccuaaccuuaaccaaacccgggaagguuuuguguucuguucccugacuguuaauagaagauuuuccucuuuaccgccccaguaagccucgagcccucuggguggcaaagggguuagaaaugggaccugcuucagaacucaagguggguaccagaguuuacccgaacaccagucuaauucuuugucacuggcggcacagcacugacgagugaccuugagguacccuuuugccccacagucccugacuuccagaaagaauggaauaagaagcugaggucugggaaccaucaucugagcugagaaaaauggauucccuguccccuuaguagggacagaguugaacuauggcuacuucuccagcucuuauuaggguuugggccuugugcagagugaguauccagcuccuccuggaggguguaagggaugcugcggccgcccggccugccugccugcccgccauggucuccuuuggucacuccuguccuguuuauuaggacaaggcuaccuugggcuucagaugaaagacagcauuugagguauaauaaaaaguaagaaccca

SEQ ID NO: 3164 - RNA, 11088 nt, Mus musculus
agguaacacuuccccagaucaaaaggagccaacgcccuuuaucauugaguggaucccagauauccucccacaguccaagauuggugagcuucgaaucaaguuugaguauggucaccaccggaauggacauguggcugacuaccaggacccaaggccacccauggaccaaccuuuggagcuggccccucugacuacuaucacuuucccuugaggcaaaucaagaguauuuugcagaguuugcacaucccaaucccugaggacuauaaauccuaguagcacuuauacgaucccugcuaacgaaccacacuuggcuaagaugcaguuacucagcccauccauguguguucuguagaagaaacucuuguaaauagccuuguguguacagucuucauacaagucgggcacuuauuucugaccagaguuuuagaagaaacaacaaaaauccagcucacuggcuucucauggauucaccugcagcuuguuuuucuguaauucuccaaaagucacagcacuggaucuuagccaacaguguuggaaaguuaacgaugcccugggccgagcaggguccucucucucugcccaagagcuccaaucacucuuuauucugauaacaaaauaaaguacagugucacuaguuuuuccaaauggugccauugaugucaugauuuuacaauuagaaccugugggagaauuuaucuugucaacaggaaaguaggcagugccaggggaucagcaacacauauucaccaccaccuccacccacccaccccacacaacaagguuucucuguguagcccuggcuguccuggaacucaguagaccaggcuggccuagaacucaagaaauucaucugccucuaccucccaaguucugggauuaaaggcauuuuuaaauuuauuguuauuauuuuaucauuauuauuauucaaaauuaagagcagcugagcacucgggaggcagaggcagacagaucucugaguuugaggccagccugaucuauacagugaguucuaggacagcaagaacuacaaagugagaaccuguuuuuuuuuuuuguuuuuuaaaagcagcugauaaaauucaaaaguucuagguucacucauccuagaacuaagaugguggaggaagugaagauuugccuucuaggagaggaggaagcauuuucuacacaccugccaugacuucccuuuacacuaucaugccagucaguuuucccacugagucuucauuuuucccuggguucuaggaauuacucuuccugaagucucacuggggcuacagauugaguucuacacaguacuaaaauuauguuuaguuuacuucuacguauauauucuuucaacuugaaauacauugguuugauaugcagggguuuuuuuucucucucucucaugcuuugccaacauguauauaugaacacaugggugccuggugccuugggaaaucaggaaagguuguuggagcgccugcaacugaaguuagggaggauugugaaccaucauguaggugcugggaaccuagguccccuggaagagcagccaauacuccuaacugcuguaccaucuaucucuccagccccuugauaggaaugucuuauaacugauaacucuguuuuaauuguaaaugacgaaacacccagcuccaaccugcuuggaggggggggggggugccuuguguuuacaguaaaggcuggacaagcaccuuguggaaaugggguguggccaggccauacaagcccuugggacaguucuagccaacuguccauucaguuggggcuuaacuuggggcaggccugugacuuugauauuaccauuuucacgguagggcuugaugcacaguaaucugucaaaccaguacuuauaggacucacucugggaucuuguugaaauguauauucuagcuggucacuauggugcacaccuucaagggcaaccuugucuacauagaaccaggucagccaaggugagaccccgugucaacaaaagugucuaucugaauuguaagcuuuaaggcaagguccaagaccugcauuucuaggaagcacccugacacuguacgaagugcuaugugaaaaacugccuuucaaauaacaagguugguucccaaaaggauuugugacuuccuuccugccuucccuucuacggcuugguguggguccagcagcuauggcugaggccuggacugcgcuccugaaugacucgggauacucgggauacucuggacuaguucguaaacuccacgucugcauaaugacacagagcaucacaugcgaucugcugauguggcugaagauggugcuuucuggcccauccugagacacaauuucgguuaaugacaagggcagagaaugaguaugauccucaaacuucccaugacccgcagcgcgaccaagcagccaggcaguuucaggagaccaaguagagcaaguaaagaagccacguuucugcccacaccgguagaggggagaagccggaacagcacgcggucacguggccccgcgaggugacgucaccacgcugccgccgcacgucgcuuccagccacaccgccacuguucuuccgccaggcggcgccgcagguuggucacgcgcuuugugcacagccgcgcuggcgcuccggacacgucaccaccuucgcguccuuucuggagagcgcgggaaggagggcgcugcggguggugacgucaccgggguucccugcgagcucgcgugggcggggcuggggacguggcgaccgccgagugucgagcuggaggggaggagacaagggagacgagggggauggguaggggagaagggccgaagggaguaggaagggguggaagauguaaaagaggugggggguagaggaaaguggcugaagaugggaagggggugcggagaggggguaggggagagccgggaaggaaggaaguguggagacgaggggaaggccggaagaguugggggaggggauuguuuaaggggagaggcgagaaggaggggugggagagaaaggaggagauaguaggagggacuuagaaagccugcccuccuuuccccuccaacgcaccuuacacuagcacagcucuugaggccuccaaggugucuguggcuccuucccgcaguagaccuuccuccagggcagccacguucugccuccuuuaaccaccaucaaucaccucaggaacaaaaggaaugguaccucaaaagacuugguagucccuaaccuuaaccaaacccgggaagguuuuguguucuguucccugacuguuaauagaagauuuuccucuuuaccgccccaguaagccucgagcccucuggguggcaaagggguuagaaaugggaccugcuucagaacucaagguggguaccagaguuuacccgaacaccagucuaauucuuugucacuggcggcacagcacugacgagugaccuugagguacccuuuugccccacagucccugacuuccagaaagaauggaauaagaagcugaggucugggaaccaucaucugagcugagaaaaauggauucccuguccccuuaguagggacagaguugaacuauggcuacuucuccagcucuuauuaggguuugggccuugugcagagugaguauccagcuccuccuggaggguguaagggaugcugcggccgcccggccugccugccugcccgccauggucuccuuuggucacuccuguccuguuuauuaggacaaggcuaccuugggcuucagaugaaagacagcauuugagguauaauaaaaaguaagaacccagaggggaagcaguccuuccuucauggccuucagcagggugggcuaauaauagaaggacucuguauuagcguauuuaucggggucuagcaguagucaccccuucuggaccuguuauuccuacaaacccacaaugccuguucuccaugcucugagcacagcauccuguacauaggucuuacuagagaaggcuacaggcuggaaguugaguugacacacagcuuuuuagcccuaauugucuggucuuuuaagauagggucucacuauauagccuaagcuagccucacucuugggaugccugagccuucuaggacuggaauuacagguaugcacuguccugaucuccccucuggucaagauaauggaagaagugugggggcagacaguugaauguguggguguuuuguaguaguucuuuggagcccaaguuuuuuaaguagaugcuuuuuuugcuuuuuguuuguuuguuguuguuguugggguuuuuuuuuuuggggggggggucaaggcagucuguguaacccuggguaucuauagaccaggcuggccuggaacucagaaauccgccugccucugccucccaagugcugggauuaaaggcgugcgccaccacggcccugcaaguagaugcuucuugacaggcagcuucugucucauguccagagacuuucugagccuaguugauagaaccuguguagauagaacaagaccuuuccuccugccuuggcuggaaaagcaaugguuccuauccugagucagccaucgugcuguugggaccuguaggcacaggcccuugggaacagacugcuaaggguuugagcaggaccugagucuaaucaugugugucaggaacugccuuggagagcuggggaugcagcuuagcugggggaaagcuugcccaauaugcucaacgccuuggguuccauccccaacaucauagaaacuguguggugccuccugcauguaaucccaacauucaggagauagagguaagagcaucaaacucuucaaggucugaccaagccagcucugucagucaacagugucucaagggagggaaggaggauugaaaagaaagagacagacagacagcuuuauaacaugacuccagccagugcugaggcguuuauaccauucuagguacuugcagagaauagggucaguucuuagaucaaagacaagggaaccaaacaagauaaacaaagccccuuggucacuguuuccaggggcuuaucagggugaacaaaaucaaaggaaucccacacuuuccuuggcugaguuuaccuugagcuuugcaucagcccaaaugugaauucuuaucugagccuacuuccuugaacccagugacaaauacuugccaaauuucuaugaguggccccaagagcucuccacauaggucugucccagcuacuuaggcacuucagaaccagccugugcuacugggaacccugguguagaaaaaaaaaaaaaaaagucuggagagcugacucagcaguuaguaauaucugcaacucuuuacaggaccugagugcaguucccagcacccauauggugacuaacaaccaucugcuucacccugacauuacagguauaaggagcaugcaugguacacagauacaaaugcaagcaaaacuucauacaacacuuuacaaauauuaaaaaaagaaccaugaagaccuaaagggaguuuggucauccuaagaauugaaguaagugcugccugggccuaaccagcucuuucuggggaacuugaauuugaugaucuccuuggcuugguggcuccuguggcaggagagaggagcuccgguccacuguccucaguauguuagcaacagccaguguuuaguuuacagacucucagcucugugaacugccuaaguagauacuuucucaccuuggaccagcaugaaaguauuucagccauauugggcccuucagaucagcucuggcugggcagcugugggaaaggacagagagggaaagcaggaagccucccucccagugcaaggcaaccagcaucuacugccggccucuguagcuacguucaggaacaugauaucagcacaaagcagagaguagggaauucuagaugaagggucaggccgacuucucugggucagggagggaaagcuggcuggggguggggagguguugcagacgagcacaguaccuugagguggagaggaaccuuuaccaccacacugggaaaguugccauuggaacugauacaggccuggggucaucugagcucucagccgccaaguccauggaaaaacacggcuguagugggagagggaacauggcccucacugaguacuugugcagccuucacugucaggcccugggcuggacaucggcuacagcaacgaaagcuuuguucccaaaauguuucuauccuugugaggagaaaccggacacagaauaugagaaugagaugcaguaugucagacagugacaggugcuguugagaaagucaaacaauggagcaggaggagguggagcugguucccuccuugcugcuuuuaaagcaggaugugggccuucuuagugggcaggacuacaccaaagggcagcacaccacaagcccucaagcucuugcccagguagcugggauuggagaucuguuugagccuaccaacuucucagccaccaugguuucauuuaagccccuuaugacagcuuauaacugaucucagugcucuggaggcuggggcaggagacccagaguuugaggucagccuaggcaacagcagagcggauagggaugugacucuguuggcaguagugcuugcuuugcacauacagugcccuagguuagauucccugcaucauccauaaacuguacauaggagcacacacuuuuaauccccacacugagagggaucaguucaaggucaucuuuagcuucacacauccuuagcucaagcuagcuuaaagcaaauucaucaacauuuauaaccccgaugcuuugaaauaaggaucuucaagccagcaggaaaccucugccuuucuuugcaaugcuagagaaugaauccagggccuucugcaugcuuuguauauggucuaccauucagcuaccuccccagcccaggauagggagauugaauauaugcgauacaaccauagccccaagcuccuggcucucaacucaauauggauagauauggugacauauccauggacacacuauuuuccaguuccucaaagguacccugacuacagccucaggaagucaggcaggcauggguguccacuggaaagggucagcucccauauaccuuaaggcagcuccuauaagcagcaggcugugugcaggacacacacucggcuccugugacucuauuucauuuuuucuauuuggggaggaugggguggguugggggcacagugguccuggaacucacacuguagaccaggcuggccucuaacucucaggaaucaaccugccucuggaauguugccauuagagggguaugccaccaccgcucagcuuacuucaaacguuaaaugaauuuuguuugagaaaaucuagaaguaaagaagucccaaggccuucguguguugggagcugaccauguuuucucuagagauaaauuuauaaggaugacucacugggagaaaaaauaagccaugaucuccagcuggaacucgauucucugaaagcuagguguggugacaggaaauggaacgucacccugaguauaaacacaaguuccaugaaaauguguguuaccugugggcugacagaagugagcagaagagcugaagaagcaccuucucaccuacugguccuccucagggcauggcaguaggagcauggagggagggauuggcacugagaggaacucauggaugucugcagccgccuggaggccggucucccuuuaccuaccucuucugauacuaccuccaaaacuacaguguccgucauuccagaaaucaaccccagaggcauuccaaagacacugucaccuauauacagucaaggaaguaguuuguggucaaagcagggaaaaucaaauaugagaugaugugaauccuaaagucaacagauccugugacaaagcuaagaggcacucuaccagcauugggugucuacacuaaccugugaggccucagaacagaugaucuccucaaagcugaggagaucgggaaugagcaugagacugcacaacacauuaggaggucugccugcugaacucuggcuaguaacucacauuccugauaucaccuaccacccuaagaaaguacaccagaggagaaaauacacuggcuuccuaacagaagggaagcuggaagauaggguccuagcugacucuacuggauuccuucugugccuuuucuaacuccccugccugugaaguucuaguccugcaggcucagacauuguguaaagagaggauucugggcccuucccuuaacugucucgcuggccaccuuaaguuaguugaugauauccuuauguaaacaggauucuccugcacagaggacuuccugggaauuauacucagugugcaggaaacaaagugugguaccugcccccaccaccaccacaguaacauguagucugagaacccgagcacaucugcaggguagcuagugcuuuaaacuaaugucugggcagcacucaugagaaaccaucacaccuauacuugccuaaacugucagcugccucucucuaauccacugcuggaguuccaacggccaugacuucccgcuucccacuggcacugcuuuaguucagcagcuccauccuuuuucuggacucuuggcauaguugauaacuugucuuccuguauccacucuccccuuacuguaacucuacuccauaaguuugggguguuggacuuugaacuauccuguaacaaggugcuuguuucaaauucaccaugcuccuuuguuuaaaccccucucagaguagagcucgggcacagugcuuuucuagccugcaagaagccccaacacccaggagcuggaggcagaaggaucagaaguuugaggucauccuaugcuacauagugaguuugaggcuggucugagugacaggaaaugucucagaaacaaaacugaaucuuucaaaggcuccuccagguuuuacugauaacuguaccuguuacuuuuacuuuaaauuucuucaugauacacauaagauccugguuccuauggaauggaaugcagcucacggguagggugcuugcaguguguagucaauggccaagaugugaacuccagcaccacaagagaccaaaacagccccugagccggcuuuauucuguccauucuccagccauccuccccuuuccccaacgugcucccuuacucucagcacucaggagguggagccaggcagaccucugggaguuugaggccagucugguguacauauugaguucucuaacagccagagcuacauaaugagaacccugucuacacacaugcagacagagagugugugugugagagccucagcucagccaccuuugcacuuccuacagugcuccaaggcuagguauguuuucguuugcugggguugugauuugugacuggguaaaugaguaggugagcccugucugcugcugcacuccacugacaagcccgaaguugaucaggcuuggucccaacaccuccaggcucacugcuuaucuugcauagugaauaacccagcacuacguuuugccaggugggagacaugcaggccccucauaguccugccucaucuuccccagugcuggaauuacuagcauuggacaccauaccaaagggcuagaaggguuagggauggaguugaggguuaauacguuaauaccugcuguugaaugguauuuugcaaacuugacaagagucucugugucucaaggccaccuucuggcaucuuccaaucuuucagugucacaagccaggauguccugucaggaaaccugaguaacaccagccucucucucugugggugagcuuugugggggugagcgggggucacuuccuuggaagcuccuugcugcuucugacaggcuuugcugagcccugcaagugugcuggagagugaccagccuccagggccuucugcucuuuguccucagcaaucuaaaggcacucaagggaaggaaggugcauccucucuggggaggaauggauuguucuaaugucugcgaucuggccacacuuggcaucugugaaagcaacuugcuuucagagcacauggagcgcaccuggcagaggucucagaucacaugcaugagcugaggaauuguagcuaaagaaagcuaaaagcuggaugcuauggcugucagggucagauuaaugaguuauugagguugugugaauuaguuuauacuucagcuaucugugaucuuugcaauauaaaagcuaauuccccaaaaacacuuaagaaagagcaauaaagagaggcagaggcaggcaaauuucugugaguucuaggccagcccuguccacauagugccaggaggaauuacauagugacauccugucuuagaaagaaauggggguugggaggaaagcaaugaucauaaauuguauguugucacacacaguguggugaccuuaaaauggcuaauaccaugaaaauaucuacaacuuggugaugugauugguuuacugaaaauguauuuuuuuuuaagcaaaguauuccagacaaugauagccaauugacaacccccuaacaacccucacagaugucagggcaggaauuuggucucauguuucugcccccaacuccuggccucagacagcugcagauacauauuccauguagcuccagucucugaaauaccaaauggaaauuuacuggggcucucaacuaagccagacucucacacaaacuguacugccccaugggacucuccacagggccagauauuuuaugagaacgggcauucccaguugauugggucaacaaaacgaaaccaaggaacugugucuuaaaacuaauguauccuguuuaauuguacacaagggacacuccacuccaaagcaagagccaggcaaaucucagguuuguagacucggugagaauauuggaggcuuuuguggagcuuuguuuucuuuagagagggaugaccagcuggcagggggcuggacgcugccuugcaggaggagggcaccagcagaggagacaggaaaacacagucagcaaaacugcggagagcuuaccagggcucuuggagaaggcacagaaaggagaaucaagggcaagcagcggguuguuagacugucgaccucagaaaggcagcccagcucuggaguuuccaagucagggaagaaaagcagcugcucguggaccuucaggugugggcuguccugaaauggccaugcgaag

SEQ ID NO: 3165 - RNA, 3158 nt, Mus musculus
uguguggcuuaguguuuuguuugauuuucagggcuaggaagcuacucugcccaccaagaccaagagcuacguuuuggaaggacacugggguggcucagaggucaagaggaagagcuacuacagcagacaggcaggauccugggcagcccggaccuucuuucuaaaacaccgugguuuggauacugcugcugcugcugcgcuggccacuaggcugagucuuugcguucagguuucaaauucccaagagaaucugacuuguccgccugggucaggugucuaccacccggucucuuuucuuccccuccuccucucuaccuccucuguccucuucucuccuuuccucuccucucuuccucuccucccucuccucuucucucuuccuuucuccgccccaccccccuuaccguucuaaugcauuccaggcugacuucccuuucuuacuuacuccuuuaguagcccaggaugaccuugaacuugugauccuccugccgcuaacucccuggagcugaaaucacugggcaugucccaccaagcccaguuucuguguaacuaggcaagccagacauaccgggcaagcgcuguacagacugggcuccacccugagcccagagcucugcccuccugagacuuugaagggaaguacuuugugggcacagcaauccccuggauggcuauuuucugguggaaaaguugccaggaguguccugucacucagaagggugaguggaagggucacggcuagaaauucauccuagaguucaggcuguucaauuggguuucaucgcagucagcaguuacaaaggaggugggccaauucgcagugcccaucacauugugucccagaggaauuaaaacccuaguaguccaucggugagggacugcucaggguggggcugcaccacucacucccuaggacccuuagggcucucccuaaaggaaauaaaggccacacacaagauggguuagggugcaaagcugcuuccaaaaagccugccucagauccaucccugggccucaggcaguggaacagaaccggcuggugcaaguuaagcucucuccucuguuuccuauacacacaauacacacaugcaauucaauguguguauugucgcagccuguugcuucuaccguuagggguuucaacugcuucguuucuuucuuuuugggggaggauggaagcaggauagagggaauuuuuuguuuuguuuugucuugagauagggucucauguaucccaaacuagccuugaaucugcuauguagcugaagauaacuguuuuauggacugcuggggaugaagcucaggacuuugugcuaggcgagcacucugccaacugagaccuugaacucucugagacuacaaguguuugcccccuccccacccaaccuguuuuauucaucacaucucuacuuuauuugaaauuaugugugugugcuaaugaguccaauugcccucaggccaaagagggcagggcguuggcucaugcggagcgguguuacaggaggucgugagcgccucacauaagugccuggaacugaacugagguccucuggaagagcaauaaacauucuuaccguguguguguguguguguguguguguguguguguguguguguguguguguguugucucuccccuugaguaaccuucuccugaccucuuugucacgguguucagugaguggauaaagucaccugaggagucuccagucucaggcuacugccagucugucuaucuguccuccugccuccagccagucuucauguaucuguaaggaauguaucagguuaguuucuuuggccaggguaauaauguuccuuuuaacugagcucuugacuacaagaauagccaagcuggagcacauucuggugaagguuucccaagucaaagcaaaccccagggcuaggggcaagagccccucccccugccuccucacagggaaccucgggauuaaaaccacugcuugggcucuggccuguuaccuggcaaucaaagguuaguucagccagaguggcccgugccucuacagaucugagcucuccaucaccccuuuaccaugggaaacgccugaaggaaaaaaaacagacuggaagcagcaagaucccaagagaaucugccuccuuacagaggugguagaggcaugugugugugugggccuccuuacagaggugguggguauaggagagcuccuuacagagguaguggacaugugggggcuggggggcuccuuacagaggugguggguauguggggggagagggccuccuuacagagguggagggcaugugugugugugucuucuuacagagguggagggcaugugugugugugucuucuuacagagguggugggcaugugugugugaggggcuccuuacagaggugguggguauguggggguagggggccuccuuacagaggugguggguaugugggggaagagagccuccuuagagagguggagggcaugugugugugucuucuuacagagguggagggcauauguguguguguggcuccuuacagagauggugggcaugugugugugaggggcuccuuacagaggugguggguauguggggggaaagagccuccuuacagagguggagggcguguguguguguguguguguaucuccuuacagaggugguggguaugggggagcuccuuacagagguggugggcaugagguaguggugggaagguggauguauggggcacgauaagcaccgugaccaacaaagcuuacucacuagcuauucuugcagaggacucugguuugauuccuagcacucacauggugacugaccuacaacccucuguaacuccaguuccaaaggaucugaugcccucuucuggccucuaaaggcaaugcaugcaugugacacaagcaaaacacacaaacacacacauacacuuuuguuucuuuuuuguuuguuuuuucuuuuuuuuuuuuuuuuugaaacagggccucacuaugucguccugguuguccuagaacucuguagaccaagagccgggcgugguggcgcacgccuuuaaucccagcacucgggaggcagaggcaggcagauuucugaguucgaggucagccuggucuacagagugaguuccaggacagccagggcuacacagagaaacccugccucgaaaaacca

SEQ ID NO: 3166 - RNA, 1843 nt, Mus musculus
ucaaauacgaagcauuuuuaaccaauccauuuguuuaauucuuaaauucuugacauuacagaacuaaacugaaauuuauuaacauuccacucuuacauuucuuaucgacaaacagaaaauaaaauccaugagccaaaaaaacccaaacgaaacuaaaaacagggaaaagcuuauaaaacuaaauauggaucccagcauuaacggcugaacagagaaugugauuuuucuuuaaauucuuagcggaugauaaaguguagaaacugaacacuuacaaauuauuuaaaaccuggaauuaccgaccagaaauuacacaguuggaucaugggaaacagcaggaaggggguuacgagcgaaccuacgcuguucuagcugcaccccauccccuucucagaggaaagccuggcauugauuagauacugggccaggcuaauacuggcagccgagccaguaauagugaccugccuuccagaagagccuuccaccggguuggcaauuuugaucugggccccggacaucuggcggaucucauugauguuggcgccuuggcgcccgauuaugcagccgauuaaguuauuuggaauggugaguucaugggugguuugaguagaugcauccaaacuugcccaauagccuuucaccucuggagagcuggagucaauuccggcgaaucccgucccgccgugcaucauggcaaagugagacuguugucuugccaccugguucagcuuggccagauccagcggagaaaugguguguuguccuugaaucgaguaggcgucuagagguggucccuccaggucguggguggcguggggguagcccgccgcgucgcugcagcgaucuuggccgcccgcgcagaugacuggcgagcuggccggcaugggcugguacgggauggucaugacucuccccuguggagacugggagagcgucuccagcaugaccaggcagaucugcuucacacacucggugacggacugcggcacgccggcgauagugauagcccgcucggucgaguugggcagcauaucccccgccaccuggaccugggccccggugcucucgcggaucuccuugaucuugcagccgcccuugccgaucagggagccacacuggguggcgggcacgaccagccgaagugugaccgggggccugcuggccgccguacuguuggucauggagcuguugauaucuuccuccagcuugucgaugaucauggcgaaggccuuaaagauggcauugguaggcccagucagcgugaugauccucuccgggcaguuccccuccgagauguugauccgcgcgccgcucuccucgcggauccucuucaccgacuccccuuucuucccgaugaugcugccuacuuccuuuccgugcaucagcagccgaauggugagagucacguugaguccgcuuucagucacaccggcguccauggcgagcggcgggcggcguucgggaguugggcucguuacguggucaaguccugggcggcuggcgggggaggggaggaguaggcccgaacugccggcgcgaggcgagcggggggccgcaggagcgggcgggcgcgggcgggaggccgcggcggcgucgcaggacuggcggcggcggcgacgggggcgagcgggaccgggagcggucgacgggcgggugggcgagggcgcggcgguggcgacuccggcggcagccucggcggucugggcggggcgggaagcccgcuuucaaccccgcguacccucugaccccggaagugcuuuccgcgcaggaccccuaggagaaaaaaaagaggaccggcuuuuuuaggucacaagacugcgccagcgcgcgcgacccuugagaaaaa

SEQ ID NO: 3167 - RNA, 57240 nt, Mus musculus
ugguguguuguccuugaaucgaguaggcgucuagagguggucccuccaggucguggguggcguggggguagcccgccgcgucgcugcagcgaucuuggccgcccgcgcagaugacuggcgagcuggccggcaugggcugguacgggauggucaugacucuccccuguggagacugggagagcgucuccagcaugaccaggcagaucugcuucacacacucggugacggacugcggcacgccggcgauagugauagcccgcucggucgaguugggcagcauaucccccgccaccuggaccugggccccggugcucucgcggaucuccuugaucuugcagccgcccuugccgaucagggagccacacuggguggcgggcacgaccagccgaagugugaccgggggccugcuggccgccguacuguuggucauggagcuguugauaucuuccuccagcuugucgaugaucauggcgaaggccuuaaagauggcauugguaggcccagucagcgugaugauccucuccgggcaguuccccuccgagauguugauccgcgcgccgcucuccucgcggauccucuucaccgacuccccuuucuucccgaugaugcugccuacuuccuuuccgugcaucagcagccgaauggugagagucacguugaguccgcuuucagucacaccggcguccauggcgagcggcgggcggcguucgggaguugggcucguuacguggucaaguccugggcggcuggcgggggaggggaggaguaggcccgaacugccggcgcgaggcgagcggggggccgcaggagcgggcgggcgcgggcgggaggccgcggcggcgucgcaggacuggcggcggcggcgacgggggcgagcgggaccgggagcggucgacgggcgggugggcgagggcgcggcgguggcgacuccggcggcagccucggcggucugggcggggcgggaagcccgcuuucaaccccgcguacccucugaccccggaagugcuuuccgcgcaggaccccuaggagaaaaaaaagaggaccggcuuuuuuaggucacaagacugcgccagcgcgcgcgacccuugagaaaaauaacccgguggcaccgccgucggguugaaaacggacaacgugggcaaaacuggggacccggcagagauugagagggagcacguguuuuguuaacccuagcggcuccggcaggggacugggaaaauauacugguuuugugccggggacagauaauuguuucccgguccgcccaaggauucgauggcggagcgauacaggcaucggcggaggccgcugcaggcgggagcuaggccgccgcgggucgaaaacgugcgcgggaggggaccagggcgcaugcgcggcagcgagggggggcgcgagcggcccgcguuggcuuccguggggggaggggcggcgaggcgaggcgcggcccggcggcugugcacgcgcucugcugggcacguggggccccuucguccccggcguccgggcgccuggucccagcccccaccuuggccuccguccggcggcugcguccgcgacgcagagagacucgagcgagagucacccgccccggcgagugccgcucgggcuaguggcguuaggaacgggggccgcuggaauggcguccacuuacauaaugcuuuguuugcacuuggucggcuccgguuagggaagcccucggaggcgcuaccuccugcccucguguuuuaugucccacgauaguucccgagaccuuagaggagcggugcgcacugacggcgugccggcauggccccccgcauguccgcgcuggcucgcccgccgccuggaccacgcuuucgggaggcggccaagccugggcgccgccgccaucuugggaggucgcccugaccgaggccucccgccgggaaauggcccucgagacgcuggagagcgccuugugcuuucuuugccggcuccucgugccgccgccauagucagccuggaggaggucgugugaaggaacguguuguuuaauacuuggccgaaaggaccagcguggcguuccucaccccaccgccaccccacccccgagcggggagggcuggcggccauguuucccaacaaaauggcgacacgugucgccaucgaaaaauugggccgggucugaaagcucuagaaugugccuuucaucagucucagaauuucccauaggaugaaacagcaagaggugcuuuuggaagaaaguuaauucccuuggugggcaggagaauaaauaaaaugcaggccugacacgggauuuuuaaaaaacugaguaauggcaggcaggugugugccugugugugugcgugcgcgcgugugugcacaguauguaaccaaguacccaagcaucuagaaaaaauuucuaguuuuuuucuagauguuguacagguggugcuguaacugauuuaagauuguuaugccuaauaagccauagaauggcaaugucucacuauucaacuguccagugauccuaaaguucacaguuauguccacuuuuccaccuuuacagucaagaggaacagauugugggugugggugugccacagcagauuccauucuaaacauuuuaucccaugcaauauauauuuuuuuuaauugaaaauuccaugaaguggguauuuauuucucuuucuuuuccccaacagagcaagacaaucccagagagaugaaugaagugaaugacccaagguuacacaggauggaaccuauaucuucugauuucucuacuggugagcaccuuuugcagauuuuuuuauuugaaucagaguuuuagaauuuaauuuugcugagcugguuaucagacauaggaucucuaacuuuuuagccaagcugucuaccacuacgccacaguuuugugugugugguuuuuuuuuuucagugcagaggcacugagcucuggauccuccugucucacuucacaaacacuggaaugacaggaugugccaccacuggcauguugagggcaugguaggaaacaccuuuaaucccaucacuggggaaacagaaacagguagaucuuugagaauuugaggccagcuggggcuacaaagugauacccuguuucaaaaaaaaaaagagaaagaaaagaacugacuugugugaacuugucauuucuaaaggagccacucagaaccccccccccccccccccccccccccgccccgcaccuguuuguauguuccgugccuucacuuauuccugguguuagugacauuuguuuaggcucaaauauuauuuuacaaagccucuggaugaggacaggaagaggaugugauucaggcuugcccaaaaguucaguaucuguucaucuggccucaucugaggcccauuucccuccaccuggcuccaagggagcaagcgagcaguucccuagagacuugcuuuccucaguugcuuguggauggauuucugguuucuccaucccaguccuuuaagcagauaaaauaaguuacuuuaccugguuccaaucaucuauuucucuuuaaauauugacagagcauggaggaauauuagauaaaucauaacuugugacuccucaaaccaugcggccuucacuauucaguguauucaauuaaguucaauguaggucauaaaucagcuuuuuucguaaaagcagcacagaugcaugugguauggaauuauaauuacagagagguuauaaccuucauuuaaauuuguuaaauacucauggaaaugaguguauaguuagguauguuuaaauuuauuaaacucaccuggucuagaaggugaggguacuucucaggaauagacucaagcucccaauuaggucagcuauuucuacccauaauuccuaaaaucauguacugaagucugcaaauagcuauuuauuaggcucacauuuaaaaauuagguuggguuuuuguugucuuguuuuaagacaggguaucgccauguagcccuggcuagccuggaacuucuuuugcagaccaggcuggcuuugaacuccgagcgauucaucugucugucucugccucuccaaaguucugggaauaaagauguguagcaccacacauggcaagcaaaagaagacuuggggguuuuuuuguuguuguuguuuuucaagaaagaguuucucuguguaacagcccuggggcugucuuggaacuuagucuauagaccaggcucagcuuguacuccgauguagguaguggauagcgcaacaaacauguacuggaguggcuguggcugugugggugucggagagaagagcuuuuugauugaaauuacauuuagaucacaugucaaacuuuucuuuuuucuuauauauuuuuaaaauuuuugucuuuuuuauuuuuuggauuuuuuuuuuuuaagauuuauuuauuuauuauauguaaguacacuguagcugucuucagacgcaccagaagagggcaucagaucucauuacgggugguugcugggauuugaacuuuggaccuucggaagagcaguugggugcucuuacccacugagccaucucaccagcccuguuuguuuguuuuugagacaggguuucucuguguagcacuggcuguccuggaacuaacucacuuuguagaccaggcuggccucgaacucagaaaucugccugucucugccuuccaaguuuuugucuuguuuuguuuuguucuuguuuuugucuuuugagacaggguuucucuguauagccuuggcuuauuuauuuuauguaugugagugcacaguagcugucuucagacacaucagaagagggcaucagaucccauuacagaugggugugagucacaaugugguugcugggaauugaacuaaggaccucuggaagagcagccaucuguccuguccagcuggugucaaacuuuucacauuaacauuauguuaccucuguccagagcuuuagcagacacacaguagcagcuaugacaauaccagcaugcagaccucaguguguaccacacuguccugagcauugcaagauguuggaacucaaggcuaagcacaguguaaaaagagaaauauuauaagaaauuuaaaugacucgcacauauguauacacacagauauauaacaaaacuaucauaaaagagaauugcuacuugaaauauacucuagaaauuucugcggcccccccccccccuuuguuguuuuguuuuucgaaacaugguuucucucuauagcucugguuauccugggacucacuguguagaccaggcuggccucgaacucagagauccgccugccucugccuccugagugcugggauuaaaggcgugugccaccacugcccgacaugcccauuucuuuauaauuaaaugcccauccgcaagugaugacagauacacauuuagucuuuucagaacuugaaauaaauggugacauuuacaauuuucagacauaaaagacuugaguauaggccauuugaguuugaaagcuauaucuuaaaccccuaaacuacauacagauuuugaugggugccucuuccugcauagugacccaguagauuaaggcaucuaaaauauuaguacuaaaaaagucauguaauagaggcaggcauggugguacacaucuuuaaucccaacacucuguaggcaauggcagaggcaagugggucucugaguuucaggcuagucugguuuacauagugaauuccaggccagcuauggcuucugucucaaaaggaaaaggcaacaaacaaaagaaaucagguaacaaaaaaaugaaauuagauauaaucagggagucuccugauucauaaaauucuggcuuuauuaauuuaccaauuuuaaaacuauuaccuggggcugcagccuggcuuagcaguuaagccaccucuuuuaaagugccugcuuuugaauuuuauaacccaguugguggcucacaacuaucuguugacuuuaguucuaggacacuggaugccuucuuguagccucaggaggaaccagggaugugacacacagacauacauugaaacaaaaaaaaaaaccaauacacauaaaaaaguauuuaaaaaccacauauaauauacagcuaaauuuuuuugauccaauuaggcuuuucuuccaagucuaccuguuuaaagucuuuucuuuugccugaaauauuuucuuuucuuuucuuuucuuuucuuuuuuuuuuuguuuuguuuuguuuuguuuuucgaggcaggguuucucuguuuagcccuggcuguccuggaacucacuuuguagaccaggcuggccuugaacucagaaaucugcuugccucugccucccaagugcuggcugaaauauuuucuaacuuccucuuuuuaaaaaaaaguuauuuuuaauauuuuuauuuuauuugaauguuuuugucuacaugugugaaaauguaucaucuauaugaagugccugcaaggcuagaaaaggacguagguccccuggaaguagaguuacagaugccugugagcugcugugcucacagguauuaggaacugaacuugaguccuucuggaagaguugcuaucucuccagcuccccugguuuuuuucuuaacugaagaccucuaggacuuaguguccuuuuucagggaagcuuucccuuucccaggucucucaacauucugcuugcucuuuccuucuuccagaauacuauuccuuuccuuucaugggcccauauuuugcugcaaaguuguacagugauccaucagguuuuaacuuaugcccugcagguuacaggaggcgugggugauccuaugauucagcaaagagagcucuggucuuuagagacugaggaucuaucuuuccucugggauucauuagcuuugagacuuguauaauccuacugucugggcagcaguguucccauaacaaaaggccaacuaaucuccaaguucuucuuuaauuuuaucuugggugugauauugucugauggucuuguuuguuuauccuuuugguaaauccaggcauaagaaauaaugagcaaauucuuuauuccccuuaggccugcacuccacguucugaggaggaguccuugaagcuacugagauaauggaacaauggaguagauaguccauuauaacucaucugggauucuucucaacuucaagugaccacagguugguuaaggggcuuaacaaggcuaggaaagucaauuaggccuaaaguuuguaaguugaauggcaggguuuaugcuucauguuauuaaauucacuucacagaagagcuaucugugagugagaaaagacuugcugaaaguuagacaguuuguuagggugugagguaagucucuugacuccuauuccuuuuuuguuuguuuguuuguuuaugccuguggcuauaacuuugaccauagaaaaguaucaaacucaggaccucccagcuaaucuauuuuuugucucaggacauuuauuugaauuaccuuagacccuugacuuuguuggguuaagagacuuuuguccccacuuauucuuaaauguuugcaucuauggguuugagaagggaugggaugauucuucacucaauucccugagauuugggugggagcugaguggguagggaccacaauuuucucucucugauccagcaaguauaguacagcuauuuaaauuugcuaacauguaguguucuguuuuguucuaaaaacaguuucaacuuuuucuuuucacccuucaguuuuauccaccuuuucuuuuguuauuguuauuuucuuuuauuguuguuuugaaauaaggucucacgauaucuggcuuaaaauuguagucuucauaccuuugucucucucugaagugcuguaaucucacuaaacugcuucuuuauuuauuucuuacuuauuuuugagauggacaaggucucauuauguaguucuggcuggccuggaacuugcuauguagaucugacuggccuugaacucacagauauucaucugcuuuugccuccaggaugcugggauuaaaauccugugcuaauaugucacauucacuuuuauuuguuugaagauuuauuuguagcugggcagugaucguaucuggccucuaauccuaucacuuggaaggcagaggcaaguggaucucuuaguuugaggccagccuggucuacagagugaguuccaggaccacaagagcuacacagagaaacccugucuuaacuaccccccccccccccaaaaaaaaacccagcacaucuuuauuuguauauguacauguuugugugugugugaauguaugcucacauauguuccaguguuugcagaggccaaaacaggcuguuagaucuccuguagcuggaguuacugauuuuuuuuuuuuuuggguuauuccagacaagguuucucuguguagcccuggucugaacucacucuguagaccaggcuggccucgaacucagaaauccaccugccuuugccucccaagugcugggauuaaauaguuacagauuuuuaugagccucucacaguggauacuggauccaaacucuuguccucugauagagcaacaguguuuuuuguuuuuguuuuuguuuuuuuaaagguauauuuuuuuucuuuuuuuuuuuuuuuuuaauuuauguuuuuuuuuuugagacaggguuucucuguauagcuuuggcuguccuggaacucacuuuguagaccaggcuggccucgaacucagaaauccacaugccucugccucccaagugcugggauuaaaggcgugcuccaccacacccgguuuaaagguguauucuuauuuuauuuuuaaaauuuuuuuaaagauuuauuuauuauuauauguaaguacacuguugcugucuucagaugcaccagaagagggcgucagaucucauuacagaugguugugagccaccaugugguuucagggauuugaacucaggaccuucagaagagcagucggugcucuuaacuacggagccaucuuuccagcccaucagcaaguguuuuuaagcauugagccaucucucugucccuuauuucauuuuuauuuaaaauaauauucauguacacaugcaacacacacaauuaaauuaaaguuuguuuuuuuuuuaaagaauuuuuguuuuuaaagguuuauuuauuuauuauauauaaauacacuguagcugucuucagacacuccagaagagggagucagaucucauuaggaugguugugagccaccaggugguugcugggauuugaacucgacauucagaagagcaguugggugcucuuacccacugagccaucucaccagcccaaaguuuuuuuuuuuuaacuuuaauuauauguguauauguuuaucuguguggguuuauacacaccaguacaguucccacagaggccagagaaugaguuguuggauucccaggaggugaaguuacaggccauuguauacuaauugauguugguugcugggauucaaacucagguucucuaaguuacuaaccaucucuguauuaccuaaaaacuuaaaaaaaauuauuacuauuuuguguguguguguguguguguguguguguguguauguguguguaugccuguuugucuguauguauaccauguguguaugcaguacuugguagaaaacagaagcauguguuagaucuucuggaacuagaguuguaagaggcggugagcugcccauugugggugcugggaacucagguccucuauaugagcucaaaguacucuuuuuuuuuuuuuuuuuuuuuuuagauuuauuuauuuauuuuauauauaugcguacacuguagcugucuucagacacaccagaagaggucacaaacacaagaagagggcaccagaucucauuacagaugguuuuaagccaccaugugguugcugggaauugaacccaggaccucuggaagagcagucaguguucuuaaccucugagccaucucuccagccccaaaguacucuuaacuaccacugaucuauuccucccuuuuguauuuuuuuuagacagggucucacuguguaaaccaggcugacuuugaacucagagcucugccugccucugccuguggagugcugaaauuaaaguauaugcuaccacaucugacuaaauaaauaaauaaaugaaugaaugaaugaaauuaauaagggcugaagagauggcucaaaaguuaagcaugcuugcugacugcccugucacccaugggcaucuugcaacugccuauaauucuguuucuaggucaucugacaccaauaucugaugauaucuaugugcacuaauauacaugugguacuugaccauacacauagacgugaauaaaaugauuacaguagagcugggcguguagcucagugguagaauccuggccuagugugccaaggcccuggguuugaucccuaccacccugcaccccaccuacaaauaaagaaaaugugaccugagaaaguacagcuuagaaacauguccugccuacauugcagguugcagcaguuuggccucauguccgggugaccuguuuucuguuaggaggucauauguuauaguaucauacagagguuagcgugguuacauucuugcuccaaguucucccaguugguuaugaugcccacagauacccaacuaguaaggcauguguauggguauguagaggcaacuuaaagggaaagaugagaauacaauaaaguagaaaagauagaaaguaaggaagugaaggaaaggaaaacccugaaagaauaaggcaaagaaaagagaagacaugauuggugagagucaucagcccucuagcuaugugaaugggcacuaaagacaggagcaggcaagaccauuucuggguuggguuuggauuuuuuuuuaagucgcuggcuguggugguacacaccuucaaucccagcacucaggaaacagaggcaggcaguucucuaaguuugagccuagcucggucuacagagugaguuccaggguagccagggcuagagagaggaaacugucucaaaagacagagaaagagagagagugcaagagagcgagcaagugagggagggagagaggaaggaagggggaacuacuauuuuuauguguauggauauuuugccugcauguaugucuuugugccuguggagggcagaaggccuugggucaccuggagcuacaguuaugacgauugugagcugcuguaaggguguugggaacccagguccucaggaagagcagcagugcuguuaaccacugagccaccucuccagcccucuuauuucccuuagcaagugagcauuuuuuuuuuaaagauuuauuuauuauuauauauaaguacacuguagcugacuucagaagcaccagaagagggcgucagaucucauuacggguaguugugagccaccaugugguugcugggaucugaacccaggaucuucggaaaaguggucagugcucuuacccacugagccaucucaccagcccagauuuuuuuuuucucuauccccuggagagaagauuucuaggccaauaauuuuaauacuagccuaaauuaauuugguuuaucagucauagaugaggacugggauggagauauauaucuguauuuucaguacaugggagacugaggcaggagaauaaugaguuugaggcucgucugagguaucaugugacgcucuaucucagaaaaauaaggggaaaaaucacagaaaauauuuuaacuuaaaauucauuauauuuuuucaguauauaaucacugauuguuugaugugccuuuaauauugggaucuaagaaagaauaaagccaaguaguagugacaggccccuauaaucuaauggaaagcugaggugaggauuucuguaagaucuuuucucaaagcacuucuuauccuuccuguuucccaccccaccccacuaaaggagauuuuuguguuuacuuuucuuuucuuuuuuuuuuuuauguauaugaauauacuguggcugucuucagacacaccagaagagggcaucggauccauuacagaugguugugagccaccaugugguugcugggaauugaacucaagaccucuggaagaggucuuaacugcugagccaucucucuagccucccugauuuccaaauuaaugguccagaggaggaaacagacccaggacagcauguuaagucuuaggguauaaaauaacagagggugcaguaggaaugcagagaagagccuuccuuuagcuuugggagaaaucugaugacauuugaagucccaccaguaaaguggauagucgggagagugacaucggguaaccaaacaaagucagagagcgcacagucaucccagucauggccaucucagaagggaauggaggagguuugcauuacuaauuuucagugauuaucuuucugcuguuucagaaguaugggcuauuuauuuacuuauuugaagccaggucaagacccuggcuggcuucagacuaucuaauagaggauggucuugaacuccugauuguccuuaacuuccugagugcuaggauuauaugcacauaugccacaccuaauuuaugugguucugggguagaggcuuugugcauauuaguaagcacuucacuaacugagccauaucucuaacccuggguuauuaaguuuaacuauccuugccugaauguacaaagugaaaguguuuguuuuggagaaguacuuaauaacaaguuaaaaauaucugagauguuuuauuuugagacaauguuucuuuguguagcucugaauggcggggaauuugaccaggcuggccaugaacucauagugauccuccucacucuaucccgaguccugggauugaacauguguaccaucacgcugagcuugcuuuaugaauuggagacauagucucaguguguagugcaggcuggcaucacuguguagcacaugcuggccuggaacauacuauguagccuuugagugcugggauguagguguucuccaccaugucuagcuguuuguuguuguuuuaaguaaaugagucuuugccugcauguucauaugcgcaccacaugugucugguuuccaaggucagaagagugauuuuccucuggaguuacagauggugguaaacuaccauauugguuugaaccacaguccuguguaagagcaagugcuguuacacugacggacugucaggguuugguuuuaaggaagaauguguauguaagcuuaggucuucauagaguuggcuaggauaaaaauuacaaagaaauugcuuuuuuuuuuuggagacaggguuucucuguguagcccuggcuguccuggaacucacucuguagaccaggcuggccuugaacucagaaauccgccugccucugccucccaagugcugggauuuaaggcaugcgccaccacaagagcaauuucugcccagugagaaauugcuauuuuauucagaacaauagaaguauguuucacuagguaauuucucugaugccaccuacuaagcacacgagucaggcauugucagcaacuuguuuuuagagaaagacaaaccagacaaagcauuaguucaacuuuauucauuguuaaaaucuauugucucuaggacugcagagauaacucacaguuaaguucacuggcugguguccagaggaucugggcucaguucucagcagccagguggcacuuaguggucuguaacuccaguuucaggagaucugaaaccucuugcuuccacuggcauugcaugagugugauauacagacauucauggaggcaaaacacucauuuguaacaaaguaaaaucuaaaaagaauuccauugaccauaucagcaauaaaggguugucucuuauaggugguugagcagaggcgccuugguuuccagaauauuuguauauacacagugaguguaggguguggaacuccagucugaaugugaaauucugauuuguuauguacuguacaugaaacuuggaagaacauuuuucacaguauuuguaguguaccuacuucagacucuccaaucacaaaccagaugugaccuuccuacuugugccagcacgccaacuuuuauuguuguuuuugagcuagacucucacuguagcacagguugaauuuguacucacugugcucacuguauucuucuugucccaauuccuugauuauuuuuuugguuuuucaagacaggguuacucuguguagcccuggcuaucauggaacucacucuguagaucaggcuggcuugauaucugucugccucugcuuccugagugccaccaccuccuggcccaguucuuuuauuaaucaccuuucuuucuucuuuuuuuauucauucauuuacuuauucugagacagaguuucaccccccccccaccccacgcacacacacaccaggcuggccucaaacuguggaucuuccugcuucugcuuuccuaaugcuggguuuauaggugugaaguuaugauauuuaaaacacuuuuucccuuugcccaacucuguucuguacucacccaggacuuccucaguggcccugucuucuuucgugucacuuacauccugccauccucucuuguuuccccuauuaggaccuuuuuaagaacuuuuuuuuuuuuuuuuuuuuuuuuuuuuuuuuuuuuagcggauccuauuauuagggcugaagagacaucccaguaagcagaggccagggguuuggaucccuagaacaacauacauuccagaggaagggguugugguagccauucuauaauccaagggcaagggagguagagaugggaucccugaggcaagcuggcuagguauaugagcuaaguugagcauuaagagacccuguucaguaaauaagugaggaaggcuucuaucuaucuaucuaucuaucuaucuaucuaucuaucuaucuaucuaucugaagcaggaucuugcugugcagucuuaguuagcuuggaacucaauacacugacuagacuggccuuaaauuuauauaccucuuucucaugagugaugggauuaaaggcaugugccacuaugccuguugaagugaugucacucucuggucuucacauucaagagcacacgcucgggcuggagagauggcucaacaauugagaccaguucugcucuaguagucauggcugcuuauguacuugcuguugcaguguugagucucucagagugucagauucuaugccuauggcaaaugauacuacucuugugaggauuaaaugaugacuauauaaauucugauaacaggaaaauaaaaagaggaagaggauagaaauuauaugaguguuagaaaauauauaucucugguuuuggaaaaauuguaagaauguaaguaaguauaaguauauauuaugagaguuaacaaaaaggcuuguugguguauuuguuuugaggcuaacugggucucacuuagccuaggcuggcauuagauagcuaaagaacaccauagaugccugauccucuugcaucaaccuuccaagugcuuuguaccaccauauccaguuuacuauauuuuguuuuuaaaacuuuuuuuuugagacaugguuucucguuguagcccuggcuguccuggaacucacucuguagaccaggcuggccucaaacucagaaauucaccugccucugccucccaagugcuaggauuaaagguguguaccaccacugccuggcuguuuuuaaauguuuauuuuuauguguaugcauacauaugugccauauaguacacauggugccacaggauuuguggaggucagagcauaacuuguaggaauaguuuauauccaucuaccauguggguccuaggagucaagcuccguggucagucuucacagcaagugcuuuuauguacugggcuaucugaauggccucaguuuuucaaaacaguugguuguguaaucuagauugccuugaagguuccaucuuuugccuuaguuuccugagugcugaguuaccuaugcuucaacaugccuaccuggugccuccccuuccccccucugucucuguguguguguuuguguguguaugcccaugagauggggugggaggggugugugugcaugugugcauggaguaugugcaccugugcauauguguauacagacuagaggaaggcuuuccuuaucuucuuuuaucauucucuaccauauuucuuugugacaaugucucuuccugaaccuguagcucuuuuuagcuaggauggcagucaccuagcaccagugagaucuuccuaucucuuuccugcaaagucaggauuuacaggucuuuauccuuguuacacagggacugggaucuaagcucagguccuccuacuuacauagcaguucugaaccacucaaccauuuuccaguuccuggacuagauauuuuuaauaaauacuuuccuuucucuguaugcuaguaaaccuuuauagugaaaaugaagaaauggaaguacuagaaucaaauccaaacugcucagggagcugacauccagguagguauccugguuaauuuuuauugucaauuugacacaaacuagaauccucugggaugaggguaccucaguuaucucaguugaagaauugccucagucagauuagccugugucugugagagagugucuuaauugaugggaaagggcucugcccaguauggacagaggugggccuaagcuguauaagaaaacuaggugagggcuggagagaugccuuauugguuaagagcacaguggcuccucuucuagagaucuugaguucaauucccagcaacuacaugguggcucauaaccauuuauacugggaucuugaugcccucuucuggcccgcagguguauaugcagguacaggacucaagaaaaggaaagaaaacuagcaugaauaagugaaugaguacguacauuccucuauagugucuucuuuagcucuugcuugagugucugcccugaauuccccuaaaugauggaccaugaccuggaaguagaaguuuaauaaacucuuuccaccuauguuuggucacagcaacagaagaucaaacuauuccuuuccuuuagugagggugugaucagaaugacagguguaaugcuagcuuuugucacagaaauguugaccagacccugugcugagcacuuuauggaguugcucuuguugguacuuggagaggcggaguaggugaagacauggaagguguggggggcacacaggcgcugguagcaggucucuuaaacagacaguucaacguuaccaguaacuguggggccuugggcaguucuauagaaugaauuacauggccagguacagugcuugacauaguauuuaauaaauaggauguacuucccaaaugucugucauaauuacaguguaguucuuaacagaccaauaaguauagcccagagaaagguaaauccauuuguauaugucacacagcauacagaggauggacugaaguuuguccuagacaguuagacguaagagcuuuugcuguuaaccauucugcuguaucacuuuuuuuuuuuuuuuuuuuugguuuuucaagacaggguuucucuauguagcccuggcuguccuggaacucacucuguagaccaggcuggccucgaacuuagaaauccgccugccucugccucccaagugcugggauuaaaggcgugugccaccacgcccggcuuugcuguaucacuuuugaggaugugagagacuauaccauagagcuguaucuugcugaauuuaaugagucugcuguuucgaaugugcauggguucuguccuccugacccuccuguaugauuuuaagcaucuugcucugccugugucucuguucugagcagguucuucucaagauguaaagaaaaaugaaagggugcuuggugugcguggugacugaagggcuggguguuccugaaccagaagcaggcacugaguaagaccuguaucuuaguguuauaguguucuuuagacuagaaguaggaccucgucucuuguuauguuuaccauuguuguucuuuuuuuucucgagacaggguuuucuguguaguucuggcuguccuggaacucacucuguagacuaggcugcccucgaacucagaaauccgccugccucugccuccuaagugcugggauuaaaggcgucauuguuguuguucuuauguaccucuuaggcaugugugugugugcgcgcgcgcgcgcgcgcgugugugcacauggaggccagaaguagguguugggucccccuagagauggguuguaggcaguugugagucacccauguggcugcuggaacugaacucagauccucuagaagaacaagucccuuuaaccacugagcgucaucucuucagcuuuuaggcuguucagaugaagcuaguaauguugagaagcaaucaguaugcacagagaacucugauguggauuucacaugcauuugucuuauuuaauccauaaaccugugaguagucacucuuguuuuauagugugugaagaggguuaggaggcucacuacagccacauaguuaguagugauagaucugggauuugagcaaaguagucuggcuccagagucccugcucuuagccucuguacccugcugcccuaugcacguguauagguguacacgugcagugcugguugaauaccccacaucugacugagauacuaaggacuaaaaauauuuuuuauuucuuacuuuuuuucaacauuugcaagguuucuuuucuuucuccacucuccccacuuccuuucuuucaaccaguuuagcauccccuaauccaaaaaacucagaaaguauguugcauacuucugugguauaggaggcaguaagggacuggaaagauggcucaguggguuaaaaacaccguuuuucuuuuccugaaaaaugggaagauuuuggucacuaggaauaaaaaccuacaacaacugugcucgacuuugucccaacuuacaccuaggacuucacuuuuagccuucuugcucuuauguaguaaacaaagugcuggguuuagagggucucugagguccuuuugaaugcugacuaagcauuaauaggaggguagcacuacuuagcaccugggauuggagcaagacacuuguaaagucaaaggcggucugauguuucaaggcauuggagaugccaacuuucagaacaaagaaugagcacccuaugagcaaggcagcucuggcucuuuuuugaggcuuauugccaagggagcucagacucuggucaguaacagccagggacacuuuggcugagguuucaguaaggacaaguaaagcaagcacguccccacccccuuccuuuucuugucuuuucaaacuguuggucuuauauccuucugugugugcagcacuguuuuaaguacuugacuaauauccuauauaucuuuauaguaaacuuaggagaguagugaugcuaaguaacaucugcagauaacaaagcugaggaaggcagaguucaauaauguguucacauuugcucagaugguagugucccaucugugccccuagccgcuggguuauauuguuugggggaccugaauaaagcaggagagagagagucuucaguguugucagugacuuuuaaguucaggaugaugauauuuuagagucgaaagaaccuuggaaguguuuaaaugguuuccuuuccugacugcuguccuuuacagaguuuccacuuuccccugacagaugccugccugguucuguuccaggcuucuacugagggcagagggcauuacuuuacuaccuccccaacucauuuuuauuuugagaugguuuagcucuguagcucaagcuagcuuggaauuccugguccuucugccucagccucccuaguacugggaauauaggcauguaucaucaugucugauuuauuuccuuauaauauuuuucucauuggcaaaauauuucucuuuuuuuuuuugagacaugguugguucugcugccuagacucuacagucuugucuuagcuacuaaguacaugggaucacugugacgucaggcucuguuuuuuguuuugacuugaaauuuaguugagaugucucauuaguuuuaggcuagccuggaagcccacaguauuaguucaucuuucacaggcagcuuuagcucucucaccucuaagaacuuugcagccacagcuaaacaaaugugugucacuucuuaucauuauuuaagugcaaagccuuuuccaccguggagaaugaaucuuaggguaugaaguccucagcuuggaaaaugaauggagguggagccucuuccaucucacagaagcugggggauuguagugaagacucugcuguggguuugagaaagucacaaaauggcuggaaguuacuugggcucuuggcaaacugcauuuacuucacuacgccacuaggugaugagcaacucaaagaccugggcagcagggacugccguuuaauggcugucugaagucacagguaucuucacugaaagauguuaaggaugcugagauguacuccuuauaugcguugucauucuuggcgucuagcuuuaaauacuaacuugaaaauuucuuugagugguuuucauaggagagggccaagaguguaaauuaacacuuaaauggagggcuggcaaaguagcuuagagagggauccaugggccuuagaggguggcaggagaaccaacucccacagacugucuuuugauacauggcauagcacacccccccaauaaauaauaaauuuuaggaacuggggguagggaccaggaguggggggugacagugauugggauauaaagugaguaaauacauuaauggaaaaauacauuuuaaaaaauaauauuuaaacuaaaaagcagaaagcaagugaauuucuggaggacaaugugauguuuucacauauuguguauacuuguguucaaauuggguugaauagcacaaucuccucagacauuaaucuuuucuuuguagugugaaaaauuucaaacucuucuagcuucuagaauauagggcauauuaucacucuuuguagucuuucuauuuauauaauauagcccaaacuguauuccuuuauaaaaauuuuuauuuauuuauuauaugugagaacacuguagcugucuucagauacaccaaaagacggcaucugaacucauuacagaugguugugagucaccaugugguugcugggauuugaacucaggacuucuggaagagcggucagugcucuuaacugcugagccaucuuuccagcccccaaaacuguauuccuaauuguaaccucuccaccucucauuucuuucucucucuggcugcagaccaccauuucauucuugcuguuaugagguuauuguuucuuacuuccauguguggggagacuguacagugccuuuacucucauccuagcuuguaucauuuaauguaaugauccccuguugcagucaugcucuugcaaaugacagauuuaaaaccuuuuuuuggggggguuuuguuuuguuuuguuuugagacaggguuucucuguauagcccuggcuguccuggaacucacucuguagaccaggcuggccucgaacucagaaauccgccugccucugccucccgagugcugggauuaaaggcgugcgccaccacgcccggcuaaaaccguuuuuuuuuuuuuuuaauugacugaaaaguauucuguaguauaguuuacauuuucuuccuuguucccccucugacuguuccacuuucuuuccuuuucuccuuuuaaaaacaauguuguuucuuucucuuugagcuggggauaggacccagguccucauggaugcuagguaagcauuccaccagagagcccuggcuugcaguaugcaguugcugucagugcuguagugaacaugggcuauugaugucuuuuucuuugugugugucuaucuuuuggucugcacagagucuuccuuauguaaucugaccucagagcuuacaucuuucugcuuuagccugcuaaguauugggauuaucugcauaucucaccauacuugggcccugugugaguagugucuucaccgcguucaguauucuuuacuauugaucacagucuauagaguagcuuucuggcgucuggguuccuagugaugcagcaugugccaguggccuaaacuggcccuuccucaguccuuuguaagcagcagccuauuauggcuaggagcuugugaauuuuauuuaugccuugaauuuuuucauagagugguaagguaugccuuaaaaaaaaacagauuuauuuuauguauguaaauacacugucccugucuuucaacacaccagaagagggcaucagauuccauuacagaugauugugagcugggaauugaacucaggaccucugggggaacagucagugcucuuaaccacugagccaucucuucagcccugaggugugcuuuuuuaaaaaguagccuugaauuaagaacuuaaaacuuuucuugguacagauguuucccagucuucuuauguuacgggugaggaaacugaaacugaacccagaaaagugcagugacaugucuugagucacagcuagccacaguggaaccucaggcauauaacccaacuccugcugagcuguccucugguauugucacuucacagcaaauggucacuaggaauaaacugaaaaguuuuuacugagacaggaauuuugccacccauuaauggggaaucaggaagagguaguaauaacucuuuauacucaaaauguggcccauuugaaggauucuggaucccuuugcccugaugucccaguuauuggauccucccuguaauucucaaacucaauaaauccagaaaguugcuucagcuuuggagaaaagaguuauugaguagacuggagugggauaaguguguuuaugcccugcuguaaauaguugacaaccuaaucagcugccagagcuuggagacagacacuguaaaccgugucuuaucaguggucuaguuucuguuugcguuccagcuggggacucuucugaugggaaccaccuguuccuggucuuugcgcgcuuuggauuuccccaguccuucaguccuuucaguuuugaaaugaaaccugcucuccuggcuaaggucagguccaagaggacuuugacaguucacaccgacuuguuuuuucuuagagccagcugguaagugagccugugguuugagaagugguagugaaucagcuguuggguaaggacugagcagugucauugcuuuggguaaccaggaaaacaaccaaguauguuugcucaggaagcugaaaguuaagagugcagucgccagagggcugcacaaccgcagccuugcuuuccagaggaggacgucucccacccccaacacccuaccccagguuuagcuacuguagccagcccagacucgccuugaauuccugauuuuccugccucagccuuuaguauuaggauuacagguguauaccaucaugcuuuauuacaaaaaagguguuugggguuuuuugucuuucuuucuuucuuucuuucuuucuuucuuucuuucuuucuuucuuucucucuuucuuucuuucuucccuuccuucguuccuucguucguucguuccuuccuuccuuccuuccuuccuuccuuccuuccuuccuuucuuccuuccuuuccuuccuuccuuucuuuccuuccuuccuuucuuuccuuucuuuccucuguagcugucuucagacacaccagaagagggcaucugauuucauuacagaugguugugagccaccaugugguugcugggaauugaacucagaaacucuggaaaagcagucaauguucuuaaccacugagcuaucucuccagcuucuuguuuuuuuuuauuguuuuugagacaggguuucucugcagaccaggcuagccuccaauucacagagauccaccucccuccugagugcugggauuaaaggcaugugccaccaucaccuggcuacugcaaaagguuuuaucucagcuucuugucuccccauaauaccuccucaccuccuuucugucugagucucuggccucucucugcugcuuugcuguccuugcccuucaccauaaacgucucaccaggacauaacucuucauuuaacucugucuagugagacuggcucaccccaugaccucacuagguugccccaggcucauuucuuagcagcauagaaccauccucccuuuaggauuucugcuggaacaauggcagcugcuuuuguucugcaugcuggcaugucuuccuuugucuuccacauucaguggucccaguuaaagauccaagacaagccugggcacagagguucaggagaaaguauggcauugggaggcuauguuaauauguucagaugugggcaggugcaaagccauauuuaaccaugaaggccauguugggugagaggguagccuuguucccuggcucauucucuuuggggacagaguguagcucaguggugaagcacuugaucccuagcaccacaaacaccaggaugauugguaguuaguaauuuauauggaauguagcaauuucugacuccuucucuuauuccuguucccuggagagaauguguccuuggaauguguaaacccagaaaacacuuaaaaguuauuuuaugucuuuaaaguuuaucuccacaaaugacauguuauauaccauucugauacuuugucucaagaaugggccuuuagccacuauuguggaguacauuuuuuuuaaagauuuauuuauuuacuuaacaugaguacacuguggcugucuucagacacaccagaagagggcaucagaucucaguacagauggcugugagccaccaugugguugcugggaauugaacucaggaccccuggaagagaauucaggugcucuuaaccacugagccaucucuccagcccuguggaguacauuuuuuuguccaagcacucaggaagguagagacagggagaucuguaaguucaaggccugucugaucuauaucguagcaagcuucagguuagacucugucucaaaaacaaaacgaaauaaaacaacaaaaauugggccuuggcaguaucccauguuaguaaauagucauuucauucuuuguggccacuguguagcauuucauaaaauggauagugcuguguuuuauuuagcuacuuuccuauugagagacaagaaaguguuucucuguucuagaugaugcucacugugauuuaaauguuggcuuucucuucugaguuuauugaucucagccuucagccagcuucaguuaccaccuacacgugggugauuuacagucuccaguuguucacagggagaacuuaauggugguuauugugucucucugucucucucuguuucucuuucugucucugucucugucucugucucucucucucuguuuucagugcuggggauugaauuuaggugcucacacaugcuaggcaagugcucuaucgcugaacugcaucaccagcccagguaucuugcauucauaguaagcacagugcgcuccuucucugguaccccauccucugauauggaagcccagcagcaacuagacaugcugucuuccccuuccuggucugaucacuaggcacgcacuggaacugaccuucaguagucuagacauuugccuucuuuguugccccugccuuaugccuugguuuucuaauuccuuagguuaaaugcuguuuaaaaugcuuauaguggucagggagcacugagugaugugugcuggugcagucaccucuaguuggcuccgucugugcauccagucuucuuuuguuuucagacagggucucacugugcaguccuggcuggcccuggacuuccuaaguagauuaggccacagagauuugcuugucucuacuuuccacaugcugggauuagagaguugugugcuauuguguugucuggauuuuucuuuguuacuuuuuagaaaaaagguuguccuguccauucugucccuuuugcuguacccauggugacugcaucagccugagaagacugugauguuacgucucugcuugagauguuaggggacuggagauggcucagcaguuaagagcuuuggcuguggcuugggagaaaacaaggcuugaagaggagcaggcgaggcugagucagugacuccagaguaagugcugagcccuagaggauucugagggagucagagcugcuuauucgccgcuugggacaggcagagagucugacgugacaaaacgugacaaagagucaggaugggaguauuccuuaaaauugggaaauuuccagaugguggggguacuuaaucccagcacucaggaggcagaggcaggcagaucucuccgagcuggaggccagccuggucuucagaacaaguucuaggauagguagggcuacacagagaaacugucucaagaaaaggaaaaaaaagaauauuguauuugaaacaguaaccaggggucuagagacauggcucauuagugaagugcuugcucagugcucuuacagaggaaggacaugaguuugguucccugcaucuacuccuagcagcucauaagcacuuggaugcuagcucuaggcuuucauggacucccacaccagcuugugcacacacuuacuuacauagacacagaauuaaagaagaaaucauuagaaauuguaauaaauucuacuagugaacagaggggaaggaugacuauuggaacuuugcaguagagguggcgccauauuuccacaguugaagagcauaugucuuacacauauggaguggcacaugcagcugcugugaggauagaaaagcugcaacuucuaagaagugugggcccuauggagaauguaaauguuacaggaaucuugaggaagggaaacagacucaaaauaucaguaauuaagcuggucuuacuaaauagcuuuuuuggugccucaaggggaaucgguguuuaagaaauaccaaguucacaaccaaaaggggcuuacugaguggaggagacugaacuagcuuauaccuugugcuuaaagacauauaaaguaaaagagcauuggcugcucuugcaccagaccuggguucugugaucagcacccacaugguggcucauaaccacuuguaacucuaauuccaggggaucuggugcccucuucuauggccauugcaagugugugguacacugacauacauguaaauacucauacauauaaaauaagaauauaaggcaaguaugcuaguggugggggcaaacaccuuuagucucagcacuuaggaacuacagguaagcagauuucugaguucaaggccagcuuggucuucagaccaaguuccaggacagccagggccaggacagccagugcuacacagagaaacccuguuucaaaacaaaaaaacaaaaacaaaaacacgaaaacaaaacaaaccaaacauaggauauugcuuuccuggauggcugagagaauggaguagucagcaagauaggaaauagagggggcugaauccugaggucuccugagaacagcaugguggauggaggguaaggagggcugggcaaacaucucaggccaggucauggauaaccacagggaucaaugacacagccucgucugccucugccucugccucugccuuucuccccucugauuucuuuuaaaaaaagauuuauuuuauguaugugaguauacuaucacugcuuuuagacacaccagaagagggcaucagaucacauuauagaugguugugagccauccuaugguugcuggaaauugaacucaggaucucuggaagaacagccaguguucuuaaucacugaaccaugucuucaguccuuuuguuuaccuuuaaaaacguuucuuguguuuguauguauguggaggaacacaagaaccauagugacuguauaugagucauagaacaacuuuuggaaguuuguuuucucuuuucucugugugaguuuccaggaucauacuuagggcuccagggagguugccugauggucuuuguauuugguguucugcuugcuuuaaaauccccagaaacauaccuuucuuuuuccuccucagccuuugcugccaggagccugcuuucuguuuuguugaggagguuguuguuauuugguuauuuuagagacagggucucucuguagcucuggcucaguccuacaacucguuauauagaucaggcuagcuuugaauucacagacauccuuugcuuccugagugcugagauuaaaggcauguacuaccaugccaagcccaauauuuuuauuuuuauguaugaguauuugccuacaugucuguaugcugugugagugcaccacccuaggaggcaaaagaagggaaucagauccucugguacuggaguuacagacagcugugaguugccauguagguguugggaacugaacuugggccuuuugcaagagcaacaaguauuuuuaacugaaucaucucucaagccucuacaaauuacacacacacacacacacacacacacacacauauuuuaaagauuuauauacgagaauaacacacacacauauauuuuaaagauuuauauaugagaauaacauugucacugucuucagacacaccaaaacagggcauuggacccaauuacagaugguugcaagccaccguguguuugcugggaauugaacucaggaccucuggaaaaagagucaguguucuuaacugcugagccaucucuccagccccuuaaauuauauuuuuaauuuuaauuuuaaauuuuagauguguauuuguuagugugcauguaccguugcauauguguggcucucagaguacugcuuuguagaaucaauuauugccuauuauauggguccuggaaauuaaacucagguugucagucuggguggcaagugccuauaucuguugagccaucucuccagcucuucaaaacaacagauuuagcuacuuuaucuuuuuaaaaaaucauuacauuuuuauuuauccauuuugugugcauagaguaaaggaugggguggcaugcaggugccauggugccuuguggacaucagaggacagcuuguaggaguuggauuuucuuguuccacuauguggauccuggggaucaaauuagaauagucaggcuugacagugccuuuaccuugugccauugugucagccccucggcugcuuugucuuuaaacaugccuccuauguggaugccugccguagucuuggagcuccuuuaagggaguuggaaggagggagcauuuccuagacuuaucuccuucuggcccaggcuuaggaaccgaccuccauagcugcagcaguuuagggcuggauugaaugugaaucuggaauugcucucugaauuuugaggagggacaggacacaggaguaguaacuauagagggaaaucuaucagugaaacacaggaagaaguaaggaagaggccagacuuugauagcacgugccuggaguggcugagacaggaggaucugggcuauauagugaaacccugucucaguaguccaagaggggcugccuauccauccauuugugguggguuucagguuugcaguaggcuugagugucugccuggaauggucuuugaguuuauggcaagaacuggcucugacgugccacagggccaugagauuggcugucaccaguccucuugggguuuauuguguuuuuguguauaccguggacucgacuauaagcugagaggagucagaguagaaacaguacuuguugauacagaacacuccgaaggcuggagaauguggcacagaugggauggucuaggugguuaucuguccugugugaagcacauauguccuccaagcaggaguaggagugguuuuggugacuguugcuaguuuuuuuuuuuuuuuuuaagauuuauuuauuauuauaucuaaguacacuguagcugucuucagaugcaccaaaagaggaugucagaucucauggugguugugagccaccaugugguugcugggauuugaacucaggaccuucagaagagcauucagugcucuuaaucacugagccaucucuccagccccuguugcuaguuuucaaagaugcucugucuuucccuguucugcacucuguauccuuuauguccccacuucuuuuuucugcuuagauuccauaguccacucauacuuacauuauagauuacuaacucacacccaacuggacucuggcugugcacaguucacuaauacuagggcugccagccaguuugcuccauuagcuuugaugauuuugaagcuuuaaaaaaaaaauuaacuuuugcugggcaugguaugggauuucugaguuugaagccagucuggucuacagagugaguuccaggacagucagggucacacagagaaacccugucucaaaaaaaaaauuaauuaauuaacuuuauuauaaaacaaaccaaaacagcaacuuagaaauaaaaauaaucacacccugauauuaaucagauccaaaguccauagaucucaaugaacuauuauacaguuagaauaggcauucacuaauaaauacauuuucaugugcuuagcagauuggagcuaugguggugagaguggaggcuggauucaaauguagaagccugugcuucccucuuagauacucuacuuaacagggauggagugacaaccaggguguguaggcugaccauccuucagaugauucugacaccaggcaucaucugaggaacauguaucagagguacauggacuuuggggucuuugucagcuccuuacccaggaaggaccaggaagccuuuuugguuuuuagggcuggagagauagcucagugguuaagagcauguaccccuuccagaagacucagguucaguuccuagcacucacauccaccuguaacucuagcuccaggggcacccaaugcuuuugacuuccacagacacuaacacucaugcaugaaccgcaccccagaauaaauaaaauaagagauccuaggaauuuagugugugucaugugauaagucagaaaaaguuuaaggagaugaaggagccaagugagcaaauaagggaaugaagagugcgccugggaugggguuuaagaaacauggacagaccacauauuauaggacauggagggccuuaaugucaggucccacugcagacuagugcuuuugagauuuaccagaaacuuugcauuaagaaagcagguuuauuggggcuggugagauggcucaguggguaagagcacccgacugcucuuccgaagguccagaguucaaaucccagcaaccacaugguggcucacaaccauccguaacaagaucugacucccucuucuggugugucugaagagagcuacaguguacuuacauauaauaaauaaauaaaucuuuaaaaaaaaaaagaaaagaaagcagguuuacaaggggagggggaggaaggacagggcuuuuggagaggaaauuaggaaaggggauaacauuugaaauguaaauaaagaaaauaucuaauaaaaaaaaaaaaagaaagagaagcagguuuaaauguagacccugguggcugugcagcauacuugagacuugcuucuaggguuuuauauguuuacugugcucuagugaaggacuuccuucuucagucuggcugcccucaguccccagagcccucuuugauguuauuucaguuuauccuaugagcaacuagaugccaguuaccucuuuuuuuuuuuuuuuuuuuccuuuuuuccccuaccuuuuaggcuguuaaguuaccucuuuuaagggcucuccucgcagccugcacagccaaguucagggcucaguuuagagaauccauagucuuccuuaauuccacuugaauuaugcuccuuuucucucuucacuguauagcacaggcuggucucaugauccuucuuagccacucucauguuaggauuacagauugaugccacaauacucagcuuaguuccucuuacagaggcuuucgcucugugguaugacuucaucuaggaagagaaagguagugcuguccagcuagagugcuagaugggaaggcgagugcaugccucugaccccaguacuuagcacugagacuggggagaaggcuuggcaguuaagagcacugacugcucuuaccuaggaccuggauucaacuucuaucacuauaugauagccugcagcuagcuguaacuccaguccugggaauccaaugccuucacaugauguacacacauaaugcaaucaaaacauauacacuuaaaauaaauaaaauaaaauaauaaauaauaaauaauaaaaucccagacagcaugucucaggucacuaaaaggucaucaaauaagauaggauagaaagacucuuaagagcagcaguugggggugcuggagagauggcucagcaguuaagagcacugacugacugcucuucugaagguccugaguucaagucccagcaaccacauuguggcucacaaccauccaagaucuggcgcccucuucuggagugucugaagacagcuauaguguacuuacauauaauaaguaagucaaaaaaaaaaaaaaaaaaaagcagagguugggaaggaucagaacaaaaaguaucuuuuuguuauuuuguguuuuugagacagggucucucuguauguagcccugguuguuguggaacucucuguagaccaggcuggccucagacucacagaaaucauucaccugccucugccuuccaagugcuaggauuaagagugugcaucaccacaccugguauuagugaaaagaauucucgaaaaaaggaggugucucaugauuuuaaccuauagucaugagauaauauuugcucaguguauacauguuuaacaaagauggcauggagggaaggagacugccagagaaggauuagugccugguuuuucucugacuuacuuauggcuugugcccuucucaguagauauuuucuucugaguauguuggaggccuggugugugcguguguugucugccuacugaaagaccacagagggagcagaagucagacagacugaggcccuggucuuguacuaugcagagacuccugucuuuuuuuuuuuuaaagauuuauuuauuauuauaucuaaguacacuguagcugucuucagaugcaccagaagagggcaucagaucucauuacggaugguugugagccaccucgugguugcugggauuugaacucaggaccucugggagagcagucggugcucuuaaccacugagccaucucuccagcccgagacuccugucuuacagcuuaggaggaucgaguuucucucuagaugaagccugcauaaauaguggucagcagagcagcuguaccgugaugaaccuugcucucaguucaguaaguagcauagaguagagcaugauaaaaauguguuugucuuccuuuuuggcggucugucucagauagcucaggcuggccuugaacucuaauguagcugaggaugacgcugaacuucugacguugucuuccaucucucaagugcuggaauuagaaguagaugcuacuuuguccaacuuuuaugugaugcugggcauugaauucaagguuucauguaugcuaggcaagcacucuaccaacugagcuauacccuuaaucuuaauuuuauuuuaaaaaaguauuauuauugugugcaugugagugugugugucugugugugugugugccuaugugcaagcgcacagcaugugaguggggggucagaggacaauuuguuugugcagacucucucuuuccuucaugcaaguucugguaauugaauugaauucagguugacagacuuuuugaccagugccuuuacccacugaggaucucagugaucuccaguaaauuuuuuucuuaaaauaguaucucucucugaggcuuagacugccuuggagcucaccuaagcuagccucaaauuuauguuaaucuuccugccucagcuucucaagugcugcaguuguaagcucacacuuggcuccaagcagcuuucuggacagccauagugaaggcauccugcauuucuggaguagcuguggcaaggcaguggaugggguggagugggcugagcaagagucagcuuuacugaaguagcuaauggcuuauauggaggaggaaagaaaggaguaguuaaugcuaggucugauauuugugcuuaccacccacagaagaaccagauacuuguuugugugcuaggggaagagcucagguccccugaggccauuugccuccuugugaugugucagucuugcuuucggcaggcaucuagagcucaggagggaagaaguaaggagcuaaauagccuggcuucaaacccuaggggucucagugugcuuccugggaccugucuuucucaucccauccagcuugcugaggguugccugugggaagccacaugugccguugcagaguggcacugacuacugcuggccaccacgcauaagauuggacaaacaaccaauguguacauaugcaguaaaguuuuuugcaaagacacugccuggcccaggcaugauaaugagguucuguaagguacugagaguauaaccaaucagaugugagacaugcaaaugagguaugauaaugagguucuguaagguacugagagagaguagccaaucagaugaggaacaugcaaaugaggcuuagugcauaaccaauccgggugugagacacgccccuccuaggccuauaaaagcagcaccaguucugggcucgaagucuuuucgccucuacaaucaagcucucccaauaaacgugugcagaaggauccuguugcagcgucguucuuccuggccagucgagcgugcgcaagaguugccuucaccuuuuucagacucccuagccuggcuucugggaagaggagggagcuuagggacugugaaauaacuugaaggguuuguuguugcuguucuccagucccuucuguaacacacuggagguggaggaaguggguaggagggccaucagcaugguacucugcugagaccucuguuaaugcucugccuuucuaugggcugucccucucuuccagcuauuaguagauuaugagcacaggcccuuuugugauuuugcuugucuugaggccaggucuugcugugucacccagcuguccucaaacuugagaucguccugccugggucacccggcgacuaggaugacaagcaaacaucaccauaucugguugauuuuauuuauuauauuuuuuaauuaaauuuuuuccuuaggucaugguggcuugagucuuuaaccucagcacuugggaggcagaaguagguggagcucugaguuugaggacagccgggucuacauagaaaacccugucuuggggcuggagaguuaagagcagcaguuaagagcacugacugcucuuccagagguccugaguucaauuccaagcaaaaacaugguggcucacaaccaccuguaaugggaucugaugcacucuucuggugugucucaagacagcaacagagacucacaucuauaaaauaaauaaaucuuuuuuuuuuuuuuuaaagaaacccugucuugaaaaaccaaaaaaggaaagagaaauccauauauuuugauugcaauuccccucccccaaacucuuuccagauccuccccacacauccaauaacaacaaaaagaagcccaaacaaagcaauauaagacaaaaagucuuaaaauguuuugaauucauuuuguauuugccauuuacugcugggcaugaggcuuccccugaaguguaguucauauacccagugagacuguuggagacaacuaacuucucuguggaugucaggcacagggagcgucuuguuuaggugugggagcccaugcccacucccucccagcacuggggccccaucugcuuugauggcugauuuuauuuaacuugaauauuaaagaucccuuuuggggacaggagagauggcucagcccugagcauugguugcucuucucaaagaucuaaguuuauuuccuagcaccuauaagguaucucagaacuggccacuacuccagcucuuagagauccguaucuucuggccccccuggugcauuguacauauacaaguaggcaaaauaucuauacacauuugaauaaaacaaagcaaaacaaaaacccuuuaaacaacaauuccaccuuugcaugccugggaucauggcaucuaccucuaauaccaaaacucaggcagaggcaagaggaucuuugugaguucaaggccagccuggucuacauagccaguuuucagccagucaggguuacauagauccuauauaauaaauaauauauaauuaauagaaauaaauguaaaauaaacaaaagacaccuuuucaugucaucaaguacagaauagguuauagggagcagaugaagucuuuaguauauugacaugggcaaggaccaaagccuuguuggacccaugggaaaguggcaaagccuuuucccauaugggcugggcucagauuucuuccucugguccaaguacuagcuaacaauugaccagugugggcaaaaccuaucaacugcgccuucuucuuccuuguuuacguccugagacagcuguccuacagacuuuucccucuugugcuguaccaaauaaaugcucuuagauaccagggugcaacuccaucagagagugcaugccucuccugcuccagauuauuuguacguauguacauacauaacauacgcacacacaauguauauaauaucuuuccuuucuuuauucucccagucuccugaccaguguucuaggcauuuauuucauaguauuuaaucaaugcauuucauguuuaauuuuuguuuguuuguuuguuuguuuuuucaagacaggguuucucuguguagccuuggcuguccuggaacucacucuguagaccaggcuggccucgaacucagaaauccgccugccucugccucccaaguucugggauuaaaggcaugugccaccacucauguuuaauauuuuaaagguccuauaucucuucccuuuuuguuuuaucaguaauauuuuauacuguuugaguccaugcuuuuaucauuuauuuauuaccuccuuccaauagaauccaagcuccaggggaugccuuuucuucuccuuuuuaguacuucucagcucguuuagaacaguucaugcauacacuugaugcuuaagcauugagugguugaauauagacuacucuuugcuuuauuuugggugauuaugcacacaguguucuaguacucacaucuuugcaccccucccacugucaccuuaugagagagucugagcaguggagcagcagagcuagaggauugcaugugcaccacaccaguucagggaaucagcuucccucaagauuggcauauagcuauaaucccagcacucagcacggagacgggaggauuaagaauucuaggcuaggggcuggagagauggcucagcagguaagaucacugacugcucuuccgaaaguccugaguucaaaccccagcaaccacacaguggcucacaaccacccacaaagauaucugaugccuucuucuggugcaccagaagucagcuacaguguacuuacguauaauaauaaaugaaucuuugguucagagcaaggagggacugagcgagugggacggaccagagcgaacgcuuuuaacuggagcaagcagagguccuaaaaauucaauccccaacaaccauaugaaggcucacaaccaucuguacagcuacaguguacucacauacauaaaauaaauaaauacaucuuuuaaaaaaaauucugccggugugguggugcaugccuuuaaucccagcacucgggaggcagaggcaggccgauuucugaguucgaggccagccuggucuacaaagugaguagccgggcuauucagagaaacccugucuugaaaaaacaaacaaacaaacaaacaaaaauuuuagguuagccugugcacauuguagguucaagaucuaucuaggcuacaugagaugguaucucaaaagccaaaaccaaacaaauaaaaccccccaaacaaauagaagaagguaaaguucaaguuggguuagccuggacugcacaguauguuugaagccaaccauucuccagcuaagccagucucacacacacaaacaaaacaacaaaaaaccauauuguguuuucuuucauaugugguuucuagacuccuguacauaaagucauguauguauauaugauguguaaggcucuaaugaguggguaagaaacuggagaguagugguggggaaugugcuuaguauacaggaaguauacuugugugaaaauguucuaagucauacaguaccauguaugaugaagcacucaagguuguugauuuugaaaccauguuucacugucuagccaugcuagucuggaacucacuggguagaccaggcuggcuuccaacucacagagauccaccuguuucugccugcugagugcuggacuuaaagguguauaccagcgugcuuggugguuucccuguggcucuaaggacacugagucuugucuuuccaugugcucuccacugacagguggaaacauggucugguaacaccacgcuuccggaugugauuguggagcuggauugcuuaaccugggcuaagucauuuaucuuccugugucccucaguucuucaugguaaggaaggguaauaauggcaccuuuuugaaaggguuuuaugaaggaucaucaauuaagcuaaggaaaaugcuuauucuaguaaacugagacaguuacuccuguagaacucuuuuuguagugcuggcauccacccauggcuuuacauaugccagacaagugcuaagaaacaugaguugguuuucaccuccuugacuguaaaagguugaaccaggggucuccuguugucugacuuugucucaggcucaaagcucuguagcuagcugaagcuggccuuaaugcucuuuuugccucccaaguacugggacuauuggccugccccaccauuucuggcuuaagguuaacaucuuuacaugugcacacugggcagauauguagccacauccccaacuuucuaauugauucucuuauuaaugcucaugagcuauaaguuagcccaaguuccuuucagcuuuguuuaugcaguuguuuucugccuguagguuuuauauuuuuuggcauucagauauuuugccuuagaauuguuucugcuuugagaccaauguuuaggaauaaagugugcuuuucuaucuugaaauuauagaaaauggcuuuuuauucuuuugaguacuauauguauuuaacuuauuaauuugaacauuuaaauuucaacaauuguucaaucuggaauuuauuguuaggucaagagugguuaagucuugagucuugauuuuuuuuuuuuuuuuuuuuaaauuuaagggcugcagaaguguuaagagugccugcuugucuucgagaggaccagagaucaauucccagcauccaucccuggaagcuacagggaauucaacacucuuccugacuuccucaaacaccugcacacauauggcuuauagacacacagggaaagaaguaaaggaaaucuuaaaaacagcuguguauuuuuaaauuuagucugugugugucuguaugugucucugugucucuguguguguaugugauaguuuucagccuuuuuccacugugcuaccagcgugugugugugucauggggcuuggcagcaggcacuuuaccuguuaagcuuucucucugcccucuacuuucauuuggauagcugucuaaaccgucauugaagagacauuuuccuugugagguccuggcuggcuccauacucugaauuccuccuucuguuuguccagggcuggggugagcugcacguguagaugugcccugauguuuguuccccuucucccagcacaucagagaguggaccaaugucugaauguggucaagaaugaaugugggccgggccugguggcccaugccuuuaaucccagcacucaggaggcagaggcaggcggauuucugaguucgaggccagccugaucuacaaagugaguucuaggacagccaggacuauacagagaaacccugucucaaaaaaaacaaaaaaagugaaugugguugugagugcuguagugaaugugguugugagugcuguagugaaugugguggugagugcuguagugaauguggugagugcuguagugaaugugguugugagugcuguagugaaugugguggugagugcuguagugcacugaggugaggagacugcugcccuuggcucugcagacuucccgugcagacccggauaaaggacugcauuauacuggguucaccacucaugcaaacagaauauucugcuuuguuaauaaacaaaugacagguuugguacuagcuuagcagaaagcacuggucuagcauuucagugcccugggcuugaucccaacaccacagaaacaacuagcugacuguagcagccacuuccuccagcccacacauacuggggaauauugaugaagggguaaccccacuggaucccaauuuuguccuugacagcuggaauuuuaauuccaguaaguuucuugccuggauuuaaaguaaaagaaagccagguauauuuguauaaucuuaguacuacugcugcuggccacaaacaaugaagggaagcugaccuucauguggaacacaccguguaggcaaaaguucugagcaacagauaaauuaggucccucuugaugaaguucuuucugguuugaguaacaagcuacauauauacuaguagacuucauguccauucagagccugugaaugaaugcaagugguagauuuuagagauuuuuuucuuuaagguuguuuuuguguguauguauucacacaugugcagugcccacagaguucagagaaggugguguuggaucugcuggaguuggaguuauaggugacgguaggauggaaacugagcucugcuccucggcaagggcagugagcacucuuaaccaccaagucuucucuccaacugggaaauagaguuuuugcaaauguaacuuacagagcaccaucacuguggcagauccugauccagugaugaugcucuauaagacaagguugccauggagauggaggcagggacuggaguucugcaugcugcuaugagcuacuccaaggacagccagccaucaccaggaacaaaacucuuccccugcuuuuuggaguguggccuugcugacaucugguuguagucuguggucuccaggcugugggaucagcuucugcucuuugaagccugacagccauuagaauaucucuagagacuaaagcacguacuaucaccucugugcucugaaagaagauggaggaccaaugaugccaagcauugaagcucuagccaauacccugcacuugggcuccugcucucacuuguuggcaccuuuaccauguacacugagcuauugaaauuauucuaaugucaggacauguuacucuggcaaguagacacacuugcuaacaucaggugucuccucagcuuuuaguuccuaugaaugucaaaagaugacauuggauuccccggagcuggggcuaaggaugagagugagcugucacgugggugcuaggaaaggaaccgagguccucuguaaaaacagcaaguacgggcuggagagauggcucagcaguuaagagcacugacugcucuuccaaaggucccgaguucaaaucccagcaaccacauguugacucacaaccaucugcaaugagaauaauaaaucuuuaaaaaaaaaaucugaaaguuaaaaaacaaaccagcaaguguucuuaucacugaaccaucuuuagcuacuggagcuccauccuuaacuuuuccuuucuaugcagaaaaacaauuguggugacaaggugaccccaaugcccuauguuuuuuggaugcuuaaaaauuauuauuauuacuuauuacuauuguuuuggcucuuugagacuguuucucugggaacucacuaggcuggucuugaacucacagagauccaucugccugccuccugagugcugagauugaagggguauacaccaccaccugcauuguuauuuguguuuucuagaauccugucccuacagcucaugccaugcgcuuguuggagcuuucaggcuggcgcagguagccuguaacucagagcuguggugagaaaaagaacuucucucuagcagcacugggccugagggcccuacagugacugcugcugaagggccccagccccugcucagcuccuuaccugcuagcaggucuugugggaaccuaugcugggcaguggcgccaaggcugucuucagucuagacuccugugcuuggauccugcuuucgucacagugggaauucuagcagugcuacauugcuuuuguuucuucccacauccugggucugagcaaaggcuuggcacaucucaacacucuuaagaaaugcuuguggaggauccagagcagggaguggcucagcaaagcauugguugcucuuccagaggacucagguuugguuccuagugcccacauggcacucaaaaccaucuuuuacuuuaguccuggagacagacauccucuucugacccucacagacucugcaugcacaugguacacagacauacaugcaagcaagacaccacacaucuaaaauuuaaaaauagaaaaaaaaauauuuugguguguguuuugcugauuuuugaagcaucugcugccagguaaccuugcccagaccuggucuugugccgccuagacuuucuccauuuccucuuuguuuuuuugcuuuuuauagcuuucuuuucuuucuguuuuguuuuuugguggucuggggagacuugaacccagaacuucagacaugcuaggcaagagcucuaccacugaacuacaucccaggccugcucuuuuuuuuuuaaaauuuauucauuuauuauauguaaguacacuucagacaccccagaagagggcaucagaucucauuacagaugguugugagccaccauguugguugcugggauuugaacucaggaccuuuggaagaacagucagugcucuuaaccacugagccaucucucuacacccucuguuuuucuuuguaccacuugcugaguggcuggccuuuuuuacuccaagaugcauccaucuccugaaacuucaagccaagccaaugcccugggccuucucagaccaugcccucagaaugaucuagaacaugggcauggcugcagaauaccacuugccgagucccaggagcugugagcuguggucuguagucagaaucgcacuguuguccaguugguuacgcccacgccugccuuggccauaaugauuugcuucugcgauccuguaugugagaagccuaggaaccucccugagaugcuucugccuggaucaccagagugggcaggauacagggccauucugguuccuacauacaagggacugaggugcauauuuuacauauaacagacuuggccagguucucccagcaucucucagucccucccugggacacccuguccccaacccugaacuuuccagcccaaaggcuggguuguccuucccacagaggcucuucccuauauaauccagacauuugcuugucccucuccucuuucugagcaaacaugccuguuucucccuuucuccucccuccucccacgcccauggcgacuccccuagcuucaauccuuggggccagugaacuuacccaagagcagcuucccaauaaacccgccuuuaauauaaccuaaucuggcuugaauuggcucauuucaccgguggagaaauaaccuaucacugggccucacugagaucauuuuauaaagaaagguuugauacuguaggugagggccaggccucuucacaguuaauauaggacucaaagugguguucacguggucuugaacucagguccucagacuugcuucugugucaacagugugaucagaucagcucuugcaagggaugggaagacugacugguaggggcugcaaaaaagggcaaggucuguagggcacacagcuuggccuggagagcagaguagcugaggugccagggccucuuguauccugucacuaacagccucaagcugucccuccauuagcccacuucaaggaccccuggaagguuggaugggaagaacaagcccucacaucauuggucaagagugucacauugucuuuccuucacaguuggguucuaauccaagcauccugcuguuguugggcaagcugaaaacaaaagagcagagugucuugcucaagguggcagcuagcagaggcuaaaucaggacugguuucuucuguuuuggccagcuccaaagcugaagcuauuucccagagcuuugucucuggugagagucgggaaaggaggcugggaagacaccguguuucccugccucacaguuggguccauaccaaccuguuuagccagugcauccuguuauagagaccacagugacaaaugugggagugauaccagugggcugcacaggagacugaaaccauugcuguuguuguuugucuccucaguguaguccacacuugaaaucucacugcugacugacuggcucacacucgaaaagcccuguccuaccucacaugaagucugaugugugccagugaguaagcucugagguggcagaagagaggguguggcgugccaucccgccuggcccagagcuggccacaccuguccagagacuguuccagugaauugucccugaguaaacaaggcuggcgcucuuuugccuuucugaggaagaccagauggcuguaggugcuggcacagcaccaagggguucuuggcccugggccagcagaggaaacagagugccaggugauaggaaaaaaaaaaaaaagaggacuggugugacuugagagggaccaagaauguccuguuucugaggucuuucccuggccuuuugcuaguguguggaauuucacagcugaaagcucuuguuuuaauuguguguaugcaugcgugcaugcguguguguguguguguguguguguguguguguguguguguaccugccugugugggaugggggagaguauuaggguccucuuuuuacuuuuaauacagagucccauaaaguugcccaggcuggccuugaacuuguguuccuccuuccuuagccuuccaaguagcuagaauuacaggucugugucuucaggccuagcucuugguuuaaaucuuugguacucaacugaaagugaaggcugagaauguaucuuagugaaaggacacaagcuuagcaugguccaagccucgaguucagugucuaaugcccagcccuguauaggggagaggaaaggaaggggaacaagagagggagaguggaagggcaggcaggcagggagggagggagggagggagggaggaaggaaagaaggaaagagggaggaagagagagagagagggagagagagagacagaggaaugaaugaaugagagugagaagagagagacagagacugacagaaggagcacacacuccagaaagggauuugaucaggaaaccucuggaaugugugacauugauuucacagaacuagccuguggaagggaugggugacagggaagaugcugcgccuuaguuguagaggcaggagaaacuccagugagucugagguaaaggcagcuggguccuaaagggaggauucaguuuuuuucaguucugccuguagaagggcagcccugaggacugcugagugagugcugggcagggaggguucugcaggcuacugggacucagugcugagugagugcugggacucagugcugagugagugaugggcagggaggguucugcaggguacugggacucagugcugagugagugcugggacucagugcugagugagugauggguagggaggguucugcaggguacugggauucagugcuaagugagugaugggcagggaggguuccgcagggugcugggacucaggcgucuggaggagacugauggccagacuacaacccaggagugcaaaacccgugggucugugguuuguugugauguccucagaaugucccagaucucaggaaggggaggcucggcuuccuagaaaugaugcacagugauggcguaaaagaggccuccggugacagcauggggcgggcggggcacuuccuucaugcugcuggucacagacuuucccagugcugagugggggcuuugcaggaaacagacuaggcacgugagaagcaaucgggcaccugacacacagccccuugggcuguaccuggagcgucuagaacagggucagaccagacuucagcuguccuccuccagagagagguuuucuggugcucaaacugccucaaggguuuggauucucccaguuguccuucccuggaaucuugccaggaccagcucaggucucagcucccugcugauaguauuuuccuucggauccacuuuggcuucacucaggccuuguaagcucuaacauucuaaccccugcuccuccacucucccccccuaccccaaguuugacaacacuuuuaauagaguaguaggacucugaaaguuucuagaagacuauccuuucaacacccuuaaccucauaugcagacuguaauggcagcugugucugcugcugauugaagggcuaguauccccaagagguagggaccccuggcaugcuuucugugcccuaaaugacaguugcccaccugucucugccuuccuccaucuugccuuuacugugccuuugacagugccaggcccuguccaccauccaccucucguucucagacucuggcccaguugugaguuccucuucaggagcuguggccagacuucaguggagagaaaguccugccugcucugcuggccauauugaacugccuguugcucugggggcuaaccggaugucauguuggucugucugcuuuuuugaggaaggcuuauagcuucacugaguucuugucuugaauuuuaugcuagcuuuccacgccuguacuggcugguuuugugugucaaccugacacaagcuggaguuaucacaaguaaggagccucccucgaggaaaugccuccaugagauccagcuguaaggcauuuucucaauuagugaucaaggggggagggcccaauguggauggugccaucccugggcugguaguccugggcucuauaagagagcaagcugagggcuggagagguggcucagcaguuaagagcacugacugcucuuccagaugucuugauuucaauucccaacaaccacaugguggcucacaaccaucucuaaugggaucugaugcccucuucuggugugucugaagacagcuauaguguacucauauacauaaaauaaauaauaugaaagaaagaaaagaaagaaagagagagagagagaaagaaagaggaagaaagaaagaaagagagaaagaaagaaagaaaaagaaagagagagaaagaaagaaaggaaggaaggaaggaaggaaggaagggagaaagaaagaaagaaagaaagaaagaaagaaagaaagaaagaaagaaagaaagaaagaaaaagcugagcaagccaggggaagcaauccaguaaguaacaucccuccaucaccgucagcuccugcuuccugaccugcuugaguuccaguccugacuuccuuuggugauguggaaguguaagcugaauaaacccuuuccuccucaacuugcuucuuagucacgauguuugugaguaacccugaugaagacaaugaccuugccucaggagaaguuaucaagaaacaucauaaauccucaaaaaggaaguagagaaggccuuucccaagccauuugcuuucuuugauugaaguuauuuuuauaguuacuuacuuuauuuuucugaauaugaauguuugcuuacacguauaugugugcucuacaugugugccuggugcucaugaaggcugcauccuggaguuagggaugaugugggccaccaugugggugcugggaaccaaauccuaaucuucugcaagagcagcaagugcccuuaccaccgagcuagccccagaauaguuauuaaaucuaccagagcacaguauugauggaaugcaguucuagaaagguuuaucacaaaaggacaggcagauggagucauggcaagaaacaguaauaccagugaggagcaggcuuuggccacuaugcccugacuuugcacuggaggaaagcucuggaaguuggcuuucucucucucuuuuuuuuuuuagauuuauuuauuuauuauauguaagcacacuguaguggucuucagacauucuagaagagggagucagaucucauuacagaugguugugagccaccaugugguuguugggauuugaacucaggaucuuuaaaagaacagucaguguucuuaacuacugagccaucucuccagucccuggcuuucucccucuuugucacagaaaguaagaaugggauuucaucuucuuggcuguaggagucaccagcuguaaggaccgaggcuucucuuguacccuuucccuccugaccucucaggauuuacgggcgacacuuuuagcagcccugccuucuuguuggggacuguuuaucucagcuucagcucaagacgucacugcacaggguuauccgugucugguggcucuuuuuuauggagcauauauaacaucauauaauucccacuuucccuauuaaaucucccuccuucuauagucucucugugggcagggccaugaaaaucugcaagauaggugugccaauucgaagaaacuggcauagcugguacccagaggaagccguucaccuuugacugagaccauuucuuaagagucuaccccuucucuggacugcuucugcucuaugccuggacuagaauuugcuguguaaacuaggcuggucuuggacuuggagucuugggaacuuguagucucaggguuuugcuucccaagugcuggaauugcaggggugcaccaccaugucuaauuugucaagugcuuuugaaccugggucuccagcccggauuucuuuucuggguuuguuaccgacaauggccacacacuauuggccuguuaaccuugaugguacuuagauaucuuaaacucaguaugucaauccacauuuccuacuuccucucaacccguccuccuccuccagacugccuccucuugacuuacgaacaucauccagggucguuagugaaccauguuuccauugcucuugcccaccguucccaccagaaaugggaagaacuuuaaaaacucuauuuguguguguaugcguguacauguguguauguacaugcguguauucaugcacacacauucacacaggccauggugugcuuguggcagucagaggacagcuguauaauguugguucucccagucuaaccauguggaucccaagugcugaacucaggcggucagacuugacaacaagugcucuucucuguggagcuaucucuccagcccucccagacaugcaauagcucuaagaugugguucucucuuccuccuccucuucuagacgucugcaaggaaucuguagguaaauccuauggcaaaauuaacacuaaacuagaacaagaaaucaagcaccagaaacuggaaaguagguucuuguuggggaacggaggccaggaucaagugaaaagcucagcccugucaggacacauauacaugauacacauauacacauauacacauauacacauauacacauauacacauauacacauauacacauauacacauauacacauauacacauauacacauauacacauauauacaugauacaggacuggcgacuccucaggagaccauugcgcaaggcacauggcacaccugcugucucagcacugagagguuagggcaggagggccaugguagugaggccagcuuggguuacauagugagguucuguuuuuagaaccugacuacuguauaaaaggaacgagaugacugagagacuuuaauacaugacuaaaaagcuggucauggugagucacaugguaaucccagcagcacugaggaagcugaggcaggaggauugcaugaguucaaggccaguuugaacucccuaugaguuucaggauaaucugggaguguuuaaaaaaaaaaaaaaagagcaaaaccaacagcagaguaaugacuuuagaagaagagaauucgggguugcuuuguuuguuuguuuguuuuugaggcagggucucacuguaaauuucuuccuggcuuggaacucgauauguagaccaggcuggucuugaacucacagagauucaccuacuucugccuccugagccaaccacaccuggugaugauuagguuuuuaaagaacauagaaagcucuuacaaaucaguagggaaaaaccaauaccccugaagaaauugagccaaagucauagaacaaauauaaaggaaguacgaagaaaaagacuauuuuacuuugaaucuagaaaacacaaacaaaagucaaguguuguauuucaguguagaucaagaacaaauauucaagagagucugggagaggggcucaggggaugcugcugaggggcagagugcccagaguuggguaugcauuuuaaacaucagugccagcagcauaaaucaguugggaaauagcauucacugugcaagcagcucggggagucagcucagggugcacguggcugggaauguaaauuagaacugucucucugaaggucagcuugacaacaccuaucgaagucggaaguguaaugccguuaguccagcuggacuauaucugaggacuuuuguuaagggcaaacuugcagaucuaugucuauuccaucaguauauauagauauuuauuacauagaguucaaaaagcaacuaaaauggacaugaguggccagauuauauguccaugcauugauaaaugaaguagauccauacuuacauggaaacaucacuacaacauacacauaaacuauguagcauggucuucucacuugaaauaaauagagccauaguuggguaugcauuuaaaaaucagaaccaggcugggcaguguuggugcacaccuuuaaucccagcacucgggagacagaggcaggcagauuucugaauucaaggccaaccuggucuacagagugaguuccaggacagccagggcuacacagagaaacccugucucaaaaaaaccaaaacagaacaaaacaaaaaaaucagagccagggggcuggagagauggcucugugguuaagagcaccaacugcucuuccagagguccugaguucaauucccagcacccauaugguggcucacaaccaucucuauccuggugugucugaagacagcuacagugugcucauacauacaauaaauaaaucuaaaacaaaaguugcauuuaaaaaaucagaaccaguugacagcaacaaaaggaugagaagcagcaacagaaaucagugaagaaagcccugugugagcugagccugaccugagcccugugugagcugagccugacuugagcccugugugagcugagccugaccugagcccugugugagcugagccugaccugagcuccgucuccagacccugcaggggaggggaaacccugacuccugaaagcugcucucugacuccgugugcacaugguggccuacauuuacaugugcauacaaacacacaaauaauaaucauaaaaauugcacaacgcaaaaaaauuugcacaacacacaaauuaucugauuuggaaaaaaaacccuaguaaagaguaggauuuugucugggucuaguggugcguaccuguaguccagcacuuagacgguagaggcaagaggaguuuaggccagccugggcuacaugagacugucucaaaaaagcaaaccaccaccaccaccaccaauaauaauaauaaaaaaaaggauucugacuggagaguggucugaccaaaugcuuuuccucagugggugaggugaugaagagccuuuacaggcucucgggcaggacuacauguugagaagguugcauguugcauaggaauggaugaggcgggaaauggccugccguggagacacagaccugaaauaaauagagguaucaguuaggccaggcagugggauuauaggccaggaucgguccaaggacugugugagggauaaccccugguccaguagucugacaggcgggaagaggagaaagaacacaggguaagaugccauacaaauaacucaguuagauuucacccugugagauacaagggaacacacaugacagcgagaaaggugaguucucuuuuagaaagagaaggggagcuguucuguggcugccgauuuccacugggagacauuucucuaaagcagaggcagcucuccuaggaaucccgcaaccuuggcagccuagggagauacugacucuucuucucugcuguaggagaugagucucguuggggagagaugggccucagaacccaugcgugugcagccccagcaugcgaaaggugcucaccauugcagagcccuaccgugugcacaacuucaacugacagaaguccacaugcuuuccagcaucucuuuccuuuuuauaugagcugaagcugaggaauagaauuaggggggcuagaggugugucucaugccuguaauucuaacacucugaaggccgaggcaugaggauugccaugaggucaaggcuucacagugaggcccugucucagaaaauaaacaauaaacgaaaaccagacaaaaguagaaugaagacacacaguauuuagcuucaguuucuccuuuccgcuuucuguucccuguucgguugaguucaaguuggaggaaaguccucaccugucucuaaguagccaugaaguauuuggaagugaagcuguccagugugaagcagcagggagugguggcuuagugcuuuaugucaguuuauucuggcuuccuuccuucgaaaguaauacaguaaaaguggauugacuuagaccagugaggaaagggccugucugcauaagaggggagaacgcuugugugaagucuggaggcuugucuccuucuagauucccuugcucucuccacgugucuguucacaagcuagugcagauccaagauagucuucucucaggggaagauuaggccucucaagucacuuugcuugucccacagguaccaucuuuaugauacuaaucucuggacacgugcagauggcacaggaggugcacgcuucgguccauucugagcuccccgcacugcccuggugucucaguacaguugccugaguucuccauacucgaggcauccccccuccccccgccaggcacgugaagguaugggacagcuuuuucuugcuucaagaugcagcuuggggguaggacaaaucuugcuuagauucuacaguggaaggggggggacccggaaacccacgggaagugucuguucugugacuccucaggauuuuccaaacugucucaugggugucauuggucccucaaaagaaagagcaguccuccuggaggaccaggcugcucagagucacuggagcaaacgaggaggcuggagggagucagaugucuuaccagcaaccuggauuuuagacaagguggguagcuguuauccagcccuguauaggaagcucuccaccucuuccuccugccugcuugguacucagucagguacuucugccuuguccuggcuccugcuugccagucuggcuuuuuucuggaugugugccaguggugacuuuuaguggaaaugauuacucucuaccggagcaaagcaaacuugggaggugcuggcucuggcucccaagugacuggagccuguccccuggccuugcccugugucuucuggcauggauuccuggccacccuuucacccuuggcacauuuccucuaagccaguaauuccaccugggugaggauuacacaucagcuccuuccuaggaacuuugaggucaggagaaugcgugccaugggagccauuccuagguaaccccugucuuuccaugggaaccgugcaguucucuugcaguccuguggguguuuggggcauggaacaugcucacaaugggcaaggauuuacacugccuuuguuucuagagcucucucacuuuuauuuuuuuauuuuugagauaggagcucaccauguaacccaggcuggccuagaacuugcuaugucucuuaggcugaucugaaacucauaauauuccacccuuaucccgccccccccucccccacgagcugggauuauagguaugagucauccuaccguguuacuacuguaguuggaggcuagccuggucuaccuaugaguuccagcccagcuagagcuacauauugacagccaucuccaaaacaaacaaaaagacaaagaaagacaaucucuaagacuggauuuuugcuucucucuuucacaagcuaaaacuuauuuuccacccggacccuccucuuuuucauugguuuauuugggcauuacaaacuuuagcaccugagaagaauuuagggaccucucucuaacccuuucuucucagaacuaaaaguuuaguucacuggaggcugccuggcugcaggcuggccacugcuucugguuucuucacacacugcuaagaaggggcagcccugcaaucccagaaauuagcaugccggugacaucacuggaggcccauuuuuuuauuuaaagggagagagaaaaagagaaagggcagaagaggaggaggaggaggaaagagaaagggaaaggagagaugaaaggggaaggagaaaagagaagaggaacuuggcuggccaggaagacaggaguguguguguguggggggggggcuuucucccagucuuccucccucucucuggggaggccuuugagcuggacuuuuccuucuuuuuaaagacaggaucucacuauguagcccuggaauugcuaccuagaccaggcuggccuugaacucacaaagauccaccugucucuggcuccugagugcuggaaugaaaggugugucaccaucugaggagggcuagagcucuaagugagggugcaaaagugagggggagagaaagcagcagaauggccacugugugaggagguagaagguuuuuauuguagguaagagagggugcagagggggaggaaagcuagagacaucugcaaguggccagagcagagagggaaaagcagucagagagagagagagagagagagagagagagagagagagagagagagagagagagagaaugaagaauggagcugggauggggguggggcggggagggccaggaagcuaguguggacugugcaaagcauaacaagugcuugugaacagggccuggaggagucuguaggcuuggagcgacccaccauaacccaauucgagcugagccaagacugucauuuugagacauaggcacugcuuuuuggaguuuggguauuggaguuucuuugggccuuuuguggaugacccauucaaagcuggccaggguuuucauagggggcucagaaggcuggaauauaggucagagguggggaggaaaagggaguggggcugggguggguuggugucagguaauggcgagagacuugugggaauucucuccagcuccugguguguugaccguuggguaaugccaccuaaggaaccuggagagacagggaggacuguaauuaugaaaagaauggccccggugggcugaggagagguagagaugggguccaagggagaccaaaggagagccuuggcgucgccucggcacgccauacuuuacaagccaguucuccucacuugguuggacugcuucaccauagaucuauggcagugucccaggguugcggguucugcaggaccacccaggcuaggggaugagcccgucagggagcaguugcaggucacuguugacuccuggguggugucugucagccaaguggacaucggcuggaguggaguuagauuggggacggaagguauuagcccggccgcugucugaaaucugcaccgaacuccucauuccagaaaaagcagcuaacauguguccggacagcugggggagacucgggccucugaggcacagcaaggacaaagccugagacauuaucaacacgaagaaguaugagaugagacagaaguguccuggaggaaagagaucaaaagcgaggaggagcuugggggcccagaagcgggagcaggaucagauuucuccuguguccguccauggcuggaucgguggagauugcguggagauguuugcagcucauccagagcacguuuaaucuauauuuagaaaacaaccaaaaggaauuuaaaaguugagccugugacuaaaauuuuuagcccgugacuaugauaauuuuuuuaaaaaagguuuaguagccagugguaauuauaacugcuaccaaggccuaauaacuuaucaguucaacuuugaacucugaagucuuaguguuguguguggucuauaaaucucauuuuucacaugccuuaaaucacuuccucagaacuuuacaacuuagguucacacaccuuaaauuauguccuuagaccuuuacaaguuacauauauuuuuuuuuaaagauuuauuuauuguuauauguaaguacacuguagcuguccucagacacaccaggagagagcgucagaucucauuauggaugguugugagccaccaugugguugcugggauuugaacucaggcccucuggaagagcagucagugcucuuaaccgcugagccaucucaccagcccaagucgcauacacuuuaaacuucuuuuuuaaucuggaaauaucugaucauuuccaugagacagaagagcuagauuacugggcgcagucacuggagggcaacuucuuuuagauaaagggacagugacaaagcuguggucagcagcaacagcagcagcaggauagcuucaguuggcuuuuacacugaaaccuguuuugucaguuucucuuuuucugcaagaggcuuguuacucuaggaaaaccacaccuggccuuuacaugugaaacuaauucaggcuggcugcuaauugaguuucaguuuuaaaacccuuauuuuuuuuuaaauuuaauuaaaauauuuuauucauuuauuuugucaguauaagaggacaauuugcagaaauggguucucuccuuccaccauguggacccugggcuuggucacugggcuugguggcaggcaccuuuauaccaggugagccacuucucuggcuccuaaagcccuuuuuauuaaagagacuuagguaacuaaacuauuauuauuauuaauuuauuuuuauuuuaugugcacugguauuuugucagcauguaagucugugugaaggugucagacuuuagagagauaaagaaaucacuuaaacugaccagggccaguugugcugcugaaggugggagcuccgucauucacuguugggguuccuuuaccuucaugggugccggugagaagacucaagacugcuucuugaugcugucaaggguagacucuaacauggaugggccacagcggccugacuccauccaggcaggaggaugaagagcagccaguucgggaucccaugaggggacucugcuuuuccgaggggaggagagagcccugcuugccacguggucugagguguuugagcagagguugaagggaccacaccauguguaauaaagccccuuuguuucuguacugccccag

SEQ ID NO: 3168 - RNA, 41618 nt, Mus musculus
auuccuuuuccaaaugagcauuuauuauuugaacagauacauaaaaaugauuccaauuuaaaaaaauacuaaaaacauacaucaaccacaaaaacacuuacucugacuggaggacaaugauccaggcuauuuucaauagcaauaaacacaagggaccaacacauacagaucgggaugagcauacaucuuauucuugacaagguaaguuguucuaacacgacuguuuuguucccagcucccccuguacauucaccaugaaaucuacuuauguaugugacucaaaggcacucaguucagaggguauaaaguccugagcuuaauaggaaacaagauucccaacuaaaauuugacauaaauuccaacuaucagagaauaugaaaaugugugacgauguaucuguacauaaauaauucauaacauaagaguacacagaaugccagacaagaccaugcacguaaggcgaaggaauauccucagaaucaaacugauuucccuuauucaaguuuauuucaaguccucaagcugauucuuguugucauuuaaaacuguaggaaaguuaaaguuuaaaaaaauaugaaaaugcuuauauuuagaauaaaaaaagaaaaaagaaaaacgaaacaaaaccaacucuuaagcuuaaucucccaaaccaugacaagggaucugauggcuaaaacgaagaagauucuggaaaggaucucaacugaacacaagacuucaccagguggcugaacaaaugaaaggacagcuuuaaaggcaccaauugaaagagcauuuaugauuggccacuuaaacuccguccuuagcauucucuuaacaaaacaggaacacauuuacagaugaguaaacucacuaacauuagauaggaucgaaauucaagcucaaaauuaaaucuauaucuuguugcaaagaaaugagaaauuuaccuacagcaauuuuuacugcuacuaaauuaaagcaagaguugauauccuuuuaacaugguuugacagaugcuuucucaguuuuaaaaaacuuuuucauaugugcauagaaauguaaugagggugaggacaucuccagggucccacaguucauaaggccggucacuguuagucaccuuggacgugaacgcaguaggucauuaaguuaaaacuggccacugaugagugccucaguguccuggguuuucugggugacgauuacucucaguucuuuuuucuggugauauauacaagaaguuacagcagauguacagagggaagaucagaagucugcuguccaaguucaucaccacuugcuccuacaagacaaauacauuagugaguuugaugacaacuagauagccccaucuuauaacauuaguaaguugagcuguuggauaaaauaagcaugaggaagcagcacaggaugaagcacucgccacagcugcacccauccagccagcccauuagcugccugcaugcgcuuguuacuucuaucuuccucaauguuuagcuccugggucacaggguggcacuaaggacuaaagcuggcagagccagcuccucaacaggggcagcuauuuucauucuucuaagacuguauaucuaguuccugcauauuuuaugagcacacagcucagaggcagagcacaugcauagugcuaaggccccugugcacagugaucugcucauucgcuuucagcucuaagacuccaguacagcauauuacuggacuaagacagggagucacugcugucaucaccaccacagcuccugcccuguaaaguccuaucgugucuagaacacagcacagaguguauuauauaaaaacauucuaggcucagcuacauccucugaagacugguggugagagccacaagggaaccaccacuaaugcuuucuauguuuuuggaucucacagauuugucaccaggacuacagagagcauaggaaguucuucaagggagcaacacugaaaugaacauucccaucaucuaacccuugggaacgucucauacacuguaagcaucagucgugauauauguucuggagaauacuuuaagcgcugcuuaauuauagagucugaagcauuaauucccaugaagaucaacuaaagcuagaguacaugagugaccaaaguaggcuuuaaggauauaauuugguuugguuugcuuuuugagacaaggugucucuguaacccuggcaguccuggaacuugcucuguagaccaggcugagcaggaacucggagaucugccuguaucugccucccaagugcugggauuaaaggcaugcacuaccacacagcagagagcauaacuuuuguacucuucauaagcauaaacauuuugguaaaaguguagauauuuuauucauauauagccuaugauuucucugcacuccaccugaaagguaaggugauauucaggacaauuucagggaguaaaacugggacacugucauccuggcagcuggggaaacagugcugccaauaggaaugccagcaugcaucugagccaccuugccuugggcaaaaucugucccugcaaccugaacauagguacguuuacuaaacuuagugacaaucuuugaagccaugcacacugaugauaaauaaaaaaaaaucacaauugugcacugaccaaacaacaacaacaacaaaaaaccaaagguucugaggaaauccagaugucagaggucuaagcacaguuaaaucuggccacggguagaucaaagagcuaacuccagggaagagaagaagcuguuauggacacugacugaaaccaaauaaauacaccaaccuuugaguagcugcaauaauccccagucuccaaucccuaaugcacuagaaggcuucuagcauccucaaagcuuuuacaccauaccauaugccuccacugaaacaccugcauggugaagugcccccugcuggucuacaauggaagugaaacuguggaaaccuugcauggccacagcacacacaggucuucuacagcaaggccuguuuccagauggagagcccacacugucugcugugccuagugucuccauugucuuacugcuguguuuagccuagaguccaucuaagccccacuggagccuccuucaugggguaagcaucuguaaucccuuuccucugagccgagcacccugcagacuugugcucauggccuucacuugccauccuugcucccaaacaccucaccaggcuaucuacucacucacuuagcccacaucugacacaccagucuuucauuacaucacauacagugaauuucuggacagccaggaccacagagugagacacuggcacaguuuuagaaugaaaccaaagacauauccucuuauaaagaaacaucuaacgaaaaaaaauuaagucauaaagggagcagaaaaaaaaauacagaugacuauuacacaguccucauccaaauaaucacuccaaacaaagaaaucauuagagacagaggagcagaucaucuugaagacuggcaacacaugaaaauguugcugaaguuaucaagucacccagaagucaaacagcaaacagaaacccaauuacaccagaaaucaagagcaagcgugugugcgccugagugcaugcacuugauccgcggaacuagagcugcagaucgcugcgagcugccaaagcuggguccugaggacuggacccauggcuucugcaagagcagcaggcacccuuaaccacugagucaccucuccaguuccugaauucacuuuccacaucuguaaaaaaaaauuagaacacaugcaauacucuucuagauguucuguagagggcugcaaucuggccaugagaaaauacacauacugccaggaguagugguacacauuugcuauacuguaaccggaaagcugaggcaggagaaugagcaguuagaggcagucugcacuaaaacuaagaaacauacaaauaaauaagagaaaaauauguacggauauguguguauuucuuauaguaaaaaacagugagacaauuuuuauccaguaaagaugaauuaucuaaauuacaguauuuuuauuuuuccuaguaugaacaccuguaacacauggaaaacaaacaccagaacugaccaaccaaaagccuucagccuucaccugccguccaccacagcagcucuaccuguccuggacucucuccaauucucuccuccaguucugaagugaccagcagcucuugcucaccugaggcuucacgugccccucuuccagcacaagcuuucccugagccgucagccaucagcaugagugaaggcuucuccuaagcucucagucaucaccucacucucaacccugcaaccuggauuagggcuucucccucagcaccacagugcacugcggccaugccauagccucucguacugggcgacacuaacacagcuagcgaggauucccuccaccacagaaauacaacccugcauacagucggcacaaaagcguuacaggaauaaacagguaagugugauuaacuuggccuggagucuuuuagcuuuccagcuguucugagcuguggcuguugguuaugaagucccagguagucccagggccaacagggaacuucaaugcaggaagacagggauuugaaggacaucaucccauaucuguugaaauggccauucucauguacuaccagccucgcccacuucugcggaucugcagucgagcucaggugucucucaugcaagccaagcccugcccugggccaucugucuguccccuuucacacugugggacugugcugagaggcugagaggcuucguagggcacgcgaggucacccucagugcaggcuccuccauccgaggagcacggcucuaaguccuuugcugacagaggacuguuuccaaugcggucggcuuuuaaaagaaagccccucccuccccucugagcaccacuucucauuucugagacauggucaccuccuuacccuaacauuucauguuuuacacacacauuuggagacaugacaagugacuucagagacaauauggagaauacuacggacgucucucaucuauagaucuaaggugcuuucagaaaacacccuuccuauucaggagcaugggcaggcugucaggcaucuucaggcucucuacugugagaagugaaugaacauguacaggauagaaaaaguccucacagcucuguaaagaugauauuuaaaguaauuaucuccuuaccaccaacucuuuccuccccucacagauaauguuuuuggacucauucuguguuucaggagguagaguagcccuccucugaaaagcccgagacuagagugucagauuuuguauuuuuccagacuuuagaauaucuaaagucuaaacauagauucauuuguauuuuauacauacauucauacagacagacucaagguaauuuuuguaauauuuauugaaaauacuguuuuaugauagaacucuuccugcgauacucaaacuuuaauacagcuuuggguuuuacuuuugguucaaggacaacagaucuacagugccggaucaggccggugcuacagaggugaccaggguauuuucacuuucauuuuaaaaauuuucaacaaauccucacucaaaauauugucauuuuaaugucaguuuuaggagcaucagagacugcaaacacacauaagacgcaguacaguggcaagcacacaugcaguacacaagcaguacagcggggcaagcacagaagcacacguaccuggucuuuuucaagcgucaguauuugguagccaguugcucuacugcauaugaguuucccacuacugucaaaagaagccaagcgcaaucuagaauuuaaaaaaaaaauacaaauuuuaaagugaagacuaaugcaaacaaggccuuccuuacucgccccucuucagagcccuugcuauucccuggaagucuucuuuccuguggacugaagccaggcucggcugugcaugcaugaggcaaacaugcuacuacagauacagccccaugacuggcuuuaggaacaggucucaucucaugaagcucggacuguccuugaacccuggucuucuugccuccgacgucugagggauggaguuacaggaaugugcucccgcagaaagugaguccuuuguaaagggccuuaaagggauuucaacacguaaaucagcaccauucacagcucuaauuugugcuacucuauuauauaaauauaacuucaugccuuuaaucuuagcacuugggagcagaggcaggcgaaucucugaguuccgggccagccuggucuacagagugaguuucaggacagccacaaagaaacccugccucaaaaacaaacaaacgaacaaaaccccaaaccaaauaagagcuucaaagugaccuuucaucucuggcaagacucacagcacacugcacuucccaugugacuccguggcaaugguaucaccacgcccauccucagagcauacacccccccccccaagcugacaccauccccaccaggcagcaaggcuucacgugucucuccccccagaacuggcauccucuagcuuacuuucuguccuaaaacccucuucuguucugggcaugagugcaagcaggguugcugcccuucagugacgcacuuaacucacuucacggggucucugcuggacuuuccuguauaaggaugaccagugcuuugcugugugagcauuacugccuguguuuauccaguuaucugacaaggcucacacagcuuggcccuauccuccagcuaccuugaacaguacugcuacaagccugggagaguacauaucuaaccaagucugacucuuugggauauaccuggaaacauaacugguaggcuggaaagcacuuguuuauucuuugaaaacuauccuguuuuauacugaagcugcaccauuuugcacaagguuacuagcaggggacaaagaccugauuauucuauagcuuuuccauucuuguuauugcuuuggauaaaaagauuagacacagguuuuacugugguuuuuauuuacuuuuccuagugauuagugauguuaagcaucuuuuuguucaggaggcauaauauaucuucuuuggagaaucuguguaucuggugucuguagggguguaugcauacauaugaguauauagaacggcuuuccucuaucacucucuaccuuauuuuuugagacccuggagcuuauccauuuggcuaagcagacugaauagcaggccccauguccucaggucuuccccccagugcagauugcggaguccaguuccuugggaggcugcuguggagugaucucagguccuuaugcuugccuggcaagcacuauauuggcugagccaucuucucagcccuuuggagaaauucuaugcaaguucuuuggugcuuuguuuuacuggacuaaacccagaguauugugcaugcuucacauggccuuggccacuuuuuaaucuuuauguuuuuaaucauaaaaauguaauuuguguguacuaggguuuuuuguuuuuaagauuuauuuauuuuauguguaugagucuacuguagcuaucuucagacacaccagaagagggcauuagaucccauuacagauggcugugguugcugggauuugaacucaggaccucuggaggagcagccaguguucuuaacugcuuaagagccauaucucuagccccaaaugaggguccuuuuauucuuuucuuucuuuuuaaaaaaaaauuuuuuuuugccugcauauauauauaaguguacuguguacaugccuaguaccuacaaaugucaaaagaggguacuggguccucuggaaauggaguuacagaugguugugagcuacaaugagggagcguugcacugaaccuggguccucucaagagaaccuacucauggagcccucucuccaccugccccauccuuuuagcugggacugucuaauuagccugaaaccucacuggaaccacaaaccuuugcucccacaccugccaguucuguuguaguuucgguuggcuguguacucagaaugcuaauccucucagggccauagucugcuuguagaucucuccuguucuguaccugccuucucgaugcuauucuuugauacacacacuuacaaucuggaugaagucucuugaugccuaugcauuuggcaucagaucaaagaagucuacaccaaaucaaauguugcaaagccuuugccuguaucaucuucuaacugagucaacgacuuuaggucuuaccuaaaaugccuuugagguucuguuuuggagacagucuucauuauguagcucuggcucucauggaacucacauauguaaauaaggcuggucucaaacucacagacaucugccugugccugucuccuaaguuuacacacauuaccaccugcuuggcccccuuugaguugauuuuugcaaacaccauucaacuacuugcuccuaucaaugcagagcaccacaugcaggaagugaaugugagcuuagcuuucagguagagcuggacacagcgcguccaacaggugcuuuccaagaacacuguuucccucagcacauuuuauuugcuaggaauauaacauggugacaguuucaaacacagaaccaagguguccaucacuccugcucuaacuguuuaucugacaccgaagaccuuccgcucuuguuuauggagacguguuucaagcaauggaguucucucaacucccaguacuuucccaguacuuacuucaucuuaccaaguccuacaccuaucuuacugguggucaagguuuuaccuaauuucuuacccuucuguguguaggaagugggggugccauccuaccuaaaugcuaugcuccuucgaggcuguaagcugacagauccacuacauggcugguucagcguauugcguuugaaaaugauguaucgauugguguaagucacaaggaggucaaagccgaaauugaagccuguccagcgccagcaguacuacgagagacaagagacgguuugacuucaucacaucagcaagccguacaucaaaaguucaacuuuuuuuuguuuucuucuuuccuucacuucaaauucucaagugaucuucugucacugcugcucccacagggcucugacagaaacagagagguggccucuaugaccugacuccucaaccuucaucccauaugccccuuuacauugcagucccagcccagggaaccaggagguuacuuuaaaaugcuucagacacaugaaggccacuucagacaccaguuaaucagagaagcaaguaauaaggcagugugggaagggcagguauaccuuggauuaaacagucauuuagcauucacugcaccaagcucaacuccagggaguggaggcacaccagucaguagauuucuaccccaguagaauuuguaucacacucuugagauacauauuacaugguagacagaggaugaguauguagggauggaaggucaggagaaugacaggagggagcaggggacuagcagcuagcgagccuggugaaaaaugugugaggagcucaaggagcuuuugggaggagguugggccaacgaguagacuggggccugucugggcgggggagauaauaaauaaguccaaaucucugugggugaaaacaugcuuggcuucucagggauggugaggagggcucuauggcuaggccagcacaggaacugcagauggcuucccagaggcagucaggcaccuaaacuaagugcaccuagucagucccuggguaagggagagugugggaggcuaagagaagauucuagaaaaggaagcaacaugaucuaguuuauguuuucaaagacuacucugaauguugugugagagaugaugcaaaaaguaacagugaaauugggaucagucugaacacugguauguguccuguguacuguguuugaacauaauguucugugggaucucccaguagcccagacaggacagauggugaccugggcugagugucaucaauacagacaugaugaaauacauuuuaacgagugauccuugagggaucucucauggacaccaagaauguaaggaaagaacuagguauccacauaaacgcaguuugaagcauauaugacagacaaacaaagacucugcuccaggcggaaaaucuagggagagcugaagaacgccccaguugcgaugcucuagguauccgagacagaugcacagugggagucaagagccacugcugcagacaggcuguaauagcaaggggauccaugagagcauguagacaggggcuacgagcugaagcccaggcacagcgguacuaaggaagacaagaaucuagcagacuuuuuagaaguagcacccaaugaagcaggaagacaauugaaagcaaaauggaaaaaaccaaaccaaaccaaacaacaacaaccaccacccucuccaacagggaauaagugaaaaaggcugccaagagcaacaaaagcagaacuccacuugcacaugggucuucacggacacagcuguagcaguuccaguggagugcugggaauacugcaggaccucagaagaaacacugagcaagaaccgcaagugcgugugcagacaaggaacaauucuaagggcccacagcuacaggcugagugagugccgcagaugcaguaugggaggcgugugagagggaggcagggacugcaggcuuugcaggguuaaaacgggaauaagaaucaaugccaguggugcugauggaacacaaauuuaaucccagcacucgggaggcagaggcaggcggaucucugaguucaagcccagccuggccuacagagugaguuccaggacagcagggcaacacaaagaaaccuugucuugaaaaaccaaaugcgauggaaccaugauggugaacaaagacaggacagacagcucagcgcagugcuauaucacaaggcuggcggagugcugggaggacggugcagacucucaccacagggaaaaggcaaggcaccaccuaacugucagaugagcagcguggcccucacucgcugacaagguagagucacuucagacagggagaaagauagguacuaccaugaagucccacagaccaggugaucuucacgguuacaacacugagggaaaacccaggggaaaggugcucaccucugaccucgcucuggcuaguuuuacauuaacuugacacgagcuagagucauuugagaaggaaacucaauugagaaaauguccacaccaaauuggccuguaaggaauuuuuuuguuuguuuguuuuuuguuuuuuguuuagugauugaugugggaaguuacagcccgugguggguggugccaucucugggcuggugguccuggguucuguaagugggaagguugagcaagccaugggaaggaagccaguaagcagccccuguccauggucucugcaucagcuucugccuccagguuccugcucugcuugaguuccugcccugccuuccuucagugacgggacuauaaucaauaauuaucuacaacaauaauaaacccuuuccucuccaaguugcuuuuaguuaugguguuuauuacagaaauggaagaccuaacuaagguagaccuuuaaacaaauuuuagccuaagugagauacucauucagagucuauaggaauugggacuugcugugcugggaugaugagucugacagcauucaaagcagaaaagaaagggaaauugaauauacacaagggaaugguuuuaagauggaacaaaauacuagucaagaagaauuggugagcugacaaaaaaggugagaggcaaagaaaagcagacugugcuacucugugugguagaaaccauguucaaguccgagaagagagggcuagaaggagaaagagaagugggugcuauaaacaggacauugagauggagauuucugaaggugauacagauguugaagcugcugggccugugaacaagagcagugaagaggagagaccgagccccuugggugauggugacaggagagcuggcagguggugacacaucugcuuugaaggagcugcaguccacugagggaugaagcaacaagaugcaggaugaagaagacaaccucuucucuguccuacuacaacccugaaggcaagcaugaaauaaccuuugaaagucaaaguagagguaaauuugggaaaaaaagaagcagguaaaaacuaggcugcaacuagaagguggaaaugaugacagguaggcugcauaguccauuuaauggaccauaggcagcuuuuaaaacaacacagagagcaggcucucugcagacagcagagugaacaguccuuucccuuacgcaccuacacccuuguuccaugugaggaacaaaggcaguucuuugguguggugagcauuccaaggggacagauggcuuugauuuaggguaacugucaaacagaaccucauuagacuauguaacaccuccaauacaaucuaucucaacuucguacugcagaaggacccucucaagccucucaucuggacuccaaacccaaggucucaggcaagacugaggaaguacugagcagcacggcucuaacccguguucaggacacaagcugcagaaagauaaacagggucuucuccagccgugccagucccuaagcacagucuggucaucaggagccccaggcagcugcucgcugugcuucaaccacuuuaaaaagaacauguaauuacugacuuuagagauagcauguauaccucagugagcccacuuuuuaauauauuauuaggaaaauuugcaaacacacgaaaguacagagcaugagagaauuuccucagugagaugagacauacagaccagagccagaccuaccucaccaucuuuggcaagcuuucgaccacaccucaugcuguuucccucaaguucuucuuuauugauuucuugaggccuaaaaugauacaagaaccaugaacuuuuacagaaaacuaauugaaaaaaacaagacaaaacugaguuuaaaagaauggaaaguuuuucuacuggcuagagagcacucuuacugggauaaaguaaucuguuaggcccuggguguagcucagugacuaagggcucaccugaaagcaccagacccuacagucacacucagcacugauaaaggaaaaagaauauacugauuaaaucagaccuaaaugucaaugucucacugauuugacuucuagauuacuuccaugacgcuuggucaaaccagaaaagagagaauaaaauaucugagaaauuuugucuaccaggaaaauauaauacuuaaaaaguauaacuacuaaaucuauuauuucuaugagacauaguuuggugucaccucccccauacaaggaaggucucauaguguagcccaggcuagccucuaacuuguacuccccgcugcuucggccucauaggcgcugggaucacacguccgcaccagcacagccagcucagcaucaaggucuugaugucaccuauuucaaaugcaaacuguuucucauggcauguaauucuuuaagaccaauauuucauaggaaaaauccauauaguuuuuucuauuuuccuucagcugguuccuuacuuuaaaauuucuaaucaugaaacugaagguacgauacagaaugaguaauaaacaaaucaugccuuaguaucugggagcucaggcuaaugggagcuagacacaguagcugugacccgcgggaagaggugugguacaaacacauagagaggagaggagaggcugggccaccacagggucaggcagacuguguucuugguagaggaggaauacaagcagcacagucuaugugccaggauuuggucagcugagcuaaggugacaugagcuggcacuagaggcagcugggguagguaggcggcugaagaggccuugcucgugaguuucuccucaaguuuuccugaguucccacauguauccugugacuauucaacuuuuuaguaugacauuuugcaggcauauaaaagaaagcugcaaugaggcaaauacucccauuaccaagcuucuguaucugggaagaacaacucaguaccaucagaugguauugucuguuuuugccuucaggcagaagugacacacugcauuucuguuuuagaaaaauaauccucuucagucugggagaagcccuugaaggaggcuuuacaggauccuaagacaaaguccuuacacuuuggcagccugcaacuggagcagauacugggcggaaagaacauggcuaugcaggcacacaguauaaacugcauguagugcuagggccuaggacauccugcagauagguuaguaguugacccucagcuaugccccagcugacacacauauuccccacgucaagcaaacaagacacuuauagaagaugucucuuggcuaagugagauaggacaaaguagaaaaaaaaaaacaacaacccucaacaaagaacauccuaaacuuaaagccaauacucaguaccacagucaccauccacuaccugauaccagcacuucagaucucauuuucacuaaauaacugacucauuuucuguuucuuuauuugucuguaaaauugaggggcugucuuuagccagagguagauagagagacccagucugucugucugccugucuguccuuuuuuuuguggggagaacuugagacagaguuucucuaugcagcccuggcuaucuuggaacucacucuauagagcaggcuggccucaagcucacagagagugcugagauuaaggcaugaguuaccaucaccuugcugugagaucccaucccaaaaaaccaaaccaaaaccaaaccaaaaccaaaacaaaaaaaugucuuguuaauuucuaggacacuuucauauaucugcuguuuagacagaaacuuacaacaggcuauuauuuucggggaauucuuuguguaaaaugaguuaaaagagaguggagaaaacaaacaaacaaacaagcaaacccacccaacccuucuucuuaagcuucuuuugugcagcuguaagcauaauggaaauaccuucaaaaucuauguaguaaccauaauacugccacauaccacacuaugaagaugagcuuugucguacauaaauauaaaaaucacaccuucuaaauguaucaguuuaaaaagucauggcagucagaugagaugaaaacacugccaucuagaauccugucugcugcgugccagacaacagcagcacuugaggcccagacaacagcagcacuugaggccaacaggcagaauucugagggcagcaagcagcugcagcuuucugucugcagaggcucugccuggaaagcuuccugugggccaggguucaugcucacaggcuuucugaaaacugccaagguuuuuuuuuuuuucuuuuuucgugacaggguuucucuguauagcccuggcuguccuggaacucacuuuguagaccaggcuggccuugaacucagaaauccgccugccucugccucccaagugcugggauuaaaggcgugcaccaccacugcccggcuaaaaacuguccaguauuuugaagcuuuuccaucuaguccucuugucuaccuauuuuguuaguuauuccuaaguggcuccacuaaauacaauauaaauauaauguauaauaaauagaaauagaaauauucuuagcaagguuuacuuauuuauuuuggauuggagacucugcuagaggugucagccuagcacgugcuagggugaagguucaagcccccacacuaccaagccaguacuaugauguagcauacucaccccacuucacugucuuguucagcccguagcauagccagccacugcuguuuauacacugccgccagccauucuaaaacagaaaugucaauugauaacuaguugacaaaacuuauuucauuuuuguguuuuuguuuuuuuuugagacaggguuucucuguguagcccugacuguccuggaacucacucuguagaccagacuggcuucgaacucagaaaucugccugccucugccucccaagugcugggaucaaaggcgugcgccacuaccgcccggcccuuauuucuaaauuuauauuuaaaacagcaauuuacaaagcagguuguuaacaaugugacucucagcucuuuaccaugguaaaggccuuugagcuuucucucagacuuaagaaugaccuccuuuccaaaagagaaguaaaagccuaugcugccuggcgcuuccauuuucuccucacagcgcacacugauuuccauuugugagcauuauuccuaacaguguuuucacuuuuguuuugucuuccuuugcuugagacaggguuucuguccuagaaccaacucuauagaccaggcuguccuagaacucucucuguauaccaggcuggcccugaacucacagaccugccuuugccuccaaagagugugccacccuggcuguuuucaguguuuaauaaaguucuauauugguaaacuuaauggauuuuucacuuauuaaguucucugucacaacacuucauucugguaaacacaccaucuuuuggguuguagagagcucugcagcaggaguacacaggcaaugguguagaacaaagaaggucuuacugguuuggacuuuacccaauggaaggguaacugugugucccuuaucagcaucuacaugaaacuuaagacugccaggagcugagaagacaggagagguuccaaagaccaguggagagcagagagagggcugaggagacaggacugugccaagggaauguggcuuugcauggcaggagagagaacagccacaauacaccagacgucugaugcugagcaagucucccgaacaagguuaacgguauuuccauggcugcaaagaaaaauguucccagggcugaggucaacuaaugagaaggcagguauauacauaagcugacuggggagggaagagggugagucagacauccaauccuaugauauggaggaaggaucaaggguuagaccacaagcaguacuagaaaggacacugggggccagcacugggacagucuugaccuccuugucuaggucagcagggugaaagguaagguucucuuucagugucuuucaguacaguuaaauaaaugcacggagggcacagaagacuuugagauuuuguugacucugacuccauaaagaaaaaacaaacaaacaaaaaacccaaaccaaaccaaaccaaacaagccaagguuagaaaagcauggugcuaagaugggaagcaagcggaggaguaagggaagauguggaauaagaugucugaugagaugaccuaggacaaaucuaauuucaugaaauaaugaacuucaacugugccuaaaaugaagacggccccugcccgcccgcccugccaccugggcucugugaguggcacucaggagcucugccugugacuuacaucucuacuccucaguuuccuucugagagcacacaccaaucuguguuuauaaugugagccguguagcacuuucugucuccucacaaaagugugacauuuaauuuuaacuuauauuuugcuuuuuaagcuaaaauuuuugaauacacagaaaauugucuacauuuauaagauggaauuaauuuguuucaagucuucucauauuauaucauuucaaaucacaaagcaaaacaaacaaacaaacaaacaaacccugaaaucuggacagaauuuuuaaaaaauuuuuauaccaaauaaacuucuuuagacuccagauguuaauacaguuuugccuuccagagacacaaaacguguccacuuguaccagacacaccuaauguauauaacagacuguuuuuuuccaaauuuuauauccuuuaagauggggcuggggaguuggcucuguguaagagcaccugcugcuauuccagaggacccaaguuugguucccuggccacaucagacagcuccuaaccacccaucuguaacuucauuucuagagaacccaacguccauggacacgcagggccugcacucaaauacauaaagacacauccuauacauaauuaaauacaucuuuagacagcuucaaccaaaguuugauccgaaggacacauguccuguggcaucuaauuuacauaauaucuauaaccugccugauguuuaccacacacuaaaacuacuauaggcuuucuuucuuccuuucuuuuugcugcacuuugcaucaaacucagaaucuugaacauguuaggcaaaugcacuaaugagcuuauauacuacuaaaugcaacuugucacaaauacaacagauuuacaaaaauaaauuaguacuuguucaagaaauuugaauuauaucaagcagauguauuugauggaacauguuuaagaauucagaauaagaaaaaccagaaacuaagcaaauuuaaagaaaacuaacagaaaaagcuauagcuguaauuuuaaaaaaauaucaaaacucacuugucaggcuguuauccaaagcagcucacugguuaaccaaccugacaauacccagagccaagugugugguugcacacccugacggcggcacuugggaaggagaaguagcagaugaacugcuucaagcuggggcugacuacagcuuaccagcagggccuagcaugcagcugaggcaguuugauucauacagaaaagaaaaacaaauauccuauugcaaaaugcuucuuagccacuuaacuaugguggcaagcacuuuaacacugaaauaugauaagggagauaaaucaggaugagaggugagcacaggaagaguauucacaugcccaucucuugggcauaaagacacuuaccuuaagggaucaaagaggacuuccugguuucuuuacuuuucuucccuaugcaaguaugaaaugcuacaaucagaaaaacaugacuuuaaaucacaaaacacaucagguuuucuuaccugaagguaccagagaauccugcucaaugauccuugcagaagccagaucacugauaauguacuguagccuuaaaugucugaacacgggcgcaaaugguuuucccugcucaguuucaaggaaagucgucccuucaaagucuauuaagaaaguuuuaauuaaacagcauucuugucaaaugugcuguuuuacuaaaugcuucuauggauagucauagacacaguuugcuagaauguaaguaagccauuuccaaggauuucaacacucuuagaaugaaucuaagauuugaggaaacuuacaggaacuuugauagaucucucaaauuaauuuuaguaauaauuauguccuuagguugggacuucagcuguccuuuuauuuuugugauugcucuuacgggacagcaugguaagagagguauacuugaggaagugacuuguaugagacucugucucuagaaucccuucccaaggaacccagaggcuaugucagggucuucacauguugaccaggacagggacagcuauucagccuucuaacuuacaucagugauggagacuacaugcaguuuugagcugccugauaugggcacugggaacugaauuuacaucaucuucaagagcaguacacacuccuaagucccaacuuguacugagccaugucuccagccccuggaagggcuccuuacacaccaugcagugcaugccacauaugaccucugcaucuacuucccaguuagugaugcacagaaguagccugcagaccccaucaagauucacugguugagagauggggcuagcuuaucagaggauaucguauaauucccacgaugaacuuaugacaaacagaacaguaguucugagaguuaggaugugggacauuuccuucuccagcacugacugcuguaaaaggcuguaaaaggcugagguaggaaauugcucaauuguuuuucagcucuaaaaucaggccaaggccugacuguaagaaacaucauuaaaagaaggugugugugugugugugugugugugcgcgcagguguguguauggggggggauaucaauaaaaaaguuucaauguaccuuuuuuccacuuugaaaaccagacaucuguuucugucaaaagcugcuuuaaagacccauuccaggaaggcaccagcugaaggaacauccacuaguuagaagacaaagcaaaacaaaguguuguaagacuucauugcuuugugguaguauuuucaaauaguccuaucuuuaaaaguaacuuucuuuuugagaugggggucucauguagccaggcuggccuugaacuuaauauguagcugaggacaaacaugaccaaccugugaagugcuggacuacaggccugugccaccauacucaguuuuuaagucagugguucucaaccugugggucaugaccccuucagcaaaccacuaucuccaaagacacugacguuauaacucuuaacacuagcaaaauaacaauuguaaagcagcaauagaaagaacuuuaugguugggagucaccacaacacaagcaacuguauaaaagggucacagcaggaaggagguugagaaccacuggacuaacuggggcuaggaacugaacccaaggcuuuguauaugccaggaaagcacucuacugauggagcucaaucucuagccuagauaauaguuaaaauuucuauuuuacaagcagcugcaagaaaguuuaacuacuuuaaaaacugauuucacuuuauuuuaugugcacugguaugaauaugucagauuccgugaaacuggaguuacagacaguugagagcugccaugugggugcugggaauugaacccugguccuuuggaagaacugacaguacucuuaaaccacugagccauuucuccagcccugaaaguauaauuaguaaagcuuuggcaggaaguaagaauuauaaaaacuccaugugaauauuaauuguugcuaacacgccuuagugaaucaaacagcuagaguuuuaacauauauaacacacugguaauucuguacuaacauauucuaaucacuaacacagcaaucacacuaaauaugaugcaagacuauaagacugcaaaagcaagaaugaacacaggaauuucugacucugcuauugagacagcaugcauggugacgagcguggauguucgauccuccagcugucauguaggagcugaacacaucauuuaauccucugcauuuuaauuucuucauuggcaagugaagugucauggaguaucucccuugcaggcuacaaaaggauguguauggaguguuuauuaguacuguguuggcagagugaccacuguccaaggacagcacuuuggacaucagagcagcuacgaggacagacagaacgacugcuaguacaguucacagguaaaaguguaauucccuucaacacacacacacaaguuauuuccuugaaggaaacugucaaauucugucccaucuugaccaccaaaauacuacgauggaagguucucgcugcagguuucacaacugcaugaagugcacacauuucccacagggacaacagacuauggaugacacacaguggggcaagagcaguggccucugccguaaguacacaugaguagcgaugccaacccuuaccaacagacagaguaauagcugaugucuuuccaacugugaaacaaaacuggaccuaaaucuaucaaaaggaugaaaaggcuggguuugguguucacucggguaaucacagcacacaggaugcugaggcagaggguuaguguaggugugggaugcagaaugaggcccugccuccaaaaaacaaaacaaaacaaaacaaaacgcaagagcaagcacugugguggucugaaagagaacagccccagcaggcucauuugucugaaugcgugguccucaguggguggagcuguuugggaagaauuaggagguguguccuuuugaggggugucauuugggugagauuugagguuuuaaaagcccaggagaggcucaaucucuugcucugccuucaucuuacugauaaugauauaaacucucagcuucugcuccugugccaugccuacuugccaucaagugcccugccaugaugguaacagacuaacccucggaaaccauauacaagcccucaguucaaugcuuucuuuucuaacuugccuuggucaugguguacuucacaacaauaaaauaguaaccaagauaaucaugaaucucuaagucuaaaugaagacucagguuuuggcacauguccucagcuugagauggguugguggaaugacuuagcauuaucaguacugugauaguggagagauauaccaggggccaccuacuuucacuucaggacacaacugaacaaacuacugaagucacaugucauuuaaugauguaaguguccuggcuuaggugauguggguauuguagccuaaacacgcauuuugagcacauucaaggagagugaagcugagcugugguguucguuaggugagguauauucaguuuaugauguauuuccucagauacaagccaguguaagccaagcagcauguauaguuccucugcuuauugagcacccagaagcaguauuuccagcuuuucaccacagaagcaaugugaaguaauauucuuuuuuuuucugugaaguaauuucuuauauucauacaucaauaccuuuuuaagagcuguauauacauccaucuccacuugcaucacaaauaaguuagacgaaccaaugagcuguuucaugacguuuauacuguaaaaagcaaaacacgagugagcuugucuucaacacagcugaaggacucuggugaacuaagauuuaacaaauuuuauauguguguaugagagagagagagagaggagagagagagagaaagagagagagagagggagggagggagagauggggggugugugugaaugcaggcacacaaguccccgugugcguguggaggucagaggacaacuuucaggacuugguucucucccuuucccacaggucuagggcuugaauuuaggucacuguguagugguugcuuuuaccuguugagcugucucacuggcucuaaaaccucugucaaauaaaauauggaguuaaaaauguuaacaaucuuauuugaacaagacaaagcuccugagcuagcuaacacugcaucucaacagcaguuucuuaacuuugacaugggguugugagggaucugcgaggggccugcauuuauucacuguuacacugggaaagcacugcaggcucugacuaaauaccagcccccuucuuccuccccaugguccuauguaaaaaugaaaaccaaaacaccuuuuuauuuuuaauaguauuccgguuuuugugacuugcuucaucucuuuuagugauagauacuuuaacagcuggcuuagagcagaaggaauagggggcaaguuguaagccagagaaaguagaggagcgaugcaaugaagcuuuuuuuuaaaagauuuauuuauuuauuauauguuaaguacacuguagcugucuucagacacuccagaagagggcaccagaucucauuacagaugguugugaaccaccaugugguugcugggauuugaacucaggaccuuuggaagagcagucaguucucuuacccgcugagccaucucgccagcccaccaaaacacuuaaaauucacuaaaauagcugcauuuucaaaguagcauuuuucucuuccugaagcaggaaauuucuauacagagcaggcuguccucaagcuugacauccccugaucucagcuuucucagugcaaagaucaucagugagccccacauacuacucaacauagccuuuaacaucuaugcuuacaagaacuuucagucagaaagcacccuguaagccaggcauggcagcucaugccuauaaucccugcggaggcaaguaugggucucugugagucugaggccaacccaucaacucagugaguuccagagcugccagggcuacagugagaccuugucucaaaaccaaacaucuuuacgacucuuagcagaaaauauggacggucaggaguuuaaauuuagaauggaaaaguggucacuggcugcucaaucuaucucuuuuucuuucccuuuccuuuaagacaaaaagcauuuggguuucuaagacaacuucucuuugacagucuuucugaaaaaguucagugagcucucuaacaucucucccuccucucuuggaagccacaacacacuagacccuuugauauauccauuuucaucaaagcaccuuuacuuccagcacuucagaggcagagcuaagugaaucucugugaguucaaggccagccuggucugcauaggaagcuacagggcagcuagagcuauacagagagacuuuguuucaaaagcaaacaaaacccccucaaaacaaaacuaaaaaacacaucacacacaugcuauuuauaaccuagagucuucauuuuccagaccugucauagaugucuuggucucacagcaaagggaagccaacaguggcaaacagcacaaucacaccacaucauccacagaccucagcuguguaucaucaacacuccaggacauccauaaggaagggcggaaggaagagugaaugauaaaugcaugcaguucaaagggccaagcuaacugugagugugacuucaaucaggguaagaggaguggggguggagugagagagagagagagagagagagacagacagagagagacagagagacagagagacagaaacacagagagagacagccagagagacagccaucauggcacguguggaagucauaggacaagucuuagggacugcuucucuccugcuaccuuguagucuuggaauagaauucagguugacaggccuuuugcauuaagcgccucugccuucugauccagcuacugucccauaaacaguuuacaguagggucuggagagcuggcucaguggcuaagagugcuuacugcuucccagcaccuacauggcagcucacaaccaucuauaacuuuaguuuuaguggauccuacacccucuucuggucucuaaggacuccuggacacacuagugcacagacauacagacagacaaacacacacuacaaaucuuuuaaaaauuuuuuuuccuaaaacacauuuugauuuuuccccccaaacaucauguucuaugauagaaaaaguuuucaaacuaucgccuuugaagcucuaugcuugcagaagugagguagcacuuagaagucuuuacggucuuugaggaguaguacguuuuuauuacaacuguuaaaauacauauauauuuuaucauuuauaacaaagagauaagugccgagcuuacuuaucucuuguauauaagccagggugccuuuuguuaaauuguucacuuuuucuuucuucuuuccucucccuccucccuccucccuccuccuccuccuccuccuccuccuccuucuccuuuuuuuuuuuuuuuuaaaagauuuauuuauuuauuauauguaaguacacuguagcugucuucagacacuccagaagagggcgccagaucucguuacggaugguugugagccaucaugugguugcugggauuugaacuccagaccuucggaagagcagucgggugcucuuacccacugagccaucucaccagccccuuuuuuuuuuuuuuuuuuaaacacucaguagguacuccuggcuguccugggacucauuauguaaaccagaccagccuugaacucacaaagauccaccugcuucugccucuaaguccuaggauuaguguguacaccaggccugguucucacaauauucuuuguauuagaaacaaacccuggacuaccugagcaaagaaagcgggucauuuuagggugaucggcuguaaagcuccucagugucacauaccugaguucuuugaaaagcuccacacucuggugagucaugagguuguucagcagccacucgaggcaccuggggucaaagcaggguuagcugauguguccgaaacugcuaacucaccaaggucuuacucacaaucuagugaaaagagugguagucaugcuaggccauucucaaagucuuucccuuagugaucugaaauuuaguauuguuuugucaguaguuauuacgggaaauucccuuaacauuaguaccauuucucauuaagaaaacuucauguuuguguuacuuuguaagauguuaccuuccauacaauuuaaaaauaaguucugcaauucucaagagucaaacugcccauguuuguauugguauaccaucguagugccuacuccuuaagugguggccaaaguuguauaagcauguuucaggcccacuguagucaaaacaagggcaauucugagcaacuuaaggcuuaguccagcagaaaagcaggacucuuaaaguaacaaagucuacucuuucccaacuaauucuuuauuacauucucguaagacuccaaaacagcugaagccccagaaguggggugggaaagaaacaggaaagguggcucacuuuuucuuuacagagucuaguccauaggucccugccgauguguaauagccacacacaguucucacagagauggucuccuucauugucucaccgcacugcuguaucaaaccauccuguaaacauaaacaagcacuagaaaggccauuuugccuggggaaucagcucucaugucaugcuuucuuacuaagauguaaaaccaaaucaaaauagcaaggaaggaaggaaggaaggaaggaaggaaggaaggaaggaaggaaggaaggaaggaaggaaggaaggaaagaaggaaauucauuaacuggaguuagccuaaguuuuuuauagguccaauagaaauguugaaaaaagaauccagcaauuagcccacugaccaucugaagcugagaaugaacugggcagggaggcacugagggaagaugcugugaguuucauauucuguuuucugcucuggacuuuacaaauuucuucaacaggacuuguuuuuuccuguucuuacugaaccaagaauucuuuacauagucaucuaaucaaguuacaggacaaacaaaggaauaauaucgaugcguggaacagugcucaguuaggguuaaagcaccaucaauaccccacagauaccucuaaacaaguauaugaguuuuaaauaacauuaaaauuuuaauuuaaugcuccccuccccuccccucauggcaggcuggagagcuggccccagggucaugagaguagaagaacuggcccugucccuuguuucaagacagcaggcccugcaucuccccugggaggcauggaagagcuagcccugacgccaugugcauugaugagcaggaccugagggcaugagaaugguagagcuggcucugccacuugcuggcugcaguguuggauggacuagccagggaagggcugaagaacuugcccugguggugugggugcuagagaguuggugggcugaccaacucaagauacuucucaccccaacaucgaccucaucagugaacugcuggauguacgaaggggcuggcccuacagaucuacaacuacagaucuccaugacacaaggcaacaagaggcuauccaagaggagucccagugaggauccaguaucaauaguguagcagaagacagaggcauugaaucagaccaacaagucacugcaaagaaccuuuguaagcaaagauguauggacaaaaggguauaccaugggccauauugugacauaugauggcuuccauaauggaauuuuuuccuuuggaggggagguuccaaggauggaagguggguacaagaggaaggggugaugagugggaucaggguacaugaugugaaauucacaaagaaccaauaaaaagcuuuaaaaauuaaucuaaaauauuuacauagguuucaaauaaaccagcuuuuauauacagaaagaacagucauuuuucauucaaguuucugaaacauaucaugcaacuauauuauuaaauuagaauuaguaaguuauaaaaauaaggcagaaugcagauuuagaacaaaaccaaaaggaccaaaguuagaaaauauagauauccaaaguaaguauuagaaagauaaaaauauuugaaaaaauaaccucagccaggauaauaaacaagcuaauaacuaguacuuuagacucagauagaucagcaugucagaccacaugggcuuaaaguaaggcauaguacugacucaguguuuuauaaacuuaucucaauucuagacccuucuucccuaacacacauuaccccaccuccuccuggggagccuuuucuucucugugguuguuacugggacuuucaucaagacagccacaguaugucugcaucucuaacauacuuucuuuccuucacauguuguaccugaaacaaucuuccauuauuuuggugugaaguugugaaucaaacccacagcccugcacaugcaggugagcacaacagagcugcaccccucagcccucuaaaauagagacugucuaucccugauuaaaaucuuccaaaggagcucccacauaaaguuaaacuuuacaaugugcagagaaaccuucauuugcugauuuugaccucuuuccaauccuuuuuauuuuuuguuuuguuucuugagacaggcucuuacuauguaacucgagcuggccuauaagucaccagggugaucuugaucucagagaucugccugcuucugcucccugagugcugguauuaaaacgugcacuaccacaccuggauuuuuuaaauguuuauuuauuuguguuguacaccuucacagcaugcauguauugaccaaaggaaaacuuggaggaagucaguucucuccuuugaccauguguguccuggggaugcaacccaaacugucaggcuugauggcaggcaucuuuaaaggcucagucaucuugccagucccccaauucaauuuauauuaauaguagaaacuuagucuccuuaacuucucuaaucuuccauccucuguuccuggucagaaaugcuguuuugcaccuuuucacacaguucaagguaagcacccuucaaacuccaucuggaaguacagugaggauucuggguugaacuggcucuuccuaucuuccaaguuuauuaggccucugcaugguguuuguguuguacucuuaacacuggguaacuguuugcaccuuugcguuuacuuaucucaguucacugugagauccuugaagguacacacagauaacccauguuuagggauuacaucuucauccucucuggcuccuuaugcuaagucuuacauauugcacaauguguucaacauauaguuacugaaagacgcacauuauuuacaugggaugauaccacaaugaagcuuaaauaacaaacuauuucuuuacccaaugaauuaaauuuacuuuuuuucuuuuuuugguuuuucaagacaggguuucucuguguagcccuggcuguccuggaauucacucuguagaccaggcuggccucaaacucagaaauccaccugccucugccucccaagugcugggauuaaaggcgugcgccaccacugccuggccuaaugaacuaaauuacugaucauauaccaucugcuuagcagugaugccacugauggacagaacucugcagaggaaugugugcagacaagugaacuuuccaagugucagcaaaucaaggaagcuaugaagaaacaccucccauccaguucacacagugaucaaagaccuucaaucuaaccaauaacuuuuggucaaacauuuucagcaauuucuaacaaauggcaugcuuauccauuuuguuuuaaagauggcagaaguagaacuucacuucuguuuuagaggugugcacagagauagacuagauuccuugacacuacuuaccaauugcagcaugcaagcugcugccaaaauggcaacgacccugcugggcuuuauuaagacgucaucucgauacagugauccaaaugcgaccugcagugcugaaagcaaaagugcacacacagaaugaaaugcugccugcaggugagaggcuccugcagaagcagaaaggacauuagucugcaccuggagaagcaucaggaacuaucauggcagcuaugguuacugaugguguuaauacauaacauugcuuguuggaaaggauucugccaacuccagccauauuuucucugucuaaucuugacauagucagugguuagaaguaaggcaucccgugaugugucagcugugucagaacugcugaguacaucaacucuaagugcacagcccaucacucuuugauaacauuucuuuagaggaguagguaaggcucucacucacaauguagauaaggcuggucuccaguucacagcauccuccugccucagccuccucagggccagaauuauagcccuguggccccaggucacuaagaugugugcuuaacuugugaccaccucugugcccauucacacccggucuucacaucuaagaccacucccccuccaaugccucucaccaauguucuucagauugcuuuguaaacaccucaaguuucuuugccucuggagcgggccuuggguuuccccacuugggauaucaaaggagaugagcaggaguagggagggaggagaggagggucugcacagaggcucgcuaagcuguucucacaaucccuuccccuccucagcccuguuuccucagccacagcucccguaaagcucucaaacagccugcugcaugauucauaugcucacuguuccacagaagaucuucacacaucauuuauuuuuauuuuuugguguuagagagcaaaccuuaaccagggcaggaaagcacucacucuuuuagcauuuagcugcagcccucacuuauagccuuugacaaaaggagacaagcuucccaugcccucccaugcuucacaucccaggcugacauagccacaaagacacaugagcgacugacugaacuccuaggacuaaauagagacagaagacacaacagauaaacugagugaaucaauaugaaauuuccaccuucuaguauaucauacaacuuuuccccuugcuuauaaggcuagacuauauuucaucaaaaaaaaaaaacccaguaauaauuauggaggugauaccuucuauaucaauguucuggucaggaaucuccaguucaauaauauucaugcuggauucuuuccaagaaccacugaacauacuagaaaaguagccagacuggaaaaaaaaagucaaugauuagccagaacuuuaucuuccaaauauuuuuucuaauaucuauuucuaacucuaagcauguaccauaucaaaaaaaucuaacauaucauuucaggagaaaaagaucaucaaaacacguacaagaagaagaaguuaaaaauaaggccauuaugagguagagugaacuauguguucagugugauacuacuacaaauccaaagcagauagauucuuacaacacuaucagaauccagaccccauaucacaauggaaccugggcagccuuucagcagucagagucccuaaggaggcauuucuuucucacaagcccagcaguacguacaguggguguaugcuucuguauucaggagagccgaggaaacaaguccuccucacacuaccgacucuucccuguggccucaguagcgauuaaggauccagagaacucccagacuggaccuaaaaggaugcacuccaaagaaaucugagacccgcaacguaguuuuauaugacuacagaggauucugaaucccagcguggguaaagucuguuucuaccugcuagguccguuccuuauaauuaauacugcaguacuuuagaauggaucaaguauuaacuaauuaaaaguucuauuucauauaaaaaacauaauaauuaaaauagaauaaacauaacaucccuuaguccuuaugcucauauguuugcauauguggcugcaggacacagucaacuauuaguuuaaauuuuuaaaauuuuacuuuuaaugauggcuuuuaaaugcuuuaaccuccuuucuagcccaccacucaccagagguaguggaaaagaaagaauaugggggaaguagaccuguuuagaaauuguucuuuagagcaaaucucaucuacauugucuggaaauuagugguucaguucacaggucagcagcagcagcucaauccacuggcaaacacuucaaggauauaccuaguuuaguaguguugggccagcagcagcagcagcagcaguggcacaacuuagcagagacagccagaccucaguugaauuggcacaagucagcaggagggauuuggaccagaagggacaccaggagaaguucuccacugugucucucucaaugaaacgaagaucagugaacacucaagaccaagaagaguuguagagcuagcucuaaaagcaagcaccucucacaguucauugagucuuuuuauacucccuccaaacaucacaggcccuccauaggucuugcugagccaugugucuugucucagcaugugagucugagcauaaguccaugugacucugucucagcugacaucacuuugccaaugggccugguccacagagguggcaagaaguuaaagcacgccgccacaguuuuuuggugcauuuucucucauagagucccaacaaugcagcucaacaacauauaagguggaccaauacauguguguccucagcaaagacucuuucacuacaucuccuuuuacugcuugcuuuauagucuuucuaccuguguauacuucagagaaacauucuuucacaggucugccuuagcuuuuuaccugugucagcuucagugaaacguuccuucauguguuugccuuaggaaaacacccuuuuaguuguguauguuuuaggaaaacuuuuuuacauguuugccccagcaaaacaccauuuaacacaaccgacuuucuaaagaacccuuaaguuuuuacuucagucagcacuaagucagaugcucugacugugcauggcucacacacucaaguccccuguaggucacagguagugccuacuacaauguacaugcuauauaauagccacauuauggcugaggggaugacaaaggccuacauguucaggacaaaugcaacugucuuuuuuccaaauauuuguaacacagaguuguuacaucugaaguuguggaaccugcaaauacauggagccagcuguucaacauggcccacaacuaggacacagccagugguucugucugaaggugcugucauggauugugagauuucacagaagacauuccaucucaagucaggaagaggcugugcgucuucuuuuagggauucaagagacagcuucaguugauauugguauucugauguacaccuuggauuguagucuuugggauauuuuuuaaaggaucucaucuuucuuaaaaacuuuuagacuaaauucgucaaguaaacuugcucaaaaaaaguuucuaaaaguuugauuaaaaugugggaggagggacuggagugauggcucagcaguuacaagaacuugcugcccuuuuugaggacuggaguugguucccugcaugcaccucaggcaacucacaaccccuaacuccaaccucgggagaccugacgcccucuucuggacuucaccggcacuguacucaauugcacaaacccacacacagacuuacauacaagaacauacauuuuaaauagugaaaauaaaaauaaauuuuaaaaaauguaauuaaaugugaaaggaaaaauacuuugcaaacaucucuggaacaauuuagcucuauugucuuuccucucauuauucuuucacaaugagggaagcacuaacuccacagguaagagcugugaggucuagcacagcaaauaaaugaaacuugagugaguuggcguaccuuaggcugagagagaugguucgggggagggggugggguacaugcacuugcugccacaacugacaacugacuccaauucccaggacccuuagagaaagagagucaacucccacaaguugcccucugacauauacaacucccuggcaagcauguguagacacacacaaaauaaguaauaauaaauguaaauguuuuaagaagaauaaaaacaucugaggucuuagagccacacuguguucuauuuugaaaauccugagccauuuugaagggaaacuugcgauggggaaagucaaauggguaggcacaucaguuaagugacaugcacagcaccauugcaggucuccuaacccaaccgggcguucuagggaggaggaaaacaccaccucuccauucacuuucuacaaagcaacacuucagagaaaaguauucaaauaguuauaaaagaaguguaaugaccuuaaccugaauauuacagauguucuccccaguucauccauuuuccagcaaaaggcacuaacacaagcuuuuugacaacaagaggcagaaguggguaguaggaccaaguaggaccaagaauuucaaaaucuguuugaagguugaggccagcuuucacucccagugcccaccaucuuucuucccagcagacacuuuacuagaggagagcuuacuaugaaauccaaccaaacagcagaacauacuccaagugcccaggcuucuccaagcucccuccuugcccagggugucagugaaauacucacuugacauaaguagauuuuguguaagcuccacucuucaccuagagcacagaucuuaaugucacuguuuucaccauucaaaaacagcguuugguagauguauuuugaugugcucuuuaauuuuuuccuguuaagaaaaccacaaaguuacaaacagcacagagcucagcaggagacuaguaucaccaggcccuguccaaugccagcacauuaaagcgggcaacauuucaccaauuuuuauacaccauuaagucucguuuuugcccuguuacugugacauccaacuucccuacugugugaaugaggagguaugagaggggaaugucacgagagguuaacuaggugcucuuacuaacagcagacagaugagacaaaagaggagggagacaucuauauccacccuauauaaguuguugguucuaaaccaauuuaaguuacuugcucaauaaacaaagacaggcuggugaccacacuuugcuuauuuccuuguuuagaaacuaagucauaggggagauucacuauugcugcagcaaacuguuacucaauuauaauccaguugguagagugccugccuugaaugcauaaggcccugguucaauccucaacaucacaaaaaaagaaaaagaaacuuagacucaagcuuauuucagcuucaaacuaaacuaauuaaaacuaauuuuaaauuuacugguuuuuccccacuagacaaauggcuugcaacccuagaucaaagcuuuuuaaaacuaugcucaaaggauaugcauguuagaggcacuggucagggcugaaccacgauauaugaacacccuguaauacccagagcauugccuauuauaucugcaagugacuucuacaugagacuuauuuuaguagaacugauuuuuaaaagcuuggcaaccacaggguugaguacauagagaguucuugcacaacccauacaagaccccucaccacuguauaaaccagauauaguggagcaggucugaacucccaacaagcacuuuggagauauggaaaagacaaucaggaguucaaggccauaacuugcucaauagugaguucaagggcagcuuagacuacaugaaacucugccuaagaaaaaaaagaguuugcaaucucugcucaagaugauccaguaagaguaugguaaugguggucauaggagcggaucuaguuuaaaaagacauaauuuaaaaagauguauuuauuuacuuaugugucugugcacaugugcauacguguaggugcaagccuugugcauggagagaucacaaggaggcaguggaugucacccuuuaucacugcccaucuacucuucuguuuguguuuguuuguuugacauaaucuagauucaccugaaaguaaaauuucaaguagacauuuauugucugaagugggcuggccuguggguuugucagugaguuaccuugauuauguuaaauuaaggugggaagaccugcccauuauggguaguaccauucccuaaaaaggguuucuaaacugugagcauggaggaagcaagcagucugcauguguuaauucacugcucucugcucuugacuucauacaaugugcuagcugugaguuccugccacccugacuucucugcaacgauggacugucagcuggagcugugagcuaaaaugaacuuuguccuggugcuuuacugcagcaaaagaaagaaagaaaaugguuaugauggugcauaccuauaaccucagugcucuuaaacaggaaggaagaucaagauuucaaggucagccuuggcuaaacagaaaaugagagaccaaccugggcuaaaugagaccuuaucaguuacuguuucaucuugugucuggaaccaguguuuuacuacucagguucuccagaacacagacacaugcccacagaugcucuagaaaacccugacaauaaaccacggacuccaaacauggggugaaauacacacacacacacacacacacacacacacucagagggggcagaauuuauuagaauaggguacugguuguggguccagccaguccaacaauggcugucugccaacaaaaggucuaagaauacaguaguuagcuguucaguccaugggcuguccagagaacauggcccagauuaaagguguaucuucccaccucaaaagaucuagauuaaggguguaucuucuugucucaaaaagauccagguuaaaaguaggucuucccauuuuauggcuuacucccucauagguacacacacauacccagacccuuggauuuuaguuaauuccagacauaguugaacugacaacuaauaacagccuuucaauaucaauuagcaaucaagaaaaugacccgcaugcguucuuccaaucuuauaaagucuguguuucaauucagauucccucacuaauaacauuggguugucaggcugacagcugaaacuaacaaauacuauuaaacacaaaagcuaauaaaaagagagagcaagaguuccgggggaaacuuaaaacacagggaaaucagaauuuaaaaaaaaauauauucauaugcuuggaacucucaaaugacucugcuuauggaaugauaauggggcacaguagcagaggauuacucagaacaaaaaagagcuauuuaaaaacaagcauuuaagucucuggauuguuaggauucaccaauuaccaagcugucaaaagacucacauuaaaauaccaaaggaaaaacuuucaaaauuucagaagaaaaaaauauggucacccaaaaauaaaacagaauuagaccaggaccaaaaccgucauccauguuuaggccggaagaugauggagcagcaucauuacaggcucagcagguaaaggggccuggugccaacacuaagggcccgcccaagucuggugucuggaacauucauggcggaauaggagcaucaauuuuuccccucugaccucuacgugggcauguguacacacauguucacacacacauauuaaauaaaaauacaauacucuuuaaaaagaguagauguuuauugacaacacagguucuguaccuaaggcucagguggaggcaagaggaagagggggcagaaagacuguaagagcuagaagaauagaaaguuugcugagagauuuuuauauccuagaaaugucagagaagcgacaaagauaaagucucacaacauagccaucuaaacaagcucugaaaaggaugauaccaacuauacucucaccuggaagaggaaaacaucgcuggccucaacccuugaugagaacuacaggcaacuaaggaaugcugagagcugcagaaauagucuucccagggaagggccccugauuaguuacccaaaaccaagugaucagcuacaaaucauauacacacaagcaaugguauacagacugcacagguuguauuauauauuuaggggaaaaacauuacucucaaaauuaaagaaauaguggccauaaauuugaaagacaucagggauagauagauggguacagggaaaaguuuaagggggaaaugauguaauucuauuuuaauuuuaaaaaauaaaaacuauaaaaaggagucaauguuuauggaaagucauauaaaguaccauaucaguuagaggaagaauaaacugcgacuacguauccacuuacauucauauaagcaaaagucaucacccuuuuccacccuuaugaaaaaauacuugaagaugaaguucaccgagaaagaaaggagagaagcuauugaaaaccaccucauagagauggggucaagucucaguuacaauccuuagaagcaggagacccagacuggagugagagggugggacucuguaggaggucuaggguucaaagcagguucuaugcuaggguaucucaaaagauugagaaaagcucaagauaugaagaaaggauauuauuaguucauuaauggaagaaaaaaggcagcuagaaacucuaggacauuaagaagcuuuuaaaaagggagccaggccaggcaugguggcacuggcuucaaccccaguacuagggagggagaucagaagcagaaagaucucuaugaguuccaguccacccagagcugcacagugagacacugaagggggagguguacgggaugagauggcucagaaggugaaggccuuacccaccaaaccugaagacuugaguucaaacccuaaaacccacaugguucaaggagaaaacucccuugagcugucuuugauugcugcacaugaacuguagcagaggccucucucaaacauaaaugucaauauuuauguaaauagauuuauauacaacagaaacaauguaaacagaaagaguucuacuggaagcaccugacauaaccuaggcuguccuugaaucuaugagucuccugucccagccucugagcgcugggauuauagcugugugccacaaugccuggcauauuccuauacuuuuuuuccuaaagaucccuuaucauuauauuuugucuuugacaguuaauuuccuguuuuuuguuuguuaugauuuauauuaaaauuuccuugcucaaauaauuguuuuucucuuuuaaauguucccugucauauauuucaaaaauuauauuaaauauacauggucuacauaccaaucaaaaggcacaagcugucauguuagauuaaaaaaagcaagauuuaacuauaugcuguauauauacuaaccuuaaacauaaagacacaaacaagggccaggcagauuacucagccaauaaagugcuuugcaaguacaaagcugaacacaagaacaaaccaacaaacacccacaaaaaagccaggugggguugccagcaucuguaauccuaacggggcagguagaaggacaggaacaggaggaucggaccuuguugguuggcuagacuagccaaucaguuuaauaaagagacucauaaaaagguaagguggaggggaauauagaaagauccacuguugaucucuggccuccacaugcaagcacaacugugcaugagugcauaugcaaagagugaaaagaugguacugguguggaaaagauccagcuugguaguaaagugcuuccggagaauggauaaggcccugggauaugggcugggaaaucuuaggggugguugggugaugggauacaggauguagguuggaaaggauuaaaaaggugcaucagacaauuaccaaaaguaagugggaguggcuaagucacuaaggcugaagaaggaugcaugucuuaugacauaagagccuguucaucaaagaguucuaauaccaaaugcacaaagacaggcacucuggggccugagaggugucucggugguaaagagcacacacugcucuuccaaaggacccaaguacaauucccaacacccacauuagggagcucaacaccucuguaacuccaguuccaggacuuugcaggaaugugcacaaauccacauacucauaaauaaaaacaaaucuuaaaaccggggggggggggggggggggcacugcacuugugcucacucucagauugugagagucucaacacucccagcccuuccuuccucucucuucucuccagggugucuggauacagcccagaauggccuuuaagucacuuuguggcucagacugaccuccaacuugaugcucuugucucagccaccagaggcuuacugcaggauuguaauaccuugcaaaaucugcguaacucuuugagguggcaauaauaguucuacuuuacauaugaaaaugaguauauuaagugcagaauacagauaggaauucagaauuggaacucauuagaacauccaucuugugaauauauucacccccuaaugaaaaguuauauuaaccuaguuuuuaaccuaagauauuuacauaucuuaccgcuaccacugagcuccaacucuaccaccuacacuuuuuuuuuuuuuuuuuuuuuuuuuuuuuuuuuugguuuuccuagacaggguuucucuguguagcccugacuguccuggaacucacucuguagaccagacuggccucaaacucugaaauccgccugccucugccuccggagugcugggauuaaaggcaugcgccaccacgcccggcucaccuacacuuuuuuugucaacaaaaaugcaauguccauaagcagauccuuuuuaaaaauuucauuaaaaaauuacaucugugugagucuaacagugaccuuaaaaagagaaaaaaaaaauccuuacugcacaguauauucugguauacgccacaucuauuucacaagcaaugauuuuuuuuuuucaacucuucccucaaaaaaaucuuaugcaaccuacacagagugcagcccaccucaacaagcagacuuuguucuuaacugggcgaaucuccaucacuggucccucuagugacaacacagagagauguccaucucagggacuacuaugcuccucucuuuacugauuuauggcuagugaugcacaguaaaauuucccguggcuauccuauucaaaaagcaaacgccugcuacggaagggacgcggaagcucuggcuaguccuuuuaggcucagguugaggcucugacacucaggaagcuucuguuuaaugugcagaacccuaagcuuucuagcucccgcacugaucccagguccacccaacacgcgcgagcucccguauuaacccaggucuaucugcaaacucccagacccuacacugacccaggucugucugcuaaugcccagcucccgcacugaccccaggucugcccggcacgcgcccgcucccgcacugaccuaggucugucugcaaacgcccagcucccaucugcuccgcgggcacucaccucccgcaccgacccucccgcgcucuccugucaaggacaccggggucaggccccccaaggugcggggcguuccguaccugcgcggcguguucagcagccucugcugcucgucgcccucguccucgucgucgucugucucggagucggggugacaguagcagaaugugccgcugcugcgcuugcgcuugcggccgcccggacaguaacagaagcuguggcccgcaucuucgccggcguccgaccugcgggccgcgcccccagccccgggcguggguucgggcugcucugugcgcccugcgggccgcagcacccggcugcugagagcgcccauggcuccggcgccuagggagcaccgaggggccgccccgccaugcccguaucuccaccgccuacuccgcugccgccucgcgcgcagccccaaccgucgccgcgaacgcagucaccuccauccucagccccgcccguagcgccucagcggaccggcuucgcuagaccucgcccccuccuucucccaacaaagcgcgcgccgcagggcgcaggcgcaaggcgag

SEQ ID NO: 3169 - RNA, 3579 nt, Mus musculus
cagucaagaguggccucagccaagguugcucugauaaugcaaugcucuggguguggcugaccucagaagaguuuuucugcuaaaaauaauuaaucucguuagacuguuuauuugauccccacugugccuuuuuaaucuuauucagaaacugugcuugcauuuaaucaugaaguuugguuuguauacaacaugagacauuuuuaauuaaaaugguggcuuuaaagggguguguauucuuucucugauuuuuuuucuacccuagagauuucuuuucacccugaaccauggaaggaacuacuuuugaaggaauacuaaauuuacuaaggauacuaaguuucuacuuaaauuaacaauauuaaaaaaagaaacacauuaaucauuaugucagccugcuucuauaaggccaauguuuacauuggagagguggaggcaggaagauuggaacuucaggcugugccuggcuacauagccacugugagaccagauugggcauaugagucccugucucaaaaagucaaaacaagaucuggggagcuggcucugugaguaauguauuuacugcagaaggacgaggagcgguguuggaaucccuggcaccaaugugaaagccaggcagagccaaugagugugugccuguaaucccaaagcugggauguggcgaugaacagaucccaggggcucacuggccagcuaguguagcugaaucccugagcuucaguuucaaugguaggcccugucucgaugaugaugguggugaggaggaggaugugguggugguagugaggaagaggauggagaguaagacaaugaugucagcuucugauuuccacaugggugcacacagccacacacacacacacacacacaaacgaugaaauugagauggcuuaguggguaaaggcucuuucuaccaagccugacaaccugaguucaauccuuagaacccacguggaagaagaaaagaaccaagucccccagauuguuuccuucucccauaagcuaaggaauaacaccccucucucauaucaaaaacguaacgaaaccaacaaaaccacuagcauuuaaauaugcuaaggccuacucaaugguauugaaugacauguuagcuuguucucugaaaacgagugauucucugcucuagucagugcagcaugccuuuuaagugucacauggaacugagcucagugggguagcuauacccuguguucucagcaccacaaaggacaaaaguugcagauguacaaagaacacacacacacuccuuuguucuuucugcguugguacugggaucacugacaacauugcuaugugacagucacuccaaugaacuuagauucagguaucaacgcuaccaccucaggacuguggaaucucuacuccaacuuuauuacacuuuggaggcauuauuagguucuuuguuuugguuuuaacagaaguuuuaccauuacguggugucuuagccaaaauuuuaagaacaguguuuuguggcugagugcuuucagugggcuguuuuucuuauccuuagguauaaguucagggggaggguagaaagucacaauuuucugcucacucuuggcuuuucagaaguccuacuguguagcuagcuccucuaggccccaaaauaaugucaucucagucaucaacauaauaagccaaaguuccaaguguagucugagguuucuuuccucagucaguucuggccucaaugggaugcuggcuuggggaagggaagucagggcaggggacgagggcaggggacuggaauggggggagggcacuucucuuuuucuccaucaucccugcuuguagcaacagugagaagagcagaggggaucaggucaguucuugcacugcccuugcucugaggguggaggcuaaguccuauguggcuguggcaggcucuuacagacauugccauggcucuccucaguauccagggagccauucaccugcgcuuccuuagacaagaccaauauggauguuuuacccucuaggaauuuagugacacaugaagccaccauguuacagucuagcuugugcauacgccaaggccucuuuguuuuuguuuuuuguuuugguuuuucaagacaggguuucucuguauagcccugacuguccuggaacucacucuguagaccaggcuggccucgaacucaaaaauccgccugccucugccucccgagugcugggacaauguuuuaagaugaccucacguauguuucauauuauguacauuccugcguguccccugcagccaccguaguucucuuccucccacuucuccuucaaccagccucagcuacacacccucagaauuucucaaacaugagaaauuccucaguggcucacaaaggacauauacugcuauaacggagugcaaauggugaauugaugcagucaguuccgggggggggggggcgaaaaacuggcaagaacucguaaaguugaaaauuucccaagagcccguuucugggaucugccugaugaagcuuuugcgagugguguuccugaaagagcaucuacguagaaauaacugaaaccccuuggcaagggaguaggcaaaugaugugucuaacaaugagcagugacaauaacuagagauuccauucaaaguauaguuuuaggagaggagaaaucauagguuugggaugguccaauuccauuuaaauuacaugucugaaugugcagcagaagagugguuauacguguaaagacaugcauagaaauggcacagagagggagaggcuggaaacugagaauuaguacacaagggguuucucauuccccacuauauaucaauaaagcuaaaggggagugaaucaaaguaagugugauagaauuccaagccaguaguagguccacagguacuuguauugcucuguuugaaacauucuauuauaaacauuuuacuuugaaagguauaaaaggcagguaugguagcucagugccucaacuccuagcacuuagaggcugagauaggcggacuucugagaguuccagggaagccuugggcuucagagugacacuuuuccuugaagaaaauuuaaaaaaaaaaaaaaaucgagggccagggauguagcuuaguugguagaauguuugcuuagcauucaagaagcccugcaucugauacucagcauuucagguccacgaaggugaugugacacauacauggcuguaaucccagcuuucaggggguagaaacaggagaucaagaguucaagagcauccuauacagugagucgaaguauguaguacgagacacugacacaauaaaauaauaauuaaaucaaaacaaggcagcagaaggaaggcaagaccuggaggcuagcugaggcuccagacugaacccggucaacacagcugggugacggucaucuaucuaaccgggccagucggguccuagagcccuggaagcaaaggccauguuggcaaguccguccucuuauuaaccguacagggcuggaugagaccccggaaucgaggaagcuuacgggaagaaccagcgacagagaucccgagaucuguuaggcauaagcacacagugcccacgccccuccguugaagccggaaccgcggaag

SEQ ID NO: 3170 - RNA, 1396 nt, Mus musculus
ugcccagcaagacccaucuuuuuuuauuuccugggggcccccuucuagaucuuccucaagugccugaaguagaaauucugggaugaacugcaagaggguaguugcaucuuuaagaaguguggggagcugguggaaaaauaaccuauacucaaaaaagagaaaaaaccauguauuucuugggggagagggcaggggaggcagggauuuggcacgacaacaacaucuucugugaagcaaucuaggaggagagaucucaauuccuuuccaaauccuuagcauuugacaggugccaaucacacagcccuguacucuauccgcacccaagcgauccuuaguaaacacagcaucuucuugcgaaagauucugaagagaaagcaguaggugugucuaaaguucccuuuaaaggcgugaauauaucugguaaggaccaggcaaaucugggucggcagagggccaugguuugggguggagcccaaggauggauguagccuggucccuagaugcuccguguacuggaucucccgcaguuccuucuucgacccucaggcuucucaguucucaucguggucggggaccggaagacaccugcuuuguuuccuucagcaccgagauuccgcucggcucccugcuggcaucauacccacuucuccccagcccccaagccuucaguaccuccgcucccaugacgucggggaacucccaaacccaacuggggcgaggcagcuaaaccgcguccuucaggugucaguccggacuccugugaaaccacaauucccagagugccucuguccaugaggccaagccauagauaaaauggcuacagagagugggacgugcagcuggaaaacuagucucuggugacuuuagcagauguacuuaaauacccgaagccucacuucugcaccacuccacuaucaucuccagucccuggagacggcguccgaaggugcgcucgcucccggggcaucuugggaauuguaguccagaugccagauuaccccgaacuacucuucccagggugcucagcggcaggacuacggcaacgcucucuuccaagugucucugucccgaguuccacugcucugguucccuucuugccaucgguuucuuucgcucuguagcuauagcuggugcaccugagacggccccugagaaggggcugugcggcccugagaagcacuuccgguggcaggucacuuccggguggguggucggagccgacgggcgcgcgcgcgggggaggggcggccucagcgcggcgcucggggaucagcuggcgggcgggcgggcgccgaagcggccccggcucugcggcagcgccgccuccuucgugucgcaggccggcggccguggccaugucgcggggcugguagcugggcucgccgccgagcggccgc

SEQ ID NO: 3171 - RNA, 49364 nt, Mus musculus
caguugagagcgaagcgagcgcugagucggacugucgggucugagcugucgcaucccagaguccucucauugccaccaccccggcccgagcucacccucgcuucugaagcucuccgcgcgcccgacagcucagcccucgcccgugaccaacaucaugugcgguaagggcagcgaugggggugugugguggccgcagggcccgcgcagugaagccagagguggacagcgcgugucaacagagcggccuuggggcugggguccugaagagaaggggggcuuguggagcgggcaucccgaggagauugaggguccugaggggagccgggaucuggaaggagaagggucucuggggagaaaggcugcuguccgugaggcagggacucuaagauggggauuccgguguugaaggggcggccggagcuagugugcuuaagagggaccggcagaggagauugugggggcccuaggagucagaggcuacuuaaaggggcuagaggauuggggguggggugggccagggaggguaucagagcguucaaggggcaccuuugcauagagcucagaggauagaugaauaccuaccuuagaagagcugugaggcucaaagugagaccaaguauggagggaugccuaggggaagguccaccaggugagugaggcgaccugugaacaugcugugugguacuggggguuaaacucauaaaggcagcuugucaagugagugaguacucuuucccuuagccacaccccccaaauccccuuuuucugucucuuuguaacugggucccacuugguagcccagguuggccuguaauucacauugcccugucucagccuuccaaguguugugauuauaaguaugaaugaccacuccuggcugguagcauuucuugaauuuacuuaucuugcagucuuaaaaauacuuaauucuagucacuuuauuuuaggcaggccugcgagaacucaagccaacgcacugacagugauaccccacaugacuucugccacucuuaagucucucaacaggaaccauuacuaaaucaauaacuugaugaaaugggcucagagcugaucuuguuggaagagagaguaguaguccuggcuaaagaucccacaucaugcauguacaccuguuuaacauaugucuuuacuacaaccauuaaaaaaaacaggcucuuuuauuccauauuuuaaggcuucuuauuuagcugggcgguggugguacaacgccuuuaauccuagcccucaggagacagaggcagguggaaaucagugauuuugaguacaaccugguuccaagacagcuggagcacaguuacacagagaaacucugucuuaccccucacccccgccccccauuaucaaaaaguguuacuaaaagauaccaugagaauuauauaugauaccacuaauaauauuguaaaaugggaaugagccauuaguaguauuuaaaaaguuauauuuuuaccuuuccuuuuaaaaccgacaaugaccacuagacuaaagagcguuuguuucuuagaaauagugucccacgcugucucucaagcaggucuagaucccaguucuccuucagccucgugagugcugagauucuaggcaugagccacugugccugguucccaagaaagaacacauuuuagaaagagguauuguaagacuuguagcugugugagaaacauucuuuguagucuuucacuuguaagaacucgggaagggguagguuguccucaguguguguuuuccuguguuuaaucguuucgccuucugaaaaugaagagcaggcuuaagcuuagagauucuagauuuuagaauucuaaacaucauggaauuacuggauuagaguugacuucauaauuaauuauacuuuuacuguuuaauagauugguuuuacaaaacauucauaaauuaguuucaaauugugaguagugaauuuucaagcugguuaguuacuaguuugcuguguuugguaguuaacgguuuucucucuuucuuugagacugacucucacuagccuggguuggcuuugaacucacucuguagcugggaauaaccuugaacuccugauccuccuucugcccccaagggcugggauggcaggacucugccaccacacccagcuaguuaaacuauguuggagugaugaguuauguaccuaggcaaguaccuggcauucugguugcagguuauuuccucaucuuguaccaggaagaaaaguauuuguauacuauaaaacaaaaagaaaaaggaaucggauguaguucaugaagcucagauaagaaaggaggaacuguuagucagaguggcugcuagugcaaggcagcuauuacacugaguuucacugauuaugaagaauaaguaaaucaauaugcuagcacacgguauuugaggcauuucuguuuuuauuugcugagacaggguuucucuguguuaggcuugguuguccuagaacccaguaacacuuuuuuauauuaguuuuauauauuucccagagaauagguaucuauuuucaauuguuuuuuuuuaaacuagugauucuugccuuuuuuaaaauuauuuuuuauuuuuuuugagauacuuaccugaagguuauugagggaugcugggacuggcugcuagggugacuuguaaauacauacuguuuacgcucuuuagaagucacacuggaggcagccgggcgugguggugcaagccuuuaaucccagcauuggggaggcagaggcagaucggauuucugaguuccaggccagccuggucuacaaagugaguuccaggccagccagggcuacacagagaagcccugucuugaaaaccaaaaaaaaaaaaaaaaaaaaaagaagucacacuggauaugaagaagcugugagcugugagggaacuuguuugauacacauuuucuggggaagggagagcuuaauaggugucaggguuaauagaaaugagcaaaagaagaugggaaggguuuuguaauacuuguuugugauagucuucucccagagauccagaauuagcaagacuaaagguucuagaaaccuuuaaaccuaguaacuuuguugggcucauauauauauauauauauauauauauauauauauauauauauauauaaagcuuuuaguuaggaggccuuuacuuauccuucuuuagcauugagcaauauuuaguguuguuuccuggggcuugggauuuucaacuguaacuuuccgguaccuagaaagggucagaaggugaugaaggugaugaagugcuugguggcacuuuuugagagaagacucaagagaguugucuuugaggaaacaaaaugaaugcagauauaauggcugcaggugcugucacaguacuaucugaggcaaucugaaauccaucaggcacaggagagcuuuguaacugcucucuguuagaccuggaaugcuccaaugacgggaggauucuuaccuugagauacagagacuagugacaagggaggcagucaccuuuagugguguuguucaucuucagucaguguaaguagaaguaaauuugagaacugugggucuuuguuuuuguuuuuuugagauaaugcuuaaaugguuaccugguaccacagaggucgggagagggcauuggagcuccugaaacugaacuuagaaugguugugaacuaccuaccauguagauguugggaacagaaccaagguccccugcaagaguaacaugcucuucaccucugagccaucucuuuagcccucaaaacauuauucuuuuuuaaaaagagaucuuacauguaaaauguggcugcauaguuauaauaugaauauauuuaugauaaaggauuaguguguauaagucuuaaauguagcauugccuuuauaaagaaacaucgcacuagagauguggucauauaaguaugguaugucuauuacauauuaugauguggcaccauaagaaggcucagacaguuaaugagaaggaaugauuugggguaggaaaucugcuuauaacuacucuucaauacugcagcaauuacaaaagggcgacuuuaaacuuuuguaguuacuuuacgcaggacugcauuuugggaaguuuaaacaagacaaaagaccuuaaauuaugagcugaaguagugacuucuuucuaggaggccaccaugugaguaugagugucucuguggacuugcccugccugcuugucaucucuuccccgcuacucagaucgaagaugauaucauaaucauaacugguggauucucuucaccuucccucccuuccuuccucccucccucccucccucccucccgcccacccuccccuccccucccuccuuccccuccccucccccucccuucccucuuuucuuuuuuccuucuuucucuucucucucucucucuccccucuccccucuccccucuccccucucccucucuccuucuuuauuauucuucuuuuucuccuuuuuuuccaagacaggauuucuuuguguagcccuggcuguccuggaauucacucugcagaccaggcugcccucaaacucaaaaagauccaccugcuucugccucccaaaugcauaugccaccacugccugguuaacucagggguuuccuuggaccaauauuucaaaggacaguuuaaccaaacgugauaauaaugauuauuggcuauaguagugcugccuuuauugaguaaaaaguuuuugaguuguaacuuuugaguaugguaguucauugaaucaaagauuccaguaauuggaagaugcaccgucaccauggaaacacaaggaaagaaucuacgcauaaucauacuuuaaaucaauguguuaaaucuguaggucugucaccucuagaaacuguucuggagacacuuucagaaggcucuaggguuaucuagagucauagauuuuauggaaugucuauauauauuaagggaauuuauuggaauagcuuacugucuauaguuccaacuaaccaaacaaugaccaucugugaaugggaaacccaagaaucuagagguugcucagugccacgaggcuggguguuucagcuggucuucuguauaagcuggaauccugaagaaguagguuccaacacaugugcaaauaagugcaagcagucgaagaaaaaaagaacccuuccuuuuuauauuguccuuuuggcccagauuaaagauguguaccauaaugccuggaccuaaguucuuuacuuggaacuugcucugucugaggaaggccuugaacucagagaucugcuugccucugucuccugggauuaaaggugugaaccaccuugccugggccuaagauuuucauggccacuaugucucaagaucugggucaaaaguguguaucuucuagcuucaagaucuggaccacaggugugcccuccauuucuagauuuuaauucauuccacauacagugaaguugacagccaggagucuaucacaacgggugauucgauuucucuacuggagaccugggguccccagcaagaaggaucagagcagcuacauuauggaaacaacuaaacaugacuccagaggggaggcguugagcgggacaguggcccaugcuugucuuggggaaaugguauggugaggggagagcacucuggauaagagucuuaagagcgacaacacugugaucugaaaggugggccuuuauucgacuuuagaauaaacaacucagcaguaaaggacuuuuuaaaauuauggugaauuuuaaugugaacaucacauuagaugguaauggagcaucuuaggugugauaggauucuguagcauaauaguccuaauuuuaaaaaaaacuuauuuuuuauauguaugggugaucuaccuucauguaugucuguguggacaguauccaugaaggcuaaaagagggcuuuggcuuuguaggacuggagugacaggcacugccaugggagugcugggacugcauagugagaccuugucucagaaggggccagugagguggcccaaguaauaguucccauccccaagaguugucuguggacuccauagucacuggggcugugcacaccugcacucacaucacaccucagacuggggcugugcacaccugcgcucacaucacaccucagacuggggcugugcacaccugcgcucacaucacaccucagacuggggcugugcacaccuguacucacaucacaccucaaacuaacaagaagacuuuuccgcugggugugguggcgcaugccuuuaaucccagcacucgggaggcagaggcaggcggauuucugaguucgaggccuaucuggucuacaaagugaguuccaggacagccagggcuauacagagaaacccugucucaaaaaaccaaaaaagaagaagacgacuuuuccacuugugacagcaguuccaguaguggguguuugagaugccaaagagaguuucaacuccaguuuauugcaacacuuuccaauacaaaauacaaaccgugccuuucauuggaugaauggauaaggaagguguguguuuguacaacggauacaacuuggucuaaaacagugaagcccugccauuuguagaaauauagguaaagaauuucaggacauugugcugagugaaaucaaccagacccagaauggcaaauacacuuucuaacguauguaugaaaaucaguauuacccuuguagaaguauggaauagggaagggggcaggggaagagggacuuuagggaugcagaagguacuaauaccuaccaggagccacacccuaaagacagcugauucucucucagcagccaucaguuguccacaucucuucaguuaggagugaagguucaugaacccuauuccuuucuauguuagaacaggcaaccacaguuauugugaguugaugagugcagagguccuauguagugacaguuuuggaauuuuguuuccuuaaaguacagaacuauuagaauguguuuccauuuuaguuccagguguggggauauggggcugcagcaacugaccauaauuugccucaagcacuagccgaggcaugguuuugucagcugcagauaguuucugugauugugugacauuuggaacucugggaacuuuucagagagugucuagagguggcggugguaguuucuggugauuaggaagguugcuugugguagcuguggucaaagaagaagcaaaaggaaaaacauuagauucagggauuuuccuaauuccucuuuccccucuauuguuguuucuuuccuaucuaguguuagggggugaacccagggggguaaagggggagaaaaaagaagaaccgucaaaguagcaaggacaccguuuucucugguccuccucuaccucuggcuucuccagucugugcucauccacaaugguaccugaaccugauucaagucauuuugaggcaguuauguauuuaggucagauuuuuuauuauuauuaaauuauuauauuggguuguaguugaaugauagagcacuugacucaaauguggucuucaggucuggaaaaaaaguaaauugugaaguuuuguuuuuaacacaaaauuuaucacuaaacacuauuuauaguagaaguauuuaguuauuuuagcucuauaguuguaggaacuauuuuguggcuuaaaauacuagaaaauguauauguguaauguaauaguauauaggauauagcccacaaguuugcuuuuuaaaaaauaaauuuuacuugacaaaauggcaguuaaggaaauaguuagcuuuauaaguuuuguuggaaacaacuaaauacuuauuuugacauauuuuuguuaaucuuuuauguuuauauaaacuucccuuuugaaaaaguuaaauggacucuaaauaauuuauuucuuuuuaaaaaguggagccaggcgugguggcgcgcgccuuuaaucccagcacucgggaggcagaggcaggcggauuucugaguucgaggccagccuggucuacaaagugaguuccaggacagccagggcuacacagagaaacccugucucaaaaaaacaaaaaaacaaaacaaaacaaaauaaaaaguggaaucuagcuuuauauuuuugcauagccuaaacauaauuguguaagguuugauucaucaaaguuguccauuaaauuuuuuugcagguauauuugcuuauuuaaauuaccauguuccucgaacaagacgagaaaucuuggagacacuaaucaaaggccuucagagacuggaauacagaggauaugauucugcugguauuuccuuuaaauuauauuaugggguuuggauugauucuugaaucuaaauaguauuuuuauuaauuuuaggagacuuaauuuguguuugcuuuguuuuguaaaugcaagucuuaagaauuuuaaauuuuggucaugucuaaaggguuugugaaugucauuucagcaguauuaucauuuauguggauauugcuucucagugauuuccuuuaggaauaacguuacuccagggcuuggggaggcgauuaguauacaugaagccuuggguucaucccuagcaccaugcaagcuggguuugguggcucaggccugugaucucagcacugaggagguaaagccaggaaggugaguucaaggucauccuuagacaaagucagccuuagacuaaguuugaggccagccugggcuguaggagucuuuaucuuaaaaaccaaaacaaacauuaacuauaaaaccauaaauuaugccaggcggugguggcgccuuuaauuccagcaugugggaggcagagacagguggaucucugaguuugaggccagccuggucuacaaagugaguuccaggacagccagggcuacacagagaaacccugucucgaaaaaccaaaaaaaaaaaaaaaaaaaaaaaaaccaaaaaaacaaaaaaaaaccccguaaacuauggggcauuuuugugggacaacuuguagaacauuguaaaaggucugcuucuaauuguaugucugcaccaugacuacaggcgcuggagcuacaugugguugugagcagcuugauauggguccagcaacuagccucagguuccugcacgcacagcucuucaccucucagccaucucuccagccuggcccuguaaacucauuuuucuuuuugugcuggagaucggcagagucuguuugacucuggcucccugucuugggcccaccagaagcucacuuucagugguuccuagcgacucaugcgccucggcaagaguuacauucauagcucugugauucacuacagcagaagaaucaagggcgaaaucgggaaaaggagcgggugugggaugaagucugcaggaaagcaggcagcagcuuccaagaagccugcucuaccaggaugcacuucaugucccuagcagcagguugugauagcacacaggaauguugucuacuagguaaacuccagaugacucagagccagacacacacacacacacagcaguccauccagaggaacguaggcacgggagccuuucagggacuuggaaucccccugaaaucuaagaucccacagggauauccugucaguuucucauuccuguuuugguagguaugggaauggaagccaagguugcacaugcaaggggugcugggcaguucccagcccuguuucuuugguguuucaguucuccguuuuuggcuuuccuaacauaguagcuucuccugggugaugaugagguuugcugucagccuuggaggcuuuucuuuugucuguugcuuaaauaggaauguucuguaagauuuuuuuuuucacuuuuuauuauuuauuugagcuuaggucuuguuguauagcuuggguagacguuuucuuccuagugcugagaugacuggcaugaaccccccguuucacccacagagguuguuugcuuagcucacuugucuuuguauuuucauggugagaugacuucaucaccucuacauuguaauuuacaguccauguauuuuguuugcuuaaaguuuuugagacagucuuuguagacccugcuggucucagcuuaccauccuccugccucagucuuuggagugcuaggacuucagguaugugcuaugacacuugauuugaauaucuaaucgguaugagcaaguugcagaccuguguuuccagcugccuucuagaaauaccuucccggguagaccacagugcagugcacuuggcugguucauagcugaacugaacgcacugugguccucacugcagaccucauucuguucugcguuccguccaucagcaaucgugccacacuuccuugaacccaggagggaaccucggcugcugccuucucacgucccaucgggcccuucugugucucucgcuugucugugcaaaucaggccuucuacauuuuugcuuuguuucagcuguaauguccucuuucucccucaccaacccauccucuccucucugccauuucagagcauuugcuagcuguccuugccacguuacuuuuguuggaaaugaccuucacgguccaaguaagcuuuucaaguucuuaguaacuuaagucucagaagaugccuuccugacggugccuacuccuuccgaggcgagcaccccacuuugcacgucuccgcuaugccuaugacacuuuaucucaauuuauguagcgguugcuuguccaaguaaucauucgaucaccauuauucuuccucugucuguuuucucuaaagacuguuagacagggauugagugcuccucaccucucuccugaccuuccuucucaaacccucuuuucugaugcugaguuugaacacaaggcccugugcaugcuaaauaagcuuuucacugcucagcuauguucccagcugucacuuaacacauaguagguuuucagaaaauucacuugguaaaugaguuaauuagaugaauguauaauuuaccuaaauuauuauuaccuuuuucucauauugguauuguuagccaguuucuaagucuugcuuuucuaccugccucuugcuaauuuaggugugggacuugacggaggcaaugacaaagacugggaagccaacgccugcaaaauccagcucauuaagaagaaaggaaaaguuaaggcacuggaugaagaaguucacaguaaugugcuuaguuugauucuuucccacucucccccuuuuugggacacgguugaggaagacuuaaagguugaagagaaggaauaaaaguaauuuucuuacugcuuggguuuaaauuguuccugagcuucaaaauacgaucauagcaauuagaaaagaaacuagguucagcggguuuggagcaagcacauaccccacagugcagaggcuucaguagccccuccugaggacggcucuggcauaggaggccugcucaugugucuccacuuggcauggcuuuuacuuugcuugauaaugaccccaaaugcaagaugcugaugcuggcuugccgacuugccagagaagcgugaagggggaggggggggcguucuuacuuaaaauggaaagaaggaaaaccaaaugcucacuuugcuaagagguacgguaaggguggaucugccgucuaaaauugagaagaaaaaacagauuggugcuaguucugcuaucgugccuccagcugaagacacgugugugugugugugugugugugugugugugugugugugugguuuauucaaauggaaacagugacacuguaggaaaucccgcuaugugcagagcucagugccauuggaguuucagguguccacggaguaucuugaaacacaaaccuugugguaaggggggcugguauaguuuucuuuaauagaauuuauaucuacagcauuaucaaauacuggagucuuaaacuuuaucuccuacagaacaacaagauauggacuuggauauagaauuugaugugcaucuuggaauagcucauacccguugggcgacacauggagaacccaauccugucaauagucacccccagcgcucugauaaaaauaaugguaggaguagauugcgugugcuuugaacugauuuuagugggcaguguugggaggggaauccaggugcuuauguuguuacuuuaauuugcuguucaucuggaaauuucaaaacauauucagacaguguacagaacuuaaucccauuccuagguuauuuuggaauuccaauaauaaaaauuggcaacucuucaauaugucaaucuuuuuauguccuuuuuuucuugcaauuuaguguguuauuuguaaguuuccuguugguuuuguauugcuaguuacaucuacuccuguuauauuuguuuguuuaaagcagucuuacucuguaggccugacuggccuuugccuuguaccgaagagggcuuagucuaggaggucaggccuguuagggccacagaaccauuguaguuaguaauauaauaguuauucucugguguugugacagggucucacuguguagcccuggcuggccuggaacucacuauguaaaccaagcuggccuucagcucauagaaauccuccuaccucugccuucugagugcuguuaaagguaugugucaccauacccagucauaauuauucuuuugauauaugaauuuaaagcuacacuguauacugucaugacuacauguaauacugugaacucuugguaaucuauuuuuaacauuuuuuucaaucaucauuuaauaaaaauagaugaaaucgaucucucaggauuauauuuauuugcucuuggaaugcuacuuugacauuuucaugugacauuccaggaaugaucuggaccuuccccaaaucaauuuauagacgcugguaaauauguaggcauuaguucccaagcuuuauuuagugucacugggauuguuguaguuggaaaggacuuauguuuaaacucaaccaagaauaaauagagaccugaguguccaaguagaguagugcucuacaagugaggagacaggcacaggagacuugcuccuuucaucccccagugcgaggguaguagcuuaguggagcagaagucagaacugguguguuuccucauguacacgcucacuaacgcugugcgcaucagcucagaaacagugcuggggagcgccugcugacgccgaggagaccacuagcagauuacuuacuuuuucccuggagaagaauccauuuauagauuuguauagguguggugggugacagagaugacaggaugaccacuaggucaaagcuggccugggcuacauaguaaaaccuugucucaagaaaggagggcugggagagugcuugccucgcauggagggguccuggguucaaaccccagggcaaccacuaagacaacaaccggaggggaaacacagcgggaagccuaugcguaaugauagcucuucauagcauuuaccagacucuaauauucggucaauacuuuuaucuccucuagaauucauuguuauucauaauggaaucaucaccaacuacaaagacuugaaaaaguuucugguaagcgaggugacccuggaagacgccgucuucugagagugggagguaguuuguuggggugugcagcguuaugcggacauguucaaguaauuaccauaauuaucuccaggguguggcguuucauugcauuucucugcugacaguggaacagaauugauuucucuuuuuuuaauaauuuauuuuauuuuuauuuuaugugcauugguguccugccuaaaugcacguguguuagggugucagaaauugggguuacagacuguugugagccgccaugugguugcugggaaucgaaucccaguccucuggaagagcagucagugcucccaagugcugagccaucuccaaccccacaguucugauuccuuacauggcauuuugaggacaagcuuuauucuguagugugacagggccaucucagugucgucuguugaguuucugcagugaugagaacucucuguaucuagcauugugggagcugugccuauaggaccgcugaacugcuccgacagagaaacuggguuuuaaguuuuaguguaaauaaccaugcauagcuaauggaucuucauuggacaguugaggaucaccaaauaacuguugcucaugaaauuaguauuuugaauauuauauauccuacuauauuuucauuacaguuuaauucauaugcggcaaaucuaaguuaagccuuuugaguuguauuuugaauucucuacaaucagauuuuaauuuugauuaaaauuaauuuuaauuauuuuauuaacuauauuaauugauucuuauuuauuaaauuugccauuauaaauuaauuuuuagguaauuuaaauuuugaguagaauaaauucaguaugacaucaaaaaaaguuaguaauuaguaagaucuauuagguugaugaggugacucaguggguaaagcgguugccagcggacagcggugaguuuguucccugaaacccacagaaagguggacagcuaaagcugaugaugccucauggugguccucuaacccucaagcacacaccauggugacacauuuagccuguacuuacagaccuacacacgcauauaugugugcacacaauuagaaaggcauuugguuuuugagaaaaaaaaauccuagaaaauauuugcugccugggggcuggagagcuggcccagugguuuagaaaacgcauugcucuucagaagacuaauucccaucacccacaggauggaaaacaacugucuguaacucgccuuucaggggaucugaugccuccuucugagcugagggcaccagucauauucaugcacagacauacauaaaugcauacaauagaaagaaaaaagauaauguuguuuuuuuaaagugaauaaaaagggaccauaaaauuaaaaaaauuuaacauuguauauauuuaagugugccuuuuuucccuuuucucuccuuguaggaaagcaaaggcuaugacuuugaaucugaaacagacacagaaaccauugccaagcucgucaaguacauguaugacaacugggagagccaggacgucaguuuuaccaccuugguggagagaguuauccaacaauugguauuaaaccauacucuuaaagauuauuguguuaggacuaacuggggaaauaacucaucaggaaagcacuugcaaugcaagugugaggacuggaguucagguccccagcacccacauaagugcuggguggcuaugguagccucuuugcaguuccagcucccaggagguggugggccuggauuuugcagcgagcugucugguuggcuacauuagugaggcagcaaauuguggguucaagugagagacccuaccuugguauguacggcagagaacaguggaaggagacagcuagcucaaaccucugucuucuacccauacucacacaugugccuacacaccuccauuuauaaccacagccauguaugcccacacacauacuaauaaacgugacuagcacacucacacaugcaagaaaaaguaauuaugcuaauauuguuuucaaguagcuuuuuaaaaauguuugaugaacaggaacuaugcuggguuuuuuuuuuaacucauaggagucuaacauuagacagcuauauuugugagauauuuuauugucaaugugugugugugugugugugagugaaggcaggagacuggcauuggguaucuuaaaacuguuguugcuaaucuuucaugugaguacaaggggucagaacucaugcucuguggguagcauuuuuccaacagagccaucuccccagcccugugcuggucuccugagugcuuuuuuaggcuuuuauuacacauucccaggcgcacauagacacacacauaugcacaaacacaauucaaugcagggaauuuuguaaaacuguuuuuugacuuaguaacuuguuuucccuggauuuaccauuccauuuauuuuacaauagcuauauucuaacuauuucacuguaguuagaggguaaaaaguaaguaaguguuggugacaaaauggcucaguagacaaauugcugugcaaggcuggcaaccugaguuugcucuucggaauucacagaggagagagccaacugcagaacuguugcccucuaacaucuacauguauguuggguuuuuuuuuuuuuuuuuuguugguauguguguaugggguggguggugcuccagugugccuacaugcgugaaccuguguacacacgugcagaggcagguguuaacagggagccaucucuccaccucauuuuaauaacuaugguuguauauaguugucaaguccaagacugaggguagaagguggagguagugguagugggugugauggguuuuggauguggagcuugacuuucuguuggcucuuccuuccugaacagacaaguagucugagagagaugugucuguugagaaacaugcuaggcacacaggugacucuccgcuuuuucauugaguauuggaacgggagcuugguggucagaguuugcucacaucagagcucgagucagugucuaccuaagaugcgggcuuggauauuagggagaucuugcugcggcaucuaaaauggagacuuguuaaaaacuaacucaaaguacacaagcgugaacagaagugucugagcagaauguuguauguccgaaaugcuuuguuugagaaucgcuaacgagaauacuacugacgcuucuuucccccauaggaaggcgccuuugcucuuguguuuaaaaguguccauuuucccgggcaagcaguuggcacaagguacaauagguuuucuuuuaaggacuaacgcugacaugcguguugaaacauucagguuacaggguacuucucaguaaccuguggguggcccuucaccguuuccguagaggucuauuuuuauucucgguuccuucucucuuuuaacagagucucuuaggaaagagaacacauuuuggcauugugauuugucuuuggugagcacgguggcucuuuaugaauuuggauauggaauauuuuuaaauuuuauacccaaagcauuaaccuucuccauauuuuuuggaaaugcgugucagacagauuccgaaggaauuguagaaccacugguuuugcuaggauguuuagaaaugaucaugaaauucuuaggacaguaagaacauuuaagaucuggggggcuggagagauagcucagagguuaauagcacuggcugcccuuccagagguccugaguucaaaucccagcaaccacacauaggcucaaaaccaucuauaaugagaucuggugcccucuucuggccugcagucauacaugcaagcagagcacuauacauaauaaauaaauaaaucuuaaaaaaaaaagaagaaccuuuaugaucugaaaacagaaggucaucuuuaaucggaaacaggaugccuaaggauguguuggugucuguguacaaugaaaaguucuucacauuaaaagaacaguuuaaaauacaguguuagaagauaugaguuaguggagucggucagacaggaaauauuugaguguguugggacacauggccucccugccagcacucagagccacugucaggcuugaaugaaagcagccgcagaggaagggcuucacugucucagugagauuuuaaugcaauaguaauuugccaguugaaaauuguuuauuagaaguaggcagguguggccugggaacucaguuuucuaauauaguuauuuuguaguucaauucagaggggaaauuaaaucauuugaagagcauuaaauuucaaauuaaaaugaauuuugaauucauacuuaaaauguguauuguuagugcauuauuuauggagaaggguugauucugacucguugcauuucaggcgagguagcccucucuugauuggugugcggagugaacauaagcuuucuacagaucacauuccgauucuguacagaacagguaaguugcugcaucacguuguaaguguggugcgggagcucugagacgcugcuccauaugcugcagugaauguucuccggucggaucuguguguacugugcagacaacuacauaguucugucuggacagaaaaagcuuguugugaacacugacgagagaauuuuucucuguuguacauccuuagcuaggacucagauuggauccacaugguggggaucacaggcagaacgaggugggaaugcacucugcacggauggaaggguuucuccugcuuccuucauuuacuaauucuuuguuuuugaaaugaacagaggcucuaaaaaugugcuuacuuuauggggaaauguuuuggcacuuuucuaauuugcagaauacaucuugucuguuugcuuuugccauuucgaaaguugcauuauuuaauaacuguuuugcaaaaggggagguuugaggaauauuucaaauaaaggcuuuuuuuuucucuuuccuguuuuauuuaaaaugauauagaugcaugcuuauauugggaaaggaacagugaaguaugcagccauuuccugagacuuagccucacucuugacugaacuagauuuaaauggucuuuauuuagugcgugacauuuuauuguuauauuuacauugauauuauaauugauuuuauuuaauuugcagccauacuuuauuuuuuauguuugaggguuuaucauuauuuauugguccugggguggcauucaaacccagagccauauauaugcuaggccaguauucuaccacuggccuguauccccagcccccagccccuaggcugguuguuuuuuuuuuuuuuuaagauuuauuuuuaauuuuuauuuauuuuuauuauauauaggcaugugugucugcauguggguguguggaugagagugaagguaacuugggaggccagaggcaucagauccccuggggcuggagucauagguguuucugagcugccugauccggguucagggaaccaaaccucagucuucugaaagaacaggaaauccucuuagccaucucuguaguaccagguucuuuacuucuuucuguuuuuugagaggagguugaaacaggaucuuguauagccugcacuaacucacacacucuauguagccuagguuaaccuuuagcucauagcuuugacugugccucccgagugcugcagugugcucccacaccuggucugccuuuacacaaacucugaaccauuuuagugacuuacacacagagggaacaacaguguaccugucuacuaacugcugagggcuuuccaugugaaagguaggggaacgcuggcuucagagaagugaaaccguaaugauuaauauguaguuuuugguuuguagaauaacaguuaccaaaagaaugccgagccugcucaucuucggauggcucuggguuuuguguuguacuugagaagagccuuguuucuuuaaccagccuucugugccugucagugcuccuuucuccgcugucucacuucucucccacuguuccccaaaaaagaccagucccacagugagagccgagucuggguccacagcuccaggcuccugcaucugcacugccucuguacuaugagugccaucucaucggcuguguuagucugggcggugguggaguacgacuuuaaucccagcauuugggaggcagaggcagguggauuucugaguucaaggccagccuguuauacagagugaguuccaggacagccagggcuacacagagaaacucuaucucaaacaaacaaacaaacaaacaaacaaacaaacaaacaaacaaaaaacuuaggugagggcuucaaaaauuggaagaaacauuuuuccuaggggaugacccuggauagcuguguuucucuaguucuaguagacagaugguguggagcccagugccaugcugucacgacaagagaucaggcuuggugggagggcuguagagagagcuguggaccgacuuucaggcuuuugucauugucuucaucuuaaagccaccuauucccacuggaaaaugguuucauuugagggagagaauuuccauaugaaaaagaauuuuauagacauuuacagucagugacaucucaguuucuuuuacauauuucaauuggggaugcuucucuuaacaaugagcucacaagaauuuggagugaugcucagccuuaggacauuuuagagacaaagcagguuguaauuuuaaauguuguucugggcuucacuuccacuugcuguucaauuuagauuuuguguguugagacaaagucuuacuauauagcugagauguugauuuuccugccucaacaucuagaguacuaggauuagagggauacacauaugacuuuacucucuuuagaaacaauucaguaugguuuuuuaaaaaggauuuauuuaaaaauuuuuugagauuauuuuauguaugaguguuugcuuauauauauguauaugucuacacaccacaagcaucaugugagaccugggcuugaacucaggucuucaugcuuaauggcuagucuuuacccagugagccaucucaucaucucccuuugcuuugauuuuaaugaauauucuaggccugauuugcugggcugacuugcuguuaaaaaaucuagacagguuuuuuuuuucuuauuuuaaaaaaauaauuugccacuagccugucuuuuugucuuuauuuuuucauugcacaauauuguuuuuuuuuaauuuaaaagucuuauguaugacuguuuugccugcauguauuuaugugcaucaugagaguaccugguacccaggaggcagaagagggagucugagcccagaauuacagauagaugugagccaccgcguggaugcugagaacccagcuuggguccucuugcaguagcagugcguguucucuagcccugcagccccuagaguuuuaaaguuauuauuaauacaauuuuggauuucugguugaaaagaaaugacuuuauggaguuuacagugcagcacuguugucugccaugaaggcuuugcgggugcugugucucugcccucucugucuguucucacuugcuuagugcauggagcccagugagccaccucacugagaacugcugaguuuuuuggcugcucagcuuuuuuguuguugacuuuaugaacaguugugccuguuucuaaacuguagcaugauuuucugugcuugcuaauuguacuuaaccucugugcucuaggcaaagacaagaaaggaagcugcggucuuucccguguggacagcacgacaugccuguucccuguugaggaaaaggcaguugaauauuacuuugcuucugaugcaaggugaguugccuucaaugagucaagagaauuuucaggaaaacuucuccaaaccaugacuguaucuugcaaaaaucuaagugcugagaauagaacugacuuuggaaugcuaagcaagcaagcagcuugccacugcauggcgccucagcugcagaacucuuuaguugagacaguugugcucaucuugugaggcauaggacaauaaacacuuuccuccuacuucagagcaugauggucacuuuacguguguauucuuagagaccuaaugccuuuacucuggagcuuuugucuguuuguuuguuuuguuuuguuucugggagguguacccaaguauuguagggaggagggguugcuuuuccagcauuuaaaguuuugggcauuuagccuuuacauuucaaguuaacuuacagcauaauucuugaacaaaggaagacugaaaauguaaaagaaagcagacuauuuacaggcauugguaauuccaauacuguaggaguggggauaaaauagaaccacccauugucugcagagacuggacaugagaggaaaugagaaugauacugcuuaguacuucagggaauguauuaucugagaaacaaacuuuacugucuucuagauuuuucaaauuugucuuugcugucaguaagcggguuuauuacagaguugauagucaaggcucagacucggaauugcugaagaauauuaauauucauucuuacaugcuuauuagcagagccauauuauaaaaguaauuuuauucuucuauaauaauuguugucuccaaggcuuacugccucagugugcuaaccuagaccuuguccuggaagcuucuguacaaucuaaucuagaccuagauuguuuuccaccucugggacuggcucacccgucuuaguaauucuuucagaucucuggcuggcugguuuaacucacuuauucugccucacacucuucaagcugacugauucaaucugccuucuaucuuggcuuccugcauugcucugcuuggcaacuuacucacuuuggcagucuauuuugaucuucuggcuucuucucauucucugacuuguucugucuucaccugggucuagcuuguucucucuacaacuugucucuauagaacuguucugggaaaacugaccccucccccagccccacccuucucugcacugcugucuuaaguagcuucccauuucucucucuucuccugagaauugaguauauccuagucugucaaaucuuucucugauuugucgcuuugucugccucucaauuagacaucacuuucaaacaugcaugcuucccucuacaaacuaacuuuacuuucauuguuugggauuaaagguuuguaguaagggcaugucuguauuccagcuggaaggauuaaaggcguguguugagggcugagccacauuacaacuggaaacaguuucuuucaguaaauaccacaaucuugagguucacaguguuaucaaacauccuacaacaccauaugcuagucucaggagaaugguacaauaaaaguacuacuuggacugccauaguaggggagacacauuuuaaagcaucuauguggaguuccuacugugacaagagcuacacaguuccuauagcaugcucccuuaaccccuuguuaguagaucuuuuuuuguuguuuuguuuuguuuuugguuuuugguuuuguuuuuuuuuguuuuguuuuguuuuuuuuuuuuuuuuuuuuuuuuuuugagacaggcuuucucugcguagcccuggcuguccuggaacucacucuguagaccaggcuggccuugaacucagaaaucugccugccucugccucccaagugcugggauuaaaggugugcgccaccacgcccgacagaucuuuuuuuaagacaacgaagcucaaucugagcugaggggaucaggagaugcuuaggugaaagguaugggaugagcacucacuaugagcuugcaaagggcgcaaagggcgucaagcagcuugaagagaaucaaggacacuugcugggaugugcauggcaguuugagguucuccugagugccagaagaaggcugaaaaaugauuuguugggugagggaaauaauucucuugauuugcaucaccuuuugcuguugacuugggcagaaaagagaacagaggggugagagaaaguaguggauacuuagggaugcugcagaagccagccagagcugaugacagcuuguacucagcaguggcagugacauggaagguagcguucagaaacacuuagcgguuaaaauggcagacuuaggugagaguuggcaggaagcagaaauagccuugcauuuuccuuuugaugagcugcugguuagguugcuauguaaagggccccuucacucuuuuguucacagugaccacauguuuaauacggcccuguaggaagcgaaggcauuacacgugguauaagaugagaguugagggcuggugagauggcucaguggguaagagcacccgacugcucuuccgaagguccggaguucaagucccagcaaccacaugguggcucacaaccaucuguaauaagaucugacgcccucuucuggagugucugaggacagcuacaguguacuuacauaaaaugaauaaauaaaucuuuaaaaaaaaaaaaaaaaaaaaaaaagaugagaguugauguuugagcuugguccaugcauucuaucugguuauugauaacaucuccuugaccauuuuguagugccgugauagagcacaccaaucgugucaucuuucuggaagaugaugauguugcagcagugguggauggccgucucucuauccaccgaauuaaacgaacugcaggagaccauccuggccgagcugugcaaacucuccagauggagcuccagcagaucaugaagggugaguaccuugucauguuaggacuugggaugcuucaagaaaggaagccucuacuuccguuauggcugaugaagcuguggagucuuccacaugaugaguggauggucaaccuggaaagggaugacucuagagaaacggccugcuggucuuagaauaguuguugaaucuaacucguggucuguuuuuaacuuuguaagaaggaggggguaccaaauguugaaagaugcuuuguaaggguacgaaugccucauggcuguucaguacucuuguuauaucucucugugcuucagccuucucauguauugagagggagaaauagacucuaucacacuaagguuugaggaucaagaaggcugaucuacacaagcucuuagaauaaauagugccugauaccugugugccccacauaauguguacugccguuaacuguuaggguuuuuauucuccuuucugacagugcuguaguagggauuauaucauagagcuacuguccucaaaguuccaugagccauacuacaguucauucaaggaaguaaauacugaucuuacuuauaaguaaggaguuuucccgguugacauaguaaagguuaauuugaucauuugaacuuaaauuugacucaaaaauuuauccucugcccuuauucauauaacuaugaauuuuagcuacuaagcaaauaaaguggcuuucuuccuuguucguuucucauguagaguggaaauacucauccaggcuuuuaggaagucagucugaaugaaaaucccuuguugcauggccuuuguuucaucucucaagauuaccuugagauaguguguuuauauugaagagguaguugauuguguacagauugcuuagcuuauuuacuguuguuuuaauuauauaauuuuuauuuuuguaggcaacuuuaguucauuuaugcagaaggaaauuuuugagcagccagaaucuguugugaacacaaugagaggaagagucaauuuugaugacuacacugguaaugacauuuuauauuuugucauuuaagucuccugggggagugccauuagcaaccugacaaauuauuguccuucuuauagauuuguggaacagcuaagauugccagguaucaaagugcgauugcacuguguauugguugagucagcucagauuuggggacagaaagugggcugguggggacaggugcuggggaaugguggagagucauggucuccuagguaguuuucacuggguaugugggagaguucuagaguuggauagcagggcuggggcucacagugugaaugugcauaaucccacuacgaggugacagucacacacuagguucuugcugugguuaucagaccuugggcacuuugccugccugucuguauaauauguguaccacauuugugcuugauucucuuggagauuagaagaggaacuggaacaggaguuugauauaguugggagccaucaugugugcucuggaaacagaacccaaauucucugcaagaacagcaagugcucuuaaccauugagccaucuuuccagccccuagguuucugucauaaguagcaaaacacgaacuucugcagaggucuuucauguuugcacuuugcuccauguugaaagcagaagucagagagcagcucuggucucuagagcacacaccacagcagcuuacagauaccgcaugacuagacucuagucuccaacucaugucacaggaguagaccauagcagaguuucugauguagucuugcccuuaauaauuuaaucauaugaauauauaauuaacaauuuaaauaaauguaaaauaugauccaagcacuagaaaguguuuaaaguuuaguauugaauuuaggaaagggauguugggaugaggggaagccucgcgauguaagaagguguaggcuuggaagauguaaguaaguggaggucagaugggaacacugggcugccuggaagagcauuagcugagggcauuggugugaaagccaugaggaggcuuaugcucuguuaugcuuaugcucaguaguuuaggguaugucucaggucuaggauuugaagaauuauaaaagucaguuuaggaaaguuggggagaggaacuguccugaggagguggauggugggcucagggggcaccucuguuauggaagcugauuagcuuuuaaagucugggugcuaucuggucuguaggugccagggaagggaaagccuggguuauauauagcaguacgaugucgaucugucugagcacagugaaaagaggaagaauggggagacaggagcaauaggagugggaccgugaggaccacauagaucugugagggaggagacccagggccagagcacagugcucaaaggauucguggaacuuaagucaggaaaaagaccuguuugcuaagcgaagagaaugaggccgacuuugagaacuucaugguaugccuuuauuccugugguuacuguguugucuuaaucccucugugccacauccuggggaacaaaacuaggacccugcaugugcuaugugugucgucuccuucugagucauacaccagcgcugagacagcuacuguguuuaaaacucuuacguguauuacgugcauaugaguugucuaauguaaacaggauaggaguucucggggacgucagaacugucagcugaauguuugccaaaggucacauugccagucacucauggguguguuccuucagugacgcuccugaggaaccccaccuccuaagcagucuuucuauuuauuucuuaguuauggcuguguugucagaguuagacuaaagcauuauccagauuaugacaugcuuggcaggcugaggcaggagcagcaagaggccugccugggucucacacauuguacauaagucauuucagaccuugggggacuccuagaauuagccuaaaagccaucagggaauuugcuugacuaaguuuaggaaacaugucuuaacaugccuguucuugaucuccaucugcaauacuaccuucucugguagacugucugcucuuuugggaggagggguaggguguuauauagucccaaauggccuggaacucacuuuugaagaccaggccagccuuagacucacauaucuccagcugccucuugauuuaaaggugcgcccuccucauguaauuugucuguuuuauauggaguaugacucaccccagccuccaggcguuguuuuuuuguuuuuuguuuuuuuuucugucuuauagccauccauuugguuuuguauggcugaguuucugaaguauauggcaagccaaaggaaaagaaucaguagaaaaugauggauagacagacagaacaaaauaucaaaaugucuagcagaaauugacugggaaggcuucuguaacccagucaguuggaguuuagucaggguaaaauggucccucaaguaaggggaggcuucggaguaucaagagugggcauugucaaauuggguagagcagaaacagaccugggauggugaggugguucuaacuuuucagcuuuuccuucccucugcacacacuuguuuguuauggggaaacaguaguaacaucuguuagaaauaguuuuuccuuggagcuguucccauggcuuuccuuaggcuguuuuuuucucgugccuaucacaguguuuagaaggcuauucugucuucagauuggagagaacaaacauucuugggccugaaaugguggggggugggggggugggaaaaaccccauuuccagaggcaguuucucaguggauucaaacagcacacaguauuuuaccaauagaacacacaucauacuuccuaaaguguagcgcacaccaagaccugugcaaacacuguacucuuacacuguguuuugauuaagagcaggcacagaaguuaaccuggaaaugcucacaggggaccuggaaaacaugaauagugugguuuauaguccaagucauuugggaaaccagcagcaaguuuuguuguugcuuuguuugguuucuacuuugguggugucuggggacugggaggcuaauacaugugagcaagugugucugugugaauguggaggucagaggucacugucgcaugccuuucucaguaccuuucaccuuaucuccugaaccuggggcuuacugacuggcugcacuggcuggucauugggcuccaccuuccuaauguugggacuugccggucuccaucuucguaaugcugggauuacaggcaccugucauugugcccaacguuuuaugugagugcuagagauccaaauuaggucuucacacuugcugagagaauauuguugucaccaucaccaucuucagagaugauccaauggauuucaguaggugggcagaggagagaugucccagcaguccaagugaggccaacauuggaacugaacuguuaagucaguagccauggcaaagacugagagaaaagagggcuugcauacaaacaggacugcaggauucuaugcacaucaguaccacauuaaaaaaaaccucucuggacugagggguggcuugagggaccaaaaugcaucacuguugcauuaaggaaugggaacaggaacuuccucuuggaguaguuugaccaagaaccucaaguuugaguucugcuucuccauuguggcuaguggccucuuggcagcaugucuguccuauaggacugaucugucugucccuguuccuucucuguugugucugaucucucuguuuguuguguuaucccuaacaaaaguuacuuuacugacucagaacaccauucggucauagagcuaugugcacacguugcucccaacauuuauguguuguuuguuuuaagguugcuuucaaccuguuugcugcucucagcaaugauugcuacaguacacaugcauuauucuucucggucgaccauggaagaguccauaaucuaagaguaaggcugugcauugagccuaaguuguaaagcugauugcaugggaaauccaacacauaguagaguugguuacauuguucucuuaaaggcagguugguuaaacaggcugaguauacauagacuagcaggguggaugcauaguccuacacgaucucugcacaauguaaauguggcugcagggucuggcaguaguuuagucucuuugaagacaagaagugcucuuagaaaaauagauuaccauaguuuggaguuuguagaaauaaacauaauguaauuuucuagguagcuuuauuagacauaaugaaaacaaucauuuuguauauuugauuguaccugccuauguucauguguuuagggagggguguguguguguguguguguguuuauauuuauauauauaugugcacuugcuugcuugcuugugcugauguggaagccagagaccaaccuuggguguuguuucucaggcuuauuccacccuguuuuguuuguuuuuuuagauagggucuuucacugagacuuggcauuuguggauuagacuggcauggcuggcggugagccccagggauccuucugccuacucuucccagagcuaggauuauaagcacucuccaucauccucagccuuuuaaauggguuccgggggucaaacucaugcgugugugacaagcauuuauggguuagccuaucuucccagccuuacuuuaucauuuaucuucuuccauugguuguuuuguguauguguguggguacauaugugauaguacacauuacauauauaugugugauaguauauagggagaggucagagcacagcuugccggaguuguuucucuccuuugccguguggguccuggguaaagugaggccaucaggguuggccgccuuuacuugcuaagucaucucgccuacacacauucaucauuuuaagaacauuauuuuucaaaaaggcuuccuuauuuuuauuuugagugaguguuuugccuguauguagguaugugcaccaugugcaugccugugccugaaaaagguguuagauugucugggacuggaguuacagaugcuugugaacugcuguguggggacuggggacugaacuuauuuguauccugugcaagagcagcaaguccucuagaccacugagccaucucuccagccccaaauucaucauucuaaauguaacauucuguuauaauuuuuuucugagacaggaucuugcuguguugcccagguuacuuuaucuugaacuccgagugucagugacucuguugucucagcuuccugauaagauucuggguuugauagaccucuguaacagccauaaucuuaucuucaacagaggcaugacacacaacagauccucauucgggaaacuuccuuaugcccucuugucauccucucuccagauccagcuuucagugccuacugacccgcugcuucuguccccauaauuuuccuuugaggucgucuuuaauguagagagaggaaugaaaagugacucaaaguagagcccaugccugucuguacgccuuggugggugggugaggugagugcagaugggggaggguccaguuccaaaaaggaauaugaauuacuuaaaacaguauuauuaauuuuucacaucgacaauggagacugaugaaaagugauucccuguuuuauauugaucuuuccuaaguaauuauauacacacauuucuauuucagugaauuugggagguuugaaagaucacauuaaggagauccagcggugucggcgguugauucuuauugcuuguggcacaaguuaccacgcugguguggcaguaaguggccccuucacauuucaguucuguuggguugaaaucaggauaucugcaugucaguccuauucuaguaaccucuaaaagcugaaaucugugaaagggacuuacguugguugucaguaaagaaacugggacauguuggccucuuaauaaauugcauuagcuguaguuacuuuauaaggaggcagguuaaacccuggccuguguaggucucuuacuuuaagaucaauuuccaaaguugaugauaauaauuuuuuauuugcugcaacacaaaauauuuauuuuuuaccccgagagcuuuuuuucccuaaggguuucucuguguaacccuggcuguccugggugaccuggaauucacuuuguagaccaggauggccugggaaucacauccccuugccucuguaggcgagggccaccacaccaaucauuuauugaaugugugaaauaucugguuaccagcuucacaugucagcaagcugugcuuuuccagagauccucuccccaaacacuucuuggucugagaaggcggcauuucauaagcgugaagagagaguaaguuaaagacgcuagugagagcuuaaggaagguguggaugaggucaacucuguaacguccauuugugaccagguuuccuacucagaagaaagcauuugauuccugcugcauucagcucugauccucaauuugaguauaaaauauugcuauguuagaauucucugaaucauuugucuucucuaagggagagauuucauaagggaucuaugugccaaaauuaaugaaagcacguaagaaaucucuugugaguagccuaugaaauagugcuguuuauucuacucauccuagacugaauguuuacuuucaugauauagucaagagcgagugacaggcacaugucuucuuucagugugucuguacccgauuaguaacaacugccuacgcucaaguuggucugaaaccagcacgcuuuccagaguuuaacugccucgugggcuuucgggucauagaauggcauuugcagcauaaauaguuaucuuuuuagguuaggaugaaaauauuuaacuauuuguaaaguauuucucaucaacacauuaguaugagauacuuuuggguuacauuauuuuuaaauaucugguagguuguuagguuuguuuguuugaagauaaaugccaauauaaugcauuuguaaucuagggggaaauuuuuuuauuuucauuuauuugaaggaagacaucuagcuugcuagugucaguaacugacuuagaaauaguuacaaauaaauuagaccaacagaaaaguaauuaaaaauuggaacauuuaauuuucaaauacuuggcauuuauguugcugucauauugcuuaaaaacuacuaaacuagaaucauugugggaccaaacacagaagaacaauucuguuugugggcaagcaaaaguguaagagcuguggaauacagacaacuuugcagggguuuuugguuuaaauuucccccuuucucucucucucuuucuucccucccacucuuaacucucuuuugcuguguguguguguguguucccccuuucucucucucucucuuucuucccucccacucuuaacucucuuuugcugugugugugugugugugugugugugugugugugugugugugugugugugugugugagcguguaggguuccuuggagcuggagaaugcaugguugugagcccucagucacagguguugggagacaaacucaguccucugcagcugcucucuugcuccagccuuugugguuuuguugcuguagaggaggaaugugcuauaaaggagggggcuagugacaggcagggcagggcuggcuggccugaggaacaggugaaaggcugcugcugacaggaagaaaaugucuguuaucagcacuaaaguuccaccaugugccuguacaucuguagggcugaaaaaagacuggugccugaagguuugcuuucuguuguuuguaauuuucugaccuuuagaauaaaaggaacuuagugagaaugcgacuuaguaaaaggcuugggaauucccuuugaacacaagcguguugcuuccucuuucacaccaugcuccauugcuccaaaguugacaacaaggagcugcccuaaacagaacuucuuaaauguauucacauuuuugaaauaguauuauuuauacauauaguacauuuuuaaauuucacugaguauguacauuauuacaauuuaacuuuaauuuuauauguuuagaauuagagaauuagugauacacaaguugacucagaacagugcuuuuucugcucaaauguuucauauuuguggauauauuugcuuauaagcauguuuucauagagcuuagaauuauggcugacaccugcaaucccagcacucaggaggcugggacaggcacuuacugcagaucugaggucagcuggcucuguacugaguuccagaucagucuaguguuaaacaaaauagagcauccacauugguaguuuuucucaaagaguugcacugaaaguuagcagugcguaucucuuaguaguaggguggugaaugcauuaauuuuuuucuuuaauuuguguuucuuagugguuuccaaauguaugccuuguuuuucuguggcagugcugugguggggccuagggccuuaagugagcuaggccagugcucaccacggagcuacccucucgucugugugcucacuuuguaauuagaaaaguggagaccaaagaaguucagugaaaaaggauguccuaaggcagaguguguucuuuucccuguagacccgucagguccuggaggagcugaccgagcugcccgugaugguggagcuugccagugacuucuuggauagaaacacuccagucuuucgagaugauguuugcuuuuucauuagucaaucagguguguucauuuuaaacuugaaggggaaaaaguuauuuuaagucaaguuuccuaauaagccaacccuaucuuuuaaacugacacuuagcagggugugguggcucacaccuuuaaucccaggcaggcagauuucugaguuugaggccagccuggucuacagagugaguuccaggacagccaggacuacacagagaaacccugucuugaaaaaaacaaaacaaaaaaaaaccaaaaaacccaaaaaacccugacacuuaaacuggcauuucagauggccugguaaauaccgauugucuucgcuuguacuaauacauucuuuaagacuuaguaaaaaugaacaucuuuuuuuacauauagcuuauagaguuuaauuuucagauaagaaacaaaaacugauccuagaaauccuagguuuuguuguuguuugagacaggguaucacuauguagccuuggcuggccugaacuuagcuagguagaccaggcuggcuuccaacucagugauaugccugccucuucaacccaagcccuaggauuuaaggugugugccccaugccuggcuaugucuuauaaguuuaauaagagcaugccuuaugcuuuauuuaaaacaagugauaguauuaaaagcauggcagucgguugguuuuucguguaugaaacugcauccucugaaacugcucucuguuacuguuguccauuuuacacaggcgagacagcugacacccugaugggacuucguuacuguaaggagagaggagccuuaacuguggggaucacaaauacagucggcaguucuauaucaagggagacagauugcgggguucauauuaaugcugguccugagauuggcguggccaguacaaagguaaauuuuugguuucuuccauggaaguuacuuaaccauacuguugguaagagacucugaucuguggggcaguuacuguacucucuucucuuagggaggagagcaggaggaaucccuggggcuuguuagucaucaacuuagcuccagguucagugagugacugugucuuagggaacacgacagagauugauagagcaggacacccgauggccugcucuccugugcaucugcacggauacauguaugugcacucacaguuaaugugugcauacaugugugugcacucacagcucauguguggauacaugcaugcuuacucacaaugcccgucucucccuuccccacacagucaaauaaauaaaacuuauuuauguauaugaauacaccuucacuguccucagacacagcagaagagggcauaagaucacauuacagaugguugugagccaccaugugguugcugggaauugaccucaggaccucuguaagaguaaccagugcugagccaucucuccaggccagcauuaaaacuuauacaucuguuucuguuuagauagugcaucuguagaagcuuaaaaauacuuuuguuuuaaagguguauaagucugcuuugcucuuugaaguugagauaugaauaaauguaagaaauauccaacucuuugcaagcuguauugauauaaaagauuacucuccacaaauauguugcuuuuuauaauuuugaaaguuuaguuuuuuuucugcuuaagcuuaacauuuuuuguugauucucuaauaagauauuugucagugguuuaggcuuuaaucuauaaagucuuauggaaaacuuuuuguaggaaaauauauaauucuuguuaaaaauuuuugaguuuuuuguuuugagagccuugguauuacuauacuuuccacauagcugaaauguagauuuucuucacaucauaagaugugacuucauccuuggugaaugcauagcuagcucuuugcagcuguguugagacagcccuggugcagugugggaacacaggcuccucauccagagcauguugugaaccacugcacuuccacaugguguggccguacaggacgaggaguugcaagggaguaagucuuucacuuacgagagcucuaauuuccuucccucguuuuacuaugaagguucgcaugcauggagugguuacagugaccuuaacacccacccuuagucuuuucuacagcuuugcacugucaugugugacuuacucgguugugcagcugugggcacacacaguucuaggagacugggcucaccucugugcucacucaaaccuccacccgcaugcucauaacuacuacuuuuucuuacuaaaguacugucguuuuccagauaguucucaugaaugggaguuuuaugauacuugugcuuuguaacuggcguucaucgagugugacaccuuugaagcuguucauguuguuauuaguuucagcaggucuuucuuugaaagcaaauccuuuuacuuuuucuuuuuuaaauugaaacaaagaucuauaggaaguugcaaagcugcauuagucagcuucacauuauaauaacaaaauacuugagacagcuaauucugagggagugagguuucugugaguucauagcucgggagggucaggucgaaguuagauagccucaugguuuuuugcuccggcuagacucucauuccauggugaggagaaugaagagagcagagaugaucugagagucagaggucccacaagauccuucccagacaguuuccaaggugaccaaaggaccccucauuagaccagcucuuacuaaaaggaggagguccuacgaccuuccaggggugucucuaacauggacugguaccugcuccuagccccagugcagugaagucucuuguaugcaucacuuagcuucccagugcuuccgucuuauaaggaagcaagcaagcaucuucuuagugauuucuuuuuaaagugacucaguuuuagugaguauuggcaagggucucagcaggaaaagauaccuacuaccaacaucaucaagccugauagucuugaguuugcuccccagaacccguguaggggaaggggagaaccaacugccuauaaguugucuucugaccuccacacauguagggacuauuguaccccaaauacccucuaaauaaauaaauguaaaaaauuuuaaagaaguauggcaauauaauacagcuucauuuuucuuagauuucaaauuaguuuuauuuucagcugucuuagauauucuuggcauaggguuuuguaaauaagcuuuacauucagauuauuucugaauggugaaugugaguuucuauguucuaaguaaucacagaaguugcucagugcucccaucaccggcucaguaaugagccugcauacaagucccccccucugccggcagcagugguuggcuuacggcuggcacuggcuuucauagcaucagaccauggauaauuugguguuuccuuaggaaaugugcagaauuugcaguuuuuguuauugcagauguuuaaguuuuuaccacacugcugacuuaguuaguguuuuuuuuuuuuuucuucccucccccgcccccuauguguuucaaguaauuuugucuuuggcugaauaaaaagaaaaucaaguugaaaaguucaguuaacauuuucuggguaaauuuuuucagaucucagacuguaagugugagguguagcuuguguuuaucauaaugaguuucucguuauguacugacgacauggaauauggcggcuggauacacacucagugguagugugggggagcuaggcugagcgcuuguuaucaggucagauuggauuuggaacagcuuuuaucuaaggagaccaagauacuggccugcuuugcccuguuuacugaagggugcaccuuagaacacaggguccuuaagcauggaggcaagggggugcugugggcauacaguggggacugguggcugugaaagccagggguccagcagaacugucagggucccagguaaugggugggcugagaaggagccuccucagcauggcaggagcguagacacugaggagugguucagggaagauuacugauugagugugaaaccacacugcacucuggagaacaaccaugugcacagcacaguaugccuaacaaacaguuuaaacacgaaaaugaaguaaaaccuuucauggcaaagcaguagcaucugcccuucaccuucagcugacgaggaagcggcuuacagggucuguaagccggaagguucacauuguauucaucguaggagaaacaucuuccagugcaaguuucugccagugcucuugagcacaguguucuggcuguguaucagaaacuguacuggguguuuucugugucugagcuaauuaucaagauugucuuggguucuugaacacuuaacauauaggguaucugaugcuguaggcaggaaaccggcucaaguucuuugacaccacuaaacaaaggaaggugcuuagauguuauguguaaaagagcauuauaaaauucugacaccuaacgcuuauuuuuaacuggaugguuuuugggacaggaucuuauguaucucaggcuacccuugaacuuguaguuaaggagaguuuagcuuccucauccuccuggcccugcuuccuaagucuugggauugucggucuguaccgucaugugugcagacguacucagcuaaguaauuaacuuucucuuuuuuucuuuuauugaaaauagauuuuuuucauauuuaauauaaagaaaggaaaacugggaccagcaagguagcuaaguggguaaaggaauucgcugccaagcuugacaacccaaaguuugauccuuuggacccccauaguagaaggagagagcugauuccagaggcugcacccuguccucuauauaugcucucuggcauguacacacccaccauugacacacacacauguaaaucauaaauuacaaauacgucaucguagguuugcaguuucuuuuuguuuuguuuuguuuuuuguuuuuguuuuguuuuguuuuguuuggauucaggguuucucuguauagcccuggcuguccuggaacucacucuguagaccaggcuggccucgaacucagaaauucgccugccuaugccucugccuccaagugcugggaucaaaggcgugugccaccacaccuggcaguuucuuaauuuuuaucgacuuacauacauuuagacuuuuauugacuuuuuguuaguguuuuuguuaaaauguaagagugaggaccugugcucauggggguagcugucaggacagugcuucuuggcucucacucagcgugaggaucugaggggaguucccagccccagcacaagcaccucagcacuggggaaauagaaauagguggguccugcauguuccuaaagagaacaguagugagcccugggucccagugagagacggugucucaacaacaacagaaaaccaguggguugcucccgaugaacaccuaagguugaccuccagcguccacaugcacauaggugaaucuuaccccuaggugcccucuucccagaaacucaaacacagugagaaugagccaagugugguagcucacaccucuacuuucuguguuuacaaggcugaggcgggaagauuauucugaauccagcccaggugacccuaccuuaaaaagaaaacagugaaaaagaggaccagccaguaggcaaagguuaaagaguaugugugggagcggccacaguuucuagccugcucuccccuucacuguggggcgggcacagauuaacagaaacuuccuucaggcuuucuuucuccuuucuuaggacugugaggggucucacuuguguuuugugugggcccaagacauagacuuaagugcuuugugauuaaaaauagagauagauucccaaguacuaagucaggucaauaucuccagaguuauguguaaaagaugaauagugaggggcuggagagauggcucaguuguuaagagcacuagcugcucuuauaaaggacccagguucaaaucccaucauucacaugacaguucacaauugucuaugauuccaguucuagggaaucugacacccucacacagacagacauggaggcagaacaccaauguaauuaaaauguuaagaaaagaugagcaguguauauugugaaagaauuaggauuuaauucucaucuuuuguuaaaaguuuucaaguucuuaaaauucacuuuucuguuuucugugguguuguaggcauacaccagccaguuugugucccucgugauguuugcucucaugaugugugaugacaggaucuccaugcaagagagacgcaaagagaucaugcucggacugaagcgacugccggguaugcauagaaaacaauaggggucucugucugccuguccguuggucagucggucugucucuguaucucuccccuguacccccuuucuuuuuuuucuuuuuuuuuuuuuuuugugagacagggucucacaugaccuaggcugcccucagacuuaacuagauaacugaggaugacauugagcuggacuuccugcuucucccuugugagugcugagaucacaagcguggugucaucaugcccaguguaugccaaggcuuugcacauguaaucgagcauucucccaccugagccacauucccagccugagcgcuuuaagacuguaaacacuuaccaauugcaguuggcaaagacucuguuuuuuagacuguuucuucacccugcuaauugcuuuuuuuugcugugcagaaguuuuuuuaauuaguaaaaaucacacccuguguaaacuucaugggcugccaugcuccaccgugcaaagcugcagaaaguuaauuuuaugaaggccugcuugucagcucuuguggucauuuccuguacuagugggaguccuucugaagaagucuuugccuuuggcaacguauugaaguauuuucacaauaugauuuacuccaguacuuucggaguuucauauccaagacagucuuuaguauauuucacauuggugagaaauaauggaucuaauuauauuugucaaucuucaguuuuccuagugugcuucuugaaaagguaauuuuucuucaaaggugauuuuucauuaguguauuuucuugacauuuuuuguuagaaaugguggcugcaaccauguggucuauuccuggguccucuguucugugguucuccauguugggcucugucagagccauguguuggugacuaccacugacugcgucgugcagucagagauggagaguugugacaaaugcgucugcauuacucuuccggcuucagauggcuuggagagcuggagucuuuugugcuuuuccuguuuugcuagagcagugguucucaaccuuccuaacacugcgacccuuuaauauacaguuccuugaaugauggugacuacaacauuauuuuugucgcuacaucauaauuguaauuuugcuacuguuaagaaucguaauguaaguaucuguguuuuucaggguccuaggugaccccuguaaaagggucauuuggcacacucacagguugagaaccacugugugagugcgucuggauuccauagcagugaacagagcugucuaaggcccaucgacucuagaguuauuuacagcugugagcuugccucccggguaccuagagcagucugccuuuccugccuuucccauacacuucacugccgggcugccuguauguuuugaaggucagagacucaccuccaccccacccucagcgcguugacuaugauuguucucuguacucaggcccagaguugugcaguuuuuacauuuaauuacuuuauuuuauggguagagguguuuugccugcaugucuaucuguguaucaugcgcaugcaagaaccuguagaggugagaagagaacauuagauucccuggaacuggagucauagauagucaagagcucccaugugggugcugggaauugaaccuggguccccugaaaggucauccagugcucuuagcugauaggcuauuucugcagcccugguuaguucaguuauaagaaguagguuucuuucuaagauggugucuggccacugcccccugagacauagagaaugacagauuggaaccccauugcugcuggaggaaucacugucugcagaccagugccugguugaggcuuugagggcuguaguuuguccuguagguagggcuuucuuauccccuccucagggugaaacuugugcuuccuuucucccagucauggggcuggagcuguguucuguuugguuacuuuuuugccugguggcucuucugauucuuuguguuuugaagagugauucauauucucauucucucucucucucucccucuucuucucuccccucucccccucucucuuucucucuuuguuuuuguuuuguguuugguuuuguuguugauuuuugagacugucuguguuguagcccagggugaguuuuaacuggguauguagggaggaggacuuugaacucuugauccuccugccucuaccuucugaguacuuggaucacagguguucuccacucugcccaauuuuaugcaguuaugaggacugagcccaagguuacuugcgcauacuaguugagcacucuaccaguggagauacauugcuggcuccuugaggcucccucccucccucccucuuucccuccauguuuuccuucuucccuuccuuccuuucuuuuuaaauccgacuccucccugacuguguuacagaaggugucuucuggcccaccauccccugaaaaguccaaaugaaggcuuuugaucuuaguuucuauaugcuugauuuguaagagagugggcagugguugaaguucucaucuugaagcuguacuuuguagcugcagaguuaauaagaucuuucugauuuugcuuccauguguuaagggaauuucauacugauaucacagaagaaaagaaaacuggccguuuuguuguuugcuuaucugugaggugcacugcucauuuuucaagacugcucugaucucugcccuaacagacuugauuaaggaagugcugagcauggaugaugaaauccagaagcuggcgacggagcuuuaccaccagaagucgguccugauaauggggcggggcuaccauuaugcuacaugccuugaaggggcucugguacguuguuucacuuacaguugauuucacucuagugacuuagggagggacaaggaacauuuacuguuauguaucccauaaugcuagggauuuaacacagagagccagguaaucacuauaucacugagccuugccauucaagugagugagugugugguguguguauguguuugugugcgcgcaggcgcaggagcaggaggugguauacacagcgcauguguggaaaucagugaacaacuuaaacaggagucaguuuucuccuuccacuguuugaauccugagcauugaacuuggauagucaggcuugguggugugcguugguugugugcaucuuaccuguggaagcauccuacuaacuccccacguguuuguagacugcguaaauugaauuguguguguuugcugugguuuauuuaccugagaaugagccauaggacucaacucaaaagugaaggcccagaagaaugucuccaugauaacuugggcuuagcaauucaagauacgugcaacagaccaagguucauuagauaagaaauugaaaugaaaauaaggcaaguagaugaauguuugcagagcagcgggcucugcguuugguaggcugaagccuuaagaaucuucuuacagauucaacccagaccaguaggccucuacuacaucuugggagaccuaaccaucucagaugcuuugugcaguguuuucuuuuuucuuuuuucuuuuuuuuuuuuucugagacaggguuucucuguguaguccuggcuguccuggaacucuguagaccaggcugaccucgaacucagaaauccaccugccucugccucccgagugcugggauuaaaggcgugcaccaccacgcccggcucaauguuuucuuaaaaguggaauucugaaaagugagcuaaagacuucucuguuuuuucauacuagaaaaucaaggagauuacuuauaugcauucggaaggcauccuugcuggugagcucaagcacggcccucuggccuugguggacaaguugaugccugucaucaugaucaucaugcgagaccacacuuaugccaagugccagaacgcucuucagcaggugguugcacggcagguaggccaagugcugugagugcccuggagaucucgguguggugacuaaggcgcagguggauuuuguacuugcaugauagagcaggcgcaguacauuacaaacacgcucacuugucaacuccuuugcuuugcucucuauguauaauuugaugauacccagucaucauuucucucauaauagaagaacuaaaccaaaacgaggccaucaucuccaaauuccuucuuccgacaguuaacauaaugcucuuucuuuuuaccuuaacacuguuaagaacuuaacuuuuuuuuuuuuaaagauuuauuuauuauuauauguaaguacacuguagcugucuucagacacuucagaaaagggagucaggucuuguuacagaugguugugagccaccaugugguugcugggauuugaacucuggaccuucggaagagcagucgggugcucuuacccacugagccaucucaccagcccccaagaacuuaacuuaaaaaaaaaaacaaaaaaacccaauguuugguuuacacuaauaucauggaugcuguggcugacacccuccccccaucagcugguuuauauuuuaauuccagaagauauuucucccuaagcacaguguacuagaaauaaacuugaacuucaaaggaagcagaccuguauucaaguauuaaacuuggcauuucuuucuuguggaaauuuuuuaagaaaucuaccgaguccacaaaaucggucugugcuucugucuaaaugagcagucagaccacaugugugugucaggcaguggagccaugcccaccucuuguugcucagcaucugcuuccuggugacuguguuguguaucguuuucuucccaggggcguccagucgugaucugugauaaggaggauacugagaccauuaagaauacaaaaaggacaaucaaggugccccacucaguggacugcuugcagggcauucucagugugauuccccugcagcugcuggcuuuccaccuggcugugcugagaggcuacgaugugagugaccgccuccauccauccaucuaucuaucaucugucugucugucguguguuugugugugugugugugugugugugugugugugugugugugugugugugugucacaguucauggguaggagucaggggacaacuugcaggaauugcagauauccuuccacugaccuaagcguugaacucagguuugguagcaagcgccuuugccugcugggcugucucacuagccccucccagcuugaaaaaucuguccugucccauucaugcuaucuccuguuaccuuuucaccgccaguucguagcuuacaucaguuuuuucuuacccauagaaacauucacuucguugaccgggagcagggcuguuuucuucauggguggugauuggcauuuuugggugggacaaguuauuguuuggaccccucccacagugagggcugcggcauucuuaauccucugggugucaugggaaccaagauacccgguaguuuuuccaggguucccuaugagggccaucuuccuaggggaccaagguagcucuccuauguaugucagcgccuuuccuuuauuguuuuucaguuauuuucuaggcuaaauuacaugauuauauuugcuaauacaauucucuuuucugcagguugauuuuccacggaaucuugccaaaucuguaacaguagaguaacagacaccugaaacuuaagacaguuaagcaacacgagauaccuuuuguauuuaaauuuuugauuuaaacuauugccuccugaaagccuuuuuuuaguaaaucuuauuuauauaucaguuauaauuauuccacucaacuaaugauuuuugugcaauugucucauuuucaauaauacaugggggaauuugauucauagaauuuaagucuaaaccuaaaaucagagagaucucagcuguauuuuguucagagaacuggauaauggauuucugggcccuccauuucauagaggaggcuuggugagugucaaggcgcuugguguuugcuucagcauaacgugauucggucagucagacugagggaagaccagugcauugaauuggauacuccaagucagugugugccagugccuggacagccaccaaaggcuuugcugcgcuacuuauaaauagaagaugcugcaguuuauguugaagcuuauuucuguuuuguuuuuaaaucaaacuguacaccaaaaaacuuggugagauuuuuaucuuaguuuaguuaaauuaguucaaacaugucugucaucucuguagacagugcguuuggguccuccacaccugcagagaagaccuuguggaguuuggaaaacuugugcuguuagacauugauauguggcuggacauuugaagauaggacacagggauccacuccuuauuucuucaucucuuaagaguaguuggcauuuucucgcaacuguagagcuuaacugaaaagcaaguacuguuuguugagugacguacuuuguagcugccuuuggcaucauagcacagaguugcugucaagccucaaauuggugucagggugcucaauucucucuucagcuuugucccaagaagaguuuccugcaguuaccuuuacuuccuccccugccuuguugcagaaagcaucccuuggugccaguguagaaguucugcuugggggguggcaggccuugcugcucauuugacccucaguguauguggcaggcucagcugagaacggcacauacuuggcacuguggagugacgucaguuucaggguuguuuucucgauguuuuccuugggacuguuuugacuccuguugaggagugaaugcaguauaaauacgugagacugucaugccuucagcugauugugucagaaaugcaggucagcaaguuggauaaaauauuuaaaauagaacauuaguuugacaccccaaaaaugugcagaguaauuucuucacagagcuauuugggucagauugugugggcagugggcagguguguguguucaaguuagguccauuguuuucaaaagcuuucaccuguacacggugaaagcgcagugcuucacggagucaugcuuuguguuugaacuuagugguaagcaguuaacacuugugaaggugaguugaagaaaaaguugaugucacuuuaggcauuucagaaggcuucauucacacugauggaggcuggaaaccugauuuugauaacccaagacagggccacaguuuguacuccaugucacugcuuuggguacguuucucuguuguauuugucccuaagacuucauguuaguggagcauguguguaaggucauuucuuaggccugaugugguagcacagcugcucguguuuggguguggcuuuuguuugguguguggcucuggagcacagggugauguugguguguugagacacugaaacugggagacgaucagcucagugcugucuggucacucacugucagcucagucacuaccccgggguccuguuggagcaguuuuggauuauacagcucagucuugcuaaccacccuccgugcagcggaacgucacaacucuuuuugucuucugucuaugauauugaacccauuuaccaguuucucauccauacacacuccaagcuagaauaaauacuaaaccagucagaaacccagaugaggaccaggguaguacugucuaaacaaauauuauuguuuuccauaucccauuuugcuuucuaccuaaauucuuuuauuaguucuuaauacccagauauuuuagcaaggcaaggcacuaggugaguaggucccacuaauuugguauaauacaggacauagaaaucuaauuuuucaaaacaaaaauacccuguaaaagggaggcuuucuauuaaaauucuccccccccccuacccccagcucccuguuuuucaagacaggguuucucugugcaguccuggcugaacuggaacucacucuguagauuaggcuggccucgaacucacagagaucucccuaccucugccuccagagugcugucauuaaauucuaaucuaucuaucuaucuuucuuucuuucuaaaaaguaauuauuuuauuuguuuacauuucaaauguccuccuuccugguuuccccuccaugaaccucccaccccaucccccuccuuuuugccucuaagagggugcuccccacccccuccgcacccccuagcaucucccuucucuggggcaucaggccgccacaggaccgagcacauuuauaguguguuuaaguucacacacacaucuuuaccugggaguccuugcuaggcagggaggacugaggcaccugacacauggcccacuugaugguuacuacuuucuaaaaaagagaaucuaugccguaagauagaaagguuagaaggugagccacucacucuuagccugugacuggcucggcggcuguguaugagcggcugccaugcugggcagcagagcuagacccucagagcaauugugacugucccugguggaccugguccuugugaggcucaggagggaggguggaaagguggagcugugcugagguauuaaaugcugggccuggguucguuugacauguucauaagcagcugccccggccuguccguggaacaggggacuauaaagaacagcaguuaguaauauggcaagcaguugugugucccugcucagcagagugaugucacaggguacugugcagaaggcuguuaguucagaacaccaacaucagcuuuuuaauagcaggcuguuucugaagugacaggugguaacccuuucaguccaggccucuugccucagugguucugaaggugggaggaaaggaggcuggacuuggucccauguagagggaaacuaacacuuucacaacacaccuucagucuuugggguuacucuuuuaucuuuuuuuauaauuaggauauucuagagcaauaaaagagacuaagguuaccuguuuauuauauacauuaacugguaugaguuuucuaaaaaaaaauaauaaagcacaaugucauuggaaaauguuuguuuaaaaaaagaauucauaauuuacaacuugggaaggccaaagacauggaagggaaagguaaagacauuuugauuuaugacauccacauuuugauuuaugacaacccauaguggguuguguguacaguaauacuacgcaggguuuuaagcuuggagacauuucacauggcuuuuauuuaguuucacauucaaaaguuuuaacauaaauuggacuuuuucacuguacuuaaagauuguuaauaaguauuucaguaucuucauagcuagaauuuauuuaaacauauccucagaucugggaugauaacagauaauaaaacugacagcauuggcuuugaauaguaauguccauaguuuuaagcaagacugcuaaguuguguuguguugacuguaaguccguacgcucaguagugauguucugaaggcugaugauggcaucagaggaaacgucaccuuaucuuguuucugcacuaguuuccagagaguguagaaauggucuugcuaauuuuugaauguucuuugguugaauguguuuuuccauuaauaacauuuuuauauuuguuuaaauuauacuucugugggacuggggguuagaauaaucauugcucuguuuugauuuuguauucuuuuaaaugaauguuuaguuuucugagccagaugguuauuucauccuuguguccuguucaauccagugacuacaccggaacugugaauaaauuacccaaaaccuugcugugugacu

SEQ ID NO: 3172 - RNA, 49364 nt, Mus musculus
agucacacagcaagguuuuggguaauuuauucacaguuccgguguagucacuggauugaacaggacacaaggaugaaauaaccaucuggcucagaaaacuaaacauucauuuaaaagaauacaaaaucaaaacagagcaaugauuauucuaacccccagucccacagaaguauaauuuaaacaaauauaaaaauguuauuaauggaaaaacacauucaaccaaagaacauucaaaaauuagcaagaccauuucuacacucucuggaaacuagugcagaaacaagauaaggugacguuuccucugaugccaucaucagccuucagaacaucacuacugagcguacggacuuacagucaacacaacacaacuuagcagucuugcuuaaaacuauggacauuacuauucaaagccaaugcugucaguuuuauuaucuguuaucaucccagaucugaggauauguuuaaauaaauucuagcuaugaagauacugaaauacuuauuaacaaucuuuaaguacagugaaaaaguccaauuuauguuaaaacuuuugaaugugaaacuaaauaaaagccaugugaaaugucuccaagcuuaaaacccugcguaguauuacuguacacacaacccacuauggguugucauaaaucaaaauguggaugucauaaaucaaaaugucuuuaccuuucccuuccaugucuuuggccuucccaaguuguaaauuaugaauucuuuuuuuaaacaaacauuuuccaaugacauugugcuuuauuauuuuuuuuuagaaaacucauaccaguuaauguauauaauaaacagguaaccuuagucucuuuuauugcucuagaauauccuaauuauaaaaaaagauaaaagaguaaccccaaagacugaagguguguugugaaaguguuaguuucccucuacaugggaccaaguccagccuccuuuccucccaccuucagaaccacugaggcaagaggccuggacugaaaggguuaccaccugucacuucagaaacagccugcuauuaaaaagcugauguugguguucugaacuaacagccuucugcacaguacccugugacaucacucugcugagcagggacacacaacugcuugccauauuacuaacugcuguucuuuauaguccccuguuccacggacaggccggggcagcugcuuaugaacaugucaaacgaacccaggcccagcauuuaauaccucagcacagcuccaccuuuccacccucccuccugagccucacaaggaccagguccaccagggacagucacaauugcucugagggucuagcucugcugcccagcauggcagccgcucauacacagccgccgagccagucacaggcuaagagugaguggcucaccuucuaaccuuucuaucuuacggcauagauucucuuuuuuagaaaguaguaaccaucaagugggccaugugucaggugccucaguccucccugccuagcaaggacucccagguaaagaugugugugugaacuuaaacacacuauaaaugugcucgguccuguggcggccugaugccccagagaagggagaugcuagggggugcggaggggguggggagcacccucuuagaggcaaaaaggagggggauggggugggagguucauggaggggaaaccaggaaggaggacauuugaaauguaaacaaauaaaauaauuacuuuuuagaaagaaagaaagauagauagauagauuagaauuuaaugacagcacucuggaggcagagguagggagaucucugugaguucgaggccagccuaaucuacagagugaguuccaguucagccaggacugcacagagaaacccugucuugaaaaacagggagcuggggguaggggggggggagaauuuuaauagaaagccucccuuuuacaggguauuuuuguuuugaaaaauuagauuucuauguccuguauuauaccaaauuagugggaccuacucaccuagugccuugccuugcuaaaauaucuggguauuaagaacuaauaaaagaauuuagguagaaagcaaaaugggauauggaaaacaauaauauuuguuuagacaguacuacccugguccucaucuggguuucugacugguuuaguauuuauucuagcuuggaguguguauggaugagaaacugguaaauggguucaauaucauagacagaagacaaaaagaguugugacguuccgcugcacggagggugguuagcaagacugagcuguauaauccaaaacugcuccaacaggaccccgggguagugacugagcugacagugagugaccagacagcacugagcugaucgucucccaguuucagugucucaacacaccaacaucacccugugcuccagagccacacaccaaacaaaagccacacccaaacacgagcagcugugcuaccacaucaggccuaagaaaugaccuuacacacaugcuccacuaacaugaagucuuagggacaaauacaacagagaaacguacccaaagcagugacauggaguacaaacuguggcccugucuuggguuaucaaaaucagguuuccagccuccaucagugugaaugaagccuucugaaaugccuaaagugacaucaacuuuuucuucaacucaccuucacaaguguuaacugcuuaccacuaaguucaaacacaaagcaugacuccgugaagcacugcgcuuucaccguguacaggugaaagcuuuugaaaacaauggaccuaacuugaacacacacaccugcccacugcccacacaaucugacccaaauagcucugugaagaaauuacucugcacauuuuuggggugucaaacuaauguucuauuuuaaauauuuuauccaacuugcugaccugcauuucugacacaaucagcugaaggcaugacagucucacguauuuauacugcauucacuccucaacaggagucaaaacagucccaaggaaaacaucgagaaaacaacccugaaacugacgucacuccacagugccaaguaugugccguucucagcugagccugccacauacacugagggucaaaugagcagcaaggccugccaccccccaagcagaacuucuacacuggcaccaagggaugcuuucugcaacaaggcaggggaggaaguaaagguaacugcaggaaacucuucuugggacaaagcugaagagagaauugagcacccugacaccaauuugaggcuugacagcaacucugugcuaugaugccaaaggcagcuacaaaguacgucacucaacaaacaguacuugcuuuucaguuaagcucuacaguugcgagaaaaugccaacuacucuuaagagaugaagaaauaaggaguggaucccuguguccuaucuucaaauguccagccacauaucaaugucuaacagcacaaguuuuccaaacuccacaaggucuucucugcagguguggaggacccaaacgcacugucuacagagaugacagacauguuugaacuaauuuaacuaaacuaagauaaaaaucucaccaaguuuuuugguguacaguuugauuuaaaaacaaaacagaaauaagcuucaacauaaacugcagcaucuucuauuuauaaguagcgcagcaaagccuuugguggcuguccaggcacuggcacacacugacuuggaguauccaauucaaugcacuggucuucccucagucugacugaccgaaucacguuaugcugaagcaaacaccaagcgccuugacacucaccaagccuccucuaugaaauggagggcccagaaauccauuauccaguucucugaacaaaauacagcugagaucucucugauuuuagguuuagacuuaaauucuaugaaucaaauucccccauguauuauugaaaaugagacaauugcacaaaaaucauuaguugaguggaauaauuauaacugauauauaaauaagauuuacuaaaaaaaggcuuucaggaggcaauaguuuaaaucaaaaauuuaaauacaaaagguaucucguguugcuuaacugucuuaaguuucaggugucuguuacucuacuguuacagauuuggcaagauuccguggaaaaucaaccugcagaaaagagaauuguauuagcaaauauaaucauguaauuuagccuagaaaauaacugaaaaacaauaaaggaaaggcgcugacauacauaggagagcuaccuugguccccuaggaagauggcccucauagggaacccuggaaaaacuaccggguaucuugguucccaugacacccagaggauuaagaaugccgcagcccucacugugggagggguccaaacaauaacuugucccacccaaaaaugccaaucaccacccaugaagaaaacagcccugcucccggucaacgaagugaauguuucuauggguaagaaaaaacugauguaagcuacgaacuggcggugaaaagguaacaggagauagcaugaaugggacaggacagauuuuucaagcugggaggggcuagugagacagcccagcaggcaaaggcgcuugcuaccaaaccugaguucaacgcuuaggucaguggaaggauaucugcaauuccugcaaguuguccccugacuccuacccaugaacugugacacacacacacacacacacacacacacacacacacacacacacacacacaaacacacgacagacagacagaugauagauagauggauggauggaggcggucacucacaucguagccucucagcacagccagguggaaagccagcagcugcaggggaaucacacugagaaugcccugcaagcaguccacugaguggggcaccuugauuguccuuuuuguauucuuaauggucucaguauccuccuuaucacagaucacgacuggacgccccugggaagaaaacgauacacaacacagucaccaggaagcagaugcugagcaacaagaggugggcauggcuccacugccugacacacacauguggucugacugcucauuuagacagaagcacagaccgauuuuguggacucgguagauuucuuaaaaaauuuccacaagaaagaaaugccaaguuuaauacuugaauacaggucugcuuccuuugaaguucaaguuuauuucuaguacacugugcuuagggagaaauaucuucuggaauuaaaauauaaaccagcugauggggggagggugucagccacagcauccaugauauuaguguaaaccaaacauuggguuuuuuuguuuuuuuuuuuaaguuaaguucuugggggcuggugagauggcucaguggguaagagcacccgacugcucuuccgaagguccagaguucaaaucccagcaaccacaugguggcucacaaccaucuguaacaagaccugacucccuuuucugaagugucugaagacagcuacaguguacuuacauauaauaauaaauaaaucuuuaaaaaaaaaaaaguuaaguucuuaacaguguuaagguaaaaagaaagagcauuauguuaacugucggaagaaggaauuuggagaugauggccucguuuugguuuaguucuucuauuaugagagaaaugaugacuggguaucaucaaauuauacauagagagcaaagcaaaggaguugacaagugagcguguuuguaauguacugcgccugcucuaucaugcaaguacaaaauccaccugcgccuuagucaccacaccgagaucuccagggcacucacagcacuuggccuaccugccgugcaaccaccugcugaagagcguucuggcacuuggcauaaguguggucucgcaugaugaucaugaugacaggcaucaacuuguccaccaaggccagagggccgugcuugagcucaccagcaaggaugccuuccgaaugcauauaaguaaucuccuugauuuucuaguaugaaaaaacagagaagucuuuagcucacuuuucagaauuccacuuuuaagaaaacauugagccgggcgugguggugcacgccuuuaaucccagcacucgggaggcagaggcagguggauuucugaguucgaggucagccuggucuacagaguuccaggacagccaggacuacacagagaaacccugucucagaaaaaaaaaaaaagaaaaaagaaaaaagaaaacacugcacaaagcaucugagaugguuaggucucccaagauguaguagaggccuacuggucuggguugaaucuguaagaagauucuuaaggcuucagccuaccaaacgcagagcccgcugcucugcaaacauucaucuacuugccuuauuuucauuucaauuucuuaucuaaugaaccuuggucuguugcacguaucuugaauugcuaagcccaaguuaucauggagacauucuucugggccuucacuuuugaguugaguccuauggcucauucucagguaaauaaaccacagcaaacacacacaauucaauuuacgcagucuacaaacacguggggaguuaguaggaugcuuccacagguaagaugcacacaaccaacgcacaccaccaagccugacuauccaaguucaaugcucaggauucaaacaguggaaggagaaaacugacuccuguuuaaguuguucacugauuuccacacaugcgcuguguauaccaccuccugcuccugcgccugcgcgcacacaaacacauacacacaccacacacucacucacuugaauggcaaggcucagugauauagugauuaccuggcucucuguguuaaaucccuagcauuaugggauacauaacaguaaauguuccuugucccucccuaagucacuagagugaaaucaacuguaagugaaacaacguaccagagccccuucaaggcauguagcauaaugguagccccgccccauuaucaggaccgacuucuggugguaaagcuccgucgccagcuucuggauuucaucauccaugcucagcacuuccuuaaucaagucuguuagggcagagaucagagcagucuugaaaaaugagcagugcaccucacagauaagcaaacaacaaaacggccaguuuucuuuucuucugugauaucaguaugaaauucccuuaacacauggaagcaaaaucagaaagaucuuauuaacucugcagcuacaaaguacagcuucaagaugagaacuucaaccacugcccacucucuuacaaaucaagcauauagaaacuaagaucaaaagccuucauuuggacuuuucaggggauggugggccagaagacaccuucuguaacacagucagggaggagucggauuuaaaaagaaaggaaggaagggaagaaggaaaacauggagggaaagagggagggagggagggagccucaaggagccagcaauguaucuccacugguagagugcucaacuaguaugcgcaaguaaccuugggcucaguccucauaacugcauaaaauugggcagaguggagaacaccugugauccaaguacucagaagguagaggcaggaggaucaagaguucaaaguccuccucccuacauacccaguuaaaacucacccugggcuacaacacagacagucucaaaaaucaacaacaaaaccaaacacaaaacaaaaacaaagagagaaagagagagggggagaggggagagaagaagagggagagagagagagagaaugagaauaugaaucacucuucaaaacacaaagaaucagaagagccaccaggcaaaaaaguaaccaaacagaacacagcuccagccccaugacugggagaaaggaagcacaaguuucacccugaggaggggauaagaaagcccuaccuacaggacaaacuacagcccucaaagccucaaccaggcacuggucugcagacagugauuccuccagcagcaaugggguuccaaucugucauucucuaugucucagggggcaguggccagacaccaucuuagaaagaaaccuacuucuuauaacugaacuaaccagggcugcagaaauagccuaucagcuaagagcacuggaugaccuuucaggggacccagguucaauucccagcacccacaugggagcucuugacuaucuaugacuccaguuccagggaaucuaauguucucuucucaccucuacagguucuugcaugcgcaugauacacagauagacaugcaggcaaaacaccucuacccauaaaauaaaguaauuaaauguaaaaacugcacaacucugggccugaguacagagaacaaucauagucaacgcgcugagggugggguggaggugagucucugaccuucaaaacauacaggcagcccggcagugaaguguaugggaaaggcaggaaaggcagacugcucuagguacccgggaggcaagcucacagcuguaaauaacucuagagucgaugggccuuagacagcucuguucacugcuauggaauccagacgcacucacacagugguucucaaccugugagugugccaaaugacccuuuuacaggggucaccuaggacccugaaaaacacagauacuuacauuacgauucuuaacaguagcaaaauuacaauuaugauguagcgacaaaaauaauguuguagucaccaucauucaaggaacuguauauuaaagggucgcaguguuaggaagguugagaaccacugcucuagcaaaacaggaaaagcacaaaagacuccagcucuccaagccaucugaagccggaagaguaaugcagacgcauuugucacaacucuccaucucugacugcacgacgcagucagugguagucaccaacacauggcucugacagagcccaacauggagaaccacagaacagaggacccaggaauagaccacaugguugcagccaccauuucuaacaaaaaaugucaagaaaauacacuaaugaaaaaucaccuuugaagaaaaauuaccuuuucaagaagcacacuaggaaaacugaagauugacaaauauaauuagauccauuauuucucaccaaugugaaauauacuaaagacugucuuggauaugaaacuccgaaaguacuggaguaaaucauauugugaaaauacuucaauacguugccaaaggcaaagacuucuucagaaggacucccacuaguacaggaaaugaccacaagagcugacaagcaggccuucauaaaauuaacuuucugcagcuuugcacgguggagcauggcagcccaugaaguuuacacagggugugauuuuuacuaauuaaaaaaacuucugcacagcaaaaaaaagcaauuagcagggugaagaaacagucuaaaaaacagagucuuugccaacugcaauugguaaguguuuacagucuuaaagcgcucaggcugggaauguggcucaggugggagaaugcucgauuacaugugcaaagccuuggcauacacugggcaugaugacaccacgcuugugaucucagcacucacaagggagaagcaggaaguccagcucaaugucauccucaguuaucuaguuaagucugagggcagccuaggucaugugagacccugucucacaaaaaaaaaaaaaaaagaaaaaaaagaaaggggguacaggggagagauacagagacagaccgacugaccaacggacaggcagacagagaccccuauuguuuucuaugcauacccggcagucgcuucaguccgagcaugaucucuuugcgucucucuugcauggagauccugucaucacacaucaugagagcaaacaucacgagggacacaaacuggcugguguaugccuacaacaccacagaaaacagaaaagugaauuuuaagaacuugaaaacuuuuaacaaaagaugagaauuaaauccuaauucuuucacaauauacacugcucaucuuuucuuaacauuuuaauuacauugguguucugccuccaugucugucugugugagggugucagauucccuagaacuggaaucauagacaauugugaacugucaugugaaugaugggauuugaaccuggguccuuuauaagagcagcuagugcucuuaacaacugagccaucucuccagccccucacuauucaucuuuuacacauaacucuggagauauugaccugacuuaguacuugggaaucuaucucuauuuuuaaucacaaagcacuuaagucuaugucuugggcccacacaaaacacaagugagaccccucacaguccuaagaaaggagaaagaaagccugaaggaaguuucuguuaaucugugcccgccccacagugaaggggagagcaggcuagaaacuguggccgcucccacacauacucuuuaaccuuugccuacuggcugguccucuuuuucacuguuuucuuuuuaagguagggucaccugggcuggauucagaauaaucuucccgccucagccuuguaaacacagaaaguagaggugugagcuaccacacuuggcucauucucacuguguuugaguuucugggaagagggcaccuagggguaagauucaccuaugugcauguggacgcuggaggucaaccuuagguguucaucgggagcaacccacugguuuucuguuguuguugagacaccgucucucacugggacccagggcucacuacuguucucuuuaggaacaugcaggacccaccuauuucuauuuccccagugcugaggugcuugugcuggggcugggaacuccccucagauccucacgcugagugagagccaagaagcacuguccugacagcuacccccaugagcacagguccucacucuuacauuuuaacaaaaacacuaacaaaaagucaauaaaagucuaaauguauguaagucgauaaaaauuaagaaacugccaggugugguggcacacgccuuugaucccagcacuuggaggcagaggcauaggcaggcgaauuucugaguucgaggccagccuggucuacagagugaguuccaggacagccagggcuauacagagaaacccugaauccaaacaaaacaaaacaaaacaaaaacaaaaaacaaaacaaaacaaaaagaaacugcaaaccuacgaugacguauuuguaauuuaugauuuacaugugugugugucaaugguggguguguacaugccagagagcauauauagaggacagggugcagccucuggaaucagcucucuccuucuacuauggggguccaaaggaucaaacuuuggguugucaagcuuggcagcgaauuccuuuacccacuuagcuaccuugcuggucccaguuuuccuuucuuuauauuaaauaugaaaaaaaucuauuuucaauaaaagaaaaaaagagaaaguuaauuacuuagcugaguacgucugcacacaugacgguacagaccgacaaucccaagacuuaggaagcagggccaggaggaugaggaagcuaaacucuccuuaacuacaaguucaaggguagccugagauacauaagauccugucccaaaaaccauccaguuaaaaauaagcguuaggugucagaauuuuauaaugcucuuuuacacauaacaucuaagcaccuuccuuuguuuaguggugucaaagaacuugagccgguuuccugccuacagcaucagauacccuauauguuaaguguucaagaacccaagacaaucuugauaauuagcucagacacagaaaacacccaguacaguuucugauacacagccagaacacugugcucaagagcacuggcagaaacuugcacuggaagauguuucuccuacgaugaauacaaugugaaccuuccggcuuacagacccuguaagccgcuuccucgucagcugaaggugaagggcagaugcuacugcuuugccaugaaagguuuuacuucauuuucguguuuaaacuguuuguuaggcauacugugcugugcacaugguuguucuccagagugcagugugguuucacacucaaucaguaaucuucccugaaccacuccucagugucuacgcuccugccaugcugaggaggcuccuucucagcccacccauuaccugggacccugacaguucugcuggaccccuggcuuucacagccaccaguccccacuguaugcccacagcacccccuugccuccaugcuuaaggacccuguguucuaaggugcacccuucaguaaacagggcaaagcaggccaguaucuuggucuccuuagauaaaagcuguuccaaauccaaucugaccugauaacaagcgcucagccuagcucccccacacuaccacugaguguguauccagccgccauauuccaugucgucaguacauaacgagaaacucauuaugauaaacacaagcuacaccucacacuuacagucugagaucugaaaaaauuuacccagaaaauguuaacugaacuuuucaacuugauuuucuuuuuauucagccaaagacaaaauuacuugaaacacauagggggcgggggagggaagaaaaaaaaaaaaaacacuaacuaagucagcagugugguaaaaacuuaaacaucugcaauaacaaaaacugcaaauucugcacauuuccuaaggaaacaccaaauuauccauggucugaugcuaugaaagccagugccagccguaagccaaccacugcugccggcagagggggggacuuguaugcaggcucauuacugagccggugaugggagcacugagcaacuucugugauuacuuagaacauagaaacucacauucaccauucagaaauaaucugaauguaaagcuuauuuacaaaacccuaugccaagaauaucuaagacagcugaaaauaaaacuaauuugaaaucuaagaaaaaugaagcuguauuauauugccauacuucuuuaaaauuuuuuacauuuauuuauuuagaggguauuugggguacaauagucccuacauguguggaggucagaagacaacuuauaggcaguugguucuccccuuccccuacacggguucuggggagcaaacucaagacuaucaggcuugaugauguugguaguagguaucuuuuccugcugagacccuugccaauacucacuaaaacugagucacuuuaaaaagaaaucacuaagaagaugcuugcuugcuuccuuauaagacggaagcacugggaagcuaagugaugcauacaagagacuucacugcacuggggcuaggagcagguaccaguccauguuagagacaccccuggaaggucguaggaccuccuccuuuuaguaagagcuggucuaaugagggguccuuuggucaccuuggaaacugucugggaaggaucuugugggaccucugacucucagaucaucucugcucucuucauucuccucaccauggaaugagagucuagccggagcaaaaaaccaugaggcuaucuaacuucgaccugacccucccgagcuaugaacucacagaaaccucacucccucagaauuagcugucucaaguauuuuguuauuauaaugugaagcugacuaaugcagcuuugcaacuuccuauagaucuuuguuucaauuuaaaaaagaaaaaguaaaaggauuugcuuucaaagaaagaccugcugaaacuaauaacaacaugaacagcuucaaaggugucacacucgaugaacgccaguuacaaagcacaaguaucauaaaacucccauucaugagaacuaucuggaaaacgacaguacuuuaguaagaaaaaguaguaguuaugagcaugcggguggagguuugagugagcacagaggugagcccagucuccuagaacugugugugcccacagcugcacaaccgaguaagucacacaugacagugcaaagcuguagaaaagacuaaggguggguguuaaggucacuguaaccacuccaugcaugcgaaccuucauaguaaaacgagggaaggaaauuagagcucucguaagugaaagacuuacucccuugcaacuccucguccuguacggccacaccauguggaagugcagugguucacaacaugcucuggaugaggagccuguguucccacacugcaccagggcugucucaacacagcugcaaagagcuagcuaugcauucaccaaggaugaagucacaucuuaugaugugaagaaaaucuacauuucagcuauguggaaaguauaguaauaccaaggcucucaaaacaaaaaacucaaaaauuuuuaacaagaauuauauauuuuccuacaaaaaguuuuccauaagacuuuauagauuaaagccuaaaccacugacaaauaucuuauuagagaaucaacaaaaaauguuaagcuuaagcagaaaaaaaacuaaacuuucaaaauuauaaaaagcaacauauuuguggagaguaaucuuuuauaucaauacagcuugcaaagaguuggauauuucuuacauuuauucauaucucaacuucaaagagcaaagcagacuuauacaccuuuaaaacaaaaguauuuuuaagcuucuacagaugcacuaucuaaacagaaacagauguauaaguuuuaaugcuggccuggagagauggcucagcacugguuacucuuacagagguccugaggucaauucccagcaaccacaugguggcucacaaccaucuguaaugugaucuuaugcccucuucugcugugucugaggacagugaagguguauucauauacauaaauaaguuuuauuuauuugacuguguggggaagggagagacgggcauugugaguaagcaugcauguauccacacaugagcugugagugcacacacauguaugcacacauuaacugugagugcacauacauguauccgugcagaugcacaggagagcaggccaucggguguccugcucuaucaaucucugucguguucccuaagacacagucacucacugaaccuggagcuaaguugaugacuaacaagccccagggauuccuccugcucuccucccuaagagaagagaguacaguaacugccccacagaucagagucucuuaccaacaguaugguuaaguaacuuccauggaagaaaccaaaaauuuaccuuuguacuggccacgccaaucucaggaccagcauuaauaugaaccccgcaaucugucucccuugauauagaacugccgacuguauuugugauccccacaguuaaggcuccucucuccuuacaguaacgaagucccaucagggugucagcugucucgccuguguaaaauggacaacaguaacagagagcaguuucagaggaugcaguuucauacacgaaaaaccaaccgacugccaugcuuuuaauacuaucacuuguuuuaaauaaagcauaaggcaugcucuuauuaaacuuauaagacauagccaggcauggggcacacaccuuaaauccuagggcuuggguugaagaggcaggcauaucacugaguuggaagccagccuggucuaccuagcuaaguucaggccagccaaggcuacauagugauacccugucucaaacaacaacaaaaccuaggauuucuaggaucaguuuuuguuucuuaucugaaaauuaaacucuauaagcuauauguaaaaaaagauguucauuuuuacuaagucuuaaagaauguauuaguacaagcgaagacaaucgguauuuaccaggccaucugaaaugccaguuuaagugucaggguuuuuuggguuuuuugguuuuuuuuuguuuuguuuuuuucaagacaggguuucucuguguaguccuggcuguccuggaacucacucuguagaccaggcuggccucaaacucagaaaucugccugccugggauuaaaggugugagccaccacacccugcuaagugucaguuuaaaagauaggguuggcuuauuaggaaacuugacuuaaaauaacuuuuuccccuucaaguuuaaaaugaacacaccugauugacuaaugaaaaagcaaacaucaucucgaaagacuggaguguuucuauccaagaagucacuggcaagcuccaccaucacgggcagcucggucagcuccuccaggaccugacgggucuacagggaaaagaacacacucugccuuaggacauccuuuuucacugaacuucuuuggucuccacuuuucuaauuacaaagugagcacacagacgagaggguagcuccguggugagcacuggccuagcucacuuaaggcccuaggccccaccacagcacugccacagaaaaacaaggcauacauuuggaaaccacuaagaaacacaaauuaaagaaaaaaauuaaugcauucaccacccuacuacuaagagauacgcacugcuaacuuucagugcaacucuuugagaaaaacuaccaauguggaugcucuauuuuguuuaacacuagacugaucuggaacucaguacagagccagcugaccucagaucugcaguaagugccugucccagccuccugagugcugggauugcaggugucagccauaauucuaagcucuaugaaaacaugcuuauaagcaaauauauccacaaauaugaaacauuugagcagaaaaagcacuguucugagucaacuuguguaucacuaauucucuaauucuaaacauauaaaauuaaaguuaaauuguaauaauguacauacucagugaaauuuaaaaauguacuauauguauaaauaauacuauuucaaaaaugugaauacauuuaagaaguucuguuuagggcagcuccuuguugucaacuuuggagcaauggagcauggugugaaagaggaagcaacacgcuuguguucaaagggaauucccaagccuuuuacuaagucgcauucucacuaaguuccuuuuauucuaaaggucagaaaauuacaaacaacagaaagcaaaccuucaggcaccagucuuuuuucagcccuacagauguacaggcacaugguggaacuuuagugcugauaacagacauuuucuuccugucagcagcagccuuucaccuguuccucaggccagccagcccugcccugccugucacuagcccccuccuuuauagcacauuccuccucuacagcaacaaaaccacaaaggcuggagcaagagagcagcugcagaggacugaguuugucucccaacaccugugacugagggcucacaaccaugcauucuccagcuccaaggaacccuacacgcucacacacacacacacacacacacacacacacacacacacacacacacacacacacagcaaaagagaguuaagagugggagggaagaaagagagagagagagaaagggggaacacacacacacacacagcaaaagagaguuaagagugggagggaagaaagagagagagagaaagggggaaauuuaaaccaaaaaccccugcaaaguugucuguauuccacagcucuuacacuuuugcuugcccacaaacagaauuguucuucuguguuuggucccacaaugauucuaguuuaguaguuuuuaagcaauaugacagcaacauaaaugccaaguauuugaaaauuaaauguuccaauuuuuaauuacuuuucuguuggucuaauuuauuuguaacuauuucuaagucaguuacugacacuagcaagcuagaugucuuccuucaaauaaaugaaaauaaaaaaauuucccccuagauuacaaaugcauuauauuggcauuuaucuucaaacaaacaaaccuaacaaccuaccagauauuuaaaaauaauguaacccaaaaguaucucauacuaauguguugaugagaaauacuuuacaaauaguuaaauauuuucauccuaaccuaaaaagauaacuauuuaugcugcaaaugccauucuaugacccgaaagcccacgaggcaguuaaacucuggaaagcgugcugguuucagaccaacuugagcguaggcaguuguuacuaaucggguacagacacacugaaagaagacaugugccugucacucgcucuugacuauaucaugaaaguaaacauucagucuaggaugaguagaauaaacagcacuauuucauaggcuacucacaagagauuucuuacgugcuuucauuaauuuuggcacauagaucccuuaugaaaucucucccuuagagaagacaaaugauucagagaauucuaacauagcaauauuuuauacucaaauugaggaucagagcugaaugcagcaggaaucaaaugcuuucuucugaguaggaaaccuggucacaaauggacguuacagaguugaccucauccacaccuuccuuaagcucucacuagcgucuuuaacuuacucucucuucacgcuuaugaaaugccgccuucucagaccaagaaguguuuggggagaggaucucuggaaaagcacagcuugcugacaugugaagcugguaaccagauauuucacacauucaauaaaugauuggugugguggcccucgccuacagaggcaaggggaugugauucccaggccauccuggucuacaaagugaauuccaggucacccaggacagccaggguuacacagagaaacccuuagggaaaaaaagcucucgggguaaaaaauaaauauuuuguguugcagcaaauaaaaaauuauuaucaucaacuuuggaaauugaucuuaaaguaagagaccuacacaggccaggguuuaaccugccuccuuauaaaguaacuacagcuaaugcaauuuauuaagaggccaacaugucccaguuucuuuacugacaaccaacguaagucccuuucacagauuucagcuuuuagagguuacuagaauaggacugacaugcagauauccugauuucaacccaacagaacugaaaugugaaggggccacuuacugccacaccagcgugguaacuugugccacaagcaauaagaaucaaccgccgacaccgcuggaucuccuuaaugugaucuuucaaaccucccaaauucacugaaauagaaauguguguauauaauuacuuaggaaagaucaauauaaaacagggaaucacuuuucaucagucuccauugucgaugugaaaaauuaauaauacuguuuuaaguaauucauauuccuuuuuggaacuggacccucccccaucugcacucaccucacccacccaccaaggcguacagacaggcaugggcucuacuuugagucacuuuucauuccucucucuacauuaaagacgaccucaaaggaaaauuauggggacagaagcagcgggucaguaggcacugaaagcuggaucuggagagaggaugacaagagggcauaaggaaguuucccgaaugaggaucuguugugugucaugccucuguugaagauaagauuauggcuguuacagaggucuaucaaacccagaaucuuaucaggaagcugagacaacagagucacugacacucggaguucaagauaaaguaaccugggcaacacagcaagauccugucucagaaaaaaauuauaacagaauguuacauuuagaaugaugaauuuggggcuggagagauggcucaguggucuagaggacuugcugcucuugcacaggauacaaauaaguucaguccccaguccccacacagcaguucacaagcaucuguaacuccagucccagacaaucuaacaccuuuuucaggcacaggcaugcacauggugcacauaccuacauacaggcaaaacacucacucaaaauaaaaauaaggaagccuuuuugaaaaauaauguucuuaaaaugaugaauguguguaggcgagaugacuuagcaaguaaaggcggccaacccugauggccucacuuuacccaggacccacacggcaaaggagagaaacaacuccggcaagcugugcucugaccucucccuauauacuaucacacauauauauguaauguguacuaucacauauguacccacacacauacacaaaacaaccaauggaagaagauaaaugauaaaguaaggcugggaagauaggcuaacccauaaaugcuugucacacacgcaugaguuugacccccggaacccauuuaaaaggcugaggaugauggagagugcuuauaauccuagcucugggaagaguaggcagaaggaucccuggggcucaccgccagccaugccagucuaauccacaaaugccaagucucagugaaagacccuaucuaaaaaaacaaacaaaacaggguggaauaagccugagaaacaacacccaagguuggucucuggcuuccacaucagcacaagcaagcaagcaagugcacauauauauauaaauauaaacacacacacacacacacacaccccucccuaaacacaugaacauaggcagguacaaucaaauauacaaaaugauuguuuucauuaugucuaauaaagcuaccuagaaaauuacauuauguuuauuucuacaaacuccaaacuaugguaaucuauuuuucuaagagcacuucuugucuucaaagagacuaaacuacugccagacccugcagccacauuuacauugugcagagaucguguaggacuaugcauccacccugcuagucuauguauacucagccuguuuaaccaaccugccuuuaagagaacaauguaaccaacucuacuauguguuggauuucccaugcaaucagcuuuacaacuuaggcucaaugcacagccuuacucuuagauuauggacucuuccauggucgaccgagaagaauaaugcauguguacuguagcaaucauugcugagagcagcaaacagguugaaagcaaccuuaaaacaaacaacacauaaauguugggagcaacgugugcacauagcucuaugaccgaaugguguucugagucaguaaaguaacuuuuguuagggauaacacaacaaacagagagaucagacacaacagagaaggaacagggacagacagaucaguccuauaggacagacaugcugccaagaggccacuagccacaauggagaagcagaacucaaacuugagguucuuggucaaacuacuccaagaggaaguuccuguucccauuccuuaaugcaacagugaugcauuuuggucccucaagccaccccucaguccagagagguuuuuuuuaaugugguacugaugugcauagaauccugcaguccuguuuguaugcaagcccucuuuucucucagucuuugccauggcuacugacuuaacaguucaguuccaauguuggccucacuuggacugcugggacaucucuccucugcccaccuacugaaauccauuggaucaucucugaagauggugauggugacaacaauauucucucagcaagugugaagaccuaauuuggaucucuagcacucacauaaaacguugggcacaaugacaggugccuguaaucccagcauuacgaagauggagaccggcaagucccaacauuaggaagguggagcccaaugaccagccagugcagccagucaguaagccccagguucaggagauaaggugaaagguacugagaaaggcaugcgacagugaccucugaccuccacauucacacagacacacuugcucacauguauuagccucccaguccccagacaccaccaaaguagaaaccaaacaaagcaacaacaaaacuugcugcugguuucccaaaugacuuggacuauaaaccacacuauucauguuuuccagguccccugugagcauuuccagguuaacuucugugccugcucuuaaucaaaacacaguguaagaguacaguguuugcacaggucuuggugugcgcuacacuuuaggaaguaugauguguguucuauugguaaaauacugugugcuguuugaauccacugagaaacugccucuggaaaugggguuuuucccacccccccaccccccaccauuucaggcccaagaauguuuguucucuccaaucugaagacagaauagccuucuaaacacugugauaggcacgagaaaaaaacagccuaaggaaagccaugggaacagcuccaaggaaaaacuauuucuaacagauguuacuacuguuuccccauaacaaacaagugugugcagagggaaggaaaagcugaaaaguuagaaccaccucaccaucccaggucuguuucugcucuacccaauuugacaaugcccacucuugauacuccgaagccuccccuuacuugagggaccauuuuacccugacuaaacuccaacugacuggguuacagaagccuucccagucaauuucugcuagacauuuugauauuuuguucugucugucuauccaucauuuucuacugauucuuuuccuuuggcuugccauauacuucagaaacucagccauacaaaaccaaauggauggcuauaagacagaaaaaaaaacaaaaaacaaaaaaacaacgccuggaggcuggggugagucauacuccauauaaaacagacaaauuacaugaggagggcgcaccuuuaaaucaagaggcagcuggagauaugugagucuaaggcuggccuggucuucaaaagugaguuccaggccauuugggacuauauaacacccuaccccuccucccaaaagagcagacagucuaccagagaagguaguauugcagauggagaucaagaacaggcauguuaagacauguuuccuaaacuuagucaagcaaauucccugauggcuuuuaggcuaauucuaggagucccccaaggucugaaaugacuuauguacaaugugugagacccaggcaggccucuugcugcuccugccucagccugccaagcaugucauaaucuggauaaugcuuuagucuaacucugacaacacagccauaacuaagaaauaaauagaaagacugcuuaggaggugggguuccucaggagcgucacugaaggaacacacccaugagugacuggcaaugugaccuuuggcaaacauucagcugacaguucugacguccccgagaacuccuauccuguuuacauuagacaacucauaugcacguaauacacguaagaguuuuaaacacaguagcugucucagcgcugguguaugacucagaaggagacgacacacauagcacaugcaggguccuaguuuuguuccccaggauguggcacagagggauuaagacaacacaguaaccacaggaauaaaggcauaccaugaaguucucaaagucggccucauucucuucgcuuagcaaacaggucuuuuuccugacuuaaguuccacgaauccuuugagcacugugcucuggcccugggucuccucccucacagaucuaugugguccucacggucccacuccuauugcuccugucuccccauucuuccucuuuucacugugcucagacagaucgacaucguacugcuauauauaacccaggcuuucccuucccuggcaccuacagaccagauagcacccagacuuuaaaagcuaaucagcuuccauaacagaggugcccccugagcccaccauccaccuccucaggacaguuccucuccccaacuuuccuaaacugacuuuuauaauucuucaaauccuagaccugagacauacccuaaacuacugagcauaagcauaacagagcauaagccuccucauggcuuucacaccaaugcccucagcuaaugcucuuccaggcagcccaguguucccaucugaccuccacuuacuuacaucuuccaagccuacaccuucuuacaucgcgaggcuuccccucaucccaacaucccuuuccuaaauucaauacuaaacuuuaaacacuuucuagugcuuggaucauauuuuacauuuauuuaaauuguuaauuauauauucauaugauuaaauuauuaagggcaagacuacaucagaaacucugcuauggucuacuccugugacaugaguuggagacuagagucuagucaugcgguaucuguaagcugcuguggugugugcucuagagaccagagcugcucucugacuucugcuuucaacauggagcaaagugcaaacaugaaagaccucugcagaaguucguguuuugcuacuuaugacagaaaccuaggggcuggaaagauggcucaaugguuaagagcacuugcuguucuugcagagaauuuggguucuguuuccagagcacacaugauggcucccaacuauaucaaacuccuguuccaguuccucuucuaaucuccaagagaaucaagcacaaaugugguacacauauuauacagacaggcaggcaaagugcccaaggucugauaaccacagcaagaaccuagugugugacugucaccucguagugggauuaugcacauucacacugugagccccagcccugcuauccaacucuagaacucucccacauacccagugaaaacuaccuaggagaccaugacucuccaccauuccccagcaccuguccccaccagcccacuuucuguccccaaaucugagcugacucaaccaauacacagugcaaucgcacuuugauaccuggcaaucuuagcuguuccacaaaucuauaagaaggacaauaauuugucagguugcuaauggcacucccccaggagacuuaaaugacaaaauauaaaaugucauuaccaguguagucaucaaaauugacucuuccucucauuguguucacaacagauucuggcugcucaaaaauuuccuucugcauaaaugaacuaaaguugccuacaaaaauaaaaauuauauaauuaaaacaacaguaaauaagcuaagcaaucuguacacaaucaacuaccucuucaauauaaacacacuaucucaagguaaucuugagagaugaaacaaaggccaugcaacaagggauuuucauucagacugacuuccuaaaagccuggaugaguauuuccacucuacaugagaaacgaacaaggaagaaagccacuuuauuugcuuaguagcuaaaauucauaguuauaugaauaagggcagaggauaaauuuuugagucaaauuuaaguucaaaugaucaaauuaaccuuuacuaugucaaccgggaaaacuccuuacuuauaaguaagaucaguauuuacuuccuugaaugaacuguaguauggcucauggaacuuugaggacaguagcucuaugauauaaucccuacuacagcacugucagaaaggagaauaaaaacccuaacaguuaacggcaguacacauuauguggggcacacagguaucaggcacuauuuauucuaagagcuuguguagaucagccuucuugauccucaaaccuuagugugauagagucuauuucucccucucaauacaugagaaggcugaagcacagagagauauaacaagaguacugaacagccaugaggcauucguacccuuacaaagcaucuuucaacauuugguacccccuccuucuuacaaaguuaaaaacagaccacgaguuagauucaacaacuauucuaagaccagcaggccguuucucuagagucaucccuuuccagguugaccauccacucaucauguggaagacuccacagcuucaucagccauaacggaaguagaggcuuccuuucuugaagcaucccaaguccuaacaugacaagguacucacccuucaugaucugcuggagcuccaucuggagaguuugcacagcucggccaggauggucuccugcaguucguuuaauucgguggauagagagacggccauccaccacugcugcaacaucaucaucuuccagaaagaugacacgauuggugugcucuaucacggcacuacaaaauggucaaggagauguuaucaauaaccagauagaaugcauggaccaagcucaaacaucaacucucaucuuuuuuuuuuuuuuuuuuuuuuuuaaagauuuauuuauucauuuuauguaaguacacuguagcuguccucagacacuccagaagagggcgucagaucuuauuacagaugguugugagccaccaugugguugcugggacuugaacuccggaccuucggaagagcagucgggugcucuuacccacugagccaucucaccagcccucaacucucaucuuauaccacguguaaugccuucgcuuccuacagggccguauuaaacauguggucacugugaacaaaagagugaaggggcccuuuacauagcaaccuaaccagcagcucaucaaaaggaaaaugcaaggcuauuucugcuuccugccaacucucaccuaagucugccauuuuaaccgcuaaguguuucugaacgcuaccuuccaugucacugccacugcugaguacaagcugucaucagcucuggcuggcuucugcagcaucccuaaguauccacuacuuucucucaccccucuguucucuuuucugcccaagucaacagcaaaaggugaugcaaaucaagagaauuauuucccucacccaacaaaucauuuuucagccuucuucuggcacucaggagaaccucaaacugccaugcacaucccagcaaguguccuugauucucuucaagcugcuugacgcccuuugcgcccuuugcaagcucauagugagugcucaucccauaccuuucaccuaagcaucuccugauccccucagcucagauugagcuucguugucuuaaaaaaagaucugucgggcgugguggcgcacaccuuuaaucccagcacuugggaggcagaggcaggcagauuucugaguucaaggccagccuggucuacagagugaguuccaggacagccagggcuacgcagagaaagccugucucaaaaaaaaaaaaaaaaaaaaaaaaaaacaaaacaaaacaaaaaaaaacaaaaccaaaaaccaaaaacaaaacaaaacaacaaaaaaagaucuacuaacaagggguuaagggagcaugcuauaggaacuguguagcucuugucacaguaggaacuccacauagaugcuuuaaaaugugucuccccuacuauggcaguccaaguaguacuuuuauuguaccauucuccugagacuagcauaugguguuguaggauguuugauaacacugugaaccucaagauugugguauuuacugaaagaaacuguuuccaguuguaauguggcucagcccucaacacacgccuuuaauccuuccagcuggaauacagacaugcccuuacuacaaaccuuuaaucccaaacaaugaaaguaaaguuaguuuguagagggaagcaugcauguuugaaagugaugucuaauugagaggcagacaaagcgacaaaucagagaaagauuugacagacuaggauauacucaauucucaggagaagagagagaaaugggaagcuacuuaagacagcagugcagagaaggguggggcugggggaggggucaguuuucccagaacaguucuauagagacaaguuguagagagaacaagcuagacccaggugaagacagaacaagucagagaaugagaagaagccagaagaucaaaauagacugccaaagugaguaaguugccaagcagagcaaugcaggaagccaagauagaaggcagauugaaucagucagcuugaagagugugaggcagaauaagugaguuaaaccagccagccagagaucugaaagaauuacuaagacgggugagccagucccagagguggaaaacaaucuaggucuagauuagauuguacagaagcuuccaggacaaggucuagguuagcacacugaggcaguaagccuuggagacaacaauuauuauagaagaauaaaauuacuuuuauaauauggcucugcuaauaagcauguaagaaugaauauuaauauucuucagcaauuccgagucugagccuugacuaucaacucuguaauaaacccgcuuacugacagcaaagacaaauuugaaaaaucuagaagacaguaaaguuuguuucucagauaauacauucccugaaguacuaagcaguaucauucucauuuccucucauguccagucucugcagacaaugggugguucuauuuuauccccacuccuacaguauuggaauuaccaaugccuguaaauagucugcuuucuuuuacauuuucagucuuccuuuguucaagaauuaugcuguaaguuaacuugaaauguaaaggcuaaaugcccaaaacuuuaaaugcuggaaaagcaaccccuccucccuacaauacuuggguacaccucccagaaacaaaacaaaacaaacaaacagacaaaagcuccagaguaaaggcauuaggucucuaagaauacacacguaaagugaccaucaugcucugaaguaggaggaaaguguuuauuguccuaugccucacaagaugagcacaacugucucaacuaaagaguucugcagcugaggcgccaugcaguggcaagcugcuugcuugcuuagcauuccaaagucaguucuauucucagcacuuagauuuuugcaagauacagucaugguuuggagaaguuuuccugaaaauucucuugacucauugaaggcaacucaccuugcaucagaagcaaaguaauauucaacugccuuuuccucaacagggaacaggcaugucgugcuguccacacgggaaagaccgcagcuuccuuucuugucuuugccuagagcacagagguuaaguacaauuagcaagcacagaaaaucaugcuacaguuuagaaacaggcacaacuguucauaaagucaacaacaaaaaagcugagcagccaaaaaacucagcaguucucagugagguggcucacugggcuccaugcacuaagcaagugagaacagacagagagggcagagacacagcacccgcaaagccuucauggcagacaacagugcugcacuguaaacuccauaaagucauuucuuuucaaccagaaauccaaaauuguauuaauaauaacuuuaaaacucuaggggcugcagggcuagagaacacgcacugcuacugcaagaggacccaagcuggguucucagcauccacgcgguggcucacaucuaucuguaauucugggcucagacucccucuucugccuccuggguaccagguacucucaugaugcacauaaauacaugcaggcaaaacagucauacauaagacuuuuaaauuaaaaaaaaacaauauugugcaaugaaaaaauaaagacaaaaagacaggcuaguggcaaauuauuuuuuuaaaauaagaaaaaaaaaaccugucuagauuuuuuaacagcaagucagcccagcaaaucaggccuagaauauucauuaaaaucaaagcaaagggagaugaugagauggcucacuggguaaagacuagccauuaagcaugaagaccugaguucaagcccaggucucacaugaugcuugugguguguagacauauacauauauauaagcaaacacucauacauaaaauaaucucaaaaaauuuuuaaauaaauccuuuuuaaaaaaccauacugaauuguuucuaaagagaguaaagucauauguguaucccucuaauccuaguacucuagauguugaggcaggaaaaucaacaucucagcuauauaguaagacuuugucucaacacacaaaaucuaaauugaacagcaaguggaagugaagcccagaacaacauuuaaaauuacaaccugcuuugucucuaaaauguccuaaggcugagcaucacuccaaauucuugugagcucauuguuaagagaagcauccccaauugaaauauguaaaagaaacugagaugucacugacuguaaaugucuauaaaauucuuuuucauauggaaauucucucccucaaaugaaaccauuuuccagugggaauagguggcuuuaagaugaagacaaugacaaaagccugaaagucgguccacagcucucucuacagcccucccaccaagccugaucucuugucgugacagcauggcacugggcuccacaccaucugucuacuagaacuagagaaacacagcuauccagggucauccccuaggaaaaauguuucuuccaauuuuugaagcccucaccuaaguuuuuuguuuguuuguuuguuuguuuguuuguuuguuuguuuguuugagauagaguuucucuguguagcccuggcuguccuggaacucacucuguauaacaggcuggccuugaacucagaaauccaccugccucugccucccaaaugcugggauuaaagucguacuccaccaccgcccagacuaacacagccgaugagauggcacucauaguacagaggcagugcagaugcaggagccuggagcuguggacccagacucggcucucacugugggacuggucuuuuuuggggaacagugggagagaagugagacagcggagaaaggagcacugacaggcacagaaggcugguuaaagaaacaaggcucuucucaaguacaacacaaaacccagagccauccgaagaugagcaggcucggcauucuuuugguaacuguuauucuacaaaccaaaaacuacauauuaaucauuacgguuucacuucucugaagccagcguuccccuaccuuucacauggaaagcccucagcaguuaguagacagguacacuguuguucccucuguguguaagucacuaaaaugguucagaguuuguguaaaggcagaccaggugugggagcacacugcagcacucgggaggcacagucaaagcuaugagcuaaagguuaaccuaggcuacauagagugugugaguuagugcaggcuauacaagauccuguuucaaccuccucucaaaaaacagaaagaaguaaagaaccugguacuacagagauggcuaagaggauuuccuguucuuucagaagacugagguuugguucccugaacccggaucaggcagcucagaaacaccuaugacuccagccccaggggaucugaugccucuggccucccaaguuaccuucacucucauccacacacccacaugcagacacacaugccuauauauaauaaaaauaaauaaaaauuaaaaauaaaucuuaaaaaaaaaaaaaaacaaccagccuaggggcugggggcuggggauacaggccagugguagaauacuggccuagcauauauauggcucuggguuugaaugccaccccaggaccaauaaauaaugauaaacccucaaacauaaaaaauaaaguauggcugcaaauuaaauaaaaucaauuauaauaucaauguaaauauaacaauaaaaugucacgcacuaaauaaagaccauuuaaaucuaguucagucaagagugaggcuaagucucaggaaauggcugcauacuucacuguuccuuucccaauauaagcaugcaucuauaucauuuuaaauaaaacaggaaagagaaaaaaaaagccuuuauuugaaauauuccucaaaccuccccuuuugcaaaacaguuauuaaauaaugcaacuuucgaaauggcaaaagcaaacagacaagauguauucugcaaauuagaaaagugccaaaacauuuccccauaaaguaagcacauuuuuagagccucuguucauuucaaaaacaaagaauuaguaaaugaaggaagcaggagaaacccuuccauccgugcagagugcauucccaccucguucugccugugauccccaccauguggauccaaucugaguccuagcuaaggauguacaacagagaaaaauucucucgucaguguucacaacaagcuuuuucuguccagacagaacuauguaguugucugcacaguacacacagauccgaccggagaacauucacugcagcauauggagcagcgucucagagcucccgcaccacacuuacaacgugaugcagcaacuuaccuguucuguacagaaucggaaugugaucuguagaaagcuuauguucacuccgcacaccaaucaagagagggcuaccucgccugaaaugcaacgagucagaaucaacccuucuccauaaauaaugcacuaacaauacacauuuuaaguaugaauucaaaauucauuuuaauuugaaauuuaaugcucuucaaaugauuuaauuuccccucugaauugaacuacaaaauaacuauauuagaaaacugaguucccaggccacaccugccuacuucuaauaaacaauuuucaacuggcaaauuacuauugcauuaaaaucucacugagacagugaagcccuuccucugcggcugcuuucauucaagccugacaguggcucugagugcuggcagggaggccaugugucccaacacacucaaauauuuccugucugaccgacuccacuaacucauaucuucuaacacuguauuuuaaacuguucuuuuaaugugaagaacuuuucauuguacacagacaccaacacauccuuaggcauccuguuuccgauuaaagaugaccuucuguuuucagaucauaaagguucuucuuuuuuuuuuaagauuuauuuauuuauuauguauagugcucugcuugcauguaugacugcaggccagaagagggcaccagaucucauuauagaugguuuugagccuaugugugguugcugggauuugaacucaggaccucuggaagggcagccagugcuauuaaccucugagcuaucucuccagccccccagaucuuaaauguucuuacuguccuaagaauuucaugaucauuucuaaacauccuagcaaaaccagugguucuacaauuccuucggaaucugucugacacgcauuuccaaaaaauauggagaagguuaaugcuuuggguauaaaauuuaaaaauauuccauauccaaauucauaaagagccaccgugcucaccaaagacaaaucacaaugccaaaauguguucucuuuccuaagagacucuguuaaaagagagaaggaaccgagaauaaaaauagaccucuacggaaacggugaagggccacccacagguuacugagaaguacccuguaaccugaauguuucaacacgcaugucagcguuaguccuuaaaagaaaaccuauuguaccuugugccaacugcuugcccgggaaaauggacacuuuuaaacacaagagcaaaggcgccuuccuaugggggaaagaagcgucaguaguauucucguuagcgauucucaaacaaagcauuucggacauacaacauucugcucagacacuucuguucacgcuuguguacuuugaguuaguuuuuaacaagucuccauuuuagaugccgcagcaagaucucccuaauauccaagcccgcaucuuagguagacacugacucgagcucugaugugagcaaacucugaccaccaagcucccguuccaauacucaaugaaaaagcggagagucaccugugugccuagcauguuucucaacagacacaucucucucagacuacuugucuguucaggaaggaagagccaacagaaagucaagcuccacauccaaaacccaucacacccacuaccacuaccuccaccuucuacccucagucuuggacuugacaacuauauacaaccauaguuauuaaaaugagguggagagauggcucccuguuaacaccugccucugcacguguguacacagguucacgcauguaggcacacuggagcaccacccaccccauacacacauaccaacaaaaaaaaaaaaaaaaaacccaacauacauguagauguuagagggcaacaguucugcaguuggcucucuccucugugaauuccgaagagcaaacucagguugccagccuugcacagcaauuugucuacugagccauuuugucaccaacacuuacuuacuuuuuacccucuaacuacagugaaauaguuagaauauagcuauuguaaaauaaauggaaugguaaauccagggaaaacaaguuacuaagucaaaaaacaguuuuacaaaauucccugcauugaauuguguuugugcauaugugugugucuaugugcgccugggaauguguaauaaaagccuaaaaaagcacucaggagaccagcacagggcuggggagauggcucuguuggaaaaaugcuacccacagagcaugaguucugaccccuuguacucacaugaaagauuagcaacaacaguuuuaagauacccaaugccagucuccugccuucacucacacacacacacacacacauugacaauaaaauaucucacaaauauagcugucuaauguuagacuccuaugaguuaaaaaaaaaacccagcauaguuccuguucaucaaacauuuuuaaaaagcuacuugaaaacaauauuagcauaauuacuuuuucuugcaugugugagugugcuagucacguuuauuaguaugugugugggcauacauggcugugguuauaaauggagguguguaggcacaugugugaguauggguagaagacagagguuugagcuagcugucuccuuccacuguucucugccguacauaccaagguagggucucucacuugaacccacaauuugcugccucacuaauguagccaaccagacagcucgcugcaaaauccaggcccaccaccuccugggagcuggaacugcaaagaggcuaccauagccacccagcacuuaugugggugcuggggaccugaacuccaguccucacacuugcauugcaagugcuuuccugaugaguuauuuccccaguuaguccuaacacaauaaucuuuaagaguaugguuuaauaccaauuguuggauaacucucuccaccaaggugguaaaacugacguccuggcucucccaguugucauacauguacuugacgagcuuggcaaugguuucugugucuguuucagauucaaagucauagccuuugcuuuccuacaaggagagaaaagggaaaaaaggcacacuuaaauauauacaauguuaaauuuuuuuaauuuuauggucccuuuuuauucacuuuaaaaaaacaacauuaucuuuuuucuuucuauuguaugcauuuauguaugucugugcaugaauaugacuggugcccucagcucagaaggaggcaucagauccccugaaaggcgaguuacagacaguuguuuuccauccugugggugaugggaauuagucuucugaagagcaaugcguuuucuaaaccacugggccagcucuccagcccccaggcagcaaauauuuucuaggauuuuuuuuucucaaaaaccaaaugccuuucuaauugugugcacacauauaugcguguguaggucuguaaguacaggcuaaaugugucaccauggugugugcuugaggguuagaggaccaccaugaggcaucaucagcuuuagcuguccaccuuucuguggguuucagggaacaaacucaccgcuguccgcuggcaaccgcuuuacccacugagucaccucaucaaccuaauagaucuuacuaauuacuaacuuuuuuugaugucauacugaauuuauucuacucaaaauuuaaauuaccuaaaaauuaauuuauaauggcaaauuuaauaaauaagaaucaauuaauauaguuaauaaaauaauuaaaauuaauuuuaaucaaaauuaaaaucugauuguagagaauucaaaauacaacucaaaaggcuuaacuuagauuugccgcauaugaauuaaacuguaaugaaaauauaguaggauauauaauauucaaaauacuaauuucaugagcaacaguuauuuggugauccucaacuguccaaugaagauccauuagcuaugcaugguuauuuacacuaaaacuuaaaacccaguuucucugucggagcaguucagcgguccuauaggcacagcucccacaaugcuagauacagagaguucucaucacugcagaaacucaacagacgacacugagauggcccugucacacuacagaauaaagcuuguccucaaaaugccauguaaggaaucagaacugugggguuggagauggcucagcacuugggagcacugacugcucuuccagaggacugggauucgauucccagcaaccacauggcggcucacaacagucuguaaccccaauuucugacacccuaacacacgugcauuuaggcaggacaccaaugcacauaaaauaaaaauaaaauaaauuauuaaaaaaagagaaaucaauucuguuccacugucagcagagaaaugcaaugaaacgccacacccuggagauaauuaugguaauuacuugaacauguccgcauaacgcugcacaccccaacaaacuaccucccacucucagaagacggcgucuuccagggucaccucgcuuaccagaaacuuuuucaagucuuuguaguuggugaugauuccauuaugaauaacaaugaauucuagaggagauaaaaguauugaccgaauauuagagucugguaaaugcuaugaagagcuaucauuacgcauaggcuucccgcuguguuuccccuccgguuguugucuuagugguugcccugggguuugaacccaggaccccuccaugcgaggcaagcacucucccagcccuccuuucuugagacaagguuuuacuauguagcccaggccagcuuugaccuaguggucauccugucaucucugucacccaccacaccuauacaaaucuauaaauggauucuucuccagggaaaaaguaaguaaucugcuaguggucuccucggcgucagcaggcgcuccccagcacuguuucugagcugaugcgcacagcguuagugagcguguacaugaggaaacacaccaguucugacuucugcuccacuaagcuacuacccucgcacugggggaugaaaggagcaagucuccugugccugucuccucacuuguagagcacuacucuacuuggacacucaggucucuauuuauucuugguugaguuuaaacauaaguccuuuccaacuacaacaaucccagugacacuaaauaaagcuugggaacuaaugccuacauauuuaccagcgucuauaaauugauuuggggaagguccagaucauuccuggaaugucacaugaaaaugucaaaguagcauuccaagagcaaauaaauauaauccugagagaucgauuucaucuauuuuuauuaaaugaugauugaaaaaaauguuaaaaauagauuaccaagaguucacaguauuacauguagucaugacaguauacaguguagcuuuaaauucauauaucaaaagaauaauuaugacuggguauggugacacauaccuuuaacagcacucagaaggcagagguaggaggauuucuaugagcugaaggccagcuugguuuacauagugaguuccaggccagccagggcuacacagugagacccugucacaacaccagagaauaacuauuauauuacuaacuacaaugguucuguggcccuaacaggccugaccuccuagacuaagcccucuucgguacaaggcaaaggccagucaggccuacagaguaagacugcuuuaaacaaacaaauauaacaggaguagauguaacuagcaauacaaaaccaacaggaaacuuacaaauaacacacuaaauugcaagaaaaaaaggacauaaaaagauugacauauugaagaguugccaauuuuuauuauuggaauuccaaaauaaccuaggaaugggauuaaguucuguacacugucugaauauguuuugaaauuuccagaugaacagcaaauuaaaguaacaacauaagcaccuggauuccccucccaacacugcccacuaaaaucaguucaaagcacacgcaaucuacuccuaccauuauuuuuaucagagcgcugggggugacuauugacaggauuggguucuccaugugucgcccaacggguaugagcuauuccaagaugcacaucaaauucuauauccaaguccauaucuuguuguucuguaggagauaaaguuuaagacuccaguauuugauaaugcuguagauauaaauucuauuaaagaaaacuauaccagccccccuuaccacaagguuuguguuucaagauacuccguggacaccugaaacuccaauggcacugagcucugcacauagcgggauuuccuacagugucacuguuuccauuugaauaaaccacacacacacacacacacacacacacacacacacacacacgugucuucagcuggaggcacgauagcagaacuagcaccaaucuguuuuuucuucucaauuuuagacggcagauccacccuuaccguaccucuuagcaaagugagcauuugguuuuccuucuuuccauuuuaaguaagaacgccccccccucccccuucacgcuucucuggcaagucggcaagccagcaucagcaucuugcauuuggggucauuaucaagcaaaguaaaagccaugccaaguggagacacaugagcaggccuccuaugccagagccguccucaggaggggcuacugaagccucugcacugugggguaugugcuugcuccaaacccgcugaaccuaguuucuuuucuaauugcuaugaucguauuuugaagcucaggaacaauuuaaacccaagcaguaagaaaauuacuuuuauuccuucucuucaaccuuuaagucuuccucaaccgugucccaaaaagggggagagugggaaagaaucaaacuaagcacauuacugugaacuucuucauccagugccuuaacuuuuccuuucuucuuaaugagcuggauuuugcaggcguuggcuucccagucuuugucauugccuccgucaagucccacaccuaaauuagcaagaggcagguagaaaagcaagacuuagaaacuggcuaacaauaccaauaugagaaaaagguaauaauaauuuagguaaauuauacauucaucuaauuaacucauuuaccaagugaauuuucugaaaaccuacuauguguuaagugacagcugggaacauagcugagcagugaaaagcuuauuuagcaugcacagggccuuguguucaaacucagcaucagaaaagaggguuugagaaggaaggucaggagagaggugaggagcacucaaucccugucuaacagucuuuagagaaaacagacagaggaagaauaauggugaucgaaugauuacuuggacaagcaaccgcuacauaaauugagauaaagugucauaggcauagcggagacgugcaaaguggggugcucgccucggaaggaguaggcaccgucaggaaggcaucuucugagacuuaaguuacuaagaacuugaaaagcuuacuuggaccgugaaggucauuuccaacaaaaguaacguggcaaggacagcuagcaaaugcucugaaauggcagagaggagaggauggguuggugagggagaaagaggacauuacagcugaaacaaagcaaaaauguagaaggccugauuugcacagacaagcgagagacacagaagggcccgaugggacgugagaaggcagcagccgagguucccuccuggguucaaggaaguguggcacgauugcugauggacggaacgcagaacagaaugaggucugcagugaggaccacagugcguucaguucagcuaugaaccagccaagugcacugcacuguggucuacccgggaagguauuucuagaaggcagcuggaaacacaggucugcaacuugcucauaccgauuagauauucaaaucaagugucauagcacauaccugaaguccuagcacuccaaagacugaggcaggaggaugguaagcugagaccagcagggucuacaaagacugucucaaaaacuuuaagcaaacaaaauacauggacuguaaauuacaauguagaggugaugaagucaucucaccaugaaaauacaaagacaagugagcuaagcaaacaaccucugugggugaaacgggggguucaugccagucaucucagcacuaggaagaaaacgucuacccaagcuauacaacaagaccuaagcucaaauaaauaauaaaaagugaaaaaaaaaaucuuacagaacauuccuauuuaagcaacagacaaaagaaaagccuccaaggcugacagcaaaccucaucaucacccaggagaagcuacuauguuaggaaagccaaaaacggagaacugaaacaccaaagaaacagggcugggaacugcccagcaccccuugcaugugcaaccuuggcuuccauucccauaccuaccaaaacaggaaugagaaacugacaggauaucccugugggaucuuagauuucagggggauuccaagucccugaaaggcucccgugccuacguuccucuggauggacugcugugugugugugugugucuggcucugagucaucuggaguuuaccuaguagacaacauuccugugugcuaucacaaccugcugcuagggacaugaagugcauccugguagagcaggcuucuuggaagcugcugccugcuuuccugcagacuucaucccacacccgcuccuuuucccgauuucgcccuugauucuucugcuguagugaaucacagagcuaugaauguaacucuugccgaggcgcaugagucgcuaggaaccacugaaagugagcuucuggugggcccaagacagggagccagagucaaacagacucugccgaucuccagcacaaaaagaaaaaugaguuuacagggccaggcuggagagauggcugagaggugaagagcugugcgugcaggaaccugaggcuaguugcuggacccauaucaagcugcucacaaccacauguagcuccagcgccuguagucauggugcagacauacaauuagaagcagaccuuuuacaauguucuacaaguugucccacaaaaaugccccauaguuuacgggguuuuuuuuuguuuuuuugguuuuuuuuuuuuuuuuuuuuuuuuugguuuuucgagacaggguuucucuguguagcccuggcuguccuggaacucacuuuguagaccaggcuggccucaaacucagagauccaccugucucugccucccacaugcuggaauuaaaggcgccaccaccgccuggcauaauuuaugguuuuauaguuaauguuuguuuugguuuuuaagauaaagacuccuacagcccaggcuggccucaaacuuagucuaaggcugacuuugucuaaggaugaccuugaacucaccuuccuggcuuuaccuccucagugcugagaucacaggccugagccaccaaacccagcuugcauggugcuagggaugaacccaaggcuucauguauacuaaucgccuccccaagcccuggaguaacguuauuccuaaaggaaaucacugagaagcaauauccacauaaaugauaauacugcugaaaugacauucacaaacccuuuagacaugaccaaaauuuaaaauucuuaagacuugcauuuacaaaacaaagcaaacacaaauuaagucuccuaaaauuaauaaaaauacuauuuagauucaagaaucaauccaaaccccauaauauaauuuaaaggaaauaccagcagaaucauauccucuguauuccagucucugaaggccuuugauuagugucuccaagauuucucgucuuguucgaggaacaugguaauuuaaauaagcaaauauaccugcaaaaaaauuuaauggacaacuuugaugaaucaaaccuuacacaauuauguuuaggcuaugcaaaaauauaaagcuagauuccacuuuuuauuuuguuuuguuuuguuuuuuuguuuuuuugagacaggguuucucuguguagcccuggcuguccuggaacucacuuuguagaccaggcuggccucgaacucagaaauccgccugccucugccucccgagugcugggauuaaaggcgcgcgccaccacgccuggcuccacuuuuuaaaaagaaauaaauuauuuagaguccauuuaacuuuuucaaaagggaaguuuauauaaacauaaaagauuaacaaaaauaugucaaaauaaguauuuaguuguuuccaacaaaacuuauaaagcuaacuauuuccuuaacugccauuuugucaaguaaaauuuauuuuuuaaaaagcaaacuugugggcuauauccuauauacuauuacauuacacauauacauuuucuaguauuuuaagccacaaaauaguuccuacaacuauagagcuaaaauaacuaaauacuucuacuauaaauaguguuuagugauaaauuuuguguuaaaaacaaaacuucacaauuuacuuuuuuuccagaccugaagaccacauuugagucaagugcucuaucauucaacuacaacccaauauaauaauuuaauaauaauaaaaaaucugaccuaaauacauaacugccucaaaaugacuugaaucagguucagguaccauuguggaugagcacagacuggagaagccagagguagaggaggaccagagaaaacgguguccuugcuacuuugacgguucuucuuuuuucucccccuuuaccccccuggguucacccccuaacacuagauaggaaagaaacaacaauagaggggaaagaggaauuaggaaaaucccugaaucuaauguuuuuccuuuugcuucuucuuugaccacagcuaccacaagcaaccuuccuaaucaccagaaacuaccaccgccaccucuagacacucucugaaaaguucccagaguuccaaaugucacacaaucacagaaacuaucugcagcugacaaaaccaugccucggcuagugcuugaggcaaauuauggucaguugcugcagccccauauccccacaccuggaacuaaaauggaaacacauucuaauaguucuguacuuuaaggaaacaaaauuccaaaacugucacuacauaggaccucugcacucaucaacucacaauaacugugguugccuguucuaacauagaaaggaauaggguucaugaaccuucacuccuaacugaagagauguggacaacugauggcugcugagagagaaucagcugucuuuaggguguggcuccugguagguauuaguaccuucugcaucccuaaagucccucuuccccugcccccuucccuauuccauacuucuacaaggguaauacugauuuucauacauacguuagaaaguguauuugccauucugggucugguugauuucacucagcacaauguccugaaauucuuuaccuauauuucuacaaauggcagggcuucacuguuuuagaccaaguuguauccguuguacaaacacacaccuuccuuauccauucauccaaugaaaggcacgguuuguauuuuguauuggaaaguguugcaauaaacuggaguugaaacucucuuuggcaucucaaacacccacuacuggaacugcugucacaaguggaaaagucgucuucuucuuuuuugguuuuuugagacaggguuucucuguauagcccuggcuguccuggaacucacuuuguagaccagauaggccucgaacucagaaauccgccugccucugccucccgagugcugggauuaaaggcaugcgccaccacacccagcggaaaagucuucuuguuaguuugaggugugaugugaguacaggugugcacagccccagucugaggugugaugugagcgcaggugugcacagccccagucugaggugugaugugagcgcaggugugcacagccccagucugaggugugaugugagugcaggugugcacagccccagugacuauggaguccacagacaacucuuggggaugggaacuauuacuugggccaccucacuggccccuucugagacaaggucucacuaugcagucccagcacucccauggcagugccugucacuccaguccuacaaagccaaagcccucuuuuagccuucauggauacuguccacacagacauacaugaagguagaucacccauacauauaaaaaauaaguuuuuuuuaaaauuaggacuauuaugcuacagaauccuaucacaccuaagaugcuccauuaccaucuaaugugauguucacauuaaaauucaccauaauuuuaaaaaguccuuuacugcugaguuguuuauucuaaagucgaauaaaggcccaccuuucagaucacaguguugucgcucuuaagacucuuauccagagugcucuccccucaccauaccauuuccccaagacaagcaugggccacugucccgcucaacgccuccccucuggagucauguuuaguuguuuccauaauguagcugcucugauccuucuugcuggggaccccaggucuccaguagagaaaucgaaucacccguugugauagacuccuggcugucaacuucacuguauguggaaugaauuaaaaucuagaaauggagggcacaccugugguccagaucuugaagcuagaagauacacacuuuugacccagaucuugagacauaguggccaugaaaaucuuaggcccaggcaaggugguucacaccuuuaaucccaggagacagaggcaagcagaucucugaguucaaggccuuccucagacagagcaaguuccaaguaaagaacuuagguccaggcauuaugguacacaucuuuaaucugggccaaaaggacaauauaaaaaggaaggguucuuuuuuucuucgacugcuugcacuuauuugcacauguguuggaaccuacuucuucaggauuccagcuuauacagaagaccagcugaaacacccagccucguggcacugagcaaccucuagauucuuggguuucccauucacagauggucauuguuugguuaguuggaacuauagacaguaagcuauuccaauaaauucccuuaauauauauagacauuccauaaaaucuaugacucuagauaacccuagagccuucugaaagugucuccagaacaguuucuagaggugacagaccuacagauuuaacacauugauuuaaaguaugauuaugcguagauucuuuccuuguguuuccauggugacggugcaucuuccaauuacuggaaucuuugauucaaugaacuaccauacucaaaaguuacaacucaaaaacuuuuuacucaauaaaggcagcacuacuauagccaauaaucauuauuaucacguuugguuaaacuguccuuugaaauauugguccaaggaaaccccugaguuaaccaggcagugguggcauaugcauuugggaggcagaagcagguggaucuuuuugaguuugagggcagccuggucugcagagugaauuccaggacagccagggcuacacaaagaaauccugucuuggaaaaaaaggagaaaaagaagaauaauaaagaaggagagagggagaggggagaggggagaggggagaggggagagagagagagagaagagaaagaaggaaaaaagaaaagagggaagggagggggaggggaggggaaggagggaggggaggggagggugggcgggagggagggagggagggagggaggaaggaagggagggaaggugaagagaauccaccaguuaugauuaugauaucaucuucgaucugaguagcggggaagagaugacaagcaggcagggcaaguccacagagacacucauacucacaugguggccuccuagaaagaagucacuacuucagcucauaauuuaaggucuuuugucuuguuuaaacuucccaaaaugcaguccugcguaaaguaacuacaaaaguuuaaagucgcccuuuuguaauugcugcaguauugaagaguaguuauaagcagauuuccuaccccaaaucauuccuucucauuaacugucugagccuucuuauggugccacaucauaauauguaauagacauaccauacuuauaugaccacaucucuagugcgauguuucuuuauaaaggcaaugcuacauuuaagacuuauacacacuaauccuuuaucauaaauauauucauauuauaacuaugcagccacauuuuacauguaagaucucuuuuuaaaaaagaauaauguuuugagggcuaaagagauggcucagaggugaagagcauguuacucuugcaggggaccuugguucuguucccaacaucuacaugguagguaguucacaaccauucuaaguucaguuucaggagcuccaaugcccucucccgaccucugugguaccagguaaccauuuaagcauuaucucaaaaaaacaaaaacaaagacccacaguucucaaauuuacuucuacuuacacugacugaagaugaacaacaccacuaaaggugacugccucccuugucacuagucucuguaucucaagguaagaauccucccgucauuggagcauuccaggucuaacagagagcaguuacaaagcucuccugugccugauggauuucagauugccucagauaguacugugacagcaccugcagccauuauaucugcauucauuuuguuuccucaaagacaacucucuugagucuucucucaaaaagugccaccaagcacuucaucaccuucaucaccuucugacccuuucuagguaccggaaaguuacaguugaaaaucccaagccccaggaaacaacacuaaauauugcucaaugcuaaagaaggauaaguaaaggccuccuaacuaaaagcuuuauauauauauauauauauauauauauauauauauauauauauauaugagcccaacaaaguuacuagguuuaaagguuucuagaaccuuuagucuugcuaauucuggaucucugggagaagacuaucacaaacaaguauuacaaaacccuucccaucuucuuuugcucauuucuauuaacccugacaccuauuaagcucucccuuccccagaaaauguguaucaaacaaguucccucacagcucacagcuucuucauauccagugugacuucuuuuuuuuuuuuuuuuuuuuuugguuuucaagacagggcuucucuguguagcccuggcuggccuggaacucacuuuguagaccaggcuggccuggaacucagaaauccgaucugccucugccuccccaaugcugggauuaaaggcuugcaccaccacgcccggcugccuccagugugacuucuaaagagcguaaacaguauguauuuacaagucacccuagcagccagucccagcaucccucaauaaccuucagguaaguaucucaaaaaaaauaaaaaauaauuuuaaaaaaggcaagaaucacuaguuuaaaaaaaaacaauugaaaauagauaccuauucucugggaaauauauaaaacuaauauaaaaaaguguuacuggguucuaggacaaccaagccuaacacagagaaacccugucucagcaaauaaaaacagaaaugccucaaauaccgugugcuagcauauugauuuacuuauucuucauaaucagugaaacucaguguaauagcugccuugcacuagcagccacucugacuaacaguuccuccuuucuuaucugagcuucaugaacuacauccgauuccuuuuucuuuuuguuuuauaguauacaaauacuuuucuuccugguacaagaugaggaaauaaccugcaaccagaaugccagguacuugccuagguacauaacucaucacuccaacauaguuuaacuagcugggugugguggcagaguccugccaucccagcccuugggggcagaaggaggaucaggaguucaagguuauucccagcuacagagugaguucaaagccaacccaggcuagugagagucagucucaaagaaagagagaaaaccguuaacuaccaaacacagcaaacuaguaacuaaccagcuugaaaauucacuacucacaauuugaaacuaauuuaugaauguuuuguaaaaccaaucuauuaaacaguaaaaguauaauuaauuaugaagucaacucuaauccaguaauuccaugauguuuagaauucuaaaaucuagaaucucuaagcuuaagccugcucuucauuuucagaaggcgaaacgauuaaacacaggaaaacacacacugaggacaaccuaccccuucccgaguucuuacaagugaaagacuacaaagaauguuucucacacagcuacaagucuuacaauaccucuuucuaaaauguguucuuucuugggaaccaggcacaguggcucaugccuagaaucucagcacucacgaggcugaaggagaacugggaucuagaccugcuugagagacagcgugggacacuauuucuaagaaacaaacgcucuuuagucuaguggucauugucgguuuuaaaaggaaagguaaaaauauaacuuuuuaaauacuacuaauggcucauucccauuuuacaauauuauuagugguaucauauauaauucucaugguaucuuuuaguaacacuuuuugauaauggggggcgggggugagggguaagacagaguuucucuguguaacugugcuccagcugucuuggaaccagguuguacucaaaaucacugauuuccaccugccucugucuccugagggcuaggauuaaaggcguuguaccaccaccgcccagcuaaauaagaagccuuaaaauauggaauaaaagagccuguuuuuuuuaaugguuguaguaaagacauauguuaaacagguguacaugcaugaugugggaucuuuagccaggacuacuacucucucuuccaacaagaucagcucugagcccauuucaucaaguuauugauuuaguaaugguuccuguugagagacuuaagaguggcagaagucaugugggguaucacugucagugcguuggcuugaguucucgcaggccugccuaaaauaaagugacuagaauuaaguauuuuuaagacugcaagauaaguaaauucaagaaaugcuaccagccaggaguggucauucauacuuauaaucacaacacuuggaaggcugagacagggcaaugugaauuacaggccaaccugggcuaccaagugggacccaguuacaaagagacagaaaaaggggauuugggggguguggcuaagggaaagaguacucacucacuugacaagcugccuuuaugaguuuaacccccaguaccacacagcauguucacaggucgccucacucaccugguggaccuuccccuaggcaucccuccauacuuggucucacuuugagccucacagcucuucuaagguagguauucaucuauccucugagcucuaugcaaaggugccccuugaacgcucugauacccucccuggcccaccccacccccaauccucuagccccuuuaaguagccucugacuccuagggcccccacaaucuccucugccggucccucuuaagcacacuagcuccggccgccccuucaacaccggaauccccaucuuagagucccugccucacggacagcagccuuucuccccagagacccuucuccuuccagaucccggcuccccucaggacccucaaucuccucgggaugcccgcuccacaagccccccuucucuucaggaccccagccccaaggccgcucuguugacacgcgcuguccaccucuggcuucacugcgcgggcccugcggccaccacacacccccaucgcugcccuuaccgcacaugauguuggucacgggcgagggcugagcugucgggcgcgcggagagcuucagaagcgagggugagcucgggccggggugguggcaaugagaggacucugggaugcgacagcucagacccgacaguccgacucagcgcucgcuucgcucucaacug

SEQ ID NO: 3173 - RNA, 2008 nt, Mus musculus
uuccucaggugaaugcugaaggggacggcagugauccaggaccuggaagacgaaaugcagcuguccuugaaguucagguuuggcacugcagagugugugguccugagacagugccugguaaaaugaaugaaccagauguaaggcagaacuuggcgaaugagaaggagaaguaggcugcauugaaggccuugauguuugcucuaagacagcgaugugcauagucuggaaauagagcagccauccucagggcuuaggaaaugaagccaugguggccggcaucuuaccagcaagccccuggaagaugaauagcuacuuagaaccagagugacaaggugugugccuguaugaggaggaagaaguauuggcuauugagcuuccugggugagggagaagcuuuacagcugcucucugaagaagcaucuauuauccugagucccagggcaggauagagauugcaggcagguuggauaaacuggcauaccugacacuuucggugacggccagggaacuagagaucagcaguguugguagaaacccacauuuuccaucuggggagguagaaggagagcguagacacuguaugcuugggagcuccuugcccagggagcaaucucccuggguccucugcuuccugcccccaugcccguuuugaccauuucaacaucccuuaagccucccaguacuuaaaagaaguacuuaccugccagaguuacaaagacuguuguguucuucugaggacaaagaggccagaaagcgagcaguuggagcaaacuuucuuuaacaaaugucccuuuggccuauucaauauuacuccacuuuaaaaccccaucaccgccacauaguauauauuuuguugccauucgcuggugaggaagccgaugcccagagugcuaggagaggggagcccacaguucuuccucucuguguguuuuugaggaaauaaaaauaaaagccacucugugcagucacugggcugagcaugccaucaaacccucaccagaaccauucgauaaauuagacguugugugguuggaaagguuuggaaaacuggccaggaccauacagggcagcaagugagauucaggcgaugcugucgugucugcucaggagacugaucccagagcucugcugagcaguguaagccugaaacagagggagacucugagguccaaauucagaagucucuacgcaguucacaugguuacagcaaaggcgacagaauccaaugcuuggauccaaugcuuggugcacuggcuggguggggaguccuuugccucuuaccacucggucagaagcguuuccacaggauagcugguguucaguggcucaugacaaggggacaauuugucaauuagacucagacuucaugguccuuugggcagacauuccuccuaagcuauuauuucuuccauccgaguuuuagccagccaaggcucugugccaaggucaggcauagucggauaguguggcugaagauguaaguaagcuauugcuucuuuuccauguguuuaaaagucucaagaugauaaaacaacccucacauccugaauggcagaggaggccaggcaggcagaaaagaaagccucacucacaccuaggccgggcucgcccacccucucaggacccuugcagcauccccaccuguuacugcagaauaugggaaaacauuuuaaagaaagugcccacucuuaugccuucucucguugugguucauugggaauuuccucugaccaccgcuagaauuuaccaccaacucuccagugaaaccuccacacaaugaucccaccaugcuccugggccugcuuugccuuuugcaaagugcucggggcaguggggccagaaaacccaugaaagcuaaagccagagaacugaaauagguuggcagcuuugauucuugacccuuguccccagcugucccuacuuacugcaguugagggcagugucuggaagccgaagcagguuaugggaaggggaggccagcuauuggcucccugccaucugcuccaca

SEQ ID NO: 3174 - RNA, 5681 nt, Mus musculus
uaaccagucccugagccccuuaucauagugagaccugagaggcugaagucuauauaaacuagacuugggaaaugaacggaucauagaaaauuguauuaugcaugccguugcauucgcuggagagagacaacaugagacgccuugugaguacaucuuuaacuuugaauguggagcauauauauaucccagucagaccagccaaggaggucuggauccucccugccccaggaacuguucaaaucaacccaggcagaauuuucaaacgaugauugggugugcaaucuucuguuggcacuucuguuuuggagaaucugaaggaaggguguccucuaauggaaucaauaacuaauuucuuaaaagucaagacucuuuggaggccagguagauacucauaugcuggagucuugucugcagugguuuuccguauuuacaaauugccaguggggaauagcuuagaugcauguggggccagcugggauagagugcuuuuugucccucuggcuuuuuuaagacaaggccucauucuguaguccaggcuacuuugacucgcuguggcuugucucagacuuuccaaauccuccaucuaagucuccugggugcuggcauucaaggcaggcacgaccacauccagcuuucacuaaagcagcuucacccucugcagcucugugucuauggcagcugcgcugcacugcacuguggugaugauaacacuguagaauagccgcuuccuuugacuuucaggggccccguuuguuacugaagccagaugccgacuuuucauggauguuaagagaagggaggacccugccagucccacuugucaugaugggugcacuugagcugggccagccucaaguacacaagaaacuauggcuagcuuaacccagcccccuauucuuuuauuaaugucugcugcagaaaacucccuugaugggcagagcacaccacauagaggaacugaacaacuuaaauauuuuaaggccuagguacauucuaacauaauuucccccaaaauaguaugcaaauaacagugaguagcuuucuucuuaggcaagguaagagaauucagaggaaaggaagccuggagggugucaguuuccaggggggauggagggugggcagaggcggaauagggcugacugugagauuugggguuuggaucaagagcuggaguagaggaugugcccagcccuggaaguagagagguagcacaaaaaggaagagugggaggccugagcuauagugguccaggcugauccuacccugucagguuggcuaaaucuaucccagugauugacaguagaagccacauaggaguguccuugagugacugacaaaaccuugccuccugagcagcaggcacacccugugugaacacaguaagcuauaguguccugacacaccugggaacucugcagggauggagggaggugaaagcuguggaccccagcaaggcagcccuggagucuaagcucaucagaggccaaggacuaagcacagugaccuuuguuccauuucagauugcgccuuccauucuugugacugucuuucuaguuccagcucuggcgcugacggugaguaugguggagaggguccagucuaccuaugucuuuuagcagaaacauuucaaagauaauacccagggguauuauuccuguaguuucucauggauucccccuuaacccugcacaggaugagcagauagacacuuggggccacuggcuuuacucauuguugauugcuccuucuagaacacuagcgacaguuauccucuggauggcucuguggggacccagaccauccaugucgaugcccucagagguguggucagcauccgagacaacagcguucagagugaaugggauggagucauggacuacaagaacguaagaugugaaacgcacuuauuacaaggacaagagagcucuuaggucugcuccaaauggaagccuuuucacugucuuccucagggacuggggugugcuauagaaguugguuugucuucuaauguugacuucuaaaggaaugcggcuaugaaucaccaccuccuucaguaacgaggccccuuaggaugacacauaaccaggaagaguaacccugugacuuagccgaacucuuuaauaaaaucuucugugaccgcggagaauauuuuucuguuuagcgugccucgguugccaaaucugcaaaacaacuccagcagcugccucuccuaccuagugggacuuuaaaggauggaacgaagucaccacccagccuccccacucagcccuuugccacccagguccuccucacucugucacauucucuccagcacacuggaagacucagaauagacacaagguguccucuccacucuccccgcguccgcuagguuaucuuccccuaacgccuucucucucuucaccucccugacucuuaacuucccaaggagauucccugaauccucccggacuacagauugccucuaauggaugcuaugagaagccaaguaaaaaaaaaaaauuccucagggaaacauuccacaguaggccacuagguggcgcaaggaaggcagaauuacugcuagagcccagguucucaacuuucccauuagugugaugcuucaauaugguuccucauguugcagugacccgcaaccauaaaauuauuucauuguuucuucauaacuguaauuuucaugcuguuaugaauuauaaugugaacaucugauauucagccucugugaaaaaggucauuugacccccaaagggucagagccaguguguugaaaacgacugaucuagaggcugaguuucuugcagcuguaccuggggcucugucagacccggcagcagcaaacugcagcuaugauccaagccagggaagaacaaauaacagaccacaaggaagagguaugcaggcagaccuagcucuagaacccaagucuugacugaggccucccaacugcccuggguacucaagagagcccucugcagcuuauacaacauucccccaggcagugaggaccucagcucucaccucauuuccaugacaacuccacagaagaaaggcuauuccuccugcuuuauugauaaaauaaacaaacaaacugaggcucucaagagccuuagaguagcagagcaggccccuaagaucauccacauuguuguauuaccauccuacccuaccugggagauaaaaccuucaccaggaggagcagaggagacaggagcagaagcugaccugugcucuggcauccagagugcagcccuucugagauguuccgcauuucggucagacuagcaggguauugcaccccugaggcgagcaggugcauuaguacugagacgauagguaacacguuucugcucuguugcuuuaaggaccuccuggcagcuaagcuguuuagcaagauggccuguguucuggcaaagauggacccagcagccuucccaaguuuggaugauauuacccaggcccugggcaaacaggugagugagcguguccaggugucucugacuggugucuacuauggggcuuuccaacguaacagccacucucuaagacauggacaggagcuucauccaugucucuccuuccugccaugaagucacaucauguucaaaggacuuuggugucccauucaaggcuaagcacaacugaaucaaucaauauccuauguaaugaccucauucccaauggcuucaaacuaugcuagaagacacaaggggcuggaugcaaacacugcaaugauuucacgacccugucucugucucuuuccuuccugccuuuccugcccccccccccccccccccgcacacacaccauuauuaccauuaagcccaagauugcugaaguucuugccuacccucucuagugagauugggaacuguuaaauaaguuaaagccaggaggauauucucugcaacuugugggaucuauuccaacuuugcuuaaaugucaacacauuuggacagcauucagaacuggggguggcgguacuaacucuaggaaaaaaguguguuaaagcaaugcuauuuuuaaaaguuguggguggagaaaugcucggagguuaagagcacuugcuccucucgcagagggucccgguuugguucccagcccccacaaggagacucucaccagucuguaacuucaaacacuccuacgcauaaaacuaaaauacacaaaucuuuaaaagagaaguucaaaguguccuguucaucuaaacugacgaaauauaaacgcaauaaauguuuuaaacuaaucaggguuaaugagaacgcacccaaagcuaauagaaaacgccacuggguccagaguuugccagagccuuguucgcccuccugaggcucaauaaaacacugcagcuagagacaccggagagcaagucuggauugguacugaaucuccccacgaauccucacagcuccccugugaaccccuucuuggauaugccguaucugagacgcccccucuuacaggcuuccggucacuacccaccuacucgaggacugaccuacacaguuuuacccagccgaaucaaaaacuuggcccaauacggagugccaaucaaagaccugugcagagccguccccaccuacuuugcucggcagcaaaaagaagguguguucacugcuggaaacaggaggugaugcaugaaucaaaagaaaagggaggaguuucgggaccuauuggcaaaaugcaaugacaucgcucauuccaucuuuucuccaguggaagagaagccgcguguuugggauguaggggauuccuuacaaggcucauggcggggggaggggggauggagaguaggggagccgccauagacugcuuugggauuugauggcugauggacacccagcccugacucgagcuuagccacacccacuguaggggaaggccauugacuuuggagcccucgguacucugcggggagaaaaucagugacuggaggaauuguaauugcuagaggcuaaaacuccaagaucugccugugaguccagaagcagucagcaacgcagccggugcccccccccaccucuuuuuuuguuuguuuguuuguuuguuuuuuaguuuuucgagacaggguuucucuguauagcucaggcuguccuggaacucacuuuguagaccaggcuguccuggaacucagaaauccaccugccucugccucccgagugccuuggucguaaacccccagccagaguucuucaagacacaagggucccggagagaaccagaccacacugggcuaagggguuacaaagcgcaauaaaagaaccauaaaagaaagaggugacuacagcaagggcuggugagaggggccggugugggccucugcugaccugaggguucaucgaaugcuggugucccauguaccuguugacucugacuuugucucuaaaguguggauccuuccucuugaagguaccgcccugacgauggacccagacucauguucugagcuccagcuucuguccuucaugggacuguccauuuguggugagaucccugggcucugaaccucuacgucagccagacuggacagaccucaucuagccucugccugugagaagugucucauugcaguccucugugcuccacauguuggcuucccauggaaccuugugaucuggggggaauaagugcauuucuaccuuguaugaauaaauaauaaaguuccaguguuacuggugcagcag

SEQ ID NO: 3175 - RNA, 2638 nt, Mus musculus
ugguuuuaauuaaauggaaagagacucccaaggcucucgccaugugccuggacuccuguguucgccuccuugacuccagauuuuggcggcuaaaagaggccaggcaggcagccagcauucugcccaagaaugggcagcaucuuuaaaaauuccugccgugaaaggaccacauaguucacaccugcuuggguagaagguuuccagcagguacuuugauuccagccaggcagagccacacaaagggucacugcuucuccccccuuguguaugcuguggcguuuacaaccagaccaccauguguaaaaaaauucaguuuuccuccccuuuuaacagacucuuccugggccuccacgacuucuucagagaaacaggauccuuaacaacugugggguaaggagucguugcagaagcuggugggacagacucuugacacacagccaauaccccacaagcacuuauuugaccuucauucuaucuagcccagucuguggcagacuuuuacaucuucaaauaggucaccuugagcuagcgguugagcugauagguccucgaaccagacugcuguguucaaauucucaggccgguugacuuuggauguggcucuugaaccauuauuuucuguuuugauucccucaucuguaaguguagcacuuaacagacugauuuugcagggcugcuaugagguuucugcaggcuccaagccuuccauguaaucaccaagcacaccgcacaugccuggggccugggccaucuaccucaguucuccuggauaacugcuuuucaacaccucccacgggcuauggacaggugacccaccuucccguuaccugcugcauggaccaccucaccucuccccagcucagcuccaucuccucuuucuauuuucucuuggaucuuuccaaucaauauuagcacuacaauguuuuucauaucaaaaaaaaucucucuugacacuacuuccuccuuuggcuauagacuauuucugagaauuuuuuuuuuaaauuaaggacuguuggacuuacugugaucgcuccucuuuuuccuuccuggauuucucccauugaggcuuuugcccccaggaccccauagaguggcuucucaagacaccaacagcuuuccugucacugaaccaggucuccauccucaccucucagccuuaucagcaauggacagagguggccgcugccaauuuguagaacucugugaaccagacugguuuucugccucuuuuccugguacucuauguccgguuucucucuuuauccuuucucucacuguaaguugggcuuacaguggguguaaagauacaucuuuaucaucuugaugaucauggcugcccuaagacuuuaguuacaccacauagauaauggcccacauauauaauguauggauguuuccagacuagaccacuuuugaguuccaaguuauguacaucguugcuuucaucucuaagaggcaucacagacuaaugugaacaccuggggccugagugugcugacccagggcguguccuucucacugagaacuaaaggaccacaugaacaauaaauauaucccaagccucugugcucaucuucucugcuuauguuucauuggccaacaugagucacaugagcaagcacaccaacacagagacaggaaguacacacagcaaugagagaaaagggacugccuagcuuacccagcugccacccggugccacaggggugcuggauuccuuaacuuuggcucaggcucuuggggacuuuggagucugugaucuacaguacuuccugccuggcccagcacacuguucccuaucugauagccccccugagcaccauccuaguagcagcuccauguggagcuucaguccuggaccuuuaaguuaggaauucugacgacauucugaagguggcauuuagagacacauagggaacuuccuggacucuuugggggugaguuccugugagucucggaaaaacauaugacccgaggggaaguuggugugcacacucagaaagucagucagcaaacucagcagcagcuauggcaaggcugcucgaagccgcccacagagucuggugcuggcuaucagauccugagugggggucagugggagucaacguuacuccugagggggaguagaaacuugcuguggcuacuucggcacaucucugaccuuuagaagaugaagaacuggaugucugauaguaaagacugaguuaacaucagcauuaaggaaagaaaacauccauguguuugcuuauuuauccugaccauuuauuaagacgucaacguuuugcuggaggaaaguucaugagcgagcaacuugauuucaaucucucuccuuccuuucucucuucucaccucccagaugcaaccaauaggaaggaggagcccaauucagugaccggcuaaauauaacaggauaugugcugaggaagaaugggagcugugagagucccugugggaggggcaugagugggaccggagagagagggaagguguccugaagcagcggcugccacacucugacuugacaaaugugucagagagauggaaagauuucaaaaaggaccggcuguggugcuucgcgcugaggcugaggugggcagaguuuaagagcagccuguacaucaagagucagagacuguca

SEQ ID NO: 3176 - RNA, 6131 nt, Mus musculus
cuguagcucuauucuuuauugauuagauccauaggaauccauguuucuaccaguccucggagaagagccaacacucgccaauggagacgcaaguguggagccaguugcaucccggggauagcuuuucccuguuacuugacaaguacgcuuuccguguuuucucugcagaaucugaaguggagauggaguguacucugagguaagauugccuggaugguguuuguaucugauuccuccaccuucacagaugcuucagggaaaucacucuaggguugagucauacuugggcugcaguagucacgucauuugucuuucuggaaaacacuuggcuuaggaaacuuaagccucgugguguuugcuccaguguuugcugucuuuuaccuuuguauuccuaagguuuccacaaaacagaaaauuaguuacacguuuacuugaauuuuuagcuuucuuaauuuuuaagauauuaauucugacuccuauagcugauuuuuuucuuauaauaacaccauaaagugcagaguugaaggacugaagacauuagguaguagaauaacugugcuaaaucacaaacuaguuucugagccagauguugggcacuuacugggcuucauuuuucaggcuuuaagugacagaguucaaauacuagacccauaggacuaauugaaaauauaugaaguauauaugaaauauaaauuucaugauaucauugguguuuuuguguauuuuggaauuaccucuauuuugcauuuguuaccaugucaaaaacuuaaaaccauugauaucagacuuguguucaucuucucgacacugaaaagccaguauauggcagagaguuguaaaaaaucaaguucacucaagagccagcacccuaaaaaguagagggggcuuucuucuccccagaagaccuucuugagauggagaggaggugcacgcucagugcggaggcacagccgugggauggagaggaggugcaugcauagugugguagcauagccgugugcucagggccuuaaggcagcaucaucauuaggcauggacuuugucuuuuauuuuauuuuauuuuauuuuauuuuauuuuauuuuauuuuccugacugggaacucuaaauuucuaggguuaauaaucucuguauuccuuuagacaagcacaguauuuguuuucagguuacccaucccagcaguucacacacucuauuaguugaugugucagacaugggauaaggagggaugucuuguuuucugauguuaucugaggguugccauguguucugguuuuuaauggacgauuauagcagcuaagaucuuggucaccuagguguuuuguauugaacauagaagggaaaggcaaguagaggaaacucugccaaacacaacugcuaggaguagccauuguuaagcauagcauaagcuuuauguauuugaacacugagaauucauaacagugacugugagauaucagucacacuacugauaucucugugcugcagcugaagaaggcagagacguuuugagacucgccuaggguuacguaacaaguccagguuccagacuaguauuuccagaaugaugcucuuacagacuacccucugcuguaccagaacgacugccuggguacccacugugcaagugcccagaggauggcgacaucgaccuggaauagucuuauauggaaugaaauagggaaggaggaagggaggagggggaaggagauggugagacagacagacagagagagagagagagagagagagagagagagagagagagagagagagagagacagagagagagagagacagagacagagagagagacagagagagagagacagagagagcaugagccuguuaguguuagauccauguuaaaaccugggccaccucucuaaugugguaggaaaguuacaaguaugugaaguguauuuugcauucuuguuacguccccagcagugggugcagaguggguguuggcgcuugauuaucagauugagugauguuguggugaggguaagacuuuuuuccuuggcuaaacuucauuguugaugaggaaggaaguaacaccauuuugucccuuugggagauuuucuuccaggaaagcacaguauauuuuugacauauuaacuuauuuuuuccaaaguacuaaaauucuuagcacuuauauuccaugcaaauaacugcugguuucaaguacuaauucugaacaaagcaauagcauguugauagaaaucucauuuuaaugugacaaugaguaacuuuaacauucauuuguaauuacagaaggguguggauuuggaugggagaggaacugggaagaucucagaggggaaggaaaaaggauucagaauauauuguaugaaaaaaaaaccuauuuacaauaaaagaaaaaugaaaggaaaauuuauaaaaucauuuguaauuauuuuaaaaucaguuucuuuguauuagcauauuuuauauuaaagacauaaaauaagcaacauguuugaacauaauuuagauuauauuuugaauccuuaaggauaacuuaaccucuaauacaaucuuaaguaugaagacuauuacugaagaacucacauuucccaauuucaaaaccugcuacaaagugcagucauuuugucuggcauaaugguaaacauaacucaguggaguugaggguuaaaaaauuagcccuuauauuuauggucuuuaccuuggacaagggcaccaauucuuuuuuuuccccugauggcuuaggaugaugaacacuucuauuuucucuuuucuuuuuuuauuagauauuuucuucauuuaaauuucaaaugcuauccugaaaguccccuauacccuaccccccaccccccucccgcccugcuccccaacccacccacuccugcuuucuggcucugguguuccccaguacuggggcauauaaccuucacaagaccaagggccucuaauuccauugauggccgacuaggccauccucugcuacauaugcaacuagagacauaagcucuggggguacugguuaguucauauuguuguuccuuuuaugcaguugcagaccccuuuagcuccuuggguacuuucucuaguuccuucauuaggggcccuguguuccauccaauagaugacugugagcauccacuucuguauuugccaguuacuggcauagccucacaagagacagcuauaucaggguccuguccucaaaaucuugcgggcauaugcaauagugucuggguuugguguuuuuuuaugggauggaucccuggguggggcagucucuggaugguccuuccuucugucucagcuccgaacuuugucucuguaacuccuuccauggguauuuuguuccucauucuaaggagggauaaaguauccacacuuuggucuuccuucuuuuugaguuucauguguuuugcaaauuguaucuguuagauccguuuguuucauaacuucuguuaguuucaguaaggguaccaauucuaaacaaacaggcugaaguuaguuguccagacaauacuggaacagcuaauauccacaaagaaagaaaugaaguuagacguucacuuuauaucacauagaaucaaaacggaucaaacaucuaaaucuacagaggguagcauagguauaaauccuuaccacccagccccagguaauggccuuacauguccaacagcaaaguaucagcauuugauaaauuggauuuccucccauuugaaaccguguaugcuugugagagcagucaagaaacaaaaaggacaagugaaugacaaaauauuuauaagucacauacaucuauaauaucaacaucuagaauauauaagcaguuacaacucaauaacaaaagaaaaaccugauuuuaagauguucaacugauuagaauaaauauuuccuaaauugagcaugaaaagauaguaucacuagucauugggaaauuuaagucaaaucuauaaugugauucucauaacaguuugaaacuaaaaaugcuuacuuagcuccuaggcaucuguaaucaaagucauuaguaaauguugauauuagcauauggagaaacuggaauucucauauacugugugauguuaugaaguaauucauucucuuuggaaugcccauauugugauaauucuuuagauuuuaaaaacaaaaaacaguuguauggccuugcacugccccuguuagguuuaugccccuaaguugaaaacaugaguuuacacagaaauguauacaugggugcucacagugaugucauucauaguagucaggguggggaaaccagccgaaugccucagcuguggaguggguaagcaaguacagaguggaggauaguuccugucauuuauuaugacuccuaacaucgaaguucaagucugcuuuugaaagagguuauuccuuauuuuacaacugcugacagaaaaauuuaaaacucaaucagacucuucagcuacauauuucugaaaucucucaucuucuguuuuaaugguguauuuauuuucauuuuauguaugugaguguuugccugcauguauguguguaagugcaucaucuaugugcuugaugugcccagaggcuagaagaggguauuggaacugagguaacagacagugagccaacauguggguucugggacuaaaccuagguccacagcgagcgcucuuagcugcugaucgaucucuucagcccugguccaugauuuuaaagacuaauguaugaugugauaauauaugaaaaacauguacuguagcauuaacugugguuuuaggcuucaguuggacagaaugagcugagcaccccagugagagguccucagaagcauagaacugaacagccucaaggcugcuaccguguguuguaacugauaggaauguuacguguuauaacugauagaaaaccaaguucccauuuuauuuuauagaaacagucagaugcuugaugaagaugauauauugagugagaugcagaaguccccugugguuaacuuaccugauaagacaacuggugccucacagcugcaaggaagcccugaaauaaccaagaccaagugucccaccauagauccuauggugagaaucguaagacgcaccauucuaaucuggucuuuauuucaaggagagagaagacaacugaaaucaugcauguuacaacgccuuggguuuuuaaguuagucuguagaggucacacuaggcugacaguuaagugaauagguaaugaauuucuuguaagaacuuuaacuguuguggauagcuauguuaaugcuaauuuucuucaaaguaaaucccuuuucagauucacuaaggguaggugguuaccuuuaggaaauaauuuaugguucuauuaguccucuucaggugaaugcagagcuuucagugagcaccagccacguccuacccagaggaaaagaauccucccagcuuggauguuggcggaaagucuaagugaccagagccucuccacaccagcugaggggggagguagguuccaggcuuuguuacuguugaguuucgaggaagcauuaaagacaauguuaagguucuucucagcaaauagauguagaaugguggcugcaugcgguauggguuagccugggacuuaaauucuguucuauuuauucugagacaugaucuuaaacuugcuaugccccugccucagucuccugaguaugguguuacaggugugggcuugccaugccugcuaaccuacauguauguggaauauaauauaaaacauaagcuguuacuuuauaccauuugucaaacugcauucuaucuguugauaccuuguugagcaugugauaguccucuuauugcuagaugcacugcuaauacauauucucaggugggccugugggugucacaucugagaugaaagggcacagcaaccagaauauuaaacuaguuaaauaagacaaugucagguacccaguguuugugcuacaacuucaugugaucuugucgcaguccagcuuacugucccagcagccaccucagugauucgugucucucugcuggguauccauuguugcagcacuuuaaacaugcucuuuuucagugucaggccccagguuuccuccacagcccuguaaaacaaaaacagcagcuuuuaguguucauguuggacacugugacucuguuaagcuuguacacuaguucua

SEQ ID NO: 3177 - RNA, 8645 nt, Mus musculus
ugauaagaaagcauuuaauugggggcugaggguuagucgauaaccauccuggugagaagcagacaggcauggugcuggagcagaagcugagagcuucaccuccugauccccagggcugagcaaaugagcaacuggaagagagaaagagacacgggcuggcgcgugcuuuugaaaucuccaaguccaccucccauugggacaccuccuccaacaaggccacaucuccuaauucuucccaaacaguuccacucccugaugacugagcauucaaauauaugagccugggggaggggcauuuucauucaaaccaucauacauaaagcuuuucuuucucugaccaagggugggugaagucaaccacuuagggacaguggacaaaggaucgggugagaggagaagagugugccucuccaugcucuagagagaaccagaggugcccagcacauucucagacacacaugguugagaacaguauagaagccguucuucuggggaaacacuguguugcuauggagacaucugucagccauaagaaaaaccauuuaggguuuuagcacccaauacacguagaaaacagauuucucugucaaaggagacaaugaugugacccucacaggucugccugauugaguacagagugucaggacuuugugucuguaugucucuagauguuucugauaccugcuugguagcuugguuguuacuaagcccuauuuaauacuguucucacaagaaguugucuccucacuucuaggagccaagaaagagauucacguauucacagaauuaccucucagcuaugguggauuuucaggacccaaaggaagaggagaagaaagcccagaagaagucccgccaggccuggcucacagccgguggguuccaaguauggggucuucagagcagcacuggaagcagccagcaggaucuuaaacugccacccaucagagagcuaaaugaggucuucagggaggagcagggccucaagucgggggugcuucgggauguccuuccgucuuacucacuugcugcucuucuuuaggaguggcaggaaaacgcacuguuuacuaaugugcugaagccuguguuggaucgggauagguggagcuggagccagcgccaccuggauuuugaccuguauaagaagccaccacucuacuuuaaguugccucgucuuccaucuccaaagcgugcaucugguaagauaacaccucugagcugagccuggaggaacugcaggcagacagagcucggguccacugggcaucuuuagcacugugugcuggguuugcauuuguagucauccuuucuggguuaagaaaccaggauucggaaugggucugguagauguagggcugaaacucaggauaccugggcuguaggucuguguguggggugcugauugaaugcuucuggacaaaucucuuugggcccaauuucuuggcuauaaaaugggagauuagaagguauauuaguagcuugugaaguuucaacacugugacaugggacuggccucuggaccccuggcaagcucagagcagagaccugggaagcucacgaggaacuucuaacuacuucauucuaguucuagaugcugcuggaauuacuagaaaaaagugaauaguaucagaggcauaggucuugcuuaaccagucucccaaguccuuuuguuguccuuuauacagucuguuuauagagaacauauuuuuucuuucucuaaaagaagcugaaacuuuguucagggagaguauauacauuuaucuagcggugagguuugccagaccaaaaauaucagagaaugccagauucaauaaacaagaggaucucucuucuggacuccagagggaccuggcuacauuggaauaguuccacgaaaccggaagcagugauaacuugccugacaggugcucucucccuaaguguggaugcugcuccugaccuucggggcaggcccuuguguuucugagacuggagagaaccugugugcugcugcccccguucagagucaguggugcuguagacaaggcucuggugaaugagcagcacacagcacagaaugccaggcucgccacuggauuccacugcuggccuuuccagcugaaccucccuguaaagacaagaaagaaguucaugugagagcuuacccacucccaucaagaaaaacagaggagaaccgaacuagaaucuaagccucugaaauccagauggguaaauggacagccugguguaacuguccuacagaccaacacaugccacagggcugcugagagcagggguuaaaggcucucccaagcuucccucauguauuuuuccauuagccucucuucacugguucuucaaagguaucuguccacuuguacaaaguuccccuuuguuaauuuguuaguccccuagcugacuuacuaaucucaguaaaguuaauuuccaagucacagcccuagcaggaugcuugggccagcccagcucucaugaucccaaucuccccucugucuaucucaagaauccaagcuaaauagagaaaaagagucggaucuccuuugcuccugagagcccuaaaaccaggcagaggcuugucugccagacauguugcaucaggacccugaguguccugcacagcagcagaaaauugccuggagaagagcagccugcuauuacugucuucugcaaccagcgaggccaaucaugagagaaaugagaacucuuauaugggaacaugcccacauggccacaguucaagguggugccauuucccccaugacugggaggcagcucugacgagaacuccugcugagagcguuagggcugugggagggcacuacuucuuggcucuaggaccucaucucacacagugaaaaaaagggggccuagaggcuaucaacaaaggcuucucagggucgugcaugaaaagcugguuuagagggggucauaggcucaggaccugaagacugaaagggacucaaauuaugauauguuauacucuuuuguugauaagugcuucugacacauuguaagugcauuuuggcuuuaguuucuacgaguaauauggacacagcuucauagcuaucucugauugugugaacuaguagaaauggcugccaaugcuucaauucccuaugagccuuaguuuccacucugguaccgucuaaagaauuggugcagccucacacagcagacagcagcaauugcaugcuauauuuagaaucuguggucuccauaguugcagggccucaccucaaaccuauguggcuucuuaaggaaggagaaagcccuucaguacaugcaggugagagacagucucccuaaugacuccaagagcuccacuuuuuuuuucuuucuauuuucagucaggguuucaaguagcuuaggcuggccuugaacucacuguguagcuggggcugacuuuguacacaugguccucaugccccuaccucuuuuuuuuuauuuucaaagauuuauuuauuauuauauuuauuauagggccucaucucacacagugaaaaaagggggccuagagacuaucaacaaaggcuucucagggucgugcaugaaaagcugguuuagagggggucauaggcccaggaccugaagacugaaagggacucaaauuaugauauguuauacucuuguugauaaguuuauuauuauagauaaauacacuguaguugucuucagacacaccagaagagggcgucagaccucauuaugggugguuguggggcaccaugugguuacugggaauugaacucaggaccuuuggaagaacagucagugcucuuaacugcugagccaucucuccagcccacgccucuaccuuuuaagugcugggauuacaggcaugagccacauggcccagaacaggguacagggaucccauccuuccucagaaugcucuguuuagagauagacacaggcuuauguacacuucuaaaagaccaacuaggacacuuuuuuuuucugcauggagagaagcgugggugacaugucuguacaguaaucucauacacaugggcugaaggagggugguuuuaacgaucccacaaauucccaucccaggaagcugccucuaacugaacucuccucaaagcucuaagagcuuacaaaagaagagaagaaggggagaaagcccugaucagcaauugacuccuggagggagaagccauuuugcuaucgucuguggcuugucagaguccugcaggccauguucuaccuuaucuggauugcagagugucaguagaccaugugugucucuuuccucaguggggcccaaugcccucuccauuauuacuggugauagggcugagcaauauaggccacuaggucaagcagaccccagauacauguuacaagauauggccagaagcuauagagggggaagagcauuccagauagagaaagggacacaggucccauauuccccaggagcaagaucugcagcugcugcagaaaacggcaaauucacaccagcuggaauccaggcauuagugauacaggucaaaggcccauauucuacucuagugaccuccccugggcagacaucagcagggccugcagagggggcuuccaucuacagagaugagcuugagcugccccgccuugcuguugugagcaccacugcucucuuggcagaaaacccugggaacagagcugaaauggccucacagacagugccuggccuugggcccuuuacccccuccagcauuaccucaauuaugcuuguccagcugguacacagugaagagauucugggcauagccuuccaugcagaacacacuagccaauagaaacagcacagcuggggucagaaaggauggccauugagagcucugaagugaccucugaauacugggcaugguggcuggggucagaacaccuggcucaaaagguacuucauacccugacuaagcuucugcugccuggaggaacaaguggcuuaaaaucugggagaccauuuccuucucugugagguagaugccuguuggcugcucugggaugcuacgugaagagcgugcuacccaguagguguuaagugacugcauugcuuccuggacagggugaggaacauacaggcaagccaugaguaagggugcuuggugcaugggcucaucacucaccugccugucuucucucagguaggaggcgaaaggcaaacauugggucuuccggacggcguuggcgcagucgaguugcaucaaagccacuuaguuccccugaaaguucuucuacgcacccucaagacuuauucucucuuagugaccaucaucugguacuaaagacucugucucgccuaaccucugcaucucguggaucuucacugggacuauaccacccaaaucccaccuuccacagccguugguuucauuaaaauguaguauaaggaaggggccauucucaguacccauaacccuguuacaaauacacacugguuccaagagcaaacuguucugugugucuggccugucuuguuuuguuuuuuaaauagcggggcaugugggguucaccugguuaugauuccagugcccaguguggauggagcagcuggcgggugauagcguggcuuucaucuccuauagguggaugagaauguuagucacuuuaacaucugcuguuucucacaguggucuggagcagaugcucauugugaaccccggcugccgccaauggcccuuucagaacuacaccucugcugucucagucacacuuugccuuucagcaucugggacccaugacgaacucucccucaguguugugggagucuggugucgguuggucugucaaugcaaccccaagacccagaaauuugucuaaaacccuaggccagcacuuagugggcucaaugcugcuuuuaguaacaagagcuccacagagcagcuccugcaucuaacccuagcugggugacuccucuuuauuucagggagcuuuucucuaccuggaaauuuccagaaggagacuauugaaacccucaacaugcagguucuacaggccagcugccccagcccauggugaucaguuucuguucuagaucuggccucaaagguggacaguaggcacaaaagaaucauguggcugcugggaugguggaugcugcaucccaggccagcaggguguuuuuaucuuccaaaauuaucuuccaagagcaucuuaacaguuugaccaaauuaauacauguucacuucuagcuugcucacacuguccuaacacgacagacaacaauuacucuuccaaccauauccuaauugacccacuugacacagccaaguaggguuuccagguagacagggcagagauggaaucgggcauugaagugcucauccaacaucccuggagaagucuagaggcuaguuguaucccgcuguaauagaaauacgagaagggaaugcaaaugugaggggcucaugugcugugccuacucaccccaaauugaggugcacaaacaccaagauugccucuccccccaagucuaugauccagcuuaguaagccuugaagccuccaggcaaugauuucuuuguucccuaugccuccuuucagcucucugcaggacgcucacaguguugugagugaaggacuggcagcauggagcucuuguguucgccuaucuugggcauguaggcuccuucuggauagcacgguucccucagauuaucagagagcagcaaccagccauauggaauauaugguguguguauguguguagccagugaggcuuucugcuggggaaauagucuugggacaaaccuagagcacaggguuaucuaucauucuagacuagcugggcagcucaacccucucauugacugcuacagacuccaugaccacugcucaaugagucuaccugguuuccaguaccugccuccaacagaagugcccaggucuuucaugcucagaaccaccuauggcuuccagaaguccugugucagcagagcucuucuccaggcugcuugcuuuccuaacugccccacccagcuuuugaaucucuguucuuacucuguucuacuaaaugagccaguccacaagcaggacagacugacaaacauggaaaaaguuucuuauuccauauggaccuagugcuaaccacuauaugcagucugccacucaccaacugcccgcugugguuaugggaaagguuaaggguuaggaucugagucauggacaggaccuaggauaagaaugagggauuaggguuaguguccuaguuagacuuuuugucaguguaacacaagccagggucaucgaggaagagggaauuucaauggagacaauaggcaggucuucgggcuacuuucuugauuacugauugcugugggauuggcgucaccccugggcaacuggucauugguugcauaagaaagcagauuuagcaagccuugaggaauaagccagaaagcaacaucuuucacagccucugcaucgguuccugccuccauguuccugccuggaguucuuggccugacuucccuucugccccccaaguuaauuuugguuuucugguucuguauagauuucauuggaguuuugauuaggaagagggacaaagagcuccaagguccccaaguucaucuucagccuccuaaaguaaggcuaagguuuaaguagggggccagcauuugaauaucugagccaucuccaguugcaagguguggcccugcccauuacugcugagguucuagugcuucagcaaggcauucugacaaauugacgggacugugaaaucucuccgggggaaagucucucgucuugaugggucugccuuuugacuuuuuaauccagcaugagauuacuaaggaaaauuccagucucuuaaggcccacuguucugagagccaaaaugagggucacagugacucuuuagaauaacuccauuuccccuaggcuugugacaagguggccucuuggggaagagaagaccuugugccuccuggaggcauuaggggauaagacuccaacuccaugaccuucugcagaguccuguaguacaggcuuuaauauggaagagaaagcccuccagacacaggccuagcugaggcuguccucagccacaagaaaggaaaagaucuuaagagagcagugccaaacucugggccaggcuuccuccaaagagaaaguucccucuagcugggagcccugagcuuagcaacuggcuucuccauagaaaagaccaccuuuccccuccaucccgucccuguagguuugccccccacccucggacccuagguuugcuucccccaguccaggccuccaccaaagagaaagacaggccugcuacagaucccagccagagaauaugccucuuuuauagagaaggaagauucuccggccccgugggccaagugucugagccaggccuuugaaaauagaagcuccacuggcugcagauccauccccaaaugaguauggggcgccugcacaggaaaguuaaugacccucuugaggcugaacccuaaaaaucuaaguccagacauacuucuuggaguagggaagacaguccugccacggaggccuuauucuagccgaagcugucuccuuauggaagagaaggggaagaagcagauacacacaucauacuccauugggaaaagaacaucccccuguugaagucacagggccacgggccagcacugugguucauuuaaaaacucaggccaacccu

SEQ ID NO: 3178 - RNA, 1187 nt, Mus musculus
uauaauuaacauauauauguacacauguauauccaaaaugcuugggaugucugauuccuucccgaaguguguggaacaaaggacaaagugcuggucgggggugcuauaauggaggaaacaaaaugauaaugcuuuucaacugggauuuguacacaaaacaagaucugcuuaucuaauagucaagggccgcugaguuugcucuucgcuccaauauggcuggguaagguucccauggcaagcgccagacggagucaauacuacauuucugugaaagagagaagaaaagccaguuagcucucaagagcaagcaggucugcccagcaucuuccagaaucaaguucuagggcaccaaagaaaauaguggccaaacaacuguuuaccucaucccagccagcggaaggagcucaggccaagcaaccaccuggagcccaaagguggccgcgguagacaaccacuuuccucucaccaaaacucuaacuucauccacguccaaguuuguuuccuccucgguucuaguuacgaggagggagggagagcuuaggaagcagucuggagaagaggcagagaacggccggccgagggcugggaauugcagaacacaacagcaggcgcaggcgcuccagccucuggugacaauagcggaaaggccuggagagggcaaaagaacugagucaggaacugguuacagugauggggauggggauagggauggggagcgauggggagugcaggucaaggccauuacuagagcgcguagcuccagcgccucccaucgggacaaacacagacguccugcacaguccacgcagcugccuggauacggucccgugccucucuggccugaccguggccgcccagccccucccuccgcggacgcgggcggcugucugaaggcgccgaucugccgagagaaaccgccaggguuugggcauggagagcucggcgggugacccauaccggcgaccugcgcggcgcacucaguggcugcugagugccuuggcucaccacuacgggcuggaccgcggcguggagaaugagaucguggugcuggcuaccggucuggaucaguaucugcaggagguuuuccaccacuuggacugccggggagcgggccgccuaccgcgcgccgacuuccgugcgcucugcgcgguacuggggcugaacgcugacggggagacggccacgga

SEQ ID NO: 3179 - RNA, 1187 nt, Mus musculus
uccguggccgucuccccgucagcguucagccccaguaccgcgcagagcgcacggaagucggcgcgcgguaggcggcccgcuccccggcaguccaagugguggaaaaccuccugcagauacugauccagaccgguagccagcaccacgaucucauucuccacgccgcgguccagcccguaguggugagccaaggcacucagcagccacugagugcgccgcgcaggucgccgguaugggucacccgccgagcucuccaugcccaaacccuggcgguuucucucggcagaucggcgccuucagacagccgcccgcguccgcggagggaggggcugggcggccacggucaggccagagaggcacgggaccguauccaggcagcugcguggacugugcaggacgucuguguuugucccgaugggaggcgcuggagcuacgcgcucuaguaauggccuugaccugcacuccccaucgcuccccaucccuauccccauccccaucacuguaaccaguuccugacucaguucuuuugcccucuccaggccuuuccgcuauugucaccagaggcuggagcgccugcgccugcuguuguguucugcaauucccagcccucggccggccguucucugccucuucuccagacugcuuccuaagcucucccucccuccucguaacuagaaccgaggaggaaacaaacuuggacguggaugaaguuagaguuuuggugagaggaaagugguugucuaccgcggccaccuuugggcuccaggugguugcuuggccugagcuccuuccgcuggcugggaugagguaaacaguuguuuggccacuauuuucuuuggugcccuagaacuugauucuggaagaugcugggcagaccugcuugcucuugagagcuaacuggcuuuucuucucucuuucacagaaauguaguauugacuccgucuggcgcuugccaugggaaccuuacccagccauauuggagcgaagagcaaacucagcggcccuugacuauuagauaagcagaucuuguuuuguguacaaaucccaguugaaaagcauuaucauuuuguuuccuccauuauagcacccccgaccagcacuuuguccuuuguuccacacacuucgggaaggaaucagacaucccaagcauuuuggauauacauguguacauauauauguuaauuaua

SEQ ID NO: 3180 - RNA, 49948 nt, Mus musculus
cuugagcacagagucaauacagaaauguuuaaugguugaauuguacacugucucugacauauccaggaaggcaacuuuucauguuucaaaaauagauuugauagaaagacuuacaucuucauaaauagguaaugugaaaaucuccccaaugugccuggcacccuugggcuggcaagucugccccugcccaagcccugcaggggggaguuuggcuagaggcccacugcuggcaguauccugggacagggcaaccuguucagugugaaccagggguuucggguagauccccuccaguuggggccuguguccuuggggacagacuuccacccaaagagacaugaggucccuucucuaguaccuuuaguggacaggaccucucuccugcugcuaccacccuggcccuaccagcccuucuguggguacuuccuccccaacagcaacagccuccaccuguuccugcuguucaguaacucuucaaacaagggaagagauuaaacuucuauugccccagaggcccugggcagcuguuggcaggcagccaagccugcccaggggaagggaagcagcugguuuguuucuaaacgggcauugcuuauguucugguccucaagcccugggcaccuuccgacaaaggcccaaaggucgcucugagcacuuugguggggcaggggccucagcagagggccugagccuuggcacuacuguuagaagggacggaugcagcuucuccauagaagccagcuucaguccaggacucagggcccucucaggccacagaauuggggucaagggaagaauucauccuugcuaggaugcuggggauagggccuguggcuggggagggcccaucgccccucaaagaugugugcuuugggucacuugugggaguccgugcuguaagaaggcagguuggcugagagaccugggagagggggucacguuggccccagacauaacagcgagcagagagauaggcaggcuguggagaccaugauuauccccacuggcugagggcccugggccuggccuuccagaccugcaccuggcagugaaacuggaaccuggaaagugagacaguagggugguuacagggcagggcugggggagugcaggggucaaggagacugguguuugugcuaaacucuuagggcaggaccgcuccuacauaagggcacagggcaggaccucauccgcacccggcacccagggauugugaaagggaagugagguuaucguccugugaaugaagaaagaaauaaucuuccugguugcugggugagccacggggccaccagugaagaagcuaccuggccaagcagagcccacugaguucuguuccacuccagguuaggcccuucuggcaguccucaacuguccuaaugccgccacauaaauacagcccucauggugugguaacccccaaccacaaaauuauuuucguaccuacugaacuguaauuuugcuaauuaugaaucguaauguaaguaucuguguuuucugauaggcaaccccugugauagaguccuuugagcucacuaaagggguugagacucacagcuuaagaaacacugccucacuggcuucauggcuuccagucuuuggaggcuagaaaagugggcucauggcccaggguggcaagugagccccaucaccagucaguugccaucuugugaaggaaaggguagagcucuguuuagggcaaaaggucucugaccucccucuucuaagcccuaaguacauuggaacccuaacguccugcugggcucagcacugguaucgcuaaagagcaaggcuugcuggguaguaguggguagcuauggcagggucaguaucuaaacucagagagacagacacauccuaaaaaugggacuuccauuugaacaccugaaccaaagaccuggcaaacuccccaccacccagcagggccaugagaggcugccuuccugaauggcucuggagacgucaaccccccagguucuacucauggaaccacagaugccagauggcucugaagaccaugugcaguacaaagggcaggcucagaguuggguaguacccacccguggguggagucaggcucugcaggggcggggucagggaaggaaccagcucucccugauaagaguuugagccaacugaaaccagcaagcaggacucucucaagugcaucgggcccaggaaaggaagacagucagcuguuuucugauaggugaccccugugaaaaggucacugccaugcccccaaaaggaucauacggguuaagaaagccuuacgggcuucaugguccccagcccuuagagccaugcagcucuaacccaguacagccacagugauccccaccugagagcacucagagcagacccugauuccaugccaucagagccaggcucagcuaguacacaggcugccuccuaccugaaggggaccccagugagucuagcccuguuuaucuaguucaccacaguucugucucccugggcugccauguagcuguugcaaagugcccuguggccagaucucccuaggaaaggugcugacagaucagaaugcuugaggugggaggcaaggguaggaugucagcaggaggaagaugcggggaacaacuccuucugaccccagcaggaagcacccguuaaggcaggcaggucucaggccagugggcacucgucuuuuuugcuuugaaacuguaagccagaccaggaccacagggaacuagaagcucuggacagucgucgcagggauggcuucuccacacggggcaaggcuggcauccauagggcccucaaccucagacacaccccagaagcugcuguucuguuguuuuuggugcugaggacugaacuuggggccuggcaugugcuaagcaugugcucuacccacgagcugccccucgaaagcugcuccucuguuguuuuuggugcugaggacugaacuuggggccuggcaugugcuaagcaugugcucuacccacgagcugccccucgaaagcugcuccuuuuuucuuaaaccuccacuuuccuaucucacccuucaaccacacugaaagauuagcugcuuuugcaaccugacuggcaacauuuugggccuuaagcccagagacaguucccaguuggccccugaccaugacucuacaauugggucagugaaaaugggaugcuacauggaaaagaaaacaucugagaggucuugguaaggcaucgagccaggcccagggagcucggagcuccaagcuggcagugaggacagaugcugaucccaccugaugggcucaggccuccccgggacaaggcucggcaccagucugugggucuaauugaugugcuuuuuauacuuugguaagaggcaggagaaugaccuggaagaaccugggguaccagccacaucccuggagagcagcaacccacugcacgucugcagcagucaaggcaggagaaggucaacaccagcacgaggcaguugggcagcacagccagcccauuucccaccacagucuaugcuggaggcucaggcuaguccuggaaugugaagaacaucgagagagcagaugcuggcuggugggaugguccacauccugcccuggaccgauagccuucuacacaggauacccugcauagcaucucccuuccuacacagcauccaggccaggggugcagaaucccucuagagaagccagugcccgggagggcugacucugaaggguggggcuugacaggcuggagacagaggaggaggggaggucagcacccacagccccagcucuccgcaauguccuugcuguccagcuggauguggucuguguucuucucacugaacaugggaccuccgugccucaugaugagcuccguggccacucuggugaaggccuccuccacauugcuggaguccuuugcggaggucucgauggcacagaggaugucauagugcucagccaggcucugugccuccgccaaugggaccucccggaaaucggcaaggucugacuuguucccuguggagaaaguccaaggaaaacaugguaggagccacaggugccagaccugcacaguccuccccagcaaagccacacuaaaaguccccaggcaugaccccucccccagcuccaggguaacacugcuagguguggugacugacuuaaaauaguccuuuuuauuuuaaccuuuugaaaaaauguucugcacaugggaguuuugccuggcagccacgaagaccaggagaaggaauuauaugccguagaaguggaguauaggugaucugggccaaaacguaggugcugcuggggaaacucaggacaugagggagcgcucaaaaccacugagccagcucgccagccaugacuuuaaucuuuuuuaaucuaguuuuuggagacagguauagcuguggcuaacuagaacacccucuguagaccugucuggccuugaacucagagaaaccugcuugcuucugccuccugaaugcuaggauuaaaggcgagcaccagcacacccgccacauuuuaaccauuuguaacaagaguucgaagcugggccaugguggcaugaacguuuaaucccagcagucaaagaggauuaaagaggcaggcggaucuauugaguuugaggccaaccugaucaacugagcaacuuccaggacauccaagguuacacagagaaaccuugucuugaaaauaaaccuaaaauaaauaaauagauucauuaauuaagaguucucacuagguugccuaggcuagacuugagguuguuaacuauagcaaaccuccugccucucagccucuugagagcuaaggcaaguguaaccaccaagucaggcugccuguauuuuaaagcuccuacuuucagcuggcaagaugguucagugguggguugaggugcuugcuguuaagcuaaguaacccgauccaauccccaguaccuacaagcuggaaaacagacuguaaguuguccuguggccuccacacgugugcuuugauguguguguaugcccauacauacaccagauagaugacugauagacagacagacagacagacaaacagauguagguagguaggcaaguaggcagacgggcacauagacugauagauagauuuuucuuuuuucuuuuuuuuuuuuuuaauguuuaaaacucauucuaggccagcaaaauggcucagcagguacaggcacuguugccaagucaagccaucuggcuucaguucacaggacccacuuaguaaauagggagaaaugacucuagaaguuguccucugacuucuacgagugcauugcggugcaucccugcaugcucagacuacacacaaaauguaguuuuaaaaugcaaauaaauaaaugaauagaguucuuacucuauggcaacucaucuuguuuucuuuuuacugcuucuuccccucugcagagcuggggaugaaaccuauaaccucuugcauacuagcaaacgcucaaccucugagcagcaagccggccacaucgccuccucugagcaugagaaguugcgcugucugcggacacaccacgccuuaacagcuagaugaucuggugcauacagagacugcacagccaaccccagcacccuucaugccuuccagccucaacggugagucuaacuuugaauugacaaggggaauggguaucugcaagcuccuaguucagcuuccagcuccuuuccugucccagcucagccccucucuaggcagguuuaggaaagaaaaacggaaaggcagagauaaggcuugcuccaggccccuccagccuccaucccuagcucaccaaucagcagcugcacgauguuggaacccgcguacuuccucacauccucgauccagugaggcacugacaagaaggugcuccucuugcugaugucguacgcaaggauagccccauuggcacuucgguaguagcucugggugaugguccggaaccgcuccuggccagcugugucccaaaucuguaacugaagggguugacccaacgacacaugucaaagggacaggaagggcagccccacagacccaugcccagaacaguguguccacuaaagguagcucacagcaacaguccucugucagccuuagaaagacuggacuuagaaagacccacaguggagagguggcuuggagguucagagugguugcugugugaucccaaggaccagagcuuagguccuagcucucaccuacaaaccaggccucccacacagcuggaaccucagcucuaauggggcagagacaggaucauugaagcuugcuggcuucuagccuagucaagaaaacuuaagccccagguucagggagagacccugccacaaagggaauagauaggaagcaauaggagaguaccugagagagagagaaagagagagagagagagagagagagagagagagagagagagagagagacagagagacagagagagacagagagagacagagagauagagagacucagagauccaguaugaagaaagaaauagaaugggaugggggauggggacagggaggaaccagcuugccucacaacaagaggcaauucugcacugcguccuccauggaguggcucuccccuuaacccugauuucagcugcagaugcugaccaccagaucuggagguaaggaauuggcuccaaggcugcacugaggcuaugcauuuaggucuuuucucugcaagcucacuggguccuggucggauagcuuugggccugaugaguccacagcugguggugaggaagcuagacugggcagugugccuguugauccaccuuggccaaagcacaggguaaagggccuuucucugccauuuacuucuucauuuaacaaauguuaaugcccuauguuaggcacccugcuggacuaagcaauggagaggcagugugcaugugaugaucucugccagggcuagcuaaagaacaaauggccaagaagucucgauaguugauaagagauagccauuuuuaaaauccaaggagacccgacaaaucccaagcagaagaaacauaaugaacuguagugggccauagccaaacugguagggggugggggugggggggggaggaugaauaggaaacaaaagcaaaauagcuagaccuauacuucuuccugggucacagcagcaaggcuuuuguccuggauggucacuuccuuuuucauucuaaugaacgcucagucaacaccuccacagaguagccccgucuacucccucagcccaauuucuuuuucuuucuuuuuggacaguguuggcaacucaggaucacacacaugcaggcaauuauucuaucacugagcuauaguuccaacucagaccccaaguaaacacucuuugcuacacuuaagucugacauaacacagacucacagacacacagauacaaacacacugacacccagauacauagacacacacagacucacagauauacagacacacacacacagacacaaacacagauacacagacacucagacucacagauacauagacacacacagacucacagauauacagacacacguacagacacagacacaaacacacagacucacagaugcacagacacgcacacauagacucacagauacacagacaccagacacacacauuaucacugccccacccacuucaugugagccccaucaaaacaggccucuguuuaucugguuuucuauucucaggcccuagcacagugcuuagcaugagaagguguccaauaccaauaaaaauuggaggacggggugcugugucuaucccaggagccuggccuaugaucagacucaaagccccaguuucugacagcuaacugcggaucaauuugaguguuaugaaagcugagagccuuuuuuacugccaagaucagccucaaacugccaagaauaccuaccagccugacaccaccccagucccuaccacuacauggaagccuggcagggcuuggugcugcacccucucaccugccauacccugcgucucaaucuuucucagccgagccuucucagccuguaccugaccuuuaggagaaauucugauuucugauaucuagaguuguguccauaagcaacuguaggccagagcacuucugagucccaaugagguaaaaaacggacucccagaacacacauguuuauaagcaagguugggcgggugagucucagucccuucucuggcccuguaauggaaagacugggaaucaccauccucaguggggauggggcuccuaauuucuuuuaagucccacacuuaauaacucucagccaaugcuggcccacaagucuccacgaggcccugaugaagcaauguaccuguaucaccuaccuuaguacuagacucuucuacccauccucuaucaccuuggggcagcucucccugacacucgugccccagcccuaagcagaaguaacuccugugccugucucucuaacaacucaugccauagaacacaucuauuuaccaaguauccaucacgaugacuuuaggagcuaggcaaggaacaucagccacagcaacacacacacacacacacacacacacagagagagagagagagagagagagagagagagagagagagagagagagagagagaagcaggggcugcaagcugcuuuccagggauucauggcucacagucccacuggguaagucacauggcugcaguaaaucaacccuguuuauuagguuaaaaacaucacuggaaguucaguuccaagaccugugcccuguccugucccucccaauggaaagggagccuguccugaguaaguagacaguggaaaguuccagagaagagaaccuuggaaaaguuaguucucagggcaaaaauugagauggucaggcugacccaaauacgaguuccugagcuauuuuuuaugaugucuugggacgugagucaaaccaggagguagugucugagggcuccuccuccaaccagccuccucugcugugcucuguccucuagggaagagcuuaacugcagguucuccaaugcugcaaacgccccauuguguuauacuaacugucaaaaggcaagaaucauuccaagggaagugcaguaggugggcaaguucagccugcugucuggcauccugcuuuagaaaaagaggugaguaggugacgggaguuccccuggggcuggcauggcagccucacagcaagccagggaccuguugcuccagcuucaguagccaaaggcuuagcuuacgucuccagguccugaggcuggagguucacugcucuggguuuuaauuagcagccacuguaacccucaucucccacagcuugcuucacacuccuuaaugagauucaguaucuggagcuuuaguuccuacaguggugagugucacagcucucgggccuaaugugucuaggacccuggccccuuaagaccuggcagcuccucggaaaucuucaagcaacuguagcuagcaguuucucaucccugguucuucaaagccuucuaucucucuuugauaucuccauucccacauuucuaaccugguguucucagcaacucuucagccacccucuuacugcuccugcugucacugcuaccauagcuuuggguuccacccucaccucuucaugucaccaucucauucuacuuuacuaaugauaaggaccaaaagacaguaagaaaagcgccuucaggagaagccuugcauuugagcuaaugcugcaaccccaggguucagugcaaaagaguguccugcagcugaguauaaagugaacugaaaugacuucuuauauacccagaaaggcgcugugccaaggauaucugcaccaucgccauguuggugugguccuucaaacaaaucaagggccaugugugccucaaucacaggucuucugcugagccgccaguggcauguucccccuucugucuguccucuguggaaauggcugcuagaguucaccacgcuugugguggcaaaagucuagugcaagcuguuugaagcagucaggacgggggugauggcuuuggaguaggaggucugcuagagcagucaacagcuuuggcugcuguauggcuuccucaagaaauccaugaggccaaucagagccagcuacaugacugauaauccuccacucaaggcagacaggguaccaggcaaaguuuaauagcuaucaaaucauguuggccccuguagugcuucgaauagguuuggccuccuuacgcucauguguuugaaugucuggcccauagggaguggcacuacuaggagcuauggccuuguuggaguguguguggucuuguugggggaaguaugucacuguagggcugggauuugaggucuccaauguucaagcuacacccaguguggaacacagucucuuucuaacugccuguggaucaaaauguagagcccucgcuccuucuccaucaccauguuggccuguaugcugccauguuucccaccaugacaguaauagacuaaaccuuugaagcuguaagccagcuccgauuaaauguuaucuuuuguaagaguuguuguggucacgaugucucuucacagcaauagaacugcuaagacagcccccaaaucuuaacuuauuuaaaggaaaaauaaacauuauaaaaggguaucuaucauuaucacgauaguucacuggcuguauuuaacaguacuuaacucuaacccagugcccagaggaaaagaaaaguaagaacucauugaucugaggacaucggcgaggcagacaagcagggguugagaggagccaguaucagagagauauggacaucauguguacccagaauuccucccaggcccucaacaugguuuaucaaggcacggcaucaggaagcaccucagucccuugcagcgauguggcuccuacaugggaguucauggcaaugccaggaagcgugugacaaagggcagcuaugccagccuuccccagguuuccuuaucacacucugcgcagcgucagcucaucucacagccacacuaagagaucaggcccauaaugccuugcacccagacaagcagaacucagcagagggccuagagcugucagcaucucggaccugucaccuaucauugucacucuaggaucaaucuuuuuuguuucuuggguuguuuauauccagacuggccucaaacccucuauguagccaaaaguaaccuugaacuucuucugagccuucugucuccauuuucucucagucucaggauuacaggcaugugccaucauuccuaauuauucggugcaggggacagaaccauggcuuccugcauugcagcauguccagccacaagauuacuccuuccaucuucagaguuguauucccaaucugcagcccuagccucucacugugugcaaggcaaggaaaguuuuuucagcaaaucucuucagugaguuacaucucccacaagcaucaaacccuugccugaauguccgugaggcaaacaagucccugccucagauacccccuucuucccuuccuggaagcucagaccacccacccaccacuagccauggagccauagcaccaagagccuggaacacaggauccuugggcaccuggcccaguucagaugggcaccaccggaccaggacaacacccaauagaaggggcugucaguuccucgugagacugugccuaucagaagagccuucuguggcaagaauggcauucuuaaaguggaagccaugaguucugcccucauuggcccucagagucuccacgguaagucucuaaacucaagcucucucuauuaccagguaaggugauguuuguuuguuuguuuguuuguuugaaauagagggugugaaguaagcugggacuaugugcacucuaaacaaguugcucuaccccgagcugcauccucugucuccugggccuucuuaauuuuccugacauccucaguccaaugcaccacaugacaggcucaacucuucccaccucuucgccgcccucccugugcccugccacucugguacuaagaaagugacaccagcuugggaucuuagcuuggccuuggguccuucggcucuccuccacaucaaccucagaacgcagugcccggcugccucccaggccucccagaaaaagcugaccacuuuguuuccugcugcccucagaaaacaguggacacgaugcccacaggaucacgcuggccuggagcaauccauggccucaucucuccccacccucaagcuguauccacgccuuucagcauguuucuauggucuggcaugcauacagccauggcaucugaacccccucuguccccccucuuuaggaaugaauacuccuccauuuuccaacgccucccuucacccuccugucuccauagcccuggacaaggaggacuguugcuuccucugggcuuguccaagcacgagacauacauccccauguguccgcagcagcuauagccaccacagggcccugcacuauaguagcuaucuucacuaucaacacucuguccugcuauggcccuguuggcaccaaguguguccacugucuggcucagcguuccagacacuacagugacagaauuaaguaccaggugcugucugagaugggaccugaaggaaagagacugucucugcugugccuuuggcaaacaaauccugccucaguugcucagaaugggcugacugcucccaacaccccuucuucccuuccuggaaacuuggaccaaccaccuacaaccagcuauggggucacagcaccaaggggagaacuggagcacagcaucccucccaggugccuggcccaguucaguugagcaucauggaaccagcauucccaagagaguugcccacuucaggacuuggaccacugacugagagaagguacuuauggaaccaggaccaaaccacgagccagucacaggagaauuacuguccugauucggagcugcaguccaagccucuagucaacaagcacaagaauccacagaacaccagcuaggucccaugcagcuuccccagagcucuuacgucaaccaccuacugccccaucaacagccugaaacccuggaaagguuucuuucccuucagagcuuggagugauaccuugggccuugaacaggcuaagcacagacucuaauaaguaagcuaccccaaaggccauggcucucagcaugccaggaagcaguuagaguuagaaguuuacccuggcacuucaggaauaaaauuauuuuucugugugauuucuucuauguauuucacagaaauuuucagguacuucccccaauuuuuuucuacauauuucaacuaaauacaaacauagcagauauuaacaagucauaguuagcaaacugauauuuauucugacaacuguaauuuuugguggggggggcaggggggcucaugaaauuaguaucccuaagugggaagggaaucaguuucucauugaaacuauacaaagaguguuucuaacuuuaaaaccuacugugcuggaaacucaggucagugguagacuucuuguguucuguugcaugggcccuacacucaauucccagcacugcaaaguuaaguuuucaaaaaaaguaauuugggagcuggcagaagagcuuauguuaggccuuguauuugauccucagcaccaaaagcucacccaguuucuacacccccucagccauaccaauggcaaucaagcaguuagcuggcgugcaaugacaagcauucuuucaggagucgguuuagcagccucauagacagcaaacugccgccccccccccccccccgcgccagggucugaccucccuuaugcuguuacagucugaguauuagguauccccaaggcccauguguauauuggcuggugaccggcuuguggcacuaaugguaggcggaagaauuuuagaaaguggaacuugguagaaggaaguuggaucacuggacacaucacacacacacacacacacacacacacacacacuggucuuuugccugcacguauauaugaggauaucagaucccauggaagaggacuuauaguagugagcuuccaugugguugcugggaauugaacccaaguccucugggagagcagccagugcucuuaacuagccaucucuccaaagcugaggacaugagcuugagaucucucucucucucucucucucucucucucucucaucuuccuuagcuacaugcucccgugaugcauuugacuuaccagcccaaagcagccaaggaaaucaccuaagagccucugaaagugucaccuaaaguaagccauuacuuccucugauuggguuuuagauuuacuuaguccccuuaaaaagcugccacuucaaaaaucaaaaugggcugggcagugguggugcacgccuuuaaucccagcacuugggaggcagaggcaggcagauuucugaguucaaggucagccuggucgacagagugaguuccaggacagccagggcuauacagagaaacccugucuuggaaaaaaacaacaaugacaacaacaacaacaaaaucaaaaugggccagaguggcccuguguuaagagcacuggcugcucuuucagaggaccagguucaauugccagcacccacauggcuucuccuaauugucuguaacuccaguuucaggaaugucacaccugcuucugguuucugcagacacagacguacauaugacacacauacaugagggucaacauuuacacauaaaacaagauaaauauuuuuaaauguaaaaagagccaaguaugguggaguauaccuuucauccuagaacguaauagacagaggcaggugggucucugugaguucaaggccagccuggucuacacagcaaauuccaaaacagccauuguaacauagaaaagaaacccuaucucaaaaaauaaauaaauaaaaaaaaaggagaaagaaaggagaugagacacauuuaguagaugccugucauggcccacuacaugucagaauugucucaaggccugggugugcccucuaaccuaaagugaacccccugacuauuuuuuacuuuuuacaguguagggaauggaacacagggcaaguaaagacucuagcaaugagcuagaaccccaagaacugguuguauuuguuugguggguuguuuaguuucuuguuuuauuuuuuauuacauuuuauuuauuuuugugugcaggaaaguuaggagagaacguuugggggugaguucuuuccucccaccaugugggucaagcucaggucauuaggcaugguagcaagcaccucuaaccacugagccaucucacagacucccauugguugcuuuuugagacaggcuuugaacauacaacccucuugccugaagcuuaugaguagcugagauuacaggcuugugcaaucagaccugauaagcaucaguucuuagauuuuuacguguguucaugaucagcaaugccaucccaaauacagaauguuaaaccagcuacagugacccaugccuuuaauccuagcuaccuaggggcugaagcagaacaaucccuugagcccaggaguaccaggccaagcuaguaacauagauccuaucucaaaaucaagcugggcauggugauacaagccuuuaauccuagcauucuuuaggcagaagcaggcugaucucuuauacugccagugccaggccaggcagggcuacauaauaagacccugucuucaaauaaauacaugaauaaaugaaugaaugaaugaaugcacagagagagagagacagacagacagacagagacagagacagagagagcaaaaacauacaggugugacuaaagguuagccaccugacugaauuuuugacaucacagcuuagaacuuaaguguuuugaugggugcuguuccuuucagagaggguuccuucugaauguucaaucagccacaacacucuacauccagagucuuuuuugaaacccuauauuuuccucuuuuggcaggucuucagggguggaucugaugauuacagacaggaagcaggccacuagggccugccauugugucaguagucaacucugguucaaaugaaaccugaggccaacaagguggcucacaucagcauaggaaggcugaaacaggaggaacacuauccugccuagcacugcaggauccuggguucagucuccaguaccaaaugucaaacagcacacugaggacuggcuuccccuuuuuccauccaggaagaggagggcucugaaacaaagugauauauauauaaugaaggguagaagaggccgagugugggcaagcuccuaaucccagcucuuaaaacaggagggcugucccaaagacaaagcuacccugggcuguccagcaaguacaggccagccaggguuacauaacaagaccccgucucauccaaugacaacaaagaagauauuaaacaggauuuacgaagcuauuaacgacaaaagguucuuccucgugaacuuacagccggcuacagguuccuuaucuagcaggauuugguugguuuucuauugcaacgugaauaaagcauuuuguauucaaacauuuuagucuccaaggcaaguuuucucuuacccacaguggccauuuucaacacugcccaauucaacugaacaagcauuuguuuauaauaagcaccugguguuacaauguugaaacaauacugcucaucaaaauguacaacgcaagugaucuaugauaaccagauuuuauuucuauuuuuuuaauuuuuaaauaacauuuauuugggagagggaagugcgugugugccacagucguguggaggucagaggacaacauucaagaguugauucucuccuaccgugugggucccagggauugaacucagguugucaggcuuagcagcaagccccuuuacccacugaaccaccucacuggccccuugaccagauuuuacacugcucccaccucccucacuuguugcucuugugcgcuugcugccagugauggagggucuaacaguacaaggacagaaaaguucccgacuaggagccaaaaggcuaggcucccauucuagacauccgcauccggacuaccucuccuucccuuguacaguggagacacacacacacacacacacacacacacacacacgaguagagcaacgaucagauggagcacuucgugacaggauaaggugcacacacacaagugcugccccuccugcuacugaccuuuaaacaugucucaugcccaagugcgcaaagaaaccucgcaggagccagauguggcagcugacacccaaaauaccagcacuugggaggugaaagagaggcucacaaguucaaggucacucuaggcuacagaguaaaacuuuuaucaaaauaauaacaauaauaauaauaauaaaagugggggagggaaagagaccagagggaccagagggaggcaggucaguaacaagccgagaggccacccuuccugacucugugagauacuuccucucuuagacuguacauagcaucacuucccauugcacugacaauccacuagggcgaagucugugaggggaacuuagagaauggugaguuagaagaggagucaucauaugcccaagauaauaugugcuugcuucuacagccugcccauucucucucauucucucucauccuccucucuucucuucuucuuucuuucucucucucucucucucucucucucucucucucucucacacacacacacacacacacacacauacacacacacacacacacacacacacacacacacacacacacacacacaaacacacacacaagcgcugcgugaggacaguaagaacccucaggaggcaagguuuaguuuacaaugaggaugguggccauugguaucaagaacagauuucuucauaaaaucacugugaccuagaacgucucuuaucuaacaguccugcuauuucugagcagauccgaaaaagucaaauugauuuuaucugaauaggaaaugcacagacacaaaaccagauccuagacuggaaaaacugggaaggcaaacaaaaacuucuggguugggaguguaucucaguaggggcgcacuugucuagagugcauggggacccuggguuccaucagcaacacugauacacagacagacagacagacagacagacacacacacacacacacacacauuuccuuuuuccuuuuaaaccuucucuaucccuacuugggaaguaacaggaggagccaugaaaacaaagaacacucuagaggcggagaacagccugagucaaggacaaugagcuggaagcccugguccuaagugagcugguaucuccaccaaguggccagguggcccgagggagccauguaaagggaugaaauccuaaccaggcucccuauacccaggccugagugccuagugaucugcacaggcaacuuuauauaacaggccuuugugcccacagagaggaagugagcagcagcaggaaggcaguccaggcuuacagcugagcuuuccuggggggcaguaccuggggaaugaugaggaggagaagcaagcuggccaucccuacucauccagagagaagacagaagcaacaauaagcaagcccucuuauuuguuugcaucauaaauuuuggcuuuauuuacaauauacuugggggauuaaaaaaaagugggcaguacuaauugguuuuugcuuauugggcuugggguagcuugggaggaacaaaggaguaagggcaacuucccugugugucucuuauuaagucuuugacuuucuguaaucugaacuaucugauuacaucaucuauaaaaaagaaaaaaucuagggaggagcagcaagauggcucagggaauaaaggggcuugcugcgaagccuggcaacuugaguucccuccaaaggacccacacuguggaaggagagaagguuguccugugacccccacaagccugcugauacacaagugcaugcacaugugugcauguacacacauacacacaauaauaauaguaauaauacauuuaaaaacauaauuuaaaaaaaacaagccaggaaaaauuuaaauauuuuuaaacguguucacaguuuuucaacacccuucacaaguaggugaguggucacuagucccauuucagagaggaagaggccugaggcuaccagaaaggacuccaacagcagaggcagaaaggagacccaccccuucagacucuccaaccagagagaugaacagcauucagauccaugugcuauguccaguccucagacccaaaacaaaugcugcagccaccucaaaugaccauuuuaaaaggccugugaacuuccacagcagcuucugagaacugagugggcuauguuuuaaaaaauguaucgugugccuauaugugaugugugucuauauaugaugugugucacacgugcaugcucacacccuggugcacacaugccauggcacauauguggaggucaguggucaacuuucaggagucuguucucaccuuagacccuggguucgggcagccagggcuuuuacuugcugagucaucugaccagccugaauggcccuaucucaauguucccauuagcugauaaacacccugaaauauucuggugccagcucuuauugaaaauauuuauaagauuccuagguauaaaaauugguuguagugauagaugucugaagccccagcaugugggaaguagaggcaaagggaucaggaucacaaguucaagagcguccucggcuacauagugaguuugaggccagcccuagggagagagacagacagacagacagagacagacacacacacacaaagagagaggggggcagagagagagagagagagagagagagaggaaaaacaaaacaagccagcccaagugcaugcucggcucucagugagacaauaguugauuggauucaucagccuucagaacuuuggaacgaccuuucuaggcacagagggaaucagaaaguaagcacuguacccagaaggcagccaaauccagaguucagauccugauguugccccugacuuacaggagaccucaggugaaccaguuacuucacuuuccuuggcuucagcgucuccucuauaaauauuaaccaguaagcaagcauauagugaacauaugugucugaugcuggccaaagggaucugugucuuuaaggggcuuaucuccaacaggaagaaacaaauaauccaggucauuucaaguccagguaaguccuauaaacacauagacaauagggaaaaaagaccugggaggucaggggaggacucugggaaagcaguauucacgcuagaacccgaauaauaaaauagccacacaaggaucuaagggacacagggaucuaugacaagaggaaauagaugcaaaggccauccaauccuggacuauuuaaagaagggagcuauacagguuagaaaauagggcugaggagguauacaggcccaucucuucaaguagaauauagcacaguaguuguaaugggaaguaacuauagaaaaaaagaacuugacuaaauuuguuauucucagcuuuccacuauagcagaacucucuauacaaacaaguaagauugaaacacagaagugaguaagauaguuuuucccugacaacugaaacccagaaguacauaagauaguucugcucuugacaacuggaacacagaaccgaguaauuaugaugguuuugcucugaccgauggggaagcagagccucuaccuucuuugccuucccaacuccugggaacuuccaaccucagcagagcuagaacagcagcuggccugucuuuaagguuccucagacccuuccaaagcccagaucaggugggagacaggguuccuuguggagcuuaugcaaagagcccgaaguucaacccucaacaccacaaaaagaauaauuaccaguaacaauggccuccagccuguagaacacaccauuaaacagcugacucacaaccgcuuauagaaaggacaagcaacagagcuuugagguaucaccacacagaugcagcucugcugcucccaggcccucgaggcugccuccugggaggaaaagcugcagugaccaucaggaagggaacuaacuagcugcaccauaguguauugcauaaccuaagcucaagugcacaguccauccagggcugcacuaggugacagguuaucuucacagguaaacaggaauacugccccgucccuggccagucagcacagggauccagcacagggaugcugggcacaggccaacagcuuuucaaaggggacucaucgucuuuauguuucuguuuucauacugcgcuuugaaugcugacuacuggcauuaucggaaggcaccaacuugaccacagacauacuccacccauggcagcccuucccuggccaccugcuccaaaggaaugguccagaacagcuaaaccugccugccugcucuuggcccuuuuccaccucaaggaaaccaaaauacacugaaacccaaaagacacccaaaagaccguuuaaaacguugcaagcaaaucucuagaggcacaguggucauaaaaacaaugauuguugacuugcuuuuuuuuuuuuuuucuacacuaugggacaggagagaggcaacacccagaaauuaucccaacuuuauagaaacaaagaacaaaguauuccagccaagggcaacagagaacaggccuacagccacccaaaugagcagcgagccacaccagcaacagggucaaaagacucccauccucgggcuucacgucugaaaacacaagacugcccccacccaguucucuuuaaagcugucuugaagauccuugugaaccagaaaccgugaaaaacggcaaaggauuucugcaggguggaaaucaggaaaguuacuaagagccucugugcacaagaacagcgcuguguccuguccaggaugcuaccuuuuuuuuuuuuuuagggaggacagacaccuagguuaagaaacuugauuucauucaucacaaauauuauuuaucaaaucauugccaggacauugugacaaccacauccugcuguuucugcuggggucauugccaaaguuugcuucucucccccaccuuccgguaucugugaugaaguuuucgguuucuaucaacccuuagucggggaggccccccacccccaccccaacuccgcgcuggcccugguggaguggaguuccaccaccggguccauaaaagagaccgcggggaggcguggccagggaggaaauucugacaaaaacuuuuggaccuccgguccuagcagccacuacuuccuggucccucccggucacggggaugucguuauuuggcugagugcuccccagagggccgcgcagggaagggucugucccggcaugcguggcgcucacggaacggcccgcagguugccuuccaccgcaaguuguuucgaaggaguccccaggcugagagacgggggggcgggaguggggugcaggcuuccuccuccacgcucuggccgcccacugucaccacucccagagcccaagguggugcuuucggaccugaacccagcacggacaucaaggcccaagcccguucugaaagaaggggaagccgaaggacuggccgcgaaccgcccgccgggagcaaagcagcgggccgcgccgccucccaccuugacccgcuugcccuggaucuccagcgucuucauggugaagucgacaccgauggugcugcccugacgcgccgagaaggcgccggucuugaagcgcugcaccacgcacgucuugcccacgcucgcgucgcccacuaacaccagcuugaacaggaaaucguaguguucguccugaucucccgggccagggcccgccauggcuccgcgggaguccugggacgcaagggcccggcuugggcuaaggacagccgcgggccgagguccgugugcccuagccggcccgccgccgggcuacguggagcggcggcggcaccugaacgagcugcacggcggaccgaucgaccgucccgcuccgccccgccccgcuccgcuccggagccccgaggacucggcuccgcccgggagcgcaccgcccggcccuccgcagcucucugccagccgucggugccgugccggcccacggcuaccucaggcccgcucgugcgccgccuucagggcggggcgagccucccugauccccagcaccgcccaucucccgccacuccgccucugggucccgcccccaggaccgcccagucucccccucccauaaccaacaccuccuagccugucaguacagucccgaccccccagcacucccucuaagcuucucaccuccccgauccuucuccgagcaccgcccgcaccccaccacggccaaagccuccgacccuucucucaacaccaccccaaucccgcccucagcaccguucuuucucacuucucagcacuucacuaacccggacuuaagcccggugcggauucgcugucaacaacgccuugauccucuauuugguccugaccccgcccuuaacaucucuuaccccgcccuaauccuccggagccucuuggcuuggaccucgccuuaggcacugcauccaagacggaaauccacccgcaccuuuucguagcccuggagcuaacuccucccuaacgccucucaacucagcucuccgcgccucuucaacuccgcuucgguccgcugcgcccccauagcaggcuuuggccccuauuaggucaacaacucguuauaaucgccaguucaucauucccuaaccucaugcccuucucagccgggccccacguccaccccucacugacaugccuccgucccucgccuggccugcacccaguggggaacaggcaagagucguuucggggcaggggacagcuauggcugacaaugaagggcugaugaggcagaacacaacucaauguucccucuucggagaauggaaaguucuggugacacacaguaaaggcagcuucccuuaggugaaaaaggaagacagaggaaaugaaaauccuugagggcagaauggccuagaguuccauuuggaagaauugauagagcagacaggaguccagucaaaccugggguggcugggaacaggaguccuggucccagccaaacaccuccugcacaagggaaaccugugagucagccagcucagaaguuuggccugagaaaccugaagucacagaaaugggacccagaugucuguaaacaguuugaacuagaucaaauaggccccaucccuaaaaaugagagaaagcugagaauacucuagcuucuuuggacagcccccuuaggcccugcauggcuauuugauucgauaguuuuuuaauaauggcuguugcaagccaaacauuguucuagggccuugagauccauccaugaacgaaaggcaaaauccaagacaaaauccaaaacuuccccaguaaggaagggaagaggaaacuuaaggaaagcagagaaagcaagcccccaggcaccaucuccacaggcccugugagcagccucacuggccaaguagaugaaaggcaaaggcugaaccuuggagaaaacagaagaguuuguucugaaacaguuggaacuccauggcugugagaaaugcccagcaguugcagccaggacccccuaaagugcugugcaaaggaauuccaagagccaugcuuugcacacucaugguaguggagaacugcagccucaagaaacugccuccaucccaagacgugcacugaaccauagugguuuccuuccugaaguuggcuguggggugggaaauaccccucagacaggccuagcucacaccaagggaaaggggagugcaaaggcugagagacucgggaaagcagaaggguaguuagucauggcucgcuggccucugcucugcccugggcuggaauuggugcaggaaagaagguauuuuggucuagauguggguucugucagcaaaagccaauccaccacuaagacauuuuaaaaauuagacuguguaaccagguguaguagugugaaccuguaaucccagcaauugggacacugaggcaggaggguugccuugaguucaaggacagcuuggucuauacaguagcaggcuggucagggauguacagaagacauugucucagaaaacgaaaaacauuguacccauggugagggcugcauaacucagcaaauguacuaaagccauuaaaaugagagcugaggagauggcucagcagauaaaaugcucacugugaagguguaagagcccaaguucagaguuccagcaguuguacuaugucagguacugaggugcacgccuauaaccauaggcagagcagacacagauggauccuggaggcacacuggccagccaaccuagccaaaacggcaagcuccaagcucaaaugagaccuuaucuuuaaaaaagauaagacggaaaacaaggaggauaaaggacacucagcaccaacucuggccucugcaugugaauauaggcacaggcacuucccaccacacacauacauacacacacacacacacacacacacaaauguacacuuucaaagaucauauucuaugcuauauaaaucacaccuugacaaaucugcauguccuuuuuuuugacaguguauuuuuucaaaacacaaugaugauuuuuuuuucauguauuaugcuuguuugagauagggaaguuuaaaaauauguauucaauauacaacuuuuccuauuaaaaaaaaagucuuauuuugauagcaaauuuugaaauaaugcauaucucaaauuucagcaagccacagauuuaacauuuuuaaaagauucugguuuuuauugauguguaugucuggcugccgcaugugugcgggugccugcagagagcagaagagggcacuggauaccauggagauggaaucauaggugccuguggacugagaaccaaacucaggucccucagguccuccaaagaguagcaagugcucuaaucacugagucauuaagccauaucgcaagcccugugccaaaccuccuccuccuuuuuaaaaaagauuuauuuauuuacccgggcagugguaguuuaaucccagcacuugggaggcaggaucacugaaucucuaaguucaaguccagccuggucuacagaguaaguuccaggacuacaaacugugucuggaggagcggggagagaaaaagaaauguaauaauuauaagggcaggugggauggcucacccuuaagagcccccaauaaaaacaggaauaaaggaaaaugcacuacaaggauggccauauaaccaccacuauccuguguccuuaauauagaaugguugcugcaaaauguuagagaaauaaaugcaaaauuaaagcagcuacccugaaacaguugagaccuuggugauuagggcugcagcuggccaagguaaagaguagcccuuuggucaacuuucagcucacccaguggccacagaaagggcaggcaucugacucucucccuuuccaaauacucaaaagccauaaauacaggacaaauccaucccuccccaugacucuucuguugguggccuuagccuacaggcuuugucucaaaauacucaagcuaucugccucuuggauccauuccuccaaccucugcucgcucucucucucgucucucuucucucccucucccucucucucucucuggcauaucuguucacaggucuugaagagacauuucagauccccaggaauguccaaacauucaagacucucuagcaucaucugcuccccagcauuaucugucccccacugccccgcaaguccucaaacacgccagccagaaggaccuguggcagcaguauccccccacuauucacuuuacuuaaauggaaacucaguucaaacacuucagugauuugccucuaagguucagggauguuaggaaagaaaaguggccagugcacaaacacaagccugaguuggagggggaaaaaauggagccaaccugacacuguccacccuagaaaccuauuguuccugaaucaagacaggcugggacauggaccaggacugcaugucccugucaggucaacguguaggugagaaaucccuaccuuaucagccugaggaaacaagaauaggcugcugccauuuauccaaccuuugagccaauguucuagguuaagggugagcacaagacaggcaaaguuuccauccacuccugggguguacagacaagagugggaauuuggagcgaggggcugucuuaguuaugguuucuguugcugcaauaaaacaccaugaccaaaaacaaguugaggaggaaaggguuguuuggcuuauacuuccaaaugguaguccaucacuggaggaaguccagacaggaacuccaacagggaaggaaccuagagacaggagcugaugcagaggccauggaggaguguuguuuacuggcuugcuuccccugguuugcucugcuugcugucuuucuuuuuuucuuguucucuccuuccuuuccuuuccauucucuuccuuucuuucucuuucuccccccaccccccccuccuucuuucuguuuuucuuuuucaagauaaagauuucucuguguagcccuggcuguccuagaacccauugaggaccaggcuggacucaaacucaaaaucuaacugccucugccuccugaguacuggaauuaaacaugugcaccaccaccaccuggcucugccugcugcuuucuuauagaaaccaggaccacaagccccauacauaguggacuggguccuccuauaucaaucacuaacgaagaaaaugccuacugccugcagccuaaucuuauggaagcauuuucucaauugaggcucccuucucucagaugacuuuugucuugugucaaguugacauaacacuagcuggcacagggguuauauguacaaggaaaagaugaggaggagggcagcugaagucuuggcuaggguggcaggcacuuguccugaagaaaagaguuuuagauuuagauuacuguguuuuagauucacaggauaggugggcuaaagacaggagacgagaugaugaugaaaucacugugauggcuugaauagauagacucacauguaugaaugcuuagccauaaggagaggcacuauuaguagauguggccuuucugaaguagguguggccuuguaggaagaagugugucagugugggggugggcucugaggccuccuuagcucaagcuagaccaguauugcagucucuggcugcugccuucuaaugaagauguaaaacucuuggcuccuccagcaccauaucugccgcccgacgcccaccaugcuuccugccaugaugauaauggacugaaccucugaaacugcuagccagcccuaauuaaaaguuguccuuuauaagaguugacuuggucauggugucucuucacagcaauaaaacccaaacuaagacagucuccuuucaguacuggcaaauuaaguuaaagcaugcaugcacauuagaagagacuuuguugaacaauguuuaccaagacuggcucugcccuuuaugcaaagaggccaagaggaccacaccuacaucaauagucacacaccacccagguggcuucugacugucccuaagccugggcaggagcucuggacagaccugcccucaauacucaggcacugcuggggcccccaccaaggacaccaguggcaggcuauucaccucucuauccagagucuguuuccauaaaggugaaaucuauguguuguauccugcaccccagaacauaccaagaaagcugccuaggggaaagcuuuaaaaauacccugaaguuccuaaaagcccucagcuuucagauaagccugccuaccccagggucuuccaaaggcucagauguauacuagucuguccccaggauucucugaugccuauggccaagccacaggacugcuaauaccaccgaguaacaccaagauggaauuugaaguacagaaaucaaggcagaggccaucaaggauaugcuccaagcuccaaguucuuuccuaaggccaacacaaaagcaggcccuggcugguacuaggcccuaccguccugccucugaggguugccaaagcuccacaccagaccugccuucucccuguacauaguagccguggaucaggagucccugccaguccuccccucagggaggauccaagagaaauuuccuaguagcuaggucucgcugccuuugcucagaaccuuccaguucccaugaacaaagcuccuuuaagagucagccaguagaaucccuguuuggcucacuucaacacagccacauaaagcaauauagcuagcucugccauccuccaugauguugcuccccagccucugaagccccacauccuuaccaugggaugagcugcuccaaaccaagaguccuuguucccuuggccuaggcuggucccugugcccaagggugagccacuuacaaugccucugaccucccagaugcugccauccucagaaaaggaggcuuagggcucacaaugcuugggcuuagagaucuugcaggagacucagcucaaagaggugcuugggauucagucacugagaaucuaccaggugcacaaacagacagaauaccaccauccucugcuguaaguguaagcuugugguaugugcaugcugggugcagccuugggaucuguaccguuccugguuauuaccaaccacucuguacccuccccauccccgccccaccccuacaguguccagugucuuccaugucugcuaucaagccaccacagucuagaugcaccacagaacaagcucuaggcacagauguuuccuuucuuauuaaaaaccuuuaauaaaaguaccuuucucugaaacaaguuauaaaaauaaagucgcuaacucaaaacuccuguccacaggacaggagaaggugaaauggcucucccagagggggaucauggcaagguaagcagugcccagacgcagggauggcuccagcacuaaccauggaauuccaucucagggucgauacaccaucucagucucccagagaagaugugucucuaaauuuagaugugauuugaauaaaaauuauguauuuuugaaaauuggcuacuaguuugauccuucuugauucccaaaagcagaguauagggcaaaguaaauuuucagagaacagauuuuacacauuccaagacaaaaaugaauggaugcacacgguagcaaaggcaucuguacaaaggcgauggcuacuaaagcauucaguaccuggcagcuuccugggaagggacagggcccuacuaucaggccagcucacauuccagaaauggagguaagcugaagggugagaaaggcacaggccuuccagcgccaggcagccuagccacagcccagggcagcuaugaggauggcgugccaugguguaccaagcacacccaccaggucuuccagaguucaagaagggcucuggcucagccuaguaccccaggagucgcuuggcuucuucacucugugccugcagggucucacuugcauauuucuggagcaguuccauuuucuuccuccguacaagcgccuccucaaucuguggacacccacaguaaagaagucacucucagcaaggcccccaccucucacauaacccaagcagggacuaccugcagggacaaggucagcacgucugggggucugcaagaacccagccacuuuccuagcaacaguccaucuaaguuccugcuuaucacuuccgucaagacggccuggcccuucauggaucccacaccccuuugugaagacaccucucugugugccacaggguuaggauuaaagagugcacaguggaagggagggacaagggacacccgggaaggugagccucuccagcggacuggcucuaagggcagcacucugccucggggcucacagcauccagccuaccuccugcugagauggcaccggcacaugagcaaugaacuucugcugaccaucuuccccggccuucuccugguugccuuccucaucagacugcacagaagaugaacauacaagccaugagcaggucaccagugacauaagcaccaacgccuuuauagaaagugucauccaagcugggcgugguggugcacaccuuuagucccagcacucgggaacucagaggcaggcggauuucugaguucaaggccagccuggucuacaaagugaguuccagggcagccagggcuaaacagagaaacccugucucgaaaaaccaaccaaaaaaaaaaaaaaaaaagugucacccagcuggaccugguggcacaaaccugcaaucccacacuugggaagcuaaggcaagaggccugccucaaguuccugccagucugggcuacagaagaagugacucugucuccaaaaguaacauuaagaaacaaaagcaccacagagcuggaaaguuauuuuaaggccucccucaacaauguaguaaaacccuaucucaaaacaaaaagaggcccggggacagagcucaguggcuuacuucuccaguaacacaaaacaagcaaacaaacaaaacgcuuaaaacagguagaauuggggcuagagagauggcucagugguuaagagcacugacugcucuuccgaagguccugaguucagaucccagcaaccaaaugguggcucacaacgauccguaaugagaucugacgcccucuucugguguguuugaagacagcuacaguguacucauauaaauaaaucuuuacaaaacaaaacaaaaaaacaacaacaacaaccaaaaaaaaaaaaaacagguaaaauuacuuauaaggaaaaaaaaguccuuuccauuauuuuuuacaauaaaggaaaauccuguugggugggaccccugcacggcaucacaccagcuacacuggucugugcccaaccacuggccagccagcuguucucacccauccuggcuucuccaguaccugcugcuugcuuugcuccugcaccuagcugagcauggugugucuaggccacugacuauagaccugaggaaccaggugaguguuuauuuguaacccagagaaagcccagggcaugcugccacccugcuuuaaacgcuuugcugaucccuacugcaugucagcuggagugugcaggaaccuccauaucuuguaacacauucacaaagucaucaaaccugucccaaaccugcuucuccgccagggauguacaagcaaguuucaucaacuggacauggaaaaccugccucgucuccccugucucagaacagcaaaucagagguguucugacugguccaugcuggaccaacagagucuagagcccagaggcucugcuugagaggugaggaucauagccccaccccuggucacaagccucugcagaaccccauaggccuguuuccaucugugaaauggguuagaagucuacucaagagucccugcugagggcuggugagauggcucaguggguaagagcacccgacugcucuuccgaaggucuggaguucaaaucccagcaaccacaugguggcucacaaccucuguaacaagauuugacgcccucuucuggagugucugaagacagcuacaguguacuuacauauaauaaguaauauauauauauguauauauauauauucaaauauauaaaaaaaaaaagaguuccugcugagccacagaagugcuaaggucaugggcugaagcuuaugugaccucaacugaguuuauauacuguccuccaucauucgagagaauuggccuguuagaaggaagcuaacacuaggucccuuagcccuuccugucuggaacucccugugcuccucugaaggguuaccacagccguccugcaggugaggacgcugggcucugcaaugagcaccagacaggacccaugcccguaccuccuccuccgugacagcauagauguugaucuccucuuccuccuccuccuccucuuccuuuucuccccuugccagccgagcuucucucucugccuuccauuuuuccaccagcucagcucugacugaagacagaggagaauagaggauuauuuaaaacacauuucagugggcuaacagaccaagauguccccuuuggaaaaagacaccgauucugcccuggagagugaaaacugcuacaaaggacagucugugccacaaugccucuagccuuagguacgguagguagguacaaggcaggcuuugugacaaugucucuaaccucuccaguggucgacugacaugcauacaugaaaaagggaaggacagugcacgcugggucccacccucaccaagcauucccaaauuccuaugggaacugcuucggaccaccuccucagcuggcaugguaugcucuacagggaagaagcaaccacugguauacacaccacacaguaagcugucagcugugcaagaagcaggucuaaaagcuacuggauacuacuaaacaagcucaggaaaagcuggcuuacaagacugagcuuagcuaaacugagcuagacugagcccucccagaaacuggaucaggacagaggaaaaucuguggcuucaccugcugcucuggaacccagcaugacccaacugccucaccugccaccuagaugucagaucacugccagcccccugcagacccucagcaacaauaaagccagcuuuugguaucaugcacuguuuccuuugcaauggagagaacaaaaaccaggugucagcuauagugacacacucauggacauacguuucuucucauacucuuguuccaagggcacaauaacuccaucaucuucauccagguaaccauaguacucaaaaucgauggccuucaugagcucagcacgugucuuucugggaggaggaagggcuacaagaaauggcagcaacuuagguugaauucgcaacaagcucauccuugagccaacccuuuucucuacacaggacacauggccacagucagcacuucucuguccuacaugggaccaagugagugcacccacccuuccuaaagcuaaagcuuugguccaacagaguggaaccuaauuaaaguuuauccuuaggcuaccaguauaagccagugauagaauccuugucucacaugcccgaagccuuugguucagcccacagcauuacaaaaauagauacguaccaaguaaauaaauggaauguguaugguuuaaauagacagaucuggggauguagaucaauagugaccacuuuuuagcaagcccuagagcccacuuuaaagucugaagcacuuucuagcaacaccuucaaacccacagguccauaauagcuuuauaggcagagaaaugcaucauucauacgguauaucauucauacagaacuauuucuacaguccugaaaacacuagggguauccuaugacuguaagucauggcguggugguaucuauccugaagccucuuuaacgcuguuuuacaacccaggaaucgguacaauguucucugacacaaaacaaccacauggaaaauaaagcauaagaaggguagaugagagcgcucugaggaagacccgucagaccagacagcugucuagaacacaaauguaauuaucaaagagaaagcaaaugaaaacuauaacacuggucuaagaauaaagguugaccacuaaagaagggaaaacugcagggguugaggacacagcucagugcuuaagagcaccacucuuccaagaccucggauugguuucagcauccacaugguagcucacaaccaucuguaaccucagguccggggaaucuaauguccccuucuggacucuggggugggggacacagcaugcaugggcacacaugcaggcaaaaacaucuguacucacaaaauuaaaauguaacccaaaaaaauuuuuaagaaaaauauaugaacauuuccacugguaaucaaauuaaauuaucaacuuuaugaauuacagaaauaagcagguaaugauagcaaacaucccugauuccaggacaagggaggccagccugggcuaccauacaaacuccaggcuggcucgggcugcacaguaagacccugucucaaaacaaaacaggaagaauggcucaaaacaaaacaggagauggcucagcagcaaaaaguguuugcuaugcaaacccgaugacucaacuucaacuccuaaaaccguguaaaggagccagaugcaguaggcagcacauaucugugaauccagacuccugugucaagacgggaaacagaaacaggagaauugcuaggaaacuggagggcgggccagccuaaaguacacagcauagagguuuaaacaagagagccucugccucaaauacagcaggagagagccaacucccaagugcuguccccuacaugcacaugggagcacacaugugccugcaguuacauacagacacauaaacaucauuuuuugaaaucacaaaaaucuucuaauuauaagaauuauagaaacaaaggcuggcccaccaacagaacacggcuugaaaaauggcuaauccauacaaugacccuucccgcuuuccuucuggugcugaggcccuagcccagggccucccugcacaggcucagcaggugcuccccaucacugccccugggaugcacuugaacuccucacaaccacuggggaggagccuuuccaugcaucaaggggugucacaacaguaugggacagccauguuuuggcagaccuccagucacugcccacaucugauaauggcaacuuuaucugccacuuuaggucauguccugugaaggggugcucaucacacuggccagagcaaaagcacugccauccuccugaccguaaggaauagguuuaaaaugcacucaugugaaauagaagaagaaacacuuucagucaacugggauugauuaauacuuuaccuaauguggaacaacuaagccuacaaggaaggggccuacaagggagccugaagauaacaaugggucccagucaccucuacagaguccagcaguggggcagcaaggggacccaaaccucuccuuaacucuacugagacgggugacucaugcgcaccacucuugagccaggccuggucgcauaggagacugaggcaggauaucacucagaccuuugagcucacgaguuuaagacaugccugggguaaaacggaaaggcucugugucgucaacaacaacaaagccuaccacugaaggaaaaacccagcuaagggcugaggauggaagucgguggcagagugcuugucuagcaagugcaagcucauggacucaaaucuuaacaaggcagaaaacuuuguauaaaauucaacgaugagauggcucaguggguaaugguacucagcagaggucugaugacacacuaauaaugucaauuacaauuaaaaaaaugaacgauagaugaaaacaaaacaaaaaacaagaacaagaacaacaaucacaaaaaugagacacgaugauacaggucuguaauccuagaacuaugaaggcugagacagaaguuaguuggcaagucuuaggccagcgugaacaaugguuuuuuuguuuuuuguuuuuuguuuuuuaacaaaaaggauagaugucuauauuccuaacagguggauauaagaagaugaggcauucaaagccuggggguacaugagaccaugcuacaaaaauauagaauaaacuuaggaauacaaauuuuaaacuauuuuuuaaaaucugggagcaauaauuccuaccagauagcauacagcauacuucucucacucaguagcaacaauuaaaggccaacgcacucucaaacacaugaacuacuuacguucuuucucaaauagcucucugacaccaggcaaaucuuuugcugccccaaaguacuuguaaccucgauuuccugggacuucuuuaccuucaugauccagcaucuuggggccaacuuucuuguugggaaagaaagaggaagaauagaucugacacacaagccugcucuuuuguucacaauacaauuugagauaauaaggucacacaugaaaaacacucuauauagaagaacauuugugcacuguuuucaaaacccuuaaaagugacccuagagagauguggcucaguaguguuugucuagcaugcaaguagcccuggcucgauucccagcaccacaaaaaaguaagcuuaaaaaaaugaaaaaugcuggcccgaaaugguggcauacaccuuuaauuucagcacugaagggcuacggaaggaggccugaugaccugaguucaauuccccaggacccacaugguagaauuaaaaaaaaaacuucuacaaguuguccucugaccacuaaaugugcauucuuuguguacaugcacacauauaaauaaaugaauaaguaaauaaauaucauuaagaaaaauuaaaaaccaggcuagagagaugacucaaugguuaagagcacugacugcucuuccacagguccugaguucaauuuccagcaaccacaugguggcucacaaccaucaguaaugagaucugaugcccucuucuggugugucugaagacaacuaugguguacugcuauacaaaaaguaaauaaauauuaaaaaaaagaaagaaagaaaaaagagcacugacugcucuuccaaaaguccugaguucaauucccagcaaucacaugguggcuuuuuggcuuacaaucauuuguaauggaaucagaugcccucuucugguaugucugaagacagcuacauaguacucauauaaauaaaauaaauaaaucuuuaggaagaaaaagaaaaaaggaaaaauuaaaaaccaaaagaaaaaaaaaaauagggcugaggaugcuaaugcuguauugugcuuccuuagacccgaauauaacuggguguggggugcaugccuagaaucucagcacuugagaucaaggcuagguuagagcauauaguauuaggcaggccugagcuacagagugagacuuggucugagagaaagaaaaaaaaaaaaaaaaaaccaccaccaacagacaaaauaaaaauauaucaaggggccuugggaugcaccuacaucuaacugacacaaggcucuggggucaauccucaguaccacauaaaaccaggcauggugguauaugccugaaacccuagcacgaaggaggcagacaugcaagauuagccuuagcuacuucaaggccaaccugaacuacaugauacccugucucaaaagauaaacaagcauggauaauaccuuuuuagaaguguuuaaauaaauguuccuacuguauauuuaaaaagaaaaaaagguaaacaaacaaaaauaauaauaaauauaaaaaauaagauagaauggaaaaugccaaaguacauuacagaguuuucccagcacacuuggugugcaucacauagcagcauaaagugugugugcugggacuaggaaaugguuuagacuguagaaacacauccuguucuugcaggggaucugccuucaauccccaacauccacaucaggaggcucacagguauucugcucaaauauaacaacugccuguaacuccaacuccugggagaucagacucccccucccaccuccauuggcaccaacacucauguuuguguucucguucucucucucucucucucucacacacacacacacacacacacacacacacacacacacacauacacacucacucacacacacacacaaggccagccuggucuacauaaugaguuccaggagagucaggagucucuacauaauaggaagaccuugucucaaaacaaacaaacaaagugugggagcaugugucuuacuauaaucaugauacuacaggagggaagacagcagacaggaaugucucuggggagccaggccaaggccugugccaugcgggauuucaggaugguaccaccauccuuuucacugcuucucugcccugccacccuuggccccucuggacaggauggacugaacuuacagacaaugcacacagacaaugcuuagacaagucaucagcuugucccaggugccccuggagcucuagcuacuuacuccauaaucaggaccgcccagcuccuugaugcggaccucccaguguccuuucucccucagcagcuuguuaauuucgucauucaggucccgaauucggaauuccccuaagccagcuagaaaacaaaaaauguuaauaucauuucuucaagaugccaugcccaauaaugaaugucaguacuuccaaucauguacucaguguuacagcuuuagaaagaaaggcuucaaccccaaagguacacugcauaaaacuacucauugaaguucagaagaaaaggccuggugugguggugcaugccuuuaacaccagcacccaggaggcagaagcaggcaaaccucagugagugaguacuagccuagccagggauacacagugagacuccaucucaaaaguaaauaaauaauaaauugauuaaggaaagucacuaacacccaaauaaaggaagaccaaguacuauaaacaaagauucccaauaaugugggguuaaaagucuuuuuaaaaacuucauccucagccgggcaugguggcgcacgccuuuaaucccagcacucgggaggcagagguagguggguuucugaguuugaggccagccuggucuacaaagugaguuccaggacagccagggcuauacagagaaacccugucuugaaagaaaaaaaaaaaaccuucauccucugggcuggagagauggcucagugguuaacagcauugacuacucuucugaaaguccugaguucaauucucagcagccacaugguggcucacaaccaucuguaaugagaucugacacccucuucuggugugucugaagacaucuacaguguacuuauguaauaaauaaaucuuuaaaaaaaaaaaacuucauccucacuaagugauggugacacacaccagcacuugggagacagaggcagguggguuuuccaggccaaccuggucuacaaagagaguuccaagacagccagggcuaugcagugaaacccuguaucaaaaaaccuuaaaaaguagcaaccaaaaaacuauaaaaggaaacccuucuauaucauuuacagcacuuuagagugaacagucaaggcuauaggcaacaguuauuucugaggcaggcaaagauucagugagucugucuacauuagcccuuucaguaaaguaggccaggacuguggacuugauagaccggccuaagaccaguuaaaaagggaagugcacagagugcaugcugaaaggcugaccaagguggcuaaacacuggacaaagauggacacuccaaacaaagaugagaggacaguugguaaccacacaaguugagcucuguguaaagcaaagcuaacuggaauaaagcugaaaguggucaugggggaacacugugcagugaaggguacaaccuggaucuggugacagcuuacacagacacauaagccucuaacuuacguuagagguagcaugcuucauccugcauaaguccauugaaacaaagaauaaaagguaagauggagagagagcuccgugguuaagagcauuugcugcucuugcagaggaccaguuugaguggcagcagccacucacaucaggcagcucacaaccaccuguaacucaggcuguggaggauuugucuagugaacucuucuagccuuagcaggcaaccgcacccgcauguacauaugcacaguuggugcaagaaagaaagaaagaaagaaagaagggagggagggagggagggagggagggagggaggaaggaaggaaggaaggaaggaaggaaggaaggaaggaaggaaggaaggaaggaaggaaggaaggaagggggcuagagagauggcucagcaguuaagagcaccaacuacucuuacagaggugcugaguucaauucccagcaaccacaugguggcucacaaccaucuguaaugagaucugauauccuauucugguguaucugaagacagcaauaguguacucauauacauaaaauaaauaaacagauccuuuuugcuagcauuugcaggaaaaaaaugguggcuacauagcaagaccuuaucucaaacaguaucaacagaaaagcugggugugaugguccaugccaguaacccuagcacuaggaaggcugagacaggaggauagcugugaguuccagaacagcugauggaggaagggaaggaggagaaagggagagaagaggaagaaaaggaaacguuuacuaugcacaguccuaccauauugaaauacagcaucucuucauauuauuauuaacaucuuuuaauuccuuucaguaauauuuuguuguuuucagcaaacaaacugaauauaucuguuagcuuuauauacaaguagacuggaguaugucucaguaguggaagaccaacuguacaagacccuagguucaauccccggcaccaccuaaacagacauauacuguguaaauauuccugguuuccuggugggguuucaauuuuuauuuauauguguguauauaugucuaacaccuauauguggguaccagcagaggucagaagagggcauuggauccccaggagcuggaguuagagcuagguguaagcaagcugaaguggagacagguaaccaagcacagguucucuggaagagcagagcagcuaguguuccuaaccacugagccggcuccccagcccuuugcuguuaucuguaugauugguuuucuuuucuuuuuuacuuuuuuguuuauuuguuuguuuuauuuucuucguuuucuucuuugagacaggguuucucccuguauagcccuagcuguccaggaauuuccuuugcagaccaggcugaccuggagauccaccugccugucucccugugugcuagaaagaaauuauggaccaucucaaguaguguguuugguuaguuuucaaaccugggucauguccuuaaacacaaggcuguccugcuugacccuccuacuugcugauuuuauaaaugguaacaacacaaaaguguuugaauuuccacauauacacaugcacauguuaauuuuuaaguauguaggcauuuuucuuccuguuguuauaaucagaaaacuuaauuuguaagauuucaauuauuuugaauuuucugacauuugugauauagcuuagaaagaauauguucuauuuuggugaauaauuugugugccccuauaagggaaaugaauagucacagauagauggggggcuggaaugggagaaucaagugggaacaaggguaggagaguuggagggaaauacagggagagacagcuaauauuaaaagggguaguauggaagccuaauacagaagaaacuucuaaaauauauacauauugaaagugaucgacucuuaucaccaaacuagacuucuaguaccgaaauuguguuacaucuaauugaguuguuguccaaggaaccccacaggaacuguuaaacaacccaggcuguugccaagacuacaaguugcuuguccaaaaacugcacagcacagcccaauugcugaagacaacaucuacacaauucauugaagauggagauguucagccagugucuacauagagccuucacccuacauuccagcaucucugguaaaggaccauacucuacaugcucuaaagagaaacacuggcuggaaagauggcucagcaguuaagagcacugacagcucuucuaaagguccugaauucaaaucccaacaaccacaugguagcucacaaccauccauaaugaaaucugaugcccucuucuggggugucugaagacagcuacaguguacuuacauauaauaaaugaauaagucuuaaaaaaaaacaaaaaggagagagagagagaaacguaaacacuaacccagcuacaaacucuuuacuacaaugguguucugccugcaggauaugcuagggcaauugguggcucaaagcugugggaguaaccaacaauaauuagcuugaccuaaggcccgcuccacaagauacaacccauaccuaacacugcuuggcugggugaucagcccagggaccaagggcaaacacuaaauaauccuaaucuaaaaaagggggggaaaaaaccgugauaaauucagucccacugacagucugcuacacucagagaucagugccuuguucagccaucaccagagaagcuuccuccugcagccgaggggacaguacagagacccacagccagacaguccacagagaagggacacucggcccuaaaugaaaugucuacaucaaaucccgucccuccaagggcggugguggcacaugcuuuuaaucccagcacuugacaggcaaaggcaggaugaccucugaguugggggccagcauggucuguagagcgaguuucaggacagccaggacuacacagagaagcccuaucucaaaaagcaaaaacaagacaaaacgaaaaccucacaaaaggaggcaaaaaaaaaaaaaagaguguaccggccagaggggaucgaaaacaccaagaaaacaaggcccucuaagucaccaugaggaaaccucaugugaacuuaggggcugaacaugcagagggccugcacagcucccagcauauccuuugcauuucuaugacagcuugcugcuagguguuuuuaugggauuccugaagugugaaugaaugggucuccgauucuuuugucuucucuugggcucuuuuccuucuguugauuuguuuuguccaauuucgaugugauaauuuuuguuuuaucuuauuuauuuuuuaagauggauaaaugaaugaaugauuaaaaaccuauccacuacaguaaaguuuaacaacuggacuguuguuuaugcaugcugggacagggaaaaucaguuuucaauaauagaacaacacuggguauaucaaccacuccacgacagaccucaugcucaggaguaguugacagacagauagacagacagauacugggcaccaccauuuauuaguguguuuacauuuauauuugguugcagcuuagugguuuguucuuuguucuguuuuguuugggggggaguauuucguuuucuugguuugggggauuuuguuguuguauugugcuaccauuugcuuuuagagaaagaacuuaaaauuggguagaaggcuggagagauggcucaguggguaagagcacugacugcccuuccagaggucccgaguucaagucccagcaaccacaugguggcucacaaccaucuguaaugggaucugaugcccucuucuggugugucugaagacagcuacaguguagccauauacauaaaauaaauaaauaaauacaucuuuuuaaaaaaaauguuggggggcuggugagauggcucaguggguaagagcacccgacuguucuuccgaagguccagaguucaaaucccagcaaccacaugguggcucacagccaucuguaacaagaucugacgcccucuucuggagugucugaagacagcuacaguguacuuacauauaauaaauaaauaaaucuuaaaaaaaaaaacauaucuuuaaaaaaaaaaaaaaaaaauguugggggcuggugagauggcucaguggguaaaagcacccgacugcucuuccaaagguccagaguucaaaucccagcaaccacaugguggcucacaaccaucuauaacaagaucugacacccucuucuggagugucugaagacagcuacaguguacuuacauauaauaaauaaaucuuuaaaaaaaaaauguuggguagggagggggagagggucuagaaggacuugaaggaggggaagaauaugaucaaaauauauuuaaauuuaaaauuguucuaaauaaugaaaaaacauaauaaaguuaaaugaaaugccauuaggugcugcauucuauaaaugccaacgaggucaaacuugacaaaacuguguuuacucguuugcuggucuuagccuccagcgugcuguguggccgugagggcugcccugagcuccugccugcacuuccugacccugggaucgcacgcaccacaccuggccggcguucacaccgguccccacaucugacugggcucuaggacacuuuagcagcguucacaccggccccacaucugacugggcucuaggacgcuuuagcaggcaggcagcuuaccauucugaaucugagcaaccuuuuuugagaucucgccaaugaucuguggaaagcaacaggcacaucucaucauuuuugaacauaucugaaaguacaagaaaccgguaauucacacgcaaaaaaaaggcuauagguguggcagcgcacaccuuuaauucuaccacuggggaggcggaggaaggaagaucucuguggguucacacacaguuuggccuaugcaaugaauuccaggccagccaagauacaaagugagacuaugucuuaaaaaacagcacugggcagugguagugcacacuugggaggcagaggcaagcaauuucugugaguucgaggucagccugguuuacagagaguucuaggacagccaaggcuacacagagaaacccugucucaaaaaaccaaaacagccggcaugguggcgcacgccuuuaaucccagcacucagcaggcagaggcaggcggauuucugaguucgaggccagccuagucuacaaagugaguuccaggacagccagggcuguacagagaaacccugucucgaaaaaaacaaaaacaaaaacaaacaaaaacaaaaaccaacaauaacaaaaaacaaaacagcuuuuaauccuagaacuagggaggcagaggcaggcagaucugugaauuagagacuagccugguauacacagcuauuagccaggaauacaaaaagagacccagucucaaaaaaaaaaaaaaauuugguuaauaaucauugaugagguaaaaagaagcaagcagagccauuauuucuacugaacauaccugccgucuccacuucuccgcuuucggcaacucaguacauucagaagcaaggaagggucuccguuccuaaggagggugagaguaacacacaugguaacugggcucuguacacaccuaugugacauccacaaccgauucagccuugaaaccuuaaauauuuaaugcucuaaauauacuugaagucacagugcuagaggauauucaauuccuaaccaucacuguacaaucucuuaggaagcuauauaauuaggauauauaauuacuccaggaacuguguauaguuaaaauaaauauauacaaauauuuaaucucuccagguccacucucuaccuucuucuagucaauauuaaagcuggaauaauaaggggcaagcgggaggcagauaaucacaugccaacagaaaagaggcuaagcagacgcacaaguguacaaacucuucagcaaacacagcaggaagagcugcggcucgaagccugcaucugcuccugguacuucccagggagugcuucacucaccuugacuuuucccucuuccagcugagcuugacgaaaccucgccagggcaguccugcaggcacacaaaagaccccauuagauuucuuagcacucaaguuccuggaugggguagaucugcucaugaccacagcuaacagcauucaugcaaaugguaauaaaaaaaccagaguaguuaaggaguuguauguuccaagggauaggccuccaacaucauuuguguuucugggcacucaaauaucuacuuuauuuacauugcauauauagacuguggggaacugcuauuuaucacacugugauaagcaauauacagaaguauuaaaaggggcuagagagauggcucagcggcuaagagcacugacuguucuucccaagguccugaguucaaaucccagcaaccacaugguggcucacaaccauucguaaugagaucugacgcccucuucuggugcaucugaagacagcuacaguguacuuucauauaauaaauaaauaaaucuuuuaaauaaaaaaaaaaaaaaaaggaagacgagcuaaaagauuaacaucagguugcccuucccaucauuuccaauucaucuucaagaggaaaaauguuuacucacugaaaguucuggaagaugucagacaacauuaaugggggaaaaaaaaccacaagcaaacaaagaaagguugcuuuaacaccuggggacaagaaaccucuucuaaaaagauuccuaccaaagggaucucauacaagcucugugccaaaugucaaauuuuucagccccaagaaaauugauacucacauggcuuuuucugcauuucgggccuagaaggagacaagggaagaaaacaccaaguuuagaauaacugucuuucuugugauugauuuaagucguacguuuuaauccaucagugugugugccugcuugucugugcaugcacugugugugugcagaggacaggagagaacaucagcuccguggaacuagaaugcaggcaacugucagccgccugacaugggugcugggcaccgaaccugcuccuaaccacuaagccaauuccucuggcccuaggauaucuuuaucacuucuacuguuuuguuuguagguugguuggcgauauagaaauuucugguuucuuuggaaacucaguugugugaugugaugucuuacugaaaacugucuuaugagaggauguuuuugcugaagcagacccaugggaggauguuuugcuaagaacagacaugugguguugucugaaggcagucuggaaaaggggaaugugauguuuugauagaguagacgcuagagagaacaugugauguuuggaaaggauauaaauguaguccaacagacagugggugaugcuggaugguauugguaggccuuagcauucuuugucagucauuguuugucaugacuucauagaggaaaacaaaccaaaaaaacuucuggugauguuccagcagcuucuugccacuucugcagauucaggccaauugccagagccuugcaguuucuucuggaucaacucgccgcugcuuacucaugaaugguauuuuccagucccgccauugcugacucaugaugguauuugugaauggaucuagcuaauacugcugaucuguguaaacuaaaaugcugauauccugacaaugaaaauuagauuugcuccaaagaacuauuucucaacagguacacauccuccucugcucuguuaaucuuuccuuuccacugccucugauggaugauggacuagaagggacauuaaaacauuuaagaacccucauuaaaaauagguuguaaaaaaucuaaaccuaccauugguugguuucuggcuuuuugagacagcauauucuguguagcccuggcuguccugagacuugcucuguagacuagacugucuuugaaguuaaagauuggccaccucuggcucccgaucuuugggauuaaaggcaugugccgcugccaucaccaggcugguuuuuauuuuuuaaaaucauacacaugugcagaauguacugugaucauaucuauuaaccucucugaccccucucucacuccugauacgauaacguaugcaccaccauacaccacucuaaccagaaaacagccuaguugucugucugcugccaguggcuaucagaggagagcaucaagacuggcuuuugcaaagugauguucauuuaagugcugccgcagcaguguuaagucaauggucccuaaauguuacacaggaucaggaagagaacaguuuuuuucaguuggauugugaacuacacagaaagcgcaccugcugaauuuggaacuagagauuuugcuccuagcucuuccucucaccaucacugagacguggucucaccaaaaucuaaguuucccuucacagcacauauuguagcuuuuaucuugcaacguuaugaugacuuacucagauaaacgcaugaagucaagcagaaacagacacacagucuagagagucagcaagaugaguuuaauuuaacuugcccuucagauugccccuuccaaucaacucugaaaggaaccuggccaguggaagguggauauaugaacaugacaucaauacaggacacacccuccuucagaaguagcuguucaagaccacuguuuccucuccuuuuuagguuucuguucucaacagucuguaguguccaaaacauccucuguaagcauuccauggcuuccuuaaauguuuaugcaucuguuuuauuuaacaggaguauguaucuguuugccccuauguauguguaaauaccaccccgcccaaaguguauuaauguuuuuuuucuacuuaguauuauaaagcacagacugacaagaaggccuauauauuugaauguguccauauuuugcacgugguuaugcauauacuuacaccugauccuuaaacauaauuugguauaugcauauagauaaauaucuaccaaaaugggcugguuuuguagauaagacuauacagauuucaaagacaucaauaaaucucagaaguaugaaagccacuccguauacuuuuaaggggauuuuuaccuuuaauuuuuuaauauuuuuuguauguguaugagugcuuugcauguaugcauguaagugcaccacaugagugucuagugucacuuaacaaguggguguuggauccccuaaaacuagaguuuuggaugauuguaagcaaccaugugggugcugggaaccaaagugaagugguuuuugaucacugggccaucucucgagguccacggacacuuuacuuugaaauuacuacaguaacugcgccucuuugaaccaacacugugucugaucucauacuuccauauuaaacgcuucuugagugaaugaaaccgagaaucacaaccucucaacagaucagcccauccuauucauucacucacgguuaugucacacacgucuagagaaugucagauucuguccucgguuucaggcaagcaaaggcguggagacccugcccuuuaaaagguccuauccguggaaccugagaacgcccgggccguucagucucuacgcauaaugugcuucacccagacugaaccaccaagacgcaauacagcucccaaacucaguuuucuugccauuucuuacagcuacgccaggugggaaaagaaucccggcauaggccagggagcccgaggccgcacacuggcccagaccucgggucccccgugagccccaucccuuccccaacgcacucaccauggugccggcgagggcgcccuggcgccgcucugcaacgcaacgugcucaggcgcccggaacaaggcaggcagacgcgggaacggaaaacagcggacagucuggucuuuuugucggaagacuaaauggaaaggaccggaaauuaaggaccggaag

SEQ ID NO: 3181 - RNA, 8494 nt, Mus musculus
ugagaaaaggguuuuacuauguuggcucugccuggaacuuuagagcaagauuaccucacauaccucacuugcugaguuuugaaauuaagggcacacacaaccacccccaugcaguuuuucaaaacuggcuagccucaaaacuccaccugccucugccucucaagugcagacagaucacucugcaugaacuaagaauaagugacaauccaaggccaucauuaugcuaagaauguucuuuuguucaugugucuaagcacaacuguggauucaguuccuuuuuuccaucucuacauagauucuggaacuaaaaacucaagccaccaagcuuauguggcaacagccaacagaagauccauagaacucuucguagcucuacaaauuaauaaaacagugcguucuucuaucaccagcuuuuccuuacugaagacauuacuuagcauagaaagaaaaguccaaacugucaucuuucaguccuccacauuccccucuuuaauaugguauuuuguucuauauacauugaugaaaauuuaaaacaaacaaaaggaacuuuagucaaaacuccccuuccuccuccagcuuuauuggaauaguuuaaaauuacauuuucuauuuucuaggacuucaguugcuuuuuccaucugacuuuuaaaaacugauuacagcaaaugaaacacaguugucuaagugauauaguauacaaaaauaacaucuugauuucugugaaaaugcauuucucugcaauuccugaauagcuccaaauuaugcuaacucugagcaucggauguuuacucuggguuuuagauuuagucuuugaaaaaauguguucuacaccuuugccaucaccaucuguacguccagcaucgucacugggaugaagcugcuucuguguuaggcuuugagccagauucccuggcauagccuucaacacauuugucuuuucaguuuacucccaacucaacuguauauucugagggccugaugcagauguuacucgauguuauuuaauagcuacugaggucagacaauccaaggccgucauuaugcuaagaauuaaaguuauuuauggaagcuuagaugcuuccagaauugguuuuaccuccuacaugggaacacacucaaacccagaagggcuuacuggucugacugaacucuucccauucauuaaucccuauucaccaguggcacggaaaggggguucuuuaacaaagcauuauacauaacaccucuaccaaacuaaacauaaacuuuuuuuguaguuaaaugcagaaauucgguuuuuuccaccccuuuccuccuuuuacacugcaaguaaagcucacuggccugggaacagccucuaucugccaaccuuuggccagugaagaggauucagagaaaauaauacaaccaucaaucagaaaaaggaggggcgacaaaggaaaauaauuaggcuguagccucaauugugcauucccgugcaagaugcccugacucgccacagcgguaacaguugacuucacuugucuugcugcaauugauggcuacaugaccaguuucaccacaccugaaaaaaaaaaaaauuacauaguuuugacauugcuucucagaacaaauaacaccguucucaaaucaauggucaauacagaaaaagaaaaaaaaaaacuuaugaacacaaauaaguauauuuuucuuuguaagacuauuucucuuuuaugagacauuacugcccagguuguuuuuaaaucccuuacagugcacgcaauuguuuucuuccuucuuuaaaagggcuuuacuuuugaaaacagucucauauaaaagucaacgcaagccguaaacacaaccuucuagcucugugcugugacuacaggaguuaaaucaucguacccagcuaagagucuacaucuuuaucuucuaaccaagaacagagaagaguaaaaacuagguucucaaaaaccuugucauaagagauuaacuaguuccaagcccaaaacaucagcaaagaugauguuauuuguaaaugaaucccuaagguuucauuuauaugcuccaauagcacuuaguaacuacaccacacacaagccauaguguuuauauagcuauacucuugacuucccauauaugacagguuuuuguuucauccuucucuacgggauacauacagacuugcacaauuucuuucacacucacugagaccuuacuacuccaaacuguacacuuuaucuugguucuguggcagugucugccuaccagguuugagguccuagguccaauaaccuagcaccacaaaaggagaaccaggagcaggguuucuuuacuaggagugguaaacugccucaaauugaggggccaauuagggcuacauaguaaacucaucucaaaagagggaaagacaagacugcucagaaaguaaagccaucuguuugccacuaagccugaaucuaccccacaaaggagaucaagucacaagccguucaacagacacuaccugcacaaaaaucuccacguuuucaguaccacuucaugacucaccuauagcacuucaccuuggugcagucuuuuugaauauguccaaauucaccacaagaauagcacuucugcucauccgcguggucacagucacgagccagauggccuggcuugccacaauuguagcagcauugcucucgcucucucuugggcuccuugcaguccuuggcaauguggccaccucuaccgcaguuauagcaggcuucaacaauaaggaaaagaagcagaccaagacuauaaaaccuuuauaaaguaguauauuuaaaccacaugcuacaaacccuuccaaagcuguguguaaguacacacucaccucucccaagaguaucaaguguuaaauacuuaccauccuccugcagaucacaauccuuggcaagaugaccagacucaccacagcgguagcagaugucagggagagacgaggaaacaaacuggaacccuauuuugaguagaaacaaaaagaauugggauaaucaggccagucuugguauuaaugaaugcuggaguacuucaaaauuuuuuauucgacaaaaauaccucuauccgagguaaaaccaccucugccgcggcuucucauuccacgaccccgaccuccaccaguagggcacucccuggcccaguggccagaucguccacacuugaagcauucguugcugcucauagcugcaguuagagcuuuggaauaucaaaaaauaucauuaaacacuuagaauucuuacugguuagaaagaccaguaccaaucuauuuacuugugcuucauacaccuaccauaugcaaaaugaaaaacucugaaacuauaucuuacaaacuucuaaauggggcauauauguauuaacaugcccguguuaauaaucucagaaauaucucaauauuccugguccagcuuaaguguguguguguguguguguguguguguguguguguauguaugcacgcgcacgccauauaugcuuacugcucaaggaaaauuaaaauauguaucacucacuuuuacccagaaauacuaauuuaaaauuucaagccaagaacaguggcagagaauccggaguucuaucuaggccagccugggcuacaucuauucacuuucucaaaaacuuguuaccaaaaguaaacccacagagaguugagcucagaagucugucuuagacacuaugcaaacugccuucucccaaaguacucucucuuauguacaacugcugcauuuaauuaggucuuuuagauuuugaccauuccccauagaaacguaaaacauggcugagaacuaugacuuucacuaccugugacucucagauucuucugcacccccccccacuugucacacccuuuuccaacuuuuaagagccaucucaaugcuaagucuauuacaaaaaauuugaccauaucucccagccacauuaaaacucaggguacuuguuaacagcuaucaaaucacacuaacaaugcuuuuaaucauauuccuggagggcugagauugagucggcucaccuuugagucacugcagcauaccacauagugauccuuuuaguagcaguuauauaagauggcuuuuguggagauggggaggccuuaaauuauacagacccaauuaaauauaaccaaauacuaacaggauagcacuaaaaaugcuugguaucacaaguuacucuaucacuaaucacuaauuuacuauguuaaugucuucaauuaaguacucacuaaggguacaucacccaaacuuucucaaaucauaggugugauccuaugcaugcagauuuuuaggagcaaaggcuuuugcuuucaauagggaucaaggcucaaaacaacaaacuagucaaacaaacaaaaaucccuccaggcuggagauugcucaacaguuacaaguacuugcugcuuguggaaggacuagaauucccuuccuaacauuggcauggcuccaguuccaggacacuguacacccuucuucugaccuccacuagcaccagcuacaacacauauggcacacacaugcagacagagucauauaaaauaaaagugcuaguaaaaagagcaaaucaaggagguucuaaguggagggaaaaaguaucuaaaaaucgaagaguaguugagaauucccaccagagguaacuaaaaugagccagcagccaagccucugucuuacuguuauuugucacacaagcucagaccucuguagaauuacuaucucgaagugcuacauaaaaugacaauaugaaauaacaaaauauugggcuggaacuguaguuuaguauaguguuggccuagcauucuugaagcccuggguuccaucucuaggacauaggcacagacagacacagacacacacacaaccuuaaaagaaagaaaauguaaaaggcaguauuaucgggcucaguggcaggugcaacauaggcugcauaugacucuauuccaaaaagaguuggggaagguagaagaaauaaauuaaaaaugauuccagugucucaccuauuguaguuuuuauuugguuuaucuaaacgaauagauacuuucugcauugagguuuaaauuacauauaagaagcagcauguauguguguauucuccuuuaucacuuagcuagccuuagugaauuuagaggcaaacuguugacaucuugucaguacgagguucuaccuguauggcuuuaauagguaagucacuuguucucagauuuguuguuguucuguuuauuauuguuuuuuuuuuuuuuccgagacaggauucucuuuguagcacucugucuuggaagucuagaccagguuggccuugaauucagccugccucugccucccuagugcugggguuaaaugaaugugccaccaaacccagccacccuguuuccuuguuaaaagggaauaaggauacauaacuugaagagugguuaagauaguagacuauguaauuauggcugacauaguagauacucagcuauuaagccuuugcacagguagucaggacaugcagauacagauaaaauuaaccaaggucagaguagugaauuauaggguaaaacaguuuucuuaugguugguacucuuauuuuucaucaugguggccagaaucagguaacagacuguaucuugcuuuuuauuauaucuaguuuguuacaacaacagagugugguauuguggugccaugccaauuuauuggagcauagauguauguucagagggcaagaacugcccuguggucucaguauaacaacugugauaaggcaaggauaacccuuugcuugggaaauagaacuuaagggucuagaggauaaaaauggauauaaaucacuguguuaagaaggccagaugaaauaguaaaguuagcucaacacacaucauaguugguggugagggcccuguaucuuugaggugauauaacaaauggguagccaaguuaacuggcuaaccugaacuuaaccaugauucugggaucuuuuuauacugcuaagauacuagcaagaggaagagaacacacaucuguugucuaacagcagugaaaaggaguguucuggguuuggacauaggaggcaguccucaaauuuaagagaugggccucaguucugguauuaaaugagugugucaccacuccuggauuuuccugcccuuuuaaaacaaguuuauucuguagccuaggcaggcuucaaauguauuugcaauccuguccauccuccccaaguacugggauggaauaggccuuuaucaccacaccuggcuuguauucauaaugugcaaagccuuccuauuugcaugaggccauaaguucacuuuauuaucccaaguauuuagcaaccugaaguuagacagugccaaaacaagagcccuauuaagugaggcaguguggaaaagagcauucuccacauagucagccagggugccuugcuugguguuaguacucugguucucaacuuacugucaggagggaguagagggaggcaaaaucucucuggaaaugcauucaccuaacaaucacuccagcagugccuuauucacuauauguuuuuaggucuaaaagguaaaaagccauacaucauuacaaaaucuuaacauuugcaguuguucaacugccagaauauaagcccuuggucuucagcugacuuggcuuaaaacauuuuacaaacugcacaucucuuugaaauaauuuaccucuugguauuaauaugaaaauaauccaaauacaauaauuuccuaaugugaaguaggagguaaauagccagauaucguacuguuaagaguuuuaaaaacuuguuacgaguuguaauuugagggaaaaauuaagcccuuaauucagcccuugggauuccaauaaauuauuccuuuuauaguccagcauacaaagaguuccuuguagacaagcagcaaacuuaagcuuuaaaagaaaaaaaaaagcaccuaggacuaugcggguuacaauuugauaagcuugaauuuuaaccaaaguaacuuucaguuuuucagacuuaaagaauaaagugauaaggaucacaguuuauguaucuuuuuuuaaaacuuucaaaaucuuaaauucaauauauacuaggagcaaauggcuaacaaauuugcaaauuuaaaauuaauccauugucauaagucucuccagaauugggucaagcaacaggaaaugguaauuuuuaucacauaaaacuacaucuggggguaaauuggggauauaacuuaauucccuuuuacuuuaaugcagucagauugagugucgugguuucuugucuauuuugugucuucaagaauauugcaaaaaccuaaccagccgauugcugugcaaugucuccuuuuccaagacccccacccccaccccagauguagucacuuccucugaaagugccugguggccgaggccaugugcuugacauguggcaacaggcaaaaggcuucaccuauaaaaucaacaccuaaacccaagugagaacgauuaaaccguccuaaaacagguuuucacgguaaugaaaaaucuagauugaucuuugccaacucuacuuccgaggcuuucuuguaauuuauauccauuuaauccgagaaauauuggcaaggacuucugccacccugauggccuuaaaggccugacaaccuacggguccuauccacccgguucccgcuccauuaaaaaaaaaaagggggggggggggugagggaccuaagacuugacucucaucgauccagggaaaggugguuucuuuugacuaacgaugucgaauaagcugcuuaagaauacgaacuacaagaaaucaggaguuugaauaaaggucgccaguacagagaaccgaauccagacucccaagccuuacagcggcgugcgcgggcuucgucacaggccagguccugaggccccgcagccgcuggcacauggcccgccaggccuccaccgggcgcucggccuggggaccuccaccucgaccaggcucucgcccccgccacaccgccccguuccaggaguucccgccacacuggcccucggcgcuaggcccgcgcgcgacucuccucgccucggccccaagggcgccgggccucgucgccacacggaugaggccugcguggcccucggggccaagagagggccccacgcuccagcccuagugccagcgccgcaggacggacaggacgcccgccacaguacggcgggccagaaacuggagccgagacgccgcucgggccgagccccgcgccugacgcagcagggcgcaggccgaggugcggccgccaucgcgccucgcaguuccggcccuccguccgucucggccgcaccaaccccgccaccuccguugcgcaggcuacacccucgccucucaccuucggcgucugagcugcccacagcggaggagacucggacgaagaaccaagaaggcgacucgcaaagcagcggcuguuuauuuucaggguccuugccugcgccacacgcgggucugcacacggccccacacacgccgcugcgcacggcucuccuccgccucgcccacggauccaaucagcgcaggaagccaggccagccaauca

SEQ ID NO: 3182 - RNA, 1092 nt, Mus musculus
uuuuuuguuuuuuguuuuuguuuuuuuuugcuuauuuugagacugggucugacuaugguugaacauuuuguucuucuguugaaauggaaucuagagucuugugcgagacaaaugcucuucuaaaccauaucuacagcccaaaggucuuacuauguagcuauggcugaccugggacuuguuauguagauuagaugaacuuggacugacaagagauccuacugccucuacuucucaagugcaagcgacuaaagguaugcaccaccacgccuggcugcucucaacuucuaagucauuucugcaggcccauguguaaguuuaaagaguaagucgcuagcggaaacuaaaaucuagacaaauuuuaguacuuuuuagaacucaagagacuugagauuuccagauucuucauguuuguauuaaaaaaaucauuaaaacgggacagaguucuagaaugcuuuaguuuauauagaaauugucuucagggugugugguaacgcuagggaaucaaacccaggacuuacaggaaaaauuuaucuucugcuuugaggaccuaugacuacacacacaaucuauuuuggagacaccaugaaaugcaaacgacggucacuccugaauggggcagcccaggcaauaacuuucuuggccuccucucauccacaaauccuagggaugucauucauuaugggucacaagaaguguugugacacaaaucaccugucaccaucuucaaccucauuaggcauuuucauuuggggcuauugcaagccaggggcacuagcagcgcgcugucgguuuauacccaggaaacacaaaacccaaacgcaucucauggaccguaacgguagccacagccgcuucuaugaucaggccacuaagaccuucccccaaaccuaaguguguguguauuggaaccuggucugcuucugagccccaccaggcuuaggggaggccgggcagggggagauuggcucccgcaagcugcgaccacugcccggaucagccccguaggcuggagagaaccagcaaagguucgagggacgaacugcuaguaggaaagcagcgaaccacucaucguagacacggaacccagguacg

SEQ ID NO: 3183 - RNA, 25788 nt, Mus musculus
cuccccuuccgcccucuuccaccuagguuuuggcaaucuccggacaggcaaugaaaaaggugggcgcaguugugcgcaggcgcagacaacagagugcgcaggcgcaguccauagugcagugcucagggcgacguggcgggcgggaguacggaagccgcagggagaagcuguucucaccgcuacucugagcaucuuccugcugcguggagcuaccgcugacaccauguugaagaaauucgacaagaaggacgaggagucuggugagggccccuugaaagaccuggggaggucagauccucguagggguucaugggaccuuccuuggcuuccuucuuccgggccucugucagagccagauccgaggcccaagaggggcaggggcuugugcgcagguccaucuauaucuguucucggaggaaacgugcuguuugcccucuccagcucuggccaggauuucugcgugaccuugugcggguaacacuccucucugggccucaguuuccccaucuugucagaggagguucccaggcuggauguuaccuugcauuucacccgaccucuugguauuugcugcgauaauucuuugccuaucuggguguaaccaguccuacaguuaauaacccugaccguuucauucauucaauaaacuacaauuacugaacaucaggcaccucacugaucauaauauuacaguagcuaaagcaaguucgauacuagaugccugcaauaggaauguuaggauggagagcccagacaguaaccagauaaucgcaugcauaauuuuuuaauguaauaucugcugucagggaaacucagucacagguuaguuaguguugguugucuccgacacauagauucauuuaaguucugguugcauagaucagugccaauuauugaacccuaaaaugcucagaaagaaugcuuaggugacugugagagagccuugacggccucugguagaugauagagacuuccuucucucuuccucguguuuggcagguuuagggucacaguucggggcuguaacucaguugauagagugcuugcuuagcuugggugaagcccuguguaugauccacaguaccauguaaaccaggaggccgaggcgggaagaucagaugcacaagagccgaccucugcuacauuuugaguuaaaggcuagcaugcgauacaugagagucugugucagcacaggaaaaaggagaaaagcaguucauucaagaucacaaccguaaucagucuucucugugcacugcagguggaggcuccaacccccuccagcaccuggagaagagugccguacuccaagaggcaagugccaccaugccugugucuggucaggaauaccugccagcccugcugucagauacuaacauacauggagugcugguuuauaaagccuggguccaggaagaugggacuuuauucauuguauuugcuaguguggcuaguauuagggcagcccaagggaagacuucugguaugguuaguagauaaauuaagaaaaauaaacucuugggagcuggacagauggcucagcgguuaagagcacuggcugcuuauucuuccagagguccugaguucaauucccagcaaccacaugguggcucacaaccaucuguaauaggaucugauguccucuucuggugugucuaagacagcgacaguguacucguauacuuaaauaaaaucuuaaauaaauaaauaaacucuucccacuugagaauacauuuauguggacugaguuaauacguacccuaugguucucuaggcccuucaugaacugaggggcagcugugguagaaaaguguacuaggcuagagguaaugguugcuucuucacaggcucgggucuuuaacgaaacucccaucaauccccggaaaugugcucacauccucaccaagauccuuuaucucauaaaccagguaacaagaugaacuuggcagggaauacaggggagguuguguaaauggagauguacccuuacgcuuuugacagcucugugauuggaaccaacagucuaggccuggguccucuuaaguuuccggcucucauuuguugccugugcucaagugccugcaggcuccaaaggucuagccuacugaccuccuguccaaaccuguggcuuuucugauucccacagggggagcaccuggggaccacggaagcaacugaggcuuucuuugccaugaccaagcucuuccaguccaaugauguaaguacacugaugaucugugcguuucugcagauguugcacccauggcaggguggcaggaggucugccugucaguauagacugccguccacagaaucaggcuucuccugacucuaauccucucccaccaagcugaucaggucuucuccaugccuuuuucagcccacacuccgccgcaugugcuauuugaccaucaaggagauguccugcaucgcugaggaugucaucauugugacaagcaggcaugucuugggcagggguggcuccucuggugggauccauugacagagacaacauguacagccaagagccuuuugacaucuguucugugcccuuuccucuuagcccacccuaugccagccucuagaauggucugcuuauuucucacuuccuaggccuugccuuucuucuuccuccuuagacaauacaaccagcauggagcuuucauaagucuuuagauagugcuaaggaaaagaaaaacagggugcaggaaguuaaugagcaagucuauuagccaguacugguuucugcgcuaggcugaguaauuuagggacagacgucacgaauauauacuccguguccuggagaacugagagucacagcuggaccuggugcugcacacuuguucucccagcauuugggagaaacaggaggauggcugccaguuugaaccugccugggcuacauagcaagaugucuccaaaaaaugaaauaaaacaaaaccacacaacaucccugccucuuacccaguucuucuauuucuucuugacauugcuaucugaggagagggaccauacagccagagucaggggcauugauauuuccuggggcuggaaagauagcucagggguuaagaucucuggcugauuucuuagcauccacaucaggaggcauaaacccgucugucaguccagcuacagagaguuugaggugcuguccggcaggauggaaugcuucagucccggaggaaacuguuauauaacucacagucucuguagccuuaggauuuaccagcaaauaaucaggcaguggggcucuaacaugguuuauggaacuguaaaagacuaugaaaacagaacagaaggacccggaagaccaaauucuuagcauaaaggagauuuauuugcuccagaaggacagaggaaagggaauaagagacagacagaagaugagggagaaggggaaggaacaagggagaaggggcagggaugguuguccuggaguggcguccuggauagagaggagacagacauggccaauaggcaaauaguaauaaaguuaaaggggggaaaguguuaggaggagguauuuaauuguaauuggacauguuaauuaggugagccaaagcuggcuuuugauuacuggaccuauguagucagccucaguaggaggauguggcuaacaaggaaugaucccuggcagauagcuuuagaaaugugaucuaguggcuuuucacaaggcagaagggaugggggagaagggccaaggcugccagagccaugcucaccaugcucaggcuggccagaguuccuucagacaacagcuugacuuuggaucagagaagaucuccagcaugagcuagauugggaaggagaaagguccaggcugagcaguggcaggugagaggccugcagaggaaagcaucucacugagacacugcucuguuugcugcuuaugaauccuugagcugauggcgauccuccugccuuugucccugagugcugggauugcaagcauguagucugucuugaauuccgugaaacucccuggagcuguuguuuggcuuggaggggugagaacagaagggagcaguagcuagcagacuggugugguaaucacaucacugguguggugguguggacuagagaagaaggauggccuaugacccccgcaugucaacagugccuccuuuccccggcagccugacaaaagacaugacugggaaagaggauaauuaccgcgguccugcuguccgugcccucugccagaucacugacgugaguccuuccaucucuaccugcuucccaagcucucgagcauacucucggcugucugcagcugucugaaucaaguagaggagccgggugggagggacugacucaguaggagcuucugaaaugguugcuuugcucugcaccccguugcuucuacgucugagcccgcguucucccaccacagagcaccaugcugcaggcuguugaacgcuacaugaaacaagcaauuguggacaagguucccagugucuccagcuccgcccucgugucuucccugguacauagcugugacuggggccugcaaggguggguugaagguagaauaaaaugucugaggccguugucagaggggaaucagacacucuggguucauugggaagagcuggggugaguggcuuugacccaccccuuacaugguagguugucaggacuggcaucagacaggaaaucugccaggcgggaagagugaggguugacagcugucugucuguccauucaugggcuugggcucaggauagugaggagggccuggcugcauaugagagaugacaggaguaugacaagaagggcaccuuuccuuuugacccuuuaacaagucccacugcccgcagcaccugcugaaaugcagcuucgauguggucaagcgcugggugaacgaggcccaggaggcggcguccagugacaacaucaugguccaggugagagggacacugaaaacaaacaggggcacacugucauuguccaaccuccacaaguucugguggccucuggccaggacaggcucuuauucuuuugucacugggugugggagauggggacauggagagaagcagccagggcagcacauggguguuuaggaaggauuucucacuggaugcugcugauagaaccaagucuauugaacgauagaugggaauguuuuggaauacaggcuguuacaacccaccuggccuagguaggccgauggccaccacaguccaaaccuuugcugagcugguucuguuagugacaugggguuuccaucugagaaacuuuccucuguaaccuaaaccugguaugccucucucugagcgucaguuucucuggaacguuggaagagcaaggguuaaaugagaagacauacacaaugagggaugggaaggaggcuugucccuuucccucagugauuguuguucuccucacucuguguggaucaugucuuuggggucaguaaugaugcucuaguguacaccucuaagggucagaagcacugacuacguggaaaguacacacaccugccauaccuuggcccucacaugccacuugacuaagaauggacagaaugaaugggaagugaccuugguaacuuacauuucuaaaaguggugucccugggcuucuagaccuccaaagccagcuugaccacagugggacaaauaaguagggacaagcaggccaguccucuagguguuggaaggguuuguguucugugucccacaggacuaugcucauaucuugcccuagcugugugcugcagcucuuucuauucuggugucuucucucacauggucaggauaccugcaggguccagaacucuggugcaagugagaacaucauguaugugauaguguguugggcacgacacuggaguugguuacggggagugcuugggaguuguuccagccccucuguguggacaugagugcugugcuuaaacaagaaggauggagcuagagacacacagugcccuucccagggcuucugugucuguugcccaugcugccucuguccuucaguaccaugcccuaggacuucuguaccaugugcggaagaaugaccgacuggccgugaguaagaugaucaguaaguucacccggcacggccucaagucccccuuugccuacugcaugaugauccgaguggccagcaagcaacuagaggaagaagacggcaggugaggacgcuggucucuugccagcuagaugaugccuucugcacugcuggacuguccccaacuucuuguugcuuuguucuuugguagccgugacagcccgcuguuugacuucaucgagagcugccugcguaacaagcaugagauggugguguaugaagcugccucagccauugucaaccugccaggcugcagugccaaagagcuggccccugcugugucaggucuccauauauccccuuccuugcugggcacaggccccgagccagagaucuucagauaggccaugauguagggcugucacagguguugcuuuaaaggagggcuguuuucaguuccaucucagugcugguggggcacugcugggccagcuggcuccagaggaggacucgggguggggcccaggaccuauaaagcucagggugcuugcucauggggcgcacuggaacucacagcuggacucacugcaacugcccugagcaggcagaaagccccuguccucugucugaccuuccucaccaggccucauuucccuucugaaacacaaagggcccucuugcuguaggugguaccggugggaucugcacaggcuacucaguagugugacacacacuacugagugcauucuguguguguuacuaaggagaagccaacagcuuucaguuguuucugcucuagcgagcagagcagugccugucucccugccggaugcuggcguugggaugagaguagagaauaugcaccuggggcuugaaaagcuaaagagcugcugcaaaacaguugagaggucaacgagggucugcauaggguuucaugaggaggagagagggaugaauaucuaacucaggacccgcccagaggcaacgaaguaagaguuguaaugauuggacuguucuucuagaggucuccacaguggugaugauacuaaacugguaggaagauaggcucaauuauggaugcauuuacucacugacuagagacuaauguacuccuaugauagucucauauuuccagaaaaugaaagauaagaaguagaggcuuuaaaagauacaucauccaacuauuuuaagagaaauguuaguuccaaaauaaauagauagguagauagauagcaagagaaaagcuaagcaauauucuagaauacagucccauucaagacuauacuagaacauagacuuuagcugugagcuucgggcaggcagguggagggaauaguguggucccugauagacacagcaguggucaacucuuuagcacugauccagagaggaauacauuugcucuuugagagaggcuuuagcccccuagcuuggugcugagguauguccuacuggguccuaugaacauagaaagagagguggcuaggugggcugcagauguggacagcccgugacuuaccccuuuugcugucggguagcugcuacuaaaagucacuugagguccuuugccgcuguucccagggaguucagagaaucagacaggcacagcauccacucagugagggccuagcacagggcaggugcuuagucuaugacggccauugacacccacagggcccuugcugacaagguucaggacgaggcaguucugcugcucucugcuaagcagaaggcuugugugugacuagcccgagagcuuguucaccuuugaucccaugccauucccugggaaccccagguauuccacugacauucccuugccuggcaucuaggcagccugaugacagugucuuccucccugcagugcuccagcuuuucuguagcucacccaaggcugcacuucgcuaugcugcugugcgcacccucaauaagguaagaguugaguggagaggaggggaugcaggcugguccagcugcugucuccuuucccugaauggacugggaggcggguagacaugguccccaaaggaccucuggccaggccagaggugaaaugacagaauuggguacugcccggugucuguccucccucugcagguggcuaugaagcacccuucagcggugacugccugcaaucuagaucuggaaaaccugguuacagacucaaacaggagcaucgccacauuggccaucaccacccugcucaagacagggagcgagagcagcauugaccgccuuaugaagcagauuuccuccuucaugucggagaucucagaugaguucaagguacccaguacccucacagccugcaguccccaagacaagggagauggucugagccugcuguccuuccucccaguuuuugacccucugucccuuugaaccuuaaauacagugugcuagaguuucggaaguggggcagcaguggauggggcagaugggaacugucuguugggagaguaagguuuagaaaaugagcagacauguaaaugagcaguagccugagaugcagugaggagcuggcccugaaguagcagcugcuggggaggaaggcagugugagccagggagaaggggcaggagcagggauugggaaaguacucggagacaggccagcuggggagcaggucaaaguggugacaucagaacaggcugcgguuguuuccugacguagagcucaugguaaaguucuaauuguaaaaaagucguuuggaaggauggugguuugggacuuauuuuuucuauuuuucaaaucaagacagggcaucccuauguagcucauucgaccuugaacucaggaugcuccugcuugagcuccuucauugcuacugggauuaccaauauguagugcccugccuggcuuucauuguccuuucuguugucauuucgguuuuucuaaacaggcugacuuagaacucaguagaauacagacuagugucaagcuuggagcaauccuccuaccgucucccaaaugccaauaguagagauguaugccacuguaucuggcuucucuuacucuuucuuuuuuuuuuuaaaagacaguguuacucuuuguagcccugacuguccugccacucacucuauugaccaggcuggccucgaacccacagagauuugcaugucuuccuccugaaugcugggauuaaaggcguguaccaccaccacccaacauauuuuuuaaacuuuuacuuuagaauaauucacaggagguugcaaauaaauaacuaagaggggagcccugggcauuucuuuccgcuccagugcccauauccagcacaguuguaguugaugaggaaaccagccguuguacgaucuagagagcuuacuucgauuucguugguuacgagaugcaugugugauaccuuucaaaauugcugccacagucagacuuagcaucacuagacagcacucaagcucuccauuccuagcccugcacccccgauucuugacagucgcuaauauauucuuauuuugcauaguuagauuauuucauuguuauauaaguggagucaugaaaucugcagaguuucugucagcagauaauaguaggagcaguuuuuaauucagcaggauaaauucuagaguguggguuguacaaacugggcagaaaucuacucugccuguggguuauaugaaggcgauguggugagauuugcagaugagaauaaccuagcccuccugacaguggaggaugaguuugaggagacuuggaucucagaagaugaacuggcuuaggagccugcaagagcggugaugugagagccauagaaggacuugaaucaguuaaagacaagggaggggagagcagagggaagaaguaggaaugccaaagagacuucaggaaaagagaggagaauggaaugucaggugaaaacagaaaaggcagggaagaagccggccaggcagggcuuggagaccgagacacacuuggucugccaagacugccauauuuccccugccuuagguggguucaggacuuaugccccagcauggagaaguguuccuccugguuucaucuuauguugagcccagggcaugucuuccccuggagggacucuguggcauuuagugagcaaguccccaggacugucagggacugccacucauucaggucucucucccagguggugguuguccaggccaucagugcccugugccagaaguauccucgaaagcaugcugugcucaugaacuuccuguucaccaugcuaagggaagagguaagggcggggccgcugggguccuucacauucuguuggugcagagaauggccugacugccaaacuugucucuugguguuacgcucagaacacuguuaaacggcuuguuuccgcgccugcggcgcuuuagacuccgugcacagaugaagcaagagcagcagcugucauaauuacaguagugauaugugacucaccagcauggcagcagguccagcaggugccccaaggcagugcuuauacagaagggcggggcauggguucuguuaugaagucugguggugcaggaugcugcaugucagucaggagcucuuggaaaacuggggcugaaaaacacaacaugggugccaggauuuuguuggguguuguuuguuuguuuuaguuuugugacagggucgcugcauagaucuggcuauccuagaacuuacuauauagaccaggcuagccuugaacugacagagauccacuugucucugccuccagaaugcauaucuguaagaaaugaacuuccacugggcauaguggugcccaccuugaaucccagcagucuggagguuuccuaaacaaaccuaaugacuugauuuuaaucccuggauuccaugguggaagaagagaaacaacuucuaaaaguuaaccuccuguccauguuugugacaugagauauauagcccuguauucacauacauuuuuaaaacauacacacaaaaugauaagugugugugcaugugugugcguguuagugauuuggggggggguuggagaaaguuuaggagugcauacuguucuugcagagaaucaaacuuuggacucaugauuagcaguugauaacugccuauaacuccagcugcaggggauucaacaccauauccuagccucucugaguaccuguacuuauguguacuuaugugcacauauccucacauagacauacacacacacacacaacacacauuuuaaaaaagaacaaaagaaaaaaggauucugggaacugaagguguaguugaacugguaggaugcuugccuagcaugcucgaagcccugauuuggccccagcacuguauaaacugggcaggugauacauacugcacuucccaugccuguauugcacauccuaacaauuggaaagcagaaacaagguucagagcucaaggccauccuuggcuacauagugauuuuaagguuagccugggauacacuagacccaucuaaagaacuggaacaugaggcuuagugugacuugaguggaaugaccugccucucagguaagucugaagaacaagcagaacacuuugugguaucugagcucaggugccucuggcccuuaaagcacagguuucucucacugaaaaagcccaagcuuugucuccucagcuuucuggcucccucccggaaaguuacaugcuuucuguagcagugaagguuaugaauggcccucacugaggggcuggaacacucagaccugagaacuugccuugccucugcugacaucugucgugcagccaggacguggcugccugcagcagugagacugaagcagcguuucggggguuuauagccuaguaccucacucacuguggucgcaugcugagcacacagcaccuuguuuuccuuuuccccuugagauuuguucuuccuauguuguccuggcuggcugugaauuuaggauuguccugccucaguaucuugagugcuggaauuacaggcaugggccaugccuggcucagaucucaccuuauuuguucuucagaauaaccuguaaggcugacacacgaaaggcgaagugaggggccagagagauggauaaaaagacacuugaucccugacacugagagcagaaagaaagccaggacaggagagaaaugacugcgacaaggugugcucuugaguccacacacucuaguguguggucacgaguacccaugggcuggauggugggccucagcagcagcccagcgagcugcuccuguguugucccaguccacagagguggauggaaagaauaccagggaucaggucagggccuuguuccacugaccuagacucuaccgccaucuaggaucuuuuucuuaacuuuauuucuauauaugagggauguaggggucugugugugaaagauggaauuauagacaugcacaacuauguuuagcucaucaaaacuuuguaguuuuuaaguuuucuugauuuauuuuauauauguaaguacacuguagcugucuucagacacaccagaagagggcaucagaucccauuacagauggcugugagccaccauaugguugcugggaauugaacucaggaccucuggaagagcagucaauguucuuaaccucugagccaucucuccagcccccaauuuuuacguuuuuuuuuuuuuuaaaauauuuuaucuuuagggguguauguguguguguguguguguguguguguguguguguguaaguguggugucugagcagaguagagugggugguagguccacuggagcuggaguuacuggcaucugugagcugccagaugggggugcugggaacuucagucuuuuacucuggaagaauagcuguuauucuuuuuuguuuguuuguuuuuuugagacaggguuucucuguguagcccuggcuguccuagaacucacucuguaguccaggcuggccucgaacucagaaauccaccugcuucugucuccugaguacuggaauuaaaggcgugcaccaccacugcccagcuagcugguacucuuaaccacuaagcugucuuuacagcccccuucagguuuuuuuguuuguuuguuuuuuccaguuagauuuauucauuguauuuuaugugugaaugucuggcugcauguauguaugaacaccaugugcgugcuugguguccucagaagucagaaggugagagaucccauggagcucuauuaugggugguugggagucagccuguggcugcuggaaaucaaaccacaguccucuuucuggacaagugcuuuuagccagcccaaccuuuuaauuuuccuccgagauuucuuacccacaguucuccucuauguuuaugaucugacugcugcaguuaccuuaguugagggaaaucgugaagugcucaucuuuuucugucuccuuuauucucagguuccaucuguaucauagcauguaucaggacuuucugcuuuucaaugcugaguaguauuccuuuagugaagaggcuacguuuuguguacaccaugcuguggcccuugugacaggugcuucugcaaucuguccuguugcugauaccgagcacuggaguuaccgaucagauaauucuguccuugguguugugaggaaccgccauguuguuuucccagccuugugugcuacccacuccauuuuuucauaucuccguucuguguggagaauaaucucccauagccgggcuuucuguuucaugucagugggucugguagggcuauagcacgcaggaguaaaggaagagagcaguaaagugcauaauguaaguguauacacagcaucccacaggaguaagugggaaagccugggggaaggagcagucauuggagacccuuguugacagccugucuccugcuagcugagacuuggcaguuggccguucccacuacacgaguuuuuacaucgugagaugagcuguagggggucuuuugcuuugggacugcuuugcuuagcugucuucagggacacuucguuuuaacaucacaugauuuacucugcgguccccaaaggugcuguuugcacuccuggacuguacugcuguucuccuuuccuuuuaucacaggacagacgacaaucaucccuggacaaggggucuuggaagacaaaacaugauugggugugaggccagaacagaguuagggagcagcccuucccuuccuccagagccagcuuaaacagcacacgacaguucacuaguguaauguguguuacacucaguagaggaaauggggucuaaaauguuuccauuaaucuuucuccuguuagaauuagaaggccaagccuuuuguuuuauccaacagagacuggaaccaaggcuucugcuuccaggcugccuauggagcguuguucccugggccugccugagcuguaggccugcguuggucuccugaggaugugagaucuuugcucagcuagacccuucucucugcaggguggcuuugaguacaagcgugccauuguggacugcaucaucagcaucaucgaggagaacucagagagcaaggagacaggauugucacaccugugcgaguucauugaggacugcgaguucacugugcuggccacccgcauccugcaccuguugggccaggaggggcccaagaccaacaacccuuccaaguacauucgcuuuaucuacaaccguguggucuuggagcaugaagaaguucgggcagguauaucugagcuggggugacccuggccucuuagcuucuuuugcagugaauuugcccaguaaugggaccuaagcucucagggggacaagcacacugggaacauggccuuauaagcuguuuuuuacauugucagaaggauuuuagaugccaaauggauaaaugauuuuuuuaaaauuuaauuuuuuuuuaaauuucauuguauauucguacuuaagaguuuuuuguuuuuauuuuuugagauagggucuuauucuauagccaagcugguucauacuugaaaccguacugcuucagccuucugugugcuggaauccuaaguauguaccaccauaccuggagagagaacacacaccacaagauuuaucuuuuuuuauaagucagugaucuaacagucuaccauuuugguuuuuuuuuuuaaagauuuauuuauuucaauuauaugaguacacuguagcugucucagacacaccagaagaggccaucagauccuauuacagaugguugugagccaccaugugguugcugggaauugaacucaggaccucuggaagaauaagcagccagugcucuuacccgcugagccaucuguccagcccuaccaucuuguuuuuaacuucaucuuauuuuccauuuuuacuucuauucccuuguaggcaaauuuucuucuuuuaguaguuagucguaagugaugguuuauuuucucauguuuuacucucaagcuuagcuacaaaggaagcugcucagaaguagcuaacaguguugauaaugccugucgccuuauucauuugaaaguugucccuaaagcccuagaacaagagccacaugugugucacccuuucuccagugacuggaggaggaauuagagaccuggguagcaccaagauccacuaggauuacacaggaucuguucugugauugugucagcggugccacccccuagcgcuucugcguggauucccacucugaacacuggugggcagccucggcacucuggcaggugggccugaggggcugcgggugagucauauuuaccuuggaacuaggugcaguaagugcucuggccaaguuuggagcucagaacgaagagauguugccuaguaucuugguguugcugaagaggugagucucagcucagaagccagagugcauagcagugcucccuuggguccaguccaccuuuuauucacaauucucuauauagcccuggccauccuggaauuuucucuguagaccaagauggccucaaacucacagagauccuccugccuuugacucccaagugcuggaaucaaaggugcaaggcaccauauccaacgaagauuuaauuauguuuaucuuauuuguguggguguuuugccugcauguauauuugugcacuuuuugugguauuuaguaccugcugaguccagaaguguacuccucuaagcucaaggguaccucuguguuuugccuuuuuuggcuugccuauggugcugggugauaucuuuacuagagagcugucuaccacugagcugcaucagccccuuguauguuauaguguugagcuuuagagcuuugccuugcccugccaucccuguacaguccugcagggucccucugacccccuggcuaggcucagucaggagugccuuguguccuggcugcaggugugugauggacgacgacaaugaagugagagacagagccaccuucuaucugaacguucuggaacagaagcagaaggcucucaacgcagguuacauccuaaaugguaaguugucccuggccaccagggccuuccuguggccuuagagaaggcgugcugucccugagccaaggcacccaagaccauucaugcuucacuagaguuguauagcagucucuuggauugauauaaccucagaagacccagggcugcauggcuugauccagucaauggaaauaaccaaguaaauuaagugcucuuuguguguuacucuggcuugaacucaggacuugcauaugcuugccaagucuccaccacugugcuguauccucaguccaaaacuuuguuguuuugagauaguaucucuuuauguagcuaaagcuggccuggaauucaugacaauccccucaggucaauguccagagugcaaaacagucauuaauaaaaaucuuuaagccugguauguugguuucugucuucguaccagcacuuaacuuauuucguauuuaccuaccugccaacccuggaaggaggaagaggauagggagggaguaaagcuugcagguuccaugacugucagcaucagcacaucuaccagucaugguaggagucccaggccucuguccucccuaggcacgccaugccucucugucgugccagccaggcagaauaacucucuacugacuuuaggucugaccguguccaucccuggucuggagaaagcccugcagcaguacacacucgaaccaucagagaagccauuugaccucaagucugugccucuggccaccacgccuauggcagagcagagaccagguaaggcccugcucauccccagggcccgucuguuucccuggacuguagagugugcaaggauaggcugauauacugcacagggaguagccccaaguggguagggacagccaugcugacagcuugcucuuuuccuugcacgcuucucucucgggagaguugacauuuacaacauccaagcaauaacgugggcucagcagcaccaugcugccugagacuagagcuguggguuaccacaccagguaugcuugcucuugcagaaagcaccgccaccgcagcagucaaacagccggagaagguagcagccacacggcaggagauuuuccaaggugaguaacgucauuauggucaguaguugugugacuucagagccugccaaccgcugaucaugcaugccucagugguagaugcuggugugcauguuugacgcccuacauuucagccgagcacaaagguuuuaaagagagcaaggacuggguuccuuaagagccaggggagagagaaugccaguuucuuucuuguuugacucugagugcucauggccugauggagcuuagcuggcauucagagacccugugcugugcuucugguucuuuuuuuuuuuuaagauuuauuuauuauuauaaauaaauaaauacacuguaucugucuucagacacaccagaagagggugucagaucucauuaccagugguugugagccaccaugugguugcugggaucugaacucaggaucuucagaagagcagucuuugcucuuacccacugagccaucuccccagccugcuucugguucuuuuuuuuuuuuuuuuuuuuuuuuuaaagauuuauuuauuuauuauauguaaguacauuguagcugucuucagacacuccagaagagggagucagaucuuguuacggaugguugugagccaccaugugguugcugggauuugaacucuggaccuucagaagagcagucgcaugcucuuacccacugagccaucucaccagcccuucugguucuuucugugugcaguucauguugccuuauaagcuuugcucuuaaaacacuauauuugaaacuuaaagacuaguccaggaacuugagcucagccuaucucuaauccucuugucuuguaucuguucacuauugcugcuguaacaguucaucaagccuugugucuaacauagccgaccagugaucuugccuaggauuaggaaagagagcauugucugaagcuguuaguggacaucuuuacagacaccuagcuugaucuucaacuguauucugcuuucagccuaucagaacaccaggauuagccugggucagucauggugacccugggcuaggaccugccaugaugcauagagaggagagucuuacccacagguuacacuaaagguucccaaagaaguuaauuuauuuauuuacucacucacucauuuuuuagugcuacaguuuaaccuagcacuccaagcaugcugaauacaaguccccuagcacugaacuauagcccuguugucuuugugaugcugagccaucuuaaugaggcacacauguagccuugaguucacuuuguaccauaagcagccuugaguuggauccuuuugcuguggucuucugaguagcugggauuaaaagucugugcuaccaugucugcuguuucugcacauucugaaguagcuuuucauugggcauaagagcacucacuucugaucucaagacucggcaagcugaggcagaaggaucacaagguugaagguagccuggacuccagguuaggccuuccagagaagaaaaagaaaaaaaaaaggauuauguauacauuguucugccugcauauaugacugcaggccagaagagggcaccagaucucauuacagaugguugugagccaccaugcgguggcuggguauugaacucaggaccucuggaggccccgggcuguguuucuaaaggaagcagcucauccuugccguccuuuccuaaccuccacaucuuuaagaguccuuguugggggcuggggagaaggcucagcagcuaagugcacaugcugcucuuacagaggacccacauucagcuccuaacacccgugucagauggggacagcuguccccucuaaucuugacaggagacagacagacagauagagaaagagagaaucaguagugaacuaaaggugaggaucuucagauggauuaggccugagacguugggguuucucacuuagugaauugcuucagacaucuugcauaagacacagugggucuuccuggaggguuauacaacuugaaccagagccucaugagauguaauggagcgagcagccaguuggacaugcaagugucuuccucucggggaggguaugagaccugaggauuuuacuagaaaccaacacaaaucagugugaagauccagaaaccaagugaauguggccuguggcuuucagagcagcuagcagcggugccugaguuccagggacuagggccucucuucaaguccucuccugagccaguggcccucacagaguccgagaccgaguaugucauccguugcaccaaacacaccuucucugaucacuugguguuccagguaagcagggcagccugaaacccaacuggcaccugugcccaggggcaaucccaggucugaugaguccuguagggcuugggggguggggguggagggcggauaacuugauuguuguguaucaucccuccuuguccaggacuucuuuagccugugacuguuaaacuaggcagagggcugggacaggggcaugguguauguguguguggguguaugugugugggugggugugggugggguuguacauccuaacucuucccauauagcaacaucugaaccccacuccaccuuauccaguuugacugcacaaacacccucaaugaccagacucuggagaaugucacagugcagauggagcccacugaggcauacgaagugcucucguaugugccugcgcggagcuugcccuacaaccagccugggaccugcuacacacuaguggcucugcccacugaagaccccacagcuggugaguucucuguagauaccauucacacuucaugggaguccgugcaucaaggauaacacagaaacucugauuuagguauaagaauuccauaggcccaaguucuuuucauauauuaucuuauuucuuucucacagcaacuguaugaggcuaaguacugccuauucuuguucauaguugaggaagcugagccucaguuagguggguuguaacuuuagaaucaaggccuguuuggucuucagacaaguacucuuacgguaggcagcacaguauuccucaaagacuggcacaaacgaccagacaucucagauucacuucaccagcuuucuuuuuccaccuuggacaguguucuacagcuguggcauggucucagccacacugcauugucucuguuuccuuggucuuuucuuuggaucugugacuugauauuccuauuuuauaagguggugccuucuuugcccagcaugcugggguugauagcacguuagccguuauuaaugcugccugaagggcaggucauggccaccugaucuucauccaacccuucuuccccacaguggcaugcacguucagcugugugaugaaguucacuguuaaggacugugaucccaacacaggagaaaucgaugaagaaggcuaugaggaugaguaugugguaagaggauccugucugggacugaagagaugcaucagcaguuaagaggaccaaguucaauuccuagcacccucauaguaaugaacugucuauaacuucaguucuaguggaucugaugccaauuuugggccucuacaggugcugcaugauuuugguucacagacauguacagauuuuuacaaauacauuucugauuuuuuuuuuuuuguggguggggcgauucgagacaggguuuuucuguauaacagaacccuggcuguccuggacucacuuugaagaugugccugccuuugccuccugaguucugguauuaaaggcacgcacuuccaugcccagcacauuucugauuauuuucuuaggauaauucuuuaauuggcucaaaaggaaagcaagauuuuuaagacgugaauugcucuuguaauguugcuuucuagauagcuaggccccuuugcucugcugggccacaguuccuuagucacuagcaugcaucugacauucacacuuguguagaauaaggaccaaaguagagacggccauuccugagccaaaaugacugaggcaggaacugccuuaagaccucuccucucaggagcuauagcuagggcgcgccuuucacugguugcuguaugcccuguaaacaucugcaagaacagguuucugugaagaucuguuggaagaaugaacaaaggaguccuugcauggacgcugcuagugcaggcuggcugaaugggaguguuaugucacauucacagcugagaugacaauaggguuccgccuauuuugggccuggaggacacaguugaaguacagaaucugcuggagaaaugacuugucgguugaagcagugccacuuacauuguguaccucgggcuugcucuguguccugaagcccaccauguccccacaguggcagguaucugcugagugagcugcaggaaggaagggggaaggagaggaguugagagcagaggucuagaaauguggaacaggaagucucucccaaagucuaacugugucuccgcuucucuagcuggaggaucuggaaguuacuguggcugaucacauccaaaaagucaugaaagugaacuuugaggcagccugggaugagguuggggaugaauuugagaaggaggaaacguucacccugucuacuaucaagacacucgaagguaaagugcugcugacgucaucucugacgauacuguggcuggccagugugccuucccgcuucccaccaagaauccagagccuuaagggauaccuagcuugggacugacuggggggaggugggugggggugggaagugcauacuuaauguguuaggcccaggauuucacuagcacccaacaaaagcacacaaauacucauaugccuguggcuuaauguugcugggauuuucccuacagaggcugugggcaauauugugaaguuccugggaaugcauccuugugagaggucagacaaagugccagaaaacaagaacacccacacgcugcugcuagcugguaagaaacgucuguggccugaguagcuucacggugggagugccacuggguuuugucugccgccauccaacuucccccacagcaacaccugugugcucucauaguccuggcuaggccuuguccuuuauccuaugggauuggcugcaaaggguguggcaugguggcucuggucaucugaaagcaguaggucuguggucuaaggcugaggauccaaaugccaucuccccagcccccgaugcacuuuuaagguaguuuuugcauuuugaaugaagugucuucuauucauauuucuuuuucagugacuugucugauguuccuuuaucuaaguaucaacuuuauugggguuauuuuguuguuguuuuuuguuuacuuuauuagaagaguggguguggggccuggccugguaacucacuccauaauuucagcauuugagagacagagacaggaacuuuuguguaaguuaaagccaagggcuacauauugagacaguuuccagaaaaaccuaagcaaagcaaaacaaaauucccaguacccauaguugacaacugucuguaauuccaauuccccuggauccaacaccuucacacagacauguugcaguaaauuuccaacccuaauaagcccagguaaugaaaacacaacucaguucauuugaauacaugcugugcgccuaguuugggcagaucuaccacuacacuagcaucuuccccguagaaggaaccccuuguaacuugcaguuucucaaggccaggugcuuccgcucuaccuuacuucuccauccuccuccucauccucuccccuccccucccccucuuccucucuuuuccaucaaaaccuucagcuucaccugccccucuuucucugcccaaucaccgucucuagccuuuauuuauaaauuaaggugggaagcagguuuacaggaaaucaccugagugcugacucauuccuuguucacagccacucacaggagaacagaauuaacaucaaauacaauuagccccagugccauccacaacacagacauacaugcaugcaaaacaccuacauaaacguuuuuaaaaaauaaguuaaaaaaaauggcugucuacauuucaucuuggaaauuucccaacacauacaaaauuaaaugguacauauaaugaacacuacugcuuaauucuugaagcaccugcgcccacucuucccuagaguauuuucaugcaacuuauuuuguaauucauauauaaauacuugcuauccuguguuuagcucaaaaauggccaaagcuuauauugcccuagacauuuguggaaauggagcugagaaugaaacucagugauuaaggcuaggcagauuucugcagcacaaucuucauguauaacccuaauuccuugaacuuguaauucucuugccucggccuucaguaacccaccacaccugacuuuuaucccuccgcagggcugauggucagacaaggcaaggcuaggcaaagcaagcagucuguuguugagacacaccgagccuuggauagguuuuguguguguguggguggguggggauaguuauuuugggaguugggggcuggguguguuuacaaacaugguugggaaggcguucugcuucagugagugcucagcagagcacucuggccuugaugaagcaacucaguccccugggucugucagacaacugcuuugugguuuuuuucuuauagggcucgcccccucauccacacucucagauucagccacugucugugagccucuaauaugagguauaagccuuacauacccgagcguucacuugagccuggcaggaggcucaggugauguauaguuagugauguaugcagugauugauaguuacugcagcacuauguccuuaaggguuccagagcucagggaagcagugagaguuguccaggccucccaguugugccucagugugugcggugggggugggguggaguggggugggguggggguguugaucaugugucacucucagcacagccuccuucagccucacaaaacucugcuuccucucacuuacaggaguauuccgggguggucaugacauccuugugcguucucggcuucugcuuuuggacacagugacgaugcaggugacagccagaagcucagaggagcugccaguagauaucaucuuggcauccgugggcuagagguggccuaagccccacuccuaucuuguccaacacuacgucgaagccacuucuucccugugaagccgguggaaacccuuccccagaccacuguguuaagaaacaaucaagagucaauacagauuuuuuuuuuuaauuccauccuaucauucaggaaugcuaggguagauuuugucaccaugccugcaaggagagacaaaugaauaaaauguucagacuuucucuuaauauuuauacucaaagaaaccgucucaucccuaugauaagucagcauguauuucuugaauaacugcugcuucugcaggcucgugcucagggccuccacuucucccugaggccucccuucaccaaauggagcgugugcauagccccucgggacugucagugccaagcuuagggugggguuaaaggcuagccgaaugacaacagcuagcaggucugguaagccacucaucuacaggcaucuguagauggauggguguccaaagguccuuagagggugucaugaucugcucugggucuaugagugggaaaaacaguaucugcauuccuuuugggcuggaguaagaaauccuaggggaugcuucagggcuugggcuuuaaacucaaaucaggugguuuaaacuguuggaaacacuugaagaacuggaccuccugugaggcuacucagauggcucagcagguaaagguaccuaucaggacggacuacccacuugguagaaggagaggaccauuuugcaauaguugccgccuaaccucaugcacaccuguauacuguaugcacaugcacauguacacauuagaacagaggccugcaccuuuaagccgaaucccauaacaugaagacaucaggcuacacuugagcaucguuaagcuguuuuagcuauggccuauuucaugacugguccuggcuccaccauguacuuggucaggcaugcaguggugaacuaaguaacguggugugaaacuuccuaacagguuauaaagagauuucucauuugggggguuuucucaaguaggugaccugaaggcugcucccuaaagacaucccucugucccccaccuuccaucccucuccuggggacugagcaguugcucuugccuggccucucugccucauuccaucccuuuaugaaggccucuccaggcuuuaaaggaaagccugaccuucaaggccacauccugcuuagcccuuccugacuguauucuuccugccuaauacccuccccuucuacucccaggccuggucauagccuggaagccauuccauucaaauaaacuucauuaaagaaauuggu

SEQ ID NO: 3184 - RNA, 5619 nt, Mus musculus
uggguggggcgauucgagacaggguuuuucuguauaacagaacccuggcuguccuggacucacuuugaagaugugccugccuuugccuccugaguucugguauuaaaggcacgcacuuccaugcccagcacauuucugauuauuuucuuaggauaauucuuuaauuggcucaaaaggaaagcaagauuuuuaagacgugaauugcucuuguaauguugcuuucuagauagcuaggccccuuugcucugcugggccacaguuccuuagucacuagcaugcaucugacauucacacuuguguagaauaaggaccaaaguagagacggccauuccugagccaaaaugacugaggcaggaacugccuuaagaccucuccucucaggagcuauagcuagggcgcgccuuucacugguugcuguaugcccuguaaacaucugcaagaacagguuucugugaagaucuguuggaagaaugaacaaaggaguccuugcauggacgcugcuagugcaggcuggcugaaugggaguguuaugucacauucacagcugagaugacaauaggguuccgccuauuuugggccuggaggacacaguugaaguacagaaucugcuggagaaaugacuugucgguugaagcagugccacuuacauuguguaccucgggcuugcucuguguccugaagcccaccauguccccacaguggcagguaucugcugagugagcugcaggaaggaagggggaaggagaggaguugagagcagaggucuagaaauguggaacaggaagucucucccaaagucuaacugugucuccgcuucucuagcuggaggaucuggaaguuacuguggcugaucacauccaaaaagucaugaaagugaacuuugaggcagccugggaugagguuggggaugaauuugagaaggaggaaacguucacccugucuacuaucaagacacucgaagguaaagugcugcugacgucaucucugacgauacuguggcuggccagugugccuucccgcuucccaccaagaauccagagccuuaagggauaccuagcuugggacugacuggggggaggugggugggggugggaagugcauacuuaauguguuaggcccaggauuucacuagcacccaacaaaagcacacaaauacucauaugccuguggcuuaauguugcugggauuuucccuacagaggcugugggcaauauugugaaguuccugggaaugcauccuugugagaggucagacaaagugccagaaaacaagaacacccacacgcugcugcuagcugguaagaaacgucuguggccugaguagcuucacggugggagugccacuggguuuugucugccgccauccaacuucccccacagcaacaccugugugcucucauaguccuggcuaggccuuguccuuuauccuaugggauuggcugcaaaggguguggcaugguggcucuggucaucugaaagcaguaggucuguggucuaaggcugaggauccaaaugccaucuccccagcccccgaugcacuuuuaagguaguuuuugcauuuugaaugaagugucuucuauucauauuucuuuuucagugacuugucugauguuccuuuaucuaaguaucaacuuuauugggguuauuuuguuguuguuuuuuguuuacuuuauuagaagaguggguguggggccuggccugguaacucacuccauaauuucagcauuugagagacagagacaggaacuuuuguguaaguuaaagccaagggcuacauauugagacaguuuccagaaaaaccuaagcaaagcaaaacaaaauucccaguacccauaguugacaacugucuguaauuccaauuccccuggauccaacaccuucacacagacauguugcaguaaauuuccaacccuaauaagcccagguaaugaaaacacaacucaguucauuugaauacaugcugugcgccuaguuugggcagaucuaccacuacacuagcaucuuccccguagaaggaaccccuuguaacuugcaguuucucaaggccaggugcuuccgcucuaccuuacuucuccauccuccuccucauccucuccccuccccucccccucuuccucucuuuuccaucaaaaccuucagcuucaccugccccucuuucucugcccaaucaccgucucuagccuuuauuuauaaauuaaggugggaagcagguuuacaggaaaucaccugagugcugacucauuccuuguucacagccacucacaggagaacagaauuaacaucaaauacaauuagccccagugccauccacaacacagacauacaugcaugcaaaacaccuacauaaacguuuuuaaaaaauaaguuaaaaaaaauggcugucuacauuucaucuuggaaauuucccaacacauacaaaauuaaaugguacauauaaugaacacuacugcuuaauucuugaagcaccugcgcccacucuucccuagaguauuuucaugcaacuuauuuuguaauucauauauaaauacuugcuauccuguguuuagcucaaaaauggccaaagcuuauauugcccuagacauuuguggaaauggagcugagaaugaaacucagugauuaaggcuaggcagauuucugcagcacaaucuucauguauaacccuaauuccuugaacuuguaauucucuugccucggccuucaguaacccaccacaccugacuuuuaucccuccgcagggcugauggucagacaaggcaaggcuaggcaaagcaagcagucuguuguugagacacaccgagccuuggauagguuuuguguguguguggguggguggggauaguuauuuugggaguugggggcuggguguguuuacaaacaugguugggaaggcguucugcuucagugagugcucagcagagcacucuggccuugaugaagcaacucaguccccugggucugucagacaacugcuuugugguuuuuuucuuauagggcucgcccccucauccacacucucagauucagccacugucugugagccucuaauaugagguauaagccuuacauacccgagcguucacuugagccuggcaggaggcucaggugauguauaguuagugauguaugcagugauugauaguuacugcagcacuauguccuuaaggguuccagagcucagggaagcagugagaguuguccaggccucccaguugugccucagugugugcggugggggugggguggaguggggugggguggggguguugaucaugugucacucucagcacagccuccuucagccucacaaaacucugcuuccucucacuuacaggaguauuccgggguggucaugacauccuugugcguucucggcuucugcuuuuggacacagugacgaugcaggugacagccagaagcucagaggagcugccaguagauaucaucuuggcauccgugggcuagagguggccuaagccccacuccuaucuuguccaacacuacgucgaagccacuucuucccugugaagccgguggaaacccuuccccagaccacuguguuaagaaacaaucaagagucaauacagauuuuuuuuuuuaauuccauccuaucauucaggaaugcuaggguagauuuugucaccaugccugcaaggagagacaaaugaauaaaauguucagacuuucucuuaauauuuauacucaaagaaaccgucucaucccuaugauaagucagcauguauuucuugaauaacugcugcuucugcaggcucgugcucagggccuccacuucucccugaggccucccuucaccaaauggagcgugugcauagccccucgggacugucagugccaagcuuagggugggguuaaaggcuagccgaaugacaacagcuagcaggucugguaagccacucaucuacaggcaucuguagauggauggguguccaaagguccuuagagggugucaugaucugcucugggucuaugagugggaaaaacaguaucugcauuccuuuugggcuggaguaagaaauccuaggggaugcuucagggcuugggcuuuaaacucaaaucaggugguuuaaacuguuggaaacacuugaagaacuggaccuccugugaggcuacucagauggcucagcagguaaagguaccuaucaggacggacuacccacuugguagaaggagaggaccauuuugcaauaguugccgccuaaccucaugcacaccuguauacuguaugcacaugcacauguacacauuagaacagaggccugcaccuuuaagccgaaucccauaacaugaagacaucaggcuacacuugagcaucguuaagcuguuuuagcuauggccuauuucaugacugguccuggcuccaccauguacuuggucaggcaugcaguggugaacuaaguaacguggugugaaacuuccuaacagguuauaaagagauuucucauuugggggguuuucucaaguaggugaccugaaggcugcucccuaaagacaucccucugucccccaccuuccaucccucuccuggggacugagcaguugcucuugccuggccucucugccucauuccaucccuuuaugaaggccucuccaggcuuuaaaggaaagccugaccuucaaggccacauccugcuuagcccuuccugacuguauucuuccugccuaauacccuccccuucuacucccaggccuggucauagccuggaagccauuccauucaaauaaacuucauuaaagaaauuggugucagccuccuuuugugaagauuacagcuuacucuaguuuuauuuaaaggcuugcacacaccccacacacaaauguuaaaaaggaaaccagguggggcuuccugacccuuagggguuugugggaauagcuagagagucucaauucggauggccuuacacauugagggugggcagcacagguuuucuggcuucagauuccggccugggaagggggacccugaggccuccuggggugccugucucaggucagugcauuuugucuugcuucaccuagccacacccccaccuguggggagggaaccccgacggcgcgacgucacgucgggggcggggcgggguuaccgaggagcgggacgggcgucucuuaggcggacgcuagcugcgaggaaggguggacuagacccucgggcggugagaggacgcgggcgcguggggagggccucguugaggggaugaggacggacgggcgggcgggaggagggccgcgcugaggagaagcuagcgggcggaagagaggacccggcggaggggacgccggcgggcgggcaggcgaggaccgcccacguuccgagcuggagccuuggcgccgacaaggccccgcccgggaccugagcguguccccgcggggcgguagugcgguggccgcggcccgcgagugucgcuggcgucaaagccgagcgcucucaccuuucccugcugcguccgugggaaacaaccugggaggagcggcuuucuuucucgcccgccacccgagggccugcuuggggacugugggccccgcaguggccgggacuggcugaccuaacggagccuccgcggaagauguggcuucgcggggagauuggcgugaccuagggagg

SEQ ID NO: 3185 - RNA, 5619 nt, Mus musculus
ccucccuaggucacgccaaucuccccgcgaagccacaucuuccgcggaggcuccguuaggucagccagucccggccacugcggggcccacaguccccaagcaggcccucggguggcgggcgagaaagaaagccgcuccucccagguuguuucccacggacgcagcagggaaaggugagagcgcucggcuuugacgccagcgacacucgcgggccgcggccaccgcacuaccgccccgcggggacacgcucaggucccgggcggggccuugucggcgccaaggcuccagcucggaacgugggcgguccucgccugcccgcccgccggcguccccuccgccggguccucucuuccgcccgcuagcuucuccucagcgcggcccuccucccgcccgcccguccguccucauccccucaacgaggcccuccccacgcgcccgcguccucucaccgcccgagggucuaguccacccuuccucgcagcuagcguccgccuaagagacgcccgucccgcuccucgguaaccccgccccgcccccgacgugacgucgcgccgucgggguucccuccccacagguggggguguggcuaggugaagcaagacaaaaugcacugaccugagacaggcaccccaggaggccucagggucccccuucccaggccggaaucugaagccagaaaaccugugcugcccacccucaauguguaaggccauccgaauugagacucucuagcuauucccacaaaccccuaagggucaggaagccccaccugguuuccuuuuuaacauuuguguguggggugugugcaagccuuuaaauaaaacuagaguaagcuguaaucuucacaaaaggaggcugacaccaauuucuuuaaugaaguuuauuugaauggaauggcuuccaggcuaugaccaggccugggaguagaaggggaggguauuaggcaggaagaauacagucaggaagggcuaagcaggauguggccuugaaggucaggcuuuccuuuaaagccuggagaggccuucauaaagggauggaaugaggcagagaggccaggcaagagcaacugcucaguccccaggagagggauggaaggugggggacagagggaugucuuuagggagcagccuucaggucaccuacuugagaaaaccccccaaaugagaaaucucuuuauaaccuguuaggaaguuucacaccacguuacuuaguucaccacugcaugccugaccaaguacaugguggagccaggaccagucaugaaauaggccauagcuaaaacagcuuaacgaugcucaaguguagccugaugucuucauguuaugggauucggcuuaaaggugcaggccucuguucuaauguguacaugugcaugugcauacaguauacaggugugcaugagguuaggcggcaacuauugcaaaaugguccucuccuucuaccaaguggguaguccguccugauagguaccuuuaccugcugagccaucugaguagccucacaggagguccaguucuucaaguguuuccaacaguuuaaaccaccugauuugaguuuaaagcccaagcccugaagcauccccuaggauuucuuacuccagcccaaaaggaaugcagauacuguuuuucccacucauagacccagagcagaucaugacacccucuaaggaccuuuggacacccauccaucuacagaugccuguagaugaguggcuuaccagaccugcuagcuguugucauucggcuagccuuuaaccccacccuaagcuuggcacugacagucccgaggggcuaugcacacgcuccauuuggugaagggaggccucagggagaaguggaggcccugagcacgagccugcagaagcagcaguuauucaagaaauacaugcugacuuaucauagggaugagacgguuucuuugaguauaaauauuaagagaaagucugaacauuuuauucauuugucucuccuugcaggcauggugacaaaaucuacccuagcauuccugaaugauaggauggaauuaaaaaaaaaaaucuguauugacucuugauuguuucuuaacacaguggucuggggaaggguuuccaccggcuucacagggaagaaguggcuucgacguaguguuggacaagauaggaguggggcuuaggccaccucuagcccacggaugccaagaugauaucuacuggcagcuccucugagcuucuggcugucaccugcaucgucacuguguccaaaagcagaagccgagaacgcacaaggaugucaugaccaccccggaauacuccuguaagugagaggaagcagaguuuugugaggcugaaggaggcugugcugagagugacacaugaucaacacccccaccccaccccacuccaccccacccccaccgcacacacugaggcacaacugggaggccuggacaacucucacugcuucccugagcucuggaacccuuaaggacauagugcugcaguaacuaucaaucacugcauacaucacuaacuauacaucaccugagccuccugccaggcucaagugaacgcucggguauguaaggcuuauaccucauauuagaggcucacagacaguggcugaaucugagaguguggaugagggggcgagcccuauaagaaaaaaaccacaaagcaguugucugacagacccaggggacugaguugcuucaucaaggccagagugcucugcugagcacucacugaagcagaacgccuucccaaccauguuuguaaacacacccagcccccaacucccaaaauaacuauccccacccacccacacacacacaaaaccuauccaaggcucggugugucucaacaacagacugcuugcuuugccuagccuugccuugucugaccaucagcccugcggagggauaaaagucaggugugguggguuacugaaggccgaggcaagagaauuacaaguucaaggaauuaggguuauacaugaagauugugcugcagaaaucugccuagccuuaaucacugaguuucauucucagcuccauuuccacaaaugucuagggcaauauaagcuuuggccauuuuugagcuaaacacaggauagcaaguauuuauauaugaauuacaaaauaaguugcaugaaaauacucuagggaagagugggcgcaggugcuucaagaauuaagcaguaguguucauuauauguaccauuuaauuuuguauguguugggaaauuuccaagaugaaauguagacagccauuuuuuuuaacuuauuuuuuaaaaacguuuauguagguguuuugcaugcauguaugucuguguuguggauggcacuggggcuaauuguauuugauguuaauucuguucuccugugaguggcugugaacaaggaaugagucagcacucaggugauuuccuguaaaccugcuucccaccuuaauuuauaaauaaaggcuagagacggugauugggcagagaaagaggggcaggugaagcugaagguuuugauggaaaagagaggaagagggggaggggaggggagaggaugaggaggaggauggagaaguaagguagagcggaagcaccuggccuugagaaacugcaaguuacaagggguuccuucuacggggaagaugcuaguguagugguagaucugcccaaacuaggcgcacagcauguauucaaaugaacugaguuguguuuucauuaccugggcuuauuaggguuggaaauuuacugcaacaugucugugugaagguguuggauccaggggaauuggaauuacagacaguugucaacuauggguacugggaauuuuguuuugcuuugcuuagguuuuucuggaaacugucucaauauguagcccuuggcuuuaacuuacacaaaaguuccugucucugucucucaaaugcugaaauuauggagugaguuaccaggccaggccccacacccacucuucuaauaaaguaaacaaaaaacaacaacaaaauaaccccaauaaaguugauacuuagauaaaggaacaucagacaagucacugaaaaagaaauaugaauagaagacacuucauucaaaaugcaaaaacuaccuuaaaagugcaucgggggcuggggagauggcauuuggauccucagccuuagaccacagaccuacugcuuucagaugaccagagccaccaugccacacccuuugcagccaaucccauaggauaaaggacaaggccuagccaggacuaugagagcacacagguguugcugugggggaaguuggauggcggcagacaaaacccaguggcacucccaccgugaagcuacucaggccacagacguuucuuaccagcuagcagcagcguguggguguucuuguuuucuggcacuuugucugaccucucacaaggaugcauucccaggaacuucacaauauugcccacagccucuguagggaaaaucccagcaacauuaagccacaggcauaugaguauuugugugcuuuuguugggugcuagugaaauccugggccuaacacauuaaguaugcacuucccacccccacccaccuccccccagucagucccaagcuagguaucccuuaaggcucuggauucuuggugggaagcgggaaggcacacuggccagccacaguaucgucagagaugacgucagcagcacuuuaccuucgagugucuugauaguagacagggugaacguuuccuccuucucaaauucauccccaaccucaucccaggcugccucaaaguucacuuucaugacuuuuuggaugugaucagccacaguaacuuccagauccuccagcuagagaagcggagacacaguuagacuuugggagagacuuccuguuccacauuucuagaccucugcucucaacuccucuccuucccccuuccuuccugcagcucacucagcagauaccugccacuguggggacauggugggcuucaggacacagagcaagcccgagguacacaauguaaguggcacugcuucaaccgacaagucauuucuccagcagauucuguacuucaacuguguccuccaggcccaaaauaggcggaacccuauugucaucucagcugugaaugugacauaacacucccauucagccagccugcacuagcagcguccaugcaaggacuccuuuguucauucuuccaacagaucuucacagaaaccuguucuugcagauguuuacagggcauacagcaaccagugaaaggcgcgcccuagcuauagcuccugagaggagaggucuuaaggcaguuccugccucagucauuuuggcucaggaauggccgucucuacuuugguccuuauucuacacaagugugaaugucagaugcaugcuagugacuaaggaacuguggcccagcagagcaaaggggccuagcuaucuagaaagcaacauuacaagagcaauucacgucuuaaaaaucuugcuuuccuuuugagccaauuaaagaauuauccuaagaaaauaaucagaaaugugcugggcauggaagugcgugccuuuaauaccagaacucaggaggcaaaggcaggcacaucuucaaagugaguccaggacagccaggguucuguuauacagaaaaacccugucucgaaucgccccaccca

SEQ ID NO: 3186 - RNA, 25053 nt, Mus musculus
ugauuaaagaaaugacauuguuaaaaaucuauagauaaauauuaacuuuagccuauaaucccaacacccaggaagcuggggcagaaggauuacaaguuuaagaccugccuaggcuacauacaucagaaaauuccccccagaauccauuagucuugaagcuguagcuucguguucuagguacauaccugggagaagaaaggagccaugucacuccuacaagcaucuccuaaggaccagguguuuuguguuugugucuugcagaucugggacacagccggucaagaacgguuccagucucuugguguggccuucuacagaggugcagauugcuguguucugguguuugaugugacugcccccaacacuuucaaaacccucgacagcuggagagacgaguuucucauccaggccagcccccgggaucccgagaacuucccuuuuguuguguugggaaacaagauugaccuggaaaacagacaaguaagcgccgacugcaguuacgucagagauaggccccgcuccucugggaccugagaguucagagcgcucucuaccaggcucagaauuacgugggaaagaaggugcaggugggcgugcuugucgucccgcggaccccagugguguggggcagccuuuguucucagagccuugguuacccuucuguaacuuaaaggaaggaacugcuuuucucauuuugggguagaaggaggcugugggcuugagucagguugcucugccuuaacucugcacggcacuuguguugaagcauagcuuuguuaauuauagcucagcuuauuucugacaucucuuuccuuuuccagauuuugucuguuguuccuuggcuggggcuggggcaggaaaggucuaaggggugaacacugcaaagugugucgccugccgcuucuagaugagaagaacaggguucauaucagagaugagcuggggaccccaggaucucucuccuuuggcuaagggccacguggucuggcuauggacagagguagcugcaguuugggucccucgugugggcagcagagugagccgaccugcaggucuauaggccacauucuuccuccuucccagauguauucucaccagcguguaauuuuccugauaggaggacugagucauuuucugcuguucaugucacuaguguccuucucccucccauagguggccacaaagagggcacaggcuuggugcuacagcaaaaacaacauuccuuacuucgagaccagugccaaggaggccaucaauguggagcaggccuuccagacaauugcucggaaugcccuuaaacaggugggucucagggcccucaagcugcaugaugcccucuggugaggucucacguucucuccuagaugccucuccccuaccugcaucugggaaaaacuaacgugcuucucuggguggcuaggucaugacagauucugcgucagcuccugugaggucuacggcuuuauuagucaucugaaagacguggggcagagcugggguauggcuugguauagcacacuuacuuaagauacagagcauuucagggcagccugguccuugagcagugagguccagacacagcaaaaccucaggaacagaacagggacauccuugugaaggacgugugaacuugucccuggguugguugguuuucaugugcauuuuagccaaucaggccacuuaggggucucucaucagaucccugaucuuuuuaaugagauaaacuugaaucaugucccagcugcuguugacacauucgugucugagcuugugcgccucauacagaaccaacgccagcuucagagggugugauuacccaacaacucaguaccaggaacuugcuuuuccugggaguagguauguacaugcacaaguaagagauaagaaaacaacaucaaggaacccagagcucccagcuacccucgucugugagacaauagcacugugagcuagggcaggauagaagccuauaauuccaucuauuggagaagccaagucaggauggcaaguucaaggacagcuugggcaacauaguagggcuggagauagauauauauaucaauacagaguuguuugccuagcauauguaagguccugguguuuguuacaguuuggggggagggagguuaaguaaaaaaaguguaggcuugggguccuccaaccagcaggcugucggugccaacucuuaacugcugacgcucaguugccaccuucaaagcagcgucccuuugagccucucauucuaggcucacuacugugaauggccagcauguucucaagagguuuguuggacaucuucguguuucaucuuuucuuuacugguguccuuuugaauucucccuaccaggauaccuuuagaauggggccuuuuacuuccgagucaucuaugguccuuauauaccaacaugugguccuuucugaggaguccucgggagugugcccagagugaucauaugaacucuuggugaacagacauuaccuucaccuacccuccaacaccuccccaccccccaguucuuuuauuugauagccuuuggucauagaaaaaaaaaggccaucuuagcuggguguggugguaucugccuauaauuucagcacuuauagagaggacagcaaguuccaggacagcauagacuacacagaaaaagacaugagaugugcuagagcaugcuaucaucccagcauuugagagguggaggccggaggaucacaaguucaaggccagucucagcaaccauucugggguauaaaagaccuaacaauaaaacgucaucucugugucagauacauuuuaaaggauccuucucccugcuuccagugaaugugagugcugggaagcagccauuguccccuugaaguguguccuuuguuuaaaucauucauguuucucuuccagcacgcacaaacugcccuggccauggcuggguuccuuugucucaguaguucucaaccuugcaaaggcugcaacccaugaauacgguuccucaugugcuagugaccccccaacucuuuauaacuguaauuuugcuaguuaauacauuguaaugugaaugucugauaugugacccccuaagguggucaugauucacauguugagaaucacagcuggaccaucuuuauuucagcaucucuuaaguuuuaugaauacacugucgcugucuucagacacaccaagaagaggguaucagaccccauuacagaugguuguaagccaccauaugguugcugggaauugaacucgugaccucuugaagagcagucagugcucuuaaccacugagccaccucuccagcccuuauuucgacaacuaggguacauccugccaaccuguggcuacccuaacccucucccacccaggccgacagcuuguugaguuuuugguuggaauuguacuggucuagccauaaaaaaauaccacagaucagacagcuuauacagaaaagguuuuauuuuguugucacaguuguacaguaugggacucuccuggccuguacauggcugucuugucuucuugcuauguccacacagggcggcauugcucagagagcagauguguuaacaugcccucuggguugucaguugguaacagauugcuguccuggcaugugugagauccuccaauccaucucuacuaccacauaaaucuagcauaguaauacaugucuuagacucccagcacuagguggaggcaggaagauuuaggaguucaacuacauagcaaguucaaggccagccugggauacauaugagacccugucugaaaaggaaaauugaaguccugugagagcugaugccacagauaaccuugucuaaucugaagacuguagguacaaguagauacauggggguaggugggugugugggggcuucaacauacaaacuugggguugacacccauucucuccaagguugucacucauauucuuugcuuuuuguguuaaauguguauauuaguguugacaugaauauaaauuuauugcuguuuauaauaaccaaaaagucagaacauugcagauguuuacaaacuggugacugucucaguaaguugguccauguacuccagacagcacucugccaacaggagcucggggcaggagcaagucuguaacacagaggucaaaacaaauccaaggccaggcugggcuacagaguaaggcccuggacuaacaaugagaaguguggcccauuggcaggcagaggacuugccuagcauguguggagcccuggcuuccuccugcauuuggagggaaggagagaacaugacugguugcuggggaauaagcagcucacucagcacaggguuuccuuuuggggugaugagcauucugacgugaugguggcccacaccgaaaccaauguguuacaugcacacuuggguguugggcccuaguaaaccucuuaacuguauauuuuuuagcuagugugaauaaaaugaaaauaacacuguuaggaaccuuuuuccccuucuuggguacagugcugugguugggcccuagcgcuugguguguaggcacucagucacuccucaggcgaagaccccagugacucaaguccaugcaacgugggggugacggcaucacgguagcucugccccuucagcugcuauguggaaacaaaggcugggaagaaccagcucccggccagcagcccagaagauugagugggagcaaggcgagcaucccgagaccauggagccuugagcagagcccuagccgacaguuaagaacuggcagugacgugaacccuaugacagaaugacagaaauccagaaccuuagcugugugugguccgcaguggucagaacuugaguuggcacacuucuggcuguggcugcugcugacacuccucacaaauucugccacccuuucauauggguacacagucaggaucugucccugugacuccagucaucaaccucccucccucucucucuccuauccaggaaacagaaguggaacuguacaaugaauucccugaacccaucaaacuggacaagaaugaccgggccaaggccuccgcagaaagcugcaguuguugaaggggcagugagcacagaguccuucacagaccaagaacacacacguaggccuucaauaugcgucccuccuccuccaaacagaccagaacgugagcucucacauccagcugccaaaagaaacuccaccgaacaguuacccaacacacacacauacacaaaacacacucgugcacacaaaaacacauacacacaacacacacacagcaagcaaacuccagccugugccugucagggcuccuggggcagcugcccgccucgugggcccuguguauggcaggcauauggcagagacccugggugcucuggggugcagugggcauggaaagcuuacucuuuuuguccacuggagagugagagaacuguucacaguucaucugugucuaauuaucugauuuuuuuuuuaacggucuuguggucuuuuaccccucccuccuugaagguccugugggaaggcuggugcccaggcuccguucugagcaggcuguuuuguauguaucuguuaaugcuuguuacuuuuaacuaaucagaucuuuuuacaguauccauuuauuauguaaugcuucuuagaaaagaaucuuauaguacauguuaauauaugcaaccaauuaaaauguauaaauuaguguaaggaauuccuggauuguguguuuaaguccucuaacgcaggcgugcaagguggaggguugaacccugucuggauuacagaguguuagagacucaaguuuggaaguccagcuagcggcaguauucuguacaguagacacaagaauuauguacgccuuuuaucacagacuuaagagccaaaaagcuuuucaucucucugaagggaaaacugaacuagacaguucccuucugugucuaaauuuuccaaaagguugauuugcuuaauauaguaguguauacaauggauaaauugcuguuacuucaagaauuaaaauucucauuuucucccuuucuguuuuuuuuccuuauauucaacacuuuaugaugcccuuuugucacuauccuacucaaagaggaaaggagaacccaccagaccugucccagugacucuaccuuuguucuagaaggcgcuccuuucaggguugugguaccuguagguuagcagacccuccuccuuucccacccacccaaguguggcccagcacuaacccaccgucucuuggguugagcccuggcaguucugucccuucccgagguccugcccugcaucauggcuugcuuccuggagcacuuccccuucagaggucuacauucuaggguguaggcugaguucuucuguaaagagacgaacgugaugccaauaaaauuuaacaagaacaaagaacagcugcugucugucuuuuucucucaaagaucaagcuauguggggacauucuguauguucaugggacucuuggugcucagaggcaagggggugaucccuagacuaccuacccuaguguggaucuuuuucuuagccacuggaaacaaaaccguggccuuuacucugguuauuuugcuguuuuccuuucucccuaucacaagccagauugauuugggcuguugaagacauuuugagacaaaauaugguugggugugaaguaggaaggcccucuccagagccagcucauugugcucaagcagcccaugacaacuuaauguacacacaaaaagcauuuuucucuaagacugaacuggcagauugcaaugagcaggaaacucacugaguucuggcugcacccuaaguaccuggcccccucauuuugcccagaugaaucguaccuacugagucgugcauugggaaguuucuaaacuccaguucauccauggucacgaagguucaaacugacaugguaucugucucuaccaaugucuagacuauacuuuggcuaggccuaggugacuaaaagucuguaauacccugugaugucuugagacugcuguggaugcucuguggauguaagugggucuggguuucugcaaggaaaacauaccaggggauccuggggccaugccuccugacaaaaggaaaaggagacaguugaguuccugaagaucuaauucugcccgguguuugaggcacagcugaucuuaaccuuucuuggaauagauugcucugggucagauuggcagccucucuuucccaaucugucagcagagagcagcuagugaggucuauaucuuacccauggcucagacccuauuaugucccauuguucuccuuuaauagaccacacaagcucuggaaaaaccagaaccagaagccccauuugccuaugugaugggugcucugcuccagccucacaugaccucacagccacagcuggcuaaagaaccuaaugcagagagaggugguggauaggcgccagcucauuaccuauugauacacuagggggcgcccaagagccaguauugaucugcuuguucuggacccaaacaucuaccaaugcagucacuugcagacauauacacccccuccccccaaaccugaguagaaccuggcuguccuggaacucacucuguagaccaggcuggccuugaacuccugaucugccugccucugccucccaaguguugggauuaaaggcaugcgccaccacucccagcugggaaaaauuuuugacauacuuagggaacauaggaauucgccucuuacgcuucuuccaguaagaagccagucugaccucucaagccauaaagccugcgcacagcugugcgguuuguuaaccaguguccccuucuuagggaccaagagaugucaggugguaaggagaaucugggagagccuuugcugauuacccaucuaaaggacaaaagauacacuggaauguccuccaaauccugucucccucugcagaacauucuuaaaacaugggcaugaacgcacguucguguggaaucuggcacuaaaccauucguagacgaccugcuucugggucaggguuucguacguagcagagccgcucccucgcugugaucuauugaaagucagcccucggggcuggugagauggcucagcgguuaagagcacugacugcucuucugaagguccugaguucaaaucccagcaaccacauggugguucacaaccauccauaacgaaaucugacacccucuucuggagugucugaagacagcuauaguguacuuacacauaauaaauaaauaaaucuuuaaaaaaaaaaaaaaaaaaagaaagucagcccucgacacaaggguuuguaagaauaaagacuaugaaaaaauuuaaaaaauaaaaaaaauuaaaaaauaaaaauaaaaaaauaaaaacaugggcauggcuaccuucucuagcuuccagaauauuugccgcauauguccuuuuaaaugcucuguggccuuaaugaauuccuucuuaugagaccuaacauucaagaacaacuccgaaguaaaccccagcaagccgauccccuuuugccacuagcuguuauuggcaccuggaaaaccaugugcguugaaggcuccuuucucuuuuccccaccgacuauuuauugcaagugcugaggauaggaaccaggccucauguguguuuaggcaagccuucccccacagggccucacagccaacauggugucugcugcaaggccaacagaugcgcacccccgacgugggggaggccuggauuagaggaaggaauguguguggagaggacacuucaugcacacacagucuagcuacggcuaacccuguuccugccaccacagccccugugucagcguucacacaggaacauucauaccucuugagagcuacaaggaaggccaagauggcagacaucguuggcaucagccgugaugagucccuccuuggagacaaugcuuuccauccuaguucacccagcagcuucucaauuccagacagccuaccuugaacucagagcaauguuggcaucccuuucucaggucaaaagaagacaacuccaacuuuugccugcagacuuggcacaggaagccacaaccagacuucccccagguuguccacuuagcuauuacucacagcccagcugaagugcccaagagccaggacugacggaaggcagcucuaucuggcagauucacagauuccuaguggggaaucuacccucuucacaccuucuuccuugggaagacuaucuguuccuugcuggguuucuugaggugcaguucgcagucuuuuaggaaugacggauuuucaagggagcaaucuccuuccugcaggaaaggucagcacacacacccucagagccucuacucucccuucugauggaggugggagauggggucucaccaugggaguuguagucaguggguccccuagaucagaagggacccucagaguacugggugggucacagccaccuuugaguuccuugccgagauuuuuccauuggacauaugaccuuguaggucuccucaaauccugguaaacccucaagaaauguaaugggugaaggcugaugagagagaguugaugaauucauucuggcauaaacacaaaauugaacuggggaagacagaagagacccugagagaagaaagcuagcaacuucacgcaggcaguguaguagaagcacggggcuggaagccguuuguuacacugccacugccuugguuauuuuuuagggcuccuggaccuuccccuuuccccuaucaguccauaauagauacccucuaaccuucugggaacaggaagucugccacagcucuccacgcuuccccugggaguagccagagucaaagcuuguggucccauuugugcagccacagagcugucuucaguuuugcuuuaaucugagggcuuuguuuggaaacagggcuuuaguguccugcaugcugggaugacaacaggcauguacuaccaggcugggugaaacccagugaauuuaaagaguaugacugcacuggcugcuacaacugccuauaacuccagcuccaggccaucaagugcccucuucuggcaugucccucuccuaguaagauaugacuuuaaaaaacagagcuaaagagauggcucagcgguuaggagcacugacugcucuucuagaggucacgaguucaauucccagcaaccacaugguggcucacaaccaucuguaauggcauccgaugcccucuucuguugugucugaagacagcuacaguauacucacauacaugaaauaaauaaaucuuuaaaaacaaaacaaaaaaaccacacacacaaaacaaacaaacaaacaaaaaaaaaagaugauaaaaccccacacaaaggacacucaguaugccauguaugcugggguccacaugaggcugcagggcuucggccccuccuguucuaauccaucaugugccugguccaccuguacuuucucccuggcccaagccugagcagcccugagaggggucugaccagcacuguguuuugcuuggguuuuuugguuuguugucuugguguuuuauuggcuuguuuuuugguuuuuguuuuuguuuuuuuuuggggggggguguuuuuuauuuuuugcuuuuuaaauuuccuggaacaaaaggaaauuaaauaaguaaaaggacaagaaauguuaguggugugccauauggggcuguuauaugucccuguuacugcagggaccaggguucuggauuugagauaaugagccauaaggugcuugcugcccaggccuggaaaauacaggaauagggccuuucuucacccaauggucacuggagaagccagccaguagucugguagucucagguggcuguggcaccccagaggucggcuugcagguuugucagucugucugucucugucugucugucugucugucuguccgucugucucuuucagcuuucugggcgaaaacuaaagaggagacacuuuaaccugaugugugggagggacgcagucuccaaagcaaugaccucaaauuaccuggaauaugguccauggggaacccccugaagccucccucucuggcuucugggaaaccggucgccagauccauaggacaagggcguggcugcaguaaacacuaauguagggcggccuuggggccaccgaacacauuuucaagacccccacuacauccucccuaguuucuauuggcuggagaagggucugugagaagaaggcauugugacugcagcgcaggggugcuggugccggugccccugccccccuuccccgccucugccucuguggcuggugggcggggaaaguguggaucuccauggagauaggaugggggcgggggaggggcggggaguguucccaacgcuaacccaacggccaacugcugagcugaaaggcagugggacugacuguaggugcugcugccuuccaacccgagaaccagggaggcagcugcaucuuuccaggagcugggccauccuaagugggccaaaaccaugucagccacaagcucuuccuucaucccugcuaaucugagcugggcaacagccuugugggucgccugaggcccucuggauggggcuggcuacccuguccccagcaccuggccugaggcccuuccuagcucacuuaggcagaugaaguuugugagcaugagugccaguuacacggaacuugguuacauagacuggccgauaggaccagaagagacuagcuagcacaaaaaugucccagaacuugaggugcccuggaggaaagacauguaaaagucgcaggaauggcacuggacagcccuacuugguguguggagucacggggcaugaggaagggugugggagauuaguguuaagcugaaaucacagaagggcccccauguagaauaggcuguucaggccuccaggcuaugggagacacugguuuggaugggggcaggauuaauuuaagcuucaaaaaaaauaauaaaaucaaagcccaaggccucgguauuuaguaacagaagaccaaccuggaugggcgagggcagaaacuccuuagaucaaggccacugugguccuagguuauccccagggaucugcucacccuuuuuuggggugauuuuuuuuuuuuuugagauagggucucugcauagccaggguuauccuggaacucacuauauagaccaggaucucuccaacucagagauccucuugccuuugccuccccaguacugagacuaaaggcauguacccccgacucuugaaguuuuaucuugaaguauuuugaaggcuuacaaagugcccaaaguccuggcccaugguguugauccuggucugggccacccagaaaugaaaggagccacugcccugaacccccagucccugacuuucugugcccugacacucuucuacuuuagcuauggcacaggaacauuaaaaagcaacaaaacaaaacaaaaacaaaaaaaacaaaaaaacaaaaacauuuuuacucaagacuaggagugaggaggcaggacugacuggugugucuaacagugaaaaacuguacugccuaaggcuggggaaacacugcucauugugcaauuuaccccagacaugaacuuugacccuugcuuccagaugaauagcuaacacuacucugaaaccacaagccacaggcacagagccacagacaggaacgcuccagccucuuggcugggucaugcugagcucugcucuguucaguuaagggcuccucagucccgagggucuuagggaugaggucgucgucccacggccagccauggcucuggccaguguggucggucagugguugcuuuucaugagggccuucuuguccugaacuuuaaaacaaaauucacuuaaaucuaaaucuaacuugggaacuucuaaaggagaaaagcuaagucugcuaauuauggagcugauaaagaauauuucuuuuucuuuuuuuuuuuuuuucuuuuuuuugguggcaggauggaauguaggcccucaggacuacuaggcaagggaucaguguugagccgucucagccugcuuugaauaaauauaaacuaccauuuuuuuagaguaaaaaguauagcuagguuacagaacugaaaauuccuuugucuacaacagggccugaaacuucuugggggcagagggacacagaggaauucaaaauuuuugaaaaaugaacacuccccaccaaauguccaaaugucgauuauuccuucuguggcacacagugagaaaaggacagaaacguccuuuugguggaauuguacaaaguauuugauagguuuuauuggggcaauguuuacauaggaguugaccuuacauagagaagacccagagucuacaauuaucagaaaaauuaauuuguuucuucuguuaugucaauaauaacaagcagggaggggcgucuuucagccuuauuaacauucagcaagcaugcugcuuaagcaacaaauagcagcuaucccuucccuggggaggucucccugaagcuagaggcaguuucugggcccuuugccagugaaacacaugcagagccccuuuggcacaccugaugguuaucuuugagcaacuuuaaugguuaucccaggaagcugagugaacucacucacucugcauucccugcccacccuguggcuucucaucugucaugaugugaccagccaggugccccugugaucccugcuagcuggacaaugacaagagcaggagcugggaagucugcuuggacuauauuccaacacaccuccugggcccaccucuuugcuggaccucagcuucuucacguaagauagaggcugggacaaggcacagauguguuaggggcccugaccaccuccuaauagaugacugauuuuuguuuuuuguuuuauuuuuuuaaacuuucauguauauauauauaagucccaagguagauuguuauuucuagauuucuaccacucaguguuaucaagaccaagucgcuaacaaggagauugauauuguaaucaauaaaagauaauuuagucugaaaaggaaucuggauggccuguuaaggaauggcaaaggagagguguggggacaggagauaaaagucaaagaggucagcagggggcaggguccagugcagaccugcaguggcacagacuugggcacagauguagcugagugccaaggcagugacacagccuguggcugcagcuguggcuguggcucuaauggcugggccucagcagcugcugauuggcucuugaguagaggagcucaggacacccacgaucugacgaagaacuaaaggaaguucuaugccucucacagagacacaagaaguuuuguacuaggguuuaaggcgagguccacaccugcccugacggguggccuagauuccaugaagcucuuggagcuggguccccuguggagaugacaugaaagauugaaagacacccaaaaccgauucuuuguuuugaaucccaucucauuuauucaacaaauauuuauugagggccuacuaugugccgggcuauguagcagugaacuacagggucuuccucuagcuaaugacaggaucccagaaaguggugggcaugcgagagggcugcuuaaauggauccaacaguaaagauuugcuaucagacacuagccagucucucaagccggaguccccucucagcauccugaugcugcucucagaaaccccucccugccagagccugcccugcugucugagguugagguuuucgagugaggggagcccuuacucgagaucaguggcccagcaaggugggagccuagcagacagauauugugucguucugauaccuaggccccauucacaguggucucuuaucucaucccagcuccuuaggggucaacccuucagagacagaaacaagaugugauuggaggggaccgaggagcucacugcaagaguucaaacagggccaacagccucccacggaagcuguaaacagagaccaagugaaaagggacccuuguccccaaagcaacuggaugccccaaagcccgggagccuccagcucuggcacagaguacggaccaccuaggaugagguccaggaauggguauuuauuaaacacaucccagaucaaccccuuuuugagccagaauauagaaaacaauuccaaacuaagggucauggggcagguagcagggccggagggagagacaucaggcgcacaaggcgggaacaugcaagaaaccagggcuucuagggaaaacuauaaaacagaaagugaaauuacauggagggagaggggcagccagcagcgguagcacuaggcuggccuucccaagagucuggggaggcuggcaaacuguggugcuguaccagcaagauaggaauaauccgaaacugcagaaggcaguugcuaugccaaaaccuauacaagguuagggaucugaggugccaguuggcuuuucuccggaucccuggccuaccuccacuccgaggagugcccuuuucuuucuuaauaaacugccucuguuuaucacuauuugugugacugagguaccuauuaacauauccaagccuaugcuggccagcucccagcaucucucaguaccuggguuccucccagcacuucuugcccccccccucuacccuaagccccucccuucccuucuccacagccucuggugccuuauaacugagccauuuuggcuacacuuaucucuuggucuccugaucuuggucaccucucuugcugucccucccccucguuguucucaggguuccguguagccugccggccaugcuaagccuggccuccucccucugccugcuuucucccuuguaucuacaauaacugucuucuccuuacuuaagacauguccuccuccuuuuauuucauuuuuuucauucaucuggugcugaaacccaggaguggcauaaaugagcucccuccuaggggacucagccuccacaaaccaagcugcugagcugacuguccuaaguuauggacaagaucguuucugcgggcuuucgccacccaccaaacuugauuccaggguccgaucugucugcugcucuuucuguuauuuccaacaguucagagaauugucgccucucuauccugugagcccaguucacaugucaaagcacaacaauagaaacccuggaaauuugagcaggugcucuccaaauucagaucuguugcuuauuacagcaacagagacaggaauggggcucaaaauacaugagcaaaccaggaggugaagaaggaaucugagaccuggacgaggcaccaagcauaccaagccagggccuccauuucuguccuugaaucucugcaugguccugcacagcuucugugcagggcaggggguggggucaccuccuugcuggagcaguggcucagguauggccaugaucaaugcagcagguuucucaggcccagaauccuggaaugagaacucuccauaccuaggguucaagaucuccagggugaaacccaagucugcuggcucccgguccuucccacaagggcguccuuacggcaugcuugcucaaaaucucaaagccuucugcuaggucccaggcacagccaagacggucuacaauuagggucuguacuuaucuggagcccacugaagccucucugcugaccuccagcagacacuuuacucuggcuuggguacucuagguuccacugacagugggaggguggggccaaaaaaugggucccagucaaauagcagcaccccauucuggcuucacaauacucauucuaucuuaaaggcauugacuuuuucucugugcucccuuccacuugaugccacuuaaagccacuugauguuccuaaagggagcacauccccccacccccuuaccccacugcagaagguaagggcacagcccccaggcucuugcccauggcuucaagacaccucaggcccuguggggcaccuggccuaggauagaauccaaaccagacugcugcucagucgucacacuugcaggggccccuccugucucagauccugaaaggcacccccauugagggcucugucuguaaauccuuagcuaauagacuuccaagugcccagauuucuuacuuggagaaguagcuauggcuacuguggccacacaucccacaccucuccuucuccgaugcaggaugagagagccuggcugugaaauccccugcugcuggggccuguaagggauccagacugucugcagaugaccagccaugcugcugcugucuguucauggcauuaauaacucuucuaauaaacuccuugcucccacaguccaucuugguguccccucugagccccacuauucaagaccuuucggauugcaggguuaguccugguccuccucccuucucugugucacuucagccaggcugcaccuugguucccaucagucauuucucgaagcuaccuucaccccaugaacaugagacugguacacaagcaguuaggagcaggggcugggcacuagcagcugccuaaauuuggcugccaauccucaacagaucuauuaaacaagccggggggucgggggggagagauguaguggcuacacagcagagaacuagagacccagcaacgccccaacaguauccugccuaccuccuccaacaagguggucagacaaacugucagaaaucucguuugcaggaaacaagcuccauccuugcccucagcccuuuccuuucccucacaggagaaucucaggacauucauccaaggcacugaaaugugcugaaagccaacaggagaggugaauaaacaacaucggaucucaaccuggggaucaccccaccuuuucaggggggcagaaugauccuuucacaggggucaccagcggauaacagauauuuacauuacgauucaguuaugaaguagcaacaaaaauaauuuuaugguuuggggucaccacgacaugaggaacuguauuaaagucgcagcauuaggaagguugcgaacgucuucauucuugccaggucaacaguauuaggcuucugaugaggagcuaaucaggaugugcccaccugcagcaguggccuccuccuuacagcugcucugugggaacaguuagcccucuccaagagccuguguaccugugggccucugacagccucaggugcccuauuuccaagagaauggcagguacagcauuuccugaaggaagcucacagaccucggacuccaugagagugccaugggucuaagugggcucgaccugacuagacagucagucauccauuccaacuuccccuaugccuuugcagucacacacuccuccuucccuggagugccagccaaugcugugcuugcucaacugcacgguagaaagccccccuucuucugaaagcccuaagaagggacucccagucugccucgaggaccugagcucucuccccagggcccccaucacacucuuuuuccacgguguuaacaugcaaauaacuccccuaccaagauggcagucugccucagugugucccuugaacccaguccccaaaaccuuucaguuacgagauugccaaggagaagggucgcucgccucaggugccaacugacuggguguaggagguaccacagggccagcucugcucuuaagagcucacaucaaucaaaacaccaagaccugggcuugccgucaagccugccaacccacagugugaucccuacaacacacauaauggaaagaaggaacuggcucucauugguugucucugaccuacacacacauguaguggcauguagguucucccuucccaccucacuaaacguaauucaaaaggaaaaaaaaaaaaaaagacacaaaaaccccccagaaaauacaagcuggagccaggcccauggguaaaaugcugcugcaguagcagcgccugaugauggaaagugcuaugaaggaaauaauacugggagccagccugcugaccagaggggaaagccaaccccugccacccaggcccaaagucuggggugcacaggcuugaggccagagccuugagugaagcauaaggcagaaaggggagugugccgaagcuggagccagggcagagcuuacccgggcugcugcagagccagcucgcugccugaugagcagccacuggagucuauuagcagagccuggcaccacaucccucuagcagaccuggggugaagugaggauggaggcuuggacagauguggggaaguuuaguuuggagguagacuugucagcagcaguagcaauacacaguccaacauagcuaccagcaaccuaaaaggggucccuuugucuuuaggggucuccacuuaugugacguaagguccuugccugcuucucagaaaucauuucaagaugagucagaagugaagcaggggcugggcagugguggcacacgccuuuaaucccagcacuugggaggcagagacaggggaauuucugaguucgaggccagccugaucuacagagugaguuccaggacagccaaggcuauaagagaaauccugucucgaaaaaaaaacccaaaaaacaaaaaaaccacaaaaaaaacacaaaaaaacaaaaacaauaacaacaacaacaacaacaacaacaacaaacagaagugaagcagggccuagugaguuucaacauucggcaggaaagcagaagagacagacagggauaaggaagggggccccggccccaggaauaugcuugaagccucucaccagcagagaagaauuccaaccuguuacugguuaaggccagucucuuucccuagccaaaaaugugcaguucccuaggaaucucaccaggaaccccauuuccagaaaaaggacucacacugcacccccuucugcagaccuagcagugccugggguuuuuugguuuuugggguuuuuuuuuuguuuguuuguuuuuuguuuuucaagacaggguuucucuguauagcccuggcuguccuggaacucacuuuguagaccaggcuggccucgaacucagaaauccgccugccucugccucccgagugcugggauuaaaggcaugcgcaaccacgccuggcucgccugguuuugacuaaucagaugauucuacccaagacaacucuggagucacccaacaaccucaccuaucaaaaagagacggcccaguggauaaaauacuuuuugaugugaaaaacaugagguuugaauucaaauucccagcacccacaugaaagcccaguaagacagcgccucuaaaaucgcaguaacaggaguggggaccuggagugacacuggccaguggucacgggaguggggaccuggagugucaucggccagcuggucugccacuggagcucuagguucagugagaaacccugucucacaauacaagggacugggacuggagagauggcucaguggcuaaaaaaacuguuagguucuuguagagaacccaaauucaguuccuaguccacaugugguggcucacaaccaucuguaacuccaguuccuggagagccaauaucuuugaaaacuaaggugaagggggacagaggaagaccccccauuucuuccucuguacacacauggcugaauguauccucauacacuguauacauggcggaaggaaaaagagaagguugcuuagcacucuuuggagauguaacuugagaaccaccaaacuggacacauggcuaaugcuaagagaacucaucuugacuccauuaccgaagccaacaucuaugguccugggugugcuuucauucucuugagcauccuccuaacaaaaucuccagcucugcuucauacuggcuaguccugacauucuuuucugcaucaaagcagcaaaugaguugugccugaauagaggccccuaaaaaaguaugggaacucuaagugugacaguguggcuguggcucugucccuucaccacugagaaaaggauauauaauacacaguuccaagacaguuccauggguggugaaggagugggaaggagggggaagaaaaggaaagagggaaaaagaggaggagggaaaaggagacgagaugggggcugucaacaguggcaaggugccugcugcucaggcaggaggaugggaguauagaucccugggccagcugggcuugucuaugcacagccauaacuccagcagugccagguacagccauaacuccagcagugccaggcagacaccugcagauucccgggcuugcuggccauccaggcucacuggauuggggagccaagguuucagugggagaccuaauuugggaaaauaaggugcagagugacugagaaagacacccaagccccauggcaacaauugcucuacaugugguugcacgcgagccacauacacacacacacacacacacacacacacacacacacacacacacacuuuacaaugacuuuccaaguuauaguccucagagaauauaauuuacaauauaguuuaaagauuaagcaaagcuuaaaguauaacuuuaauucuuucaaacgccuauuuuuaaugaugguucuuaaacacuuuaacauuccuuguagcccaccacccaccagagguaguggaaaagaaaggauacaggggaaguggaccugcuuagaaagguucuuuggagcaacucccaucuguguugucuggaaaucggcagcucgauccacucgaaaacaccucacggacacaccagcaguccagcucaguaguugggauagcaaacaccaaucagcagcagugguacuaccuagcagagacagccaggccuuggccuuggcuggagucagcaggagggaccaaggagaaauggccaggaaguucuuggcugugccccucucagggaagagaagaucaggucagccucugccacuguccaucgaguccuaguuauauucuauuuauacauccaaacaucacaucucacccauaggucuugccucagcaccuaucugucucagcugacaucacucugcgcaugagcccuagucugcggauguggcaagaagccgcagcacaccaccacaaguuuuguuguuguguuuuucuauggaguccaacaaacgcagugcaacuccacaguguaacucggaccaaugcaugcgugucguuagcaaagacucccucaucacguguccuuucaugugcuugguugagcagaacauccuuuuccuguguccacuucagcuaaacguuccuucacguuugcaaaccccauucaaccaaagaacucuuuaaguuuccacgucauuaaagugcaagcaaagauuaaaaguuuagugaaauauaugcacuagcucacuuuuuaaaaucuuaaauuuuccuuuugugaaugaaauaauguuuuuaugggaugcagucuuagauguuagggaagggcuaauaagguaacaacucgauguucuaagcauucuugcguaauuaauuacaguucauuugauguuuacaugccuuaggaaaaaacagcaucucuguggguaauuuugggcuuaucgauuguauugaaguuuccugacucuuaacaagaaagacaaacuagauucucacauugcuuugucugucuuaccucagauugacuggaccaacagacaccagucuggugaacaacaucuguccugauugaagcuucugccugagccugagggcagcauggcauuccagcacgcaggguacgcagcagcagcagcagcagcagcagcagcgggcuccugguagcuggagauaggagugagugucaucagcccacggaagggguuuaaagaaaaagaggguagugaguccaggagagccugcacccuauagcccgcugucccucaaaacucacaggccccuuggcccuccuccugagaacgagucacaagaggaugacuugggcucugggcucugcuaaacccuggccacuuccugacgauccuuccuuugauggggaugaggucguggggugcggggaggcuggcacacccacgaguacugaguuugaaaggcugagaaucugggccuucuugaucuacaggcagucacucccucuuuucacccaagaggccagggaacugcuuaccuauuggaacaaagcuggccuggacgcuuuaguggugucuacuauguccuccgcaggcuggccauugccugcacagcccucucuccaccguuggacuacuucccaggcuuucagguccuucucuguaccaccaccuccuucaaguccucccgcaccaagugaugcaguauucgaucccccaaagccggcaggauccucaaaagccaaauccccugccacacccucuaagggaaaugccuuaaggguaaccuuacacuuuuccauccuggagcccccaucuaauucugagggguccagggacggcuacuuaagcaucacaaaaugggguacuuggggccagagaguggugaggaagugucuagggagaggcccuuguggucgugccugcacugacucaucuuugagaugccaggcgugcaaccucagggcaauucccuucuguugguuccccuuaggauucugagaagacccccgccccagcacgcucucgggcuuugccuugcuccugucggccgcgugagggcguacccuguguuaguugggacaaauuaaugcccuuccugcgggcagggcugugguccccugggcccagaaccaacucaggugccugaggagcacucuugucugccgccugcaaaguucucggucuuggggucucgcccggggcccgugcuaauccuuugcaaaucgagcgccccccuccuccaugcuccuauagccugggguacacaccucugagccgcuccgcugagcccguccuaggcgcaggccgccucugcgcagcgcagcgggcucggaugcuguccagggcacacugcugagggugcagccgcgcccgggagccgcgggcggaggagccaguggccgcggaaggcgcuccaagaagcacaaguuggcgcuggacugggcccaggcuguuguuguucucaacgugguccgccacggggaaauaaaagcggagcggggcgcgcucuccgccagagcguagcgcgcacgcccagagcuccggagcccgcgcagugcugccgcgcuccccgcaggcuccucuccgcaucccacccccccagccccgccgcggccggcccggcccccgcccgcaccucagcccugccgccuggucccaggcccggccgcggccgcucccgccuggagccgccgcgcgcccccagucccccggcgccgccgcggccccucgccuuccucuucccggcgcggccccccggcuaccgcgcgccgccugccgccaacccgcuggccaccaugucgguggagcuugaggaggcccugccgccaacgagcgccgacgggacggcccgcaagacggccaaggccggcggcucugcggcgcccacgcagcccaagagaaggaagaaccgcaagaagaaccagccaggcaaguacagccagcuggugguggagaccauccgcaagcugggggagcgcggcggcucgucucuggcgcgcaucuacgcugaggccaggaagguggcaugguucgaccagcagaacgggcgcaccuaccucaaguacucuauccgggcgcuggugcagaacgauacgcuacugcaggugaagggcaccggcgccaacggauccuucaagcugaaccgcaagaagcuggagggcggcgcggagcggcgcggagcuucggcggccagcagccccgcgcccaaggcgcgcacggcggcggcggacagaacgcccgccaggccgcagccggagcggcgcgcgcacaagagcaagaaggcggcggcugcugccagcgcgaagaaagugaagaaggcggccaaacccagcgugcccaaggugcccaagggccgcaagugacgccccuacggucuggcgacaucgucgaguuuuccaucugucucuaucccuauccgccccccccacccucgguguaccgguuccguaggguuccgccuggcccaggucccugaucccuguccccucccccgccccucccccagcgaugcugcguucuguuugcuuuagguuuuugaaacggcccuggcgacgcccccauuggcucucacccuuggcaacggccgucgccaugguuaccggcccggcggcgccaauggccugguggcgccugccuacugugcccgcugauggccaccaggcgcuuggguuguguggcgccuugcuccgcccgcugccuuccuggggcgcaauaaacgguuccaaccuugac

SEQ ID NO: 3187 - RNA, 46190 nt, Mus musculus
cgucucgugacagacacuuccgcucggggcggcggcgguggcggaaguggaagcaaggccggagcuuugaccauaaagcccaaggcggcggcguuggcggcgguguuuggggccgggcagcuccgaggagccugcuggagccggaaucggacgucucuguugcggccugcguugugucuccuccuccguugacccugcggugagcagcgggccccggccgcccuucccccgccgccgcuugggccuccgggccuggcguccucggcgagccgagcgccgagcugggccgggccaggcggggcggcgcccggcgggcggagggcgaucggcgaucgguggguggcggguacgggauccucgggcugggcgcguccccaccggcaaccugcugggugggaagagcuaccggccggccggccaccgaggcagugcugccaggcgcgucacaugccccggcccgccgccggcacugggagacaggagcuuucaggguccugcaggguaaaucccguuuccgaaguuccgggaagaaggaccucccgagugccuuucaaauggccugauguccuccuggcucauaaucgugccgauguugagaguaagguugugaagauuugagauuucucggcugcugggcugcguggcaagaccgcacaaauugcccuguucucccaacagccccuccgaagcaccgaggcagugccuacuuacagagaaagcgaagaacagagaggcuaaggcacucgaccaaggucacaccgcugauaaauuucagagugagagguugaaacauaggcagcuagacuacuuagcacuuacuggccucuggccucuuguacuuuagaugcccccaaagccugccaccuguuaucugccaucagcaccccccuccaccuccugucuagugaugucauuugagagccucuuaguccuaccuuaaagccauguuguauuuguacuugugacuuacaaggcauauuacaaggcauauaagguaguguagugucaucaaaccagaagaucuugaauucuggcaagguauguauuggauuugaauagguuucuuagccagcucuuuuccuugagucaggucuggcaugccuacugugugcaccuuucuacaagaauuucuacaacaaccuaaccuguugacucuucaccguugaaaaucuuguguuuuugguuuuccaaagaauaaacucuugucucuuucuugugacuucagcaacugauacccacaugauugaguuaauaaaaucucuuguuggcauauuucucuucgaucuugguaauauuggaucagaauugaguguaagaacuggaaagugaauuauaacuacuucugaagcuggccagacuaaaguuugguguccuugguugucaauaguuuaguuugcuacccggccugguauacuuacgggcuguaaaccuauguaaugaguuuagaagaggaaucgcuaaacgugauucccuuuuuguuguaugauauuuuuguccucccucgaggggaauuagaugccacuucguccagugcacugucaugugugagcagaggcuggagaagacaaguggcuggcaccuucauuugggagauguuuuucuuccacaugugugucaggcauuacuggguccugacucagggaagaaggcauggcuggguuguguccucagagaauuguaaaaugaugagucucagagccaggagcuguuuaggaaggaaugacucggauguagaaagaaucggaggcuucugcaaaaaguaguuuuuauuuuauuuuauucccucaggugaaucagauauccagauguguauuguucuggcuaacuacuugaaauauuugccaacucuuuguguguuguguaugcaugcacaugugcaucugugugggccugagguggguauugggugucuuacuuuacugcucgccuuuuuaauuuuuaauuauuuacuuuuugaagacagggucucuucccugacccuggagccuauccacugcuagcaggcuagccagugagugcacgcaugcgcacacgugcacacacgcaugcacacacgugcacacacgcaugcacgugcccgaggguguugcagaugccucugaaccuacccuuuuucuuuuuccuucauuuuuggguuguuuguuuguuuguuuguuuguuuuuuugguuuuucuagacaggguuucucuguguaguccuggcuguccuggaacucacucuguagaccaggcuggccucgaacucagaaaucugccugccucuccuuuucuuuuucuugauuuaaauguggguccugggaucuguacucagguccuuacacuugucuguccgacaacugagccaaccucagcccccaucucugucagcauuagguuugcuccuguaagagagggccauagucuggugauagucugaucaccucuuuuaaagaguaaccaccagcacuaaacgugauucccuuuuuguuguaugauauuuuuugcccucucucaaagggaauuagaugccacuucguccagugcacugucaugugggagcagaggauggguuuuccuuuuuagcugacaagaaagcuuacugucgcucugcuagacuuagugaugcaugcuggagaagcccuguguccucugcuugccauggcucucugguucccuccauucaggggcccagguuuuacacugaagguagaaccucaggaguaaaggaaggaggguggaacuggcaugcgcucuaaaaauagcuuuauuagugaagucuuccaggugacugcugacaaccacauggugacuuuccugguugccuucuuuuuuuuuuuuggugucaguugugguucauauucagagauccuaacccuguaagagcuguccuuguacgaaaggaguugugaaucaguuucuggcuccaccaccaaaugaggcaaggaaguuugagcauuggcuaugcuguuacucugucuucagagaggucugcacuaguaauacuuuuacauuugucaguaacuuucuaugaaaauguggugugaacccagauucaaagguucagucgucaucuucugcaucuauccucccuggggucuggcaucagucuuuaauuuuuuucaaugauaaaucaucuaaguucuauccaaguuggcaaauguggcugagauagaugaguuucccuggggaacuaggagguggccuccuaguuugagcugaacagcagcuccucuuuagaagaguucugaaacucccuuaucuuuauguccuucuuucugcaccucuugguguugcucuucucguugugaccaagacccuuaccugugcuggucugugcucugcucuguggucuggguacugcauuguccgcaguugcugcagacauuuugcagaauguuuucuugcuuguuauuuauccuuacauuguucaccuuuuagagaacauuaaagacuagagaucaugugcaucuuuguuuuaaaguugaaauaaaacacaaaaccaaagccuggcuguaagcagugguugugagcagugauuguaacccagaggugaaugugacaugauaguuuacaucagagccgccuugaggacucucccugaccaguuuccauuuuaguaaugcagacugauuccaauaccaaauuuagaacagcuacuugcaaaauguccccuuaaggagagaagaaagcuugggauuugauuccaguggugaugcauucgccuguucaucugcuuaggacgcaguaauuaaugcacagggugggaguccagccagaggucuguuuuggugaugucaucacugguuuggagaugugauugauucuguuauccguuuccuggucuccuaggauugccuguguuggcacagagcagauuugaggcagccugaggaccugagcagucuguagggauagcacagccuggccugcuccuccaucagccuugcugauggugcugccaggcagaaggaaggagauucuggaugcuucccagcgucaggugacaguagccucuucagggaguuaacucacuuuacuucaggaaccaggaaccaacuauaacagcuacugugcaugaacaagaugcacucaauauaaguaugacaauguuauaaauacaugucaauaaaauuaaaauaguuaacgcauuuauucuguucuuguaucagugugauuuuuaaaguuauuucaauuuaguuuugaauugaccacacaauaacaaaguuacuaugacuuuaaaaacuugaaacugcauuuuaugaaaaauaguggccccucacacaugugcuucauagggucuuuuguagucuaggcugccaaaaauucuccauguacuuucagauuucgggagcuugaggaaacucuaggucuuuuuuuuuuuuuuuuuuuuuuuuuuuuuuugguuuuuugagacaggguuucucuguguagcccuggcuguccuggaacucacuauguagaccaggcuggccucgaacucagaaauccaacugccucugccucccaagugcugggauuaaagacgugcgccaccacugcccggcucuaggucauuuuugcagucccuauuauagaacuguuucuagggugugguggcauccaccuuuugagacccugccuuuaaauuaaaauguagguuggauauguuggcacacaucuucagucuuagucuuagcaguuggcucucugugagugaggccagccuggucaacauaguuccaaggcagccagagcuacaaagaaagagccugucucaggggaaaaaaaaaaagcagcucuuuaucccaugucugucauugagucagugacugcaggagagcaucacugucuuguauaggccuuccuacccagcauuccuguccuuccaggucccgggacauacaauuuuuugggcacuuguuguugccuguguuacuuguugagaugguccugguuaguuuggguggcccaguuggaguagaguggcaucgugccuuuucuaucauacgguuucccugaaggucucaguuguugauuccuuaugcaaaugucuuucuuucacuaacuuauuuaaagucaugucuuauuuugcugauuauugaacuaaucagaaccuuaagaaaaguaggaaguagaaaaaagugauuccauaccaaccauuuuucccuucaaauauaaacuuuaacuuaucuuacuuuauuugguuuuauuuuucaagauaggguuucucugugaagccguggcuguccuggauggaacucacucugaaguccaggcuggcauuagagaucugccugcuuuugucccucaaguaugaggauuaaaggcauguaccaccccagugcccuacuuuuuuuuuuuuuuuuuuuucuagacaggguuucucugcguaucccuggcuguccugccucugccucccaagugcugggauuaaaggcgugugccaccacuccuggccccacauggaaauaaauauaaaaauaagagaauuuucacaaauuuucacuccuugugccuuuuucaauccauuaucuccuuacugcuguuaacucaaguguacugguuuuuuuucaucuuuguaaagcuauuuauugagcaucuucuccaaccccggucccaucccacucccacgcucaggacaugaagccagcugcagcugauuucuaacacggugacuaaucuugcuugguuuggauuccuuugugugaauggaaucaugcacugugcagucauucucuguaucucugaaaccugugucaugugugguuuuaauuccauuuucauuacacuguaauauuucauuggugauguggcgugcaucugaagucuuguuacucuggaagcuggugcaggaccaucucuugagccuaggaguucaaggucagccuggggagcuaacauaugaaggaaagccuguguuuuuccuuuuucuuuuuuuugguuuuucgaggcaggguuucucuguguaguccuggcuguccuggaacucacucaguagaccaggcuggccuggaauucagaaauccaccugccuuugccuccugggauucggugugcaaagccacgcccggcucuguuucaaaauauaaaugaaugaauaaaaaguggaaaggcagggcuuuagucugugugucugucuguguuccaugaacccaguaguuuaaacagcagcaguguauuccuuacaguucuggagacuauguaccugagcugcggguggacagaaaccucuuuucuguccuucauacuagcacccuuguuuguguguguucugaccaccuccuuuuagcuaugcuaagggccagcccuaaugaccucaucuagccuguaaccccuuuaaagaucaguaagucccauucugauuuggggcccagcuuggaaugcauggggcaagggugggccaaaauuuagcugucuuucacuuuaauugacagggcugcugcucacaagaagcugacccuuuguggccuccuuuucccuuaccagugcaggagaccugaaguggguaagacggaguuaguuccuagagcagugugcccuaguuugagauuacuaacaaugcugcuuagcugugugagaggucgaggccgagggaugcucagcaugugccugagccuggacuugaucccuuagcuccucagaaaggaaaacaaguaaugcagggaugacugcucugagcauucugagaaaaccagaacgacucaguaugguucauggccgucccugugcucucuuugcuuucaugaucuuugaucuugacccaucccucaugggcuucaccuguggagacagcagcucaucauagcagagucugaugaucugacgccguguccuuaagguggcagaguuccucaugcacacguuaggagcugggcucuugcuguucuuauugccguucagguugguauuugcuggcaucagacuaccaacuuuuuggcugaaugaucuugaacuuugaaaaucagauccuuaguuugaaguauuauaugacuuugcuucuucccacaucucagccucauuuaaagauuuaaaauucugcaccuguaauucugcaguguaacuuagcuuuuaguagcaugugaguaguuuccagaccaguaguuacuuuguaguagauuuuuauuaucuaguauaagcaaauacuauggggaauguaaaauuaagagucuuuaagauucaggaguaauuguagaauccaggaaaaauagcuuaaagaaaauguuaaaaguucuaugacuaaagugggagagaggaccuuaguggauuuugggauaauguuggcauggaagugugacuuagugggaaggcaggcacugcagcuaacaggugccaccgauagugcuguaccagguagacaucucucucuuaaaccuaugacugcugaagagacuggauaugccccaguucugggagaggacuggcuuuguugugcuaauguauuauuucaguuggcugggcuccaugagcuaggcagucgcuucucugcugagcuauccuccuuuuccagaguugccuuuaacaguguguaggaaugagaggacuaggggugggagaaggggcugaauuugacucuccucuucagcaagcuggccauguagguuccuccgagaagcuuaugccaggccaccauugauuaucugugauaaucugaguugaaauuaaaacuuguggagcuguugaaauaguucuuacauaacugccugugugccuagcuagcuguauuucuugccugccugccuaacaaaaaacaaauaaagaagccuaucauccuugccuuuucauccagcuccuccccucccugcccaacaccaccaccaccaaaaaaacggaauugcuuuccaaggaacuugcuuuuugaaaguugcuuuuuguuuuuuuuuucccccucugggaacauguuaccuggaacagagugagaauagucuguacauugcaucacuucacaauuucaaaugaaacuugacgacaugucacuuuguuccaggugaggaagcaaggagacccucaguauugugaagcacugcaaagaaaggcugggucuagcaucucaugucuuaaguuugcagaguucugugacccuaacaugagaagagcaucuucugugaggguguggcuuccuuaauuucaugcuuuguguuuucagcauuauuuaaaagucagaucuagggcuggagagauggcucagcgguuaagagcacugacugcucuucugaagguccagaguucaaaucccagcaaccacaugguggcucacaaccaucaguaaugagaucugaugcccucuuccagagugucugaagacagcuacaguguacucacauaaaauaaauaaauacccuuuaauuccagcacuugggaggcagaggcagauggauuucugaguucgaggccagccuggucuacagagugaguuccagaacagccagagcuauacagagaaacccugucccccccccccccccaaauaaauaaauaaauaaauaaauaaauaaaagucagauauacuugcucuucuguaucugaugugaaaauauucaggaauaaugaccuuugacacauuagcaggcauagcagaugaggcuguucuuuauaacucccucugaauggacacaauagcacgagguucuugguuuacugcugggcuuucuguuuuauuugguuuggagaagagucuuuuuugccuuguuagcucaagcuagccuugaacuugagauaguuguucuuuagguagaacccagagcuuugugcagacucagcaaguauuccacagugagcuaaacccugggucuucauacuccugcaggagcauuuuuuuaaaaauauuuauuuauuguauaaguacacugccuucagacacaccaaaagagggcaucggaucccauuacagaugguugugagccauuaugugguuccugggaauugaacucaggaccucuggaagagcucuuaaccgcugagcccucucuccagcccccaaaaauguguagcccaggcuggccuagaacuggugaucuuccugccucugccuccuucagcaaauccuacuggcgugcuccaccacuacagaccagcagcauucuugaugugcaaaaggaauaaacaagcuaacuugcucuguagaccgggcuggucuugaacucgagaucugccugccucagccucccaagugcuggaauuaaagggguguucccccuccccugcuuguagcccuuccuuggcccaugugugauguuuuguuuuggccagaaucuuucuccggcugacuguuguuuagugcuuaauugucuugucugguccucauucucgagauacuguuguuaaaugaguucaugucucucugucccccucucccucacacacccccuuuccccuucucucccuuugcucaugucuuuuccucagucucugggacaguguccuucugcuuuauguuguguuuggguaagccaggcaguucucuguccuucauagaacuccacugaaguugcuuaaauacuggucacuuauucuaguccauuaaucagugugacagccgacucagucaucuagagucugcugguugcuuagagaggaaccuuuuccuaaggugucuucaaaaagugaagcagcuaaguacuugcccuguucguguaugggauacagauauuggguacugcguaguuuuccacugguuagagcuguagagugguagaagauguguuuuugacuccuaagagcccuggguucuuuggggcagaguaauggagugauggauuaccuuugaagaagcaagugccagucuguaacaugcuugcugugcaagcuggaggaccugaguguggaucaguaccuacaaaaagcugggugugagggggcacuucugugacuccagcauagguaggaggcauagguagaucuuagggaccugcuggucagcagcuguagcugaaguggugagcuguggcuucagugagagacuguuucaagauccaaguuggagagcaguaggugagacaccuagugucagccucuggcguacacaacuccucacacacacaccuccucacacacacaccuccucacacacacaccuccucacacacacaccuccucacacacacaccuccucacacacacaccuccucacacacacaccuccucacacacacaccugggagcaugcacuggcacugaucaauaacaacaaagaguucacagcaacaguuacuucauaaucuagaugaauuacuguuuguuaauuguugucuuugaacuggguucaucacuccuguggagaguuguuaaugguggauuuucuguuuuauuaauugaaaauauuuuuauuuuauauguuuggauaucuugccuguaugucaggcagcacuccugagccugauuccucaagggggccugaagaagguaucugauucacugggauuggaguuacagauggccaugagccaccaugugggugcuuguccuuuggaagaguagucauuacccuuaauugcugagccaccucuuauuuuggcagaucaagagacaauuaguuuuuacagaauagacuguugggccaguuuuucuuuucagaacuuuucaaggaacuuuuagcagucuaaguugaagaaaaugauugccuucuagacagaaguucacgggucagccaggucuucccguuuuucauuaucuucuggaggcugagcuaacguuuguccaggucauaugaagucugucucccugcaccuacucagcuguuccugccaaauggauaucuuuguggcuuacaaaucugugaacucaugacauugccugaaguuguagaggaucuacuaucugcugguugucccugaaagauagacccuucugggcaagguuuuuuaaacccuaguaggguuuuaaagcaggccugauuagaaagauuccccuguaugguuaguguguguaguuagaaugagugugugugugugagugugugugugugugagugugagugugugugagugugugugagugugugugugugugugagagugugugagugugugugugugugugagugugugagugugugugugugugagugugugugugagugugagugugugugugagugugugugugugagugugugugugugugugugagugugugugugugugagugugugugugugugugagugugugugugugugagugugugugugugagugugagugugugugagugugugugugugugagugugugugugugugugugagugugugagugugagugugugugagugugugugugugugagugugugugugugugugagugugugagugugagugugugugagugugugugugugugugagugugugugugagugugugugagugagugugugugugugugagugugugugugugugagugugugugugugugugagugugugugugugugugugugugugugagugugugugugugugugauggguagauggcauguauaguuaauuaguaauuucaccuguucaaacagugcugguuagaaacugagcagugaguuggcuuuucuguuucuuucuccuugcugcuguagagaacacugaguucuauccuugggauucaggggaagugaaaguauagucagcgggcaggcagccucagcaugcauggugcugagcacugugcuguagaaaggccuggggagggacgaaauaacuuaaguacauaaauuaaaaauuaauaaggaagugccaucagcaaaagaaaauaguauaaagauauuacaugccauacucaaaguuaagauuucggugacuuuaguauauuacuaguggcuuuuuguauuauuuuguaguuuggggcugcugaacccguggcucugugcaggguagacaaccaucuaccauugagccacaacuucagcuccaccuuugugaacaaacaguaauuuuguuguuauucuuuugugacacagggucucuguguaguccuggauauucuagaacucacuuuguagacuaggcuggccccaaacucacauaaauccuccugcaucugccucccaaggcuugugcuguaaugccugaacaaugguuuuauuuagagaucuaguuguacagaaagaauucucccacucccacaaaauacaagggauuuauucagaaguaaaauuucaagguggauacgguacaggguaucgguggauacaggcagaauugccuaaaaaucuugaagucuugguuuguuugaggcauuuguguguguguauuuugacaccagguuucucuaacagaacucuggcuguccuuggcucccuguguagacuaggcuggucuugaacucacagauacccgccuuccucugucuccugaaugcuaaagucacaguucuauacauuaaucaucucaaaaggaugauuaauaauaaaauuauuucauuuguaaaagcauggaaaauaauuaaccagguuagacgaaacaaagucacaaaauacugaugagagagagugaagugcgagagagaugacuaaacgaccaaaaguggcagccguacaagugucucagucacuuaguuacugugcuacugugaagagacaccacaaccaugacaacucuuacaagagaaaguguuuaccuggggcuggcuuaugguuucagaggccuaguccauuauucucguggcaggagcaugguagacauggugcuggagaggucguugagugagcuacaugcugauccacaggcugacagagacacaugggucuggccugggcuuuugaaagcaaagcccacccucagcgacacacuucauuaucuaggccaagucuacuaagcuuuuuaauccugucaaggacuuccacucccugguacaagccaggggggccauuuucauuaaaccaccacaagugugaugacccaagucaaucuguagaaccuacauagaaggccagaugcagcagggugcaucuuaauccugucacuccuaggggaaaaagagaagcagaaauugucuagaagcuugggggcuagcuagucuggacucuacaguguggugcagcacacguucucucucucuuucucucacacauucucucucucacacacacacacacacacacacacacacacacacacacacacacaaauacauuguuuuaaaagauuucuucaauguauauaagugcuugcuauguguguguauguguagcauguguaugccuggugcuuugaggaggucugaagagggcauuggaucaccagaaaauggucacgagacaccaugugggugcugggaaccaaaccccugcccucccucugcaagagcagcaagugcuguuugccucugagcuccagacauugaagaggccgugauaacugucugagaagaauccauuaaaggaagaagugguuguuuugguuugcaguuugaaaauggacaacuggggcuggagagagauggcucagcgguuaagagcacugacugcucuuccgaagguccuggguucaaaucccagcaaccacaugguggcucacaccuguaaugagaucugaugcccucuucuggugugucugaagucggcuacaguguacuuaagauauaauaaauaauaaauaaaucuuuuuaaaaaaagaaagaaaauggacagccuaucauagugggaaaaacauggcaguaggagcauaaaguggugauuacuuaccucucugaugucaggaaacagaugcucacugguggugagcauaucuccugucuuucagacccugacuccagcccaaguugcucucauuuaaggugggucuucccuguucgguuaaaaggcagcaaacacuagccaaagcacuagccugucauagugauaagugucuuuaauuccaacacugaggaggcaaacucaggcagaucucugaauuugaggccagccugaucuacauagagaguuuaggacagcuagggcuacgagucugucuucaaaaauccuucaucacuuguccuuucacgugcuugcuuuagcagaacauccucuccugugugcuucagugaaacguuuuuucaagagucugccuuagccuuucacaccuguguccacuuuaacaaaguguuccuucacguguuugcccuagcaaaacaacauuggacugacuuuccaaagacuccuuaaauugccacuucaauagcccuaauuuuuuugcuuuuguuuaucaagaccggguuucucuguauaguccuggcuguccuggaacucagucuguagaccaggauggccuugaacucagaucugccugccucggccuucugagugcugggauuaaagguaagugcuaccacagccugacagaacacucccaguuuuaauuaucugccuuuucuggguauugcagcauacagcuguaacuugagcuaauuuugcuagcaaaggcagaaggaucaagaguuuuaggccagccuggugcuacagcauaguaagauucuguuucaaaaagcaagcaaaauuauaaccuacccaaaauuuaucuucuaucucauggauuucugaauguccaaauugucgugacugcucagaacuagguugugcuggagucagaguucaugauuucaaauuuuacaucagagcaagccaggcauaacagaaaaucacaccugaaaucccagcucucuggaggcugaggcaggcagaugacaaguccagaccaagcccuacuuccuuaaacauagugaaacuuccccaaaauaaagcugcuccaaucacagcagcuugguauuggcacaaguuuagauuuugguuuauaaucuuuuuuccuccuuagugucuguugauaauagcaagagcauaguaaaaaacauauucuugacauuuuuuuuuucgagacaggguuucuuucucuguguagcccuggcuguccuacucacuuuguagaccaggcuggccucaaacucagaaaucugccugccucugccuccugagugcugggauuaaagguaugcgccaccacacccggcuucauacuugacauuuuuaaauuuaauuuuuauugugguaacaauguaugugguguaaaauuggccauuuuuaaucuugcuuauuuuauguuguugaaggcacauuuuugguuuguguauauguguaugggguguguguguguguguguguguguguauguauggguggcucaugcauacaugcgguucugggaaagagcucaugcugucuucuguuaguguucauuguacauauugagagguugggucucagagcuugugcugcuucagcuagucuagguugccaauuuguuccagggucucuuaccucuguucccgccuugcuggaauuacugacaggccaucaugugucgcugguauuuacaugagugcuagugccagguggaacauggcaaguggauaucuugggguuacugacagugaaguagacaaaauagcauagaggguugauaucugccaagcucuagugccuuaaggcuuauuauaaagcuuaugugucucuuugggaacuaaaugcucaagguugaggagaaacccccaaauaauauuuaccacaacauuuuggcaccccacauugggugccaguuguaaauggaauuaauuguucuaucuagcccguaaaaaagacacaaucuagguauuuuauuuacaagccauaagccuagauggagcagguuuggagcuauucugacuuauuucccagccauaacgucccuuguuacuugcugguccuggccaugugcucaugguccaucucuucucuguauccuuccuucuucuucucucucucucucucugcagccucugcagcccccucgcaccauccucaaaucccaccuuuccaaucacaccacgcaaaaaagagaaaagauugugagugucacagcaccccaucuuacuugaaaccacaaaugggugcuugauuagguuucaugucuaucuagauaggacagcauuugucgacuugauuagaccuugguugcccacguccuuaccucaaaauuguuuuggcugugucucugagggugcuuaugugggaagcauuugagugggacacuugaggaagucagauagaagucuguguugaccagaaggcagaggaugaaaauaugcucugugcaugucuuucaugucuuuucauauacacauucuuacuguaagguccuguggucuguuauccuccauaauaauaauaauaacuuauuauuauugagacaggguuucucuguguagcccuggcuguccuggaauucauucuguagaccaggcuggccucgaacucacaaaucugccuccgcccccccaagugcugggauuaaagguaugugucaccagugcccggcuguaauucuuaaacugcaacuaucaucagcuaguauagagcuugucuaggaugaagaguuccccacacuccaguguagcuggugacagcauucugauguucaguggguuucuauuuuucuugugaaguaggguccugugauagaguaguaaaugcucuuaacugcugagucaucucuccagcucuucagcuuuugauuuuagucuuuuuuuuuuuuuaaaacaaaaacaaaaacccaaagagguuuuacacacccagaaccggaaaucagaucccauuacagauggguugugagccaucaugugcuugcugggaauugaacucaggacuucuggaaaagcaaucagagcuuuuaaccacugagcuaucuaucuagcccugagauaagacuaguuuaaacugaauucaagucacagguacacagaagggcuccugcauugacuuucauguccuuucccacuggacaccaggagagugcacaguggggaagaggaggaaagaagccagucauaaaguaggcuaggaggcugugcaccuuuugucucacaucggccagcuguggggccugcgacgagggacuuugcauccccaucugccuaccugaccuuugcaucauucuuucugcucaagugaaagagcgaagagccagugacaauuguuuaagaaaaaacugaauuugggccagagagauggcucagcggcuaagggcacugacugcucuuccaaagguccugaguucaaaucccagcaaccacauggugccucacaaccaucuguaauggggucugacacccucuucuagugugucugaagacagcuacaguguacucguauaaauaaaaucuuuaaaaaaaaaaaaacacccgaauuuaagaaagcucauuucucagguuucuucucggaaaaaaaauccaaguugaaauggugguguuuuuuuauuguuugcacagugugacuggguugguuuuguuucuguagaccuuucuauccugaugguggaaggcuuucucaccucccaggcaugugccacuaugccaugcuucugcuguugcugcuaccuugauuuuuguacaaauaaugcaagugauuuuuaaaaguuauuuguuuauuuauuuguguuaugugugugaguguuuuuccucaguuuugggacuuuggagguccugcuugggguuuaauaaggaaguggagacguguguaguagaaagcugugggccuauuuccccggcagucucucagcuagcccaucuaaucuaacuuuaguucuucuucaccaucucgcucugcauggcucccucugcucucccucccuaaucugcuccuguucucuuucucuuuuggcuccagcuuugcccagcacuuuauugcgcaaaugccacacuucuuucuucugcgaaaacgcuauuagcauagugggagagauuccucccccagggcagcuugccuuuccuuuuugggaggugaggaauuacuggcacagcaauuaacaauugagaauacagggacauaccuucauagccaguugauacaauguguguggggugacuuaucccaacauacaucccucaguguaguauauauucuaugugugugccuacuucugcaaaggccagaacaggacuuccuggaauuggaauuacagaugguuguaagcuaccgugugugcuggaagucaaacccaguucucugcaagaacaaguguguuaagccacucuccagcccccaaguuaaauuuuugagagccagcaacuuacuaagaaaagagaaagaaagcucuguugcaguuuucuuaauucguaacuauucagagagaaacagcuccggucuguggcacacaucugucacccucagcccuggguggcagaagcaggacaggugaguuguuggaaauucaaggucagccugggcuauccaggggugccuguuucaacaaaaucaaggacagguaccaguacuaaccgaaacaugguagacacacaaguggucccuagagccuguggagugcuacccugggcuuuaggaaggagcugcugugcuugccaaccaggaagcacuacuuuaaaggugacauaccauagaucuguuuguuuauaguuccaugggaccauacaucuucuauagauuuagaaaaucugugguaggccaggaaggccaaauugcuuagccucugcuuacacagaauaacacauuucagcccuuggugaguuucuucuaccagaggacaucuggacauccuugugaaccuaccuaaguccuauguuauacuuuagguauaacuugcuaaugugcuuuaggguuuggaaauguguguuuauuuagguacuggggucagacucagagccucacagguaguagccacauucccacuuugauauuuaaaacugacauccuuggaaauuuuuucugcuucaaaccucugcugaggguguuagccauaucaugugaccuucaggccuucugacaaauagucauacucuguguuuuguuguuuguuuauuuuguuuauucaagacagggucucucuuauagccuuggcuguccuugaacuuccucuguagaucuggcuggacuugaacucacagcaauucuaccuuggccucccaagugcuggcuuaaagugauuaaaggugugcaccacugggccgggaagauggcucaggaguuaagaacacuggcugcucuuccuaagguccugaguucaaauucuaauaaccacaugguggcucacaaccaucuguaaugagaucuaaugcccucuucuggugugucugaagacagcuacuguguacuuacauauaaugaauaaauaaauauuugggggaaaaaaaagguauguaccaccacugcccauuuuauuuuuauuuuuacgugccugcaauguauaugcaucacauguaugacugguaccuguagagacuggaauuggauccccuggaauuggaguuacagauguuugugagccaccauguggguacugggaauugaacccacauccucaacuccucacuucgaaaccucuggguuaugggagaggaggcagguuuuuacaagcuugaugguugaugguaggcucugcaucauuugcuacauucauauuuuugagcuuuuuugucuuuuuuuugagacaggcucgcuuaucccagauugucuucagauuugcucuguagcugaggcuggcuuugaacucuugauccuucugacuccaccugccuagaggaugugugcuaccacacucagcucugauuguggaacuuuaaacuuccaaguaugaguauagauuacuauuuauuuaccuggcugcuuuuacuuuccuuugagaugcuguugaggaagugaacaagaauuaguuuguaugagaaauguaacaacaugaaacaccuuaguuggguuuuuuuuguuguuguuguuuuguuuuguuuuucaagacaggguuucucuguguagcccuggcuguccuggaacucauucuguagaccaggcuggccuugaacucagaaauccgccugccucugccucccaagugcugggacuaaaggcgugcgccaccacgucccgcuaccuuauuuuuuuuuaagcuuaugguauacauguuuggguuuuuuuuguuuuuguuuuuguuuuguuuuuuuuuaauacaaauacauuguggaauagccacauccagcuggcuauuaguguacuccuguuuuucuguggugagaacacuuucaaauguacucuguaguuuuccaguauccagucuauuguuacuuacuagucaccauaguguauaagcauucccuucuucaugccuggccacgggugacugccaccugcuguccaggcuucuuuggguuugagauccaccugaaugugucuuccugugucuggcuuauuuucugugacauauuuuuuucacccguugaaguauaguuggcuuaguuuccauaucuuguucagccccacaaggcuaguaguagauccaacagaugugcuggcaaguaaaugcaagcuggcgaagaagagugaucuuccuucuuccaguguccuuauguaggucuccagaagaaggugugguccagauuaaagguguguaccaccacaccuggaucugggacuagucuuguccuagguugaccuugaacucagaucuccuugccuuagucaccugggauucauagccacuaugccucaagaucuccaugccaagauccaggucagaaacuugugucucccagccuuaagaucuggaucacaggugagcccucccccucuggauuguaguucauuccagauauagucaaguugacaaccaggaauagccauuacaaauaguguacacaugcaugcacagucauuuuucaagccagaaaaaaggaggggaaauuacacacacacacacacacauacacacacacacacacacacacacaccccaguauauuaccuagccauaaagaagacuagaagcuaucauuugcugaaagugagcagaacuguaggucaguacauuaagugcagugaucuagacagacaaauauaucauguauaugaacaguuaaaauuuuuuuuucaaaguagaauaaugaucacuggagacugggaaagauguggggaaggguggaaaauggaggcuacaucugaucagcguguauauuuaucacuauaugcuuaucaaacuaauaaccccacuaaauuccauuaauacaacuaauacuauuauugaacauucuugaaaacaagauguucgccugcuugcauuuacuugccagcacaucuguuggcucuacuucuagccuuguggggcugagaaacuacuagaccccuggacuucccauucauagcugaccauugucgaggaguuggacuacagauuguaagucauaacaaagucccucacugcauagagacuacccacaaguucugugacucuagagaagccugacugauacacuuuuggaggucaucuuuuggagucaguucuucugccuucauuugggcuuuaagaguugaacuuaggucagcaaacuuguucugcaagugcuuuugcacaaugagccaucucacaggccuccugguguguguguguguguuaauuuuuuaugcagucuuauggcaaacucaguguguagcugcgaaugaccuccaguucuugauccucccagggacuaagauuacagguguucucugccauggcugcucuguccccauuuuaauccauuuaucucuugguguuuaucgacugauuucauggccuguguucgugccgcaaugagugugggugugcagguguccuuuggugugcugcaguagugcugccaggacuggcuguaaaggcgcacuguggcuugaggcgcuugguguugucuaggcucuuacccucugugcguugguugaauuucucuuugcucugguguuacucaugguuguuaggacuguugacaagcuuaguccagacuuccagguaguguuggagcaucuauggucugcugagaccguggucacaaauauuuugaaauguauucucacgaagaauucacauaucagauauuacucauuguuuggcauugaacagccaagauuuaugcugugccuucaggagggggagaaauggguuggauacuggguaauggaacaagaacgguuauaggcuuagauuugaguugguaggcuauauauuaguccuaguacaauacuucacauguuuagauccacacugugcagcagaacuuugugucaugguauaagucuccauaucugccuuuuauagcuggugauuauuaacuaagcacuuaaacuggagcuagugcugcugaagagaaguauuucauuuaucgaguuguuuucauuaaaguauagcaagcuguaguuaguaacgacuaaauugcagauucaaguauugaccaggguuccacaagcuuuucccauuaccaaucucccuuccuacuugugucucuagacauuuucccacagugucuucaggucuugcacucuaucuacuuagcagcauuccccuagcgcacagagaagcuguuaauuccauagaugcacgaguguauguacugugcccacuagaucuaaggucaccuggucauugauuagcauccuuuuggggaaugcaugaucaaaacuaauggcagauaguagcauagugaaggcuaaccuagagucagcaguugcugugacuacuaaggcuaucauauuugugacuuguauaguucacaacuugaaagcugagggaagcuuuggaggagcuguaggacuccguuauccuuugucuuuagguaacauucuuauauuaucaauuuuguuguuugguuuugaggucucauguaauucugacuagcaaaaggaagaaagaaaaagcugggcacugguggugcaugccuuuaaucccagcacuugggaggcagaggcaggaggauuucugaguucuaggacagccaggcuacacaacaacccugucucgaacaaccaaauaaauaaauauacacacacacacacaaauuuaagaaacuaucauuagaaccuggccuggagcuggguuuuuugcuacccaugaaaacaaauguuuaagugcuggaggaugguucuuguagguuuuuuuuuacgucauugaagaguggaacucaagauaugccaucugacacugcauacugacuucauaaucuuuagcugugaccauuuaaccguauucucuguaggccuuaagcaacaaauuaccauuugcaaaguagcugagaggauguguacugugcgggguagacuaguucucccuagugguguagauggaugccacacgguuagggaagcuucuuucuugucaccuuacaagcagugucaccuaugauagcaccacauaagcucccugugccuacacaaagggacaauagugucugagggcaccgagacugacuuguagaaauuagcagcaaaagccuccuaauacuuagcuuuuuugucugguaaaugaauuccagcuugccucauggcaauaagauacaggaccaugggcagaauuuguugaaauuugauggagagaggaguugccaguucuaggguuuuuuuugguuugcuuucuuuuguucuguuuuucgagacaggguuucucuguauagcucuggcuguccuggaacucacuuuguagacuaggcuagccucgaacucagaaauccgccugccucugccucccgagugcugggauuaaaggugugcaccaccacgccuggcccaguucuaguuuuuagauuucuucuaaucuuccuagauuuuugcucucuucuucagucaucccuuuagggaaucaggcuacugagcaaaaagaaguauucuuuccaacugggggaacaccuguuuagcauuugugagauccugccagcauguuugauugauaacaucuuaaaaaaauaaaauugguccccccuuguaagggagagcauagggaacauuuauuaucuugcugcuucagagaccuuuuuccuuuuuuuuuuuuuaaagauuuacuuauuuauuacauguaaguacacuguagcugucuucagauacuccacaagagggcaucagaucucauuacagaugauugugagcccuacgugguuacugggauuugaacucaggaccuuuggaggagcagucagaacucuuaaccgcugagccaucuccccagcccuagagaccuuuucuuauccacgaaguacugcugacaugucccuaccuuugccuuguucugcuuggacugccugguauccugccgguuucauuugacuucccagaucgcaaucgucuggaaggcagcucuuuccaucaguuccauuuauauugcauuguauaugugaagaaugcugguguuuccaauuuagcauagggugguaaaaucccagcacaaacaagcauuccuuugggugaaaauuaagucccaaauaaucacauuauuuuauuuuauuuugagacaaaaaucuuacaauacuaugcagccuugaucuuaccauguauccaggcuguguuuuaucugcccagcucucuagccuugcucacaaucagggccccgccuaaaucucuucugccccuggauguuguuucuccucacuucaccuccauucugaugucaccaucucuugccuagauagccacagcauuucccagcauugggccuuuaggacuuuaguuucaugacuuucuccuggccugcagcauccagacaauguggcuaauaggcugccugauuucugaggucugugcacaugcuauucccucugccugaaucuccuugcuauuuucugcuuuaggcccaggcucugcuaguucuucuacaggaauuguucccaguucuugaagcugucauaauuaccuucuacauaguuugaucuuaguacucuacacaugaauauacaguuagcauacaaaaaaagagguuucauugugacauuucccuacguuguuuguuuagugucuccuucccaccccacaguauuuuacuucuuguguuugguaugguuucugccuguagccuagugcaauuuuugcuuuugauauuuguuagugaauauaggaagauuauuauggcacuggguugaaggguacugucaguagcaugauuaaggaauaaaauaguagagcccacauauacgcaugcaagcaagacacucauauucauaaaaguaaauauuagaguagaguuuccagcaucccuaggagagagaacaggacuaaaacuauaagacaugagacuggagagauggcugagaguuuggguucuugaugcuuuugccucucgaggacccagaguugauucccagcauccauacaguggcucagaagugucuuaugacuucaauuccaggagauccaacauccuuuuugcccuuugcaagcaucugacacacauuuggucacagauucauguaagaaaacacucauauauauauaaaguauauaugaaauacaggaaaagagcaagacauuugagcaacucuguuuugucgucccagguguuuuugacuuuaucguuuccuccuaggguguuuuuuuuuuuuuuuuuuuuuuuuuugcauuuuccucaugaauuucuuuagagaugguaguucuaaauuaaacuacuggaacauacaaauuaggcauggcuguugggcuguggauuucaagucuuaguacauuuuagcaucucaaaaaacaagugaaaaacacaaacucacgcagguggaagcaggcuuuauuaagaggauggugauuuggcaacuguucucaccgggaacggcaacguggcuggcuuucuggcacacucuuagaguuuugggcuauuccaccuucucucucaagcuccaucgugugcaguagcaccucaguugcccagguacaggaaaggccccggaagguuggaaaguggagguaagguugggcucuuagacaggaaaacuacagacaggcccuugcacccugggggcauggaacuccggggggaguucuuagcuaaauugccaaaggcacuuugccacacagucagagagguacauaaacccagugagacuaguuccuguauucugcccucaaaaaggacuucauuauuuuuacugcagugaucuggcuaaagccacucccucauucccuuccuuccucaccugccugguggauuuuucauucuugcucucucagaaucagcugucacugucucucaguuugcaugagcacuccagaaaguauagccgagccucugcuuccugccuucucucuccacugugcuaggggauggaugccagcauuuguacugacugaccuggggguaugaagcauuuccaguuggucuuucuuguuuuaauuagugaaauuuuacuggcauuuccaguuauguucaacuucggucucuuagcuucauguuguuugagguaauaauaguguauuucugagcucucugcuuuagaaaccucauuuuucauuuauauugucuuggguugcauuuuggggcuaguagguguucuugugacuugaggugcuuguggaggucaugggacagugggggcaguuggguuauuucugugggucucaagcacuaauuucagauugccagauucaacagcaagaccauuuacccacugagccgucuugccagccagagucuauuauuauguucccuucaucuccuguguacaguucucugguguguaaguuuauuuuacauaaguuguugaucaguacauucaagaagaacagaauugaauguggucucgcugcccugaagagaggugugcuugguguggaaagguggucuguucaggacucugagacuuuggggucacgaaauagucaguccccaguccccguucuccagacaugcugcugcugcucuccuuaacuccacagcuagguccguaagaaccauaaaaacaauugcaagauggacauguguggccuucuuccugcuucuggguggacuucuuucacuauaguucuuucaagguugugacuuucuaaauguagaucugcagcucucuugagggcaacaggcauauuucugagagagagugucuuggcgacaguuacuggugggcaugccuucuccacacugauuggccucuuggggucuuugccaauuuccuccugggcaguguuuagcgccacggccacuguccuccucgcccagcccaccagcaagcacgaggaggcagccuuacugaauguucuuuuauuuuuaaaaaaauauuuauuuuguguauuuuaugucugugaguccucugucucauguacaucugcaugccagaaggagacaucagaucccauuauagacaguugugagccacugugggugcugggaauugaacucccugaacugcuaauucauccuccagccccgaauaacugaauuuucuucacccuuggguuauuauucaaaguggcugcucuucauuccuaccuguaaaagaccaguugacaucugucaccaaguuuuccuacgcaucaugcuuuccagaccaugugaguguucugucuggagguaugccugcaugccagaagaggccaucagaucucauuacagauggcugugaaccaucguguaguugcuggcaauuaaacucaggaccucugcaagagcagccagugcucuuacgugcucagccaucucuccagcccacaaacucuuaaguuuuuuauuuuuaaaggaaggaguugaauauauaucagacacacagagaaaaagacccucugugaagcagagguggggcuuugaaagccaaaaaauuccagaaauaaguucuuaaccugaaaacaaaggcguuuggucugagggcuuccacacaggugguguauugaguucgggcccugcugagaggaucucccucuugcauuugaccucuucccccaugggcuguuagguacccucuguccugccagcuugcauacagcugaggggaacccuuuuucaccugaguuguuuuucguuuuuuguuuuuuguuuauuuuaaauacugagauggaaucucaacuauguagcccugacuguccuggaacucacucuguagaccaggcuugaaaauacagugcucaguggaaguagcuaaugcugcuauuaaagucuuucaucuuaaacuccucagaaugaaaaguccaaaguuauauuuauauuuuucucuuuucccuguuguguucacagacugauugaucuuagaaacagucuaauuuuuaucaagaccauaacaaguuuucauucacuuagaccucuuuuuacacaguguaugugcgcuagguguuuugcugagagcagugaaagcuggugucgccugugccuccugagcugcauugguaaaagcagaauauacccugauguaggaugcugaagcccaccgugggccuccugagggcagucaaucacuugggaacuuuucccuguaaggaauaaauggcucugcuaagagugacucugauaucugugagcccagccauaugcugaguggacucuugugggugggagcaagcgcccacugccuccugcuugccgcguguacucugagggugaaagaucucucauuccugacuccuccuucagcuccugcugccucucaaggaagagugucccacagacagaggggugcacuuacuucucuuuccccucucccucucucugguuccucucucccucuccuuuuggugcugaggaucagaccuagggccuugcaugggcuagacaugcccucugaccccagagcaaugcuuagccccauucucaacauccuccuuuccacauuuaccauaaauuaacaacccgggagacucaaaauaaccaaauccuaugcucaaaacaccguccgcuguugugggaaucaauggcuuuggggcagcaacccuguguaguuuccagaguuggaagcugaagaaagugacucuuaaggugucucacuucacugcggcccagucagcauguuaggugcuuccuuucugauacucaaaaaggcuacuaagaaaucaagcuauggccaagccauauauauauggugcacauauuuaauccuagcagucaggaggcagagacagaggcaguggugggucucugugaguucuagaccugccuagucuacauagugagacuuuguaaaaagaaguuuuuacaacagguauccaccgguauaguguuauucaucucaaaaagugauaccagccaggcaaugguggugcacaccuuuaaucuugggauuaaaguacuuaggaggcagaggcugacagaucucuuaaguuugaggacagccagggcuacauggagaaacccugucucgaaaaacaaaacaaaaaggugaugcuagaucuucagugagacugaaaccuugcugagucaacacagacucugggacggugggguugggaguaagacuccauauguauguauguauguauguauguauguauguauguauguaauguaugguuuagaguaugagaaaacucuagauaggacagguggcugaaggaagcugucuccgaggguucagcuuccuuacacagccuguggguguuuuucuuaucagugucacugagcuuaauaggcugucaugcacuaugggggugggguggggguggggcagcauugggcagugagaauaggcagacuuugucugauaguugaucuugguugcugacuucauuugacugagagauacuuaggaaauguauaaggcuugucucugagugugucugugauggcauuuccagaagugauuuuuuuauuguauugauuuuauuguguguauaugugugugcaugucccagcauauauguggaggucagaggacaacuuucacaaacugguucucuccuuccaggcuuuaggaccggggauugagcucaggucaucagguuuggaggcaagagcccuuaucugcugagccaucucacugaccccagagacaguuaaguagggagacagucuuugaauguggguggcaccaucucauaccuuuuggugggagguggaggcugauggaauaaaagggacaggaggaagucuagugcacaggcuuucuugcuguguguuuucuggguauugugauggcaccaguuucacuccacacucucccuaccgugaucuuauuaugggcccacaguccuugcaguugcccuguugccuuugaaacugugaucuaaaauaaaucauuucaagggauuaccugcuuuuuguccuaagcaaauggcucauuaguucuugagcuaccacucccuuugccacgcugucccuauagccagagacaauggaaacagucacuuugagggacauaggguuccacuuccuugugagucaguugguacagcaucuccugugugcucuugggugugcuaucacccauugaaaaggcaguuggcccugaacuucuucccuugucaucuggacucuauucuguucucugucugaccuguguuugggacauauauuaaaauaacagcaaccaguacuugucaguuuacacccaauacucagcuaacaagcgguauuuuugaaacccaaucauuuucugguaagcucuuucuuuguuaaagaucaaggauugacaagaccuggaagagugaaccaagggucagcauguuacauacuguacagucauggaagccaaggcugccuaguuuuuuggcaaaagguugucccuaaacagaguugcacugugaagcauuguucauccuccagucucauguuugauaauucuuuacuuggcaccaggcaaauagaaaacaaaacuguccucauggagaauuuuagaaaguggagaauauauauauauuuagauuuauguaaguggguuuuuuuuuuuuuuuuugguuuuucgagacgggguuucucuguauagcccuggcuguccuggaacucacucuguagaccacgcuggccucgaacucagaaauccgccugccucugccuccggagugcugggaucaaaggcgugcaccaccacgcccggccuauguaaguguuuuaaagcagcaaacaguaguugggggagagggaggggugucuuagguuacaguugcugagaugaagaagcuauggaagauuguuauuuacuggacuguuccucauagcuugcucagccuucuuucuuauagaauccaggaccaaaaucccaggcagggguggcacuacacacaaaaggcugugcccucucccaucaaucacuaauuaaaaaaauggccuacagacuuguugacagaaaauauuacagaaauauuuucucaguuaaggcucccuucucucuggugacuuuagcuugugucaaguugacauaaaacuagccagcacagggcgcuccuuaaauugguuccuaacuggcugugguggcacacacucuuaaucccaaugcccaggaggcaaaagcagacaggucucagaguuaaagaccaucucguggucagccagagccacacagaaacccugauucuaaaaaaugaaagaaaggaggaagggagagaggaaaaggaaggaaggaaggaaggaaggaaggaaggaaggaaggaaggaaggaaggaaggaaggaaggaaggaaggaaauagguuccuuugcugagaaaguagugcuuaaucuucacuugugagauuugugagucuguuuggaguguuaaucccaacugcugaugccaguaauggacccagcacuugaggagagagagggcaccggcauccguucagccccugcccugcugucuuguuagguuagcuaaaggguucacaggccgggggccagucugagugagggcuggggcucagcuccuggcagaccagaguggcugcacuguagacaaugcaaaacugccuuaauguuucuucagcucaccugcacuuucuccucccgacagcuucaaggaugaccucuaggaagaaaguguugcugaaggucaucauccugggggacucuggguaaguguuucucacgaaucugaccucagauuggcuuggagcuucauccucacugaucucaaggcaguuccacauucggcucugggccuggccucuauccuuuacuguugggguuuccuguguuuggccuauugaaaugcuuaaggaacccucaaacaaguauuuucuuguuuuugaaagugccuuccagugggguagaguauaggaauagugucuccugcccaggacugugagaaauggcauacugucugaaaggagucucaaggccuuugaggauuacagaccucacucuacuucuguaaauucuaauuguguugcagaacuggguagaaccagcaccuuagaccacuggucagccauugcgcuauaccccuggcaaggcaagcacuacugucuuaggcuguauguaugugcacucuuuguggaaagccuugaacaaggaaagcauuggcgcuuucuuuagguugcauuacccugacccuacccuuaucuuacugaacacuugguuggugaguuuucuuggugaaaaaauuccuugggagggacauucuuaauguuuuauuauguaugugcauaugcgugugggugugaagguccgugcaagaauuguuuuuccuccugcucugggggcccugggauugaauuaaguuuucaggcuuggcaauaggugccuuucgcuuuagccaucaaacaggcccuguuuuguuguuuugcuugggcuuuaguuuugaaacaaaaacuguggcucaaugcccuugaacucacugugcagcccagucuagccucaggcucucagugcugcugccucuaucucuaagcacugaauuccaggcauguggggcuacaccugucuuggaacauuccuuucuggcuacauacugcugaguggcuuccuccugguguuacuugaccacacugagugaugcauaaacaccugagauuacaaagccguuuggagugaucuuaucacaaaguuccauuuaggagugagugaguuuguguguguuucuuuuaguaaaaugcuuuguuuuguuuuuaaacuguugcaguaccgggaguuaaacccaggccugguguaugucaggcaagcacucuaccaacuaaacgcucuuccuagcucaggcauguugcuuugaacauuguaaacacaaaucccuuucagucccuuauuugacucagacauguggguuuuguucaauuucaguguuggaaagaccucucucaugaaccaguaugugaacaagaaguucaguaaccaguacaaagccacaauaggagcggacuuucugaccaaggaggugaugguggacgacagacuuguuaccaugcaggugagccacugcucagccuggagccagacugccagcuuacugagucuucuuuaaaugaagucuucuuuaaaugguggguggguggguggggguggaguuggcuugcuuucuuccuuucugugaguuguagggauuaaacacaggucaugaagcuucugugcggagcacuucaccucuggguagcaccuucugugcugagcccucguguaggcccaguugauugcauccagacugucugucauaccuccgugcuuuucaaacuuaccauuauauuuguggagaauggauaauuggcugcaaauaguguuguuggauaaaauagcaguaaaagcacggucgggagcaugguggagacagagcccgagccccaugcaggcugagugcacaugcucccgccaugcaugagcacggagccacaccccaauccuaaauuugaaauuuauauuacaagacaacuaggaauuuuuguaaaauuuaauuuuagcuacaguuauugucuuuuuuuuuuucauuucuuuucccuuucuauuuauuuauguuuguuuuuucaagauaggguuuccuuguauagccuggcuguccuggaacucacucuguagaccaggcuggccucaaacucagaaaaauccaccugccucugccucccaagugcugggaucaaagguuugugcuaccaugccuagcuucuuuuuccuuccuuuuuuccuuccuuuuuuccuuccuuuuuuccuuccuucccuucccuucccuucccuucccuucccuucccuucccuucccuucccuucccuucccuucccuucccuucccuucccuucccuucccuuccuuccuuccuuccuuccuuccuucuuucuuucuuucuuucuuucuuucuuucuuucuuucuuucuauaaggauuuauuuauauguaaauacacuaaagcugucuuuagacacuccagaagaaggcaucagaucucauuaaggaugguugugagccaccaugugguugcugggagaauugaacucaggaccucuggaagagcagucagugcucuucacuguugagccaucucuccagccccuucuuuuuccuuucuaaacuuagcaaccuaccgguuucuucuguguucuaaaauaucuuuauuuauuuaucuuucuuucuuuuggaggcauuggugucuguauucaugacugaccuugaacucauaaauugcacuggggugcugggauuaaaguucuguagcuuaucuaagugccuuuguucagugcuucagcuuggaaaucuuucuggguuuuccuaacuucugauagcaaauauuaagguaguaguuaacuauuuaauuguugacuauccuaaauugaugucucggugauuaaaagugauuuaaagcacuagcugcucuuuacagaggacccagcuucaguucucagcacugcuguguauaacuucaguucuaagggaccugauacccucuucugcucucuaggcaauuuggugcacaagugcaggcaaacacauaaauaaaaacauuuuuauaaaguugaguucuguaaggcugauuuaguguuuccauaugucugcgcaccuuaugccccauguguauuaguauacaugguuguugaggcauuuuauguaguguguacacuggcuugugcacgaacgaacaccucuugaaaaagaaucccaauauauuugucuugucuucugguccaugaucucgcugagguaguugguacagugacaccaaacuaaagaaacaggagaacaucuuuuuuguuguuguuguugcguuuuacguuaaaacugaggucaggccgggcagugguggcgcacgccuuuaaucccagcacuugggaggcagagacagguggauuucugaguucgaggccagccuggucuacagagugaguuccaggacagccaagacuauacagagaaacccugucuugaaaaaccaaaaaaaacaaaaacaaaaacaaaacuaaggucagucaccguacauguuuguguggugugguaguguguguauguguguguguguguguguguguguguguguguguguguguguguguguguguguguguauacagguacauguguaccaaggaaugagugugccaguuagaaaacaacuucagguguucguccauccauccauccguuuucuuaggcaggaucucacuuuguagcccuggcugucauugaacucagaagaaaucaacuccuaacugcuaggaugaaaggugugcaccauuugagacagggucuucgaaauuuauauucugguuuuucuacuacauacacaaagcauacacauaacuaaagcaacaaaaacaaaaguggggcaggagagguggcuccauggaugaagaaagcccuugcuugcuaugcaaaaugugaggauccaugcugaaauucccagaacccaaguaaaaccagauacacaagggaugcaucuauguggcgagcacuauaacagggagacaggagacaaacaggcaagcgcuguaagguaagaacucugaauuggcucacaguuuaggauggggguaaugugagucggccuugccuagcacauaugcacauacauuggaagauacucaaaauaccugagugaaaguuaagacaccaaauuuggggaaaggacauuucuggaacaaagagggaagugaaauugugauaggcucagaggguugggaugggaugauuuuuaaguuuuaacuuuggaaggaguagagauguaagcuucuacucacguguggagucagaacugagagacacccucuucucgccacuccauccccagcagacacacacuguacaccacauguccaguccccacaaagaauguaaaagcaggacagggagacaggccaaauauguggcaagacuucugggacucagagguuugagauugccccauugucucccuguccacauguguggugguuccugugguguguuuagggaacggagaacuuggaauugaaccuacagucucuuaagugcucugcuguugggcuuuguccccagaccuuuucaaaugagugucuugagacaaggugucauuuugauacgaacuugaacuugcaaaucucuuguuucagccuccccaggagcuaaaauuaaagguuugugcaccuagauucaacuugauguguguagaauguaaguuuauacucuucaaagaauagggaccucuaucuuaaagaauuuaacagaaacacaugcccuuaaugacaaaaguaagauuucucuguaggacacuuacaauuggagugagaggauauauguuccuggccauuugaggaaaucaugucccaggucaucuucauagugacuaccguuucuuaaaacaggaauagaaaccaaaauggaaaaagugcuauaaaaaaugaggauauggaaaauuuagaacuuaaaaaaacuggggaaugcaaaaacaccaaaauaagugaaaggcaccguuaaacucuagaaguguggguaagcugcaggguuugggcagggguucggaaggccuggcuagguguaguggcgcaugccaauaaccccagcauuugggaggcagaggcagguagaccuuuaccaguucuguggaccucuaugaggccaggcuggucuacacaggaaaauauauucagagcuacauaguaagacaguguuuuggaaaaacaacaaaacaaauuaaacaaaaaggaacucaagacuguaggaagccaaaugcuaggcccaagagcccccagaaagaaugugugacuugaaggaagggcagugaggcugguguucuuuccagcaguaggaaaacaggugcugauaaaacacaggaguugcacagaccugcaccaucugcgcccagcccaggauugagagccacacucacugcugcaguguaucccacagauagcgucaaaugagccacacuggagacccaagcacagaagaguccaggagagagcaggaugagguagccacuucugaaugauggugcagagucuggagugagcccgcagagucaagaguuuuugcagguuguaguaaaagauaagaaaaggaauacaucacacagaagaacccaguggugaccuucuuggucuuugagagugcuuuuuguacuuacaaaggagccaggucgcuuucacugcuaguuuaggcucauccaugacaauugauuuauuuuuacaggugaggguuuacucuauauagcccaggcuacucucaaacucuugcaauuguuuuaccugugucuucccaagugcuaggaauaccagcaggaauugucagacccaguuaacauauuagaacuccuccccucuuuaggggaugggcaguguuagggccuuagccuagagccuccuacaagacuagguguucuaccacagaccucugacuccagcucuguacauugguuuuaauuuaaaacaaacaaacaaaaaaaccaaaacaaaaaaaacccuuacaucugcagagaacaaauaggcaauauagauuuggggagaaaagaauuaaguuucuagaacuugggaaauuucacuuauuaguagauuggacauagcagagaggaugugcaaaaaagaaacagaaaagaaagcugggugaggccacacccacucguuuuucccaugucuuuacacaugcccagcgagugauuuccauugagcuguauauaaaagaauuuggcuccuacacuaaggagaccaggauuggcguugcacauugucagguccaguggaguagugauggcuguuuuaccauucacguuucugauacuguugaggaaaagcuacaagucagugugcagugcugggcacagcuggguaggugugcauggacacuccaggcuuuguaagccaucauagugaagccguggaguagcguagauacacagaaggcccacaggauaggacaggacacgggcgacaggggccuugcugggaacucuaagggacacagguuguacuugacuggaccaagaccuucaaguggagcagccagaagguucaggacccgagguaaaaaaugcacaaaguaaaaacgugcacauggaaaguagaggagugagaacaaguccuacaggugaagcuagucugagaauacuuaaccuaccccaaauggcaucacucuccauucaguagucccugaacaagggugugugcucacaggaagcugguggucagaaaauagagaacaaaaaauggcaggucacagacaaaccuuaauagccagaagccagguuucagggaauuggagucauguggagguggagguaggcaggcaggcacugugcucuccugcaauguggccaugucucccagcauagcuuauguuuccacuccccgaucccgcauccauaacaauaugauaauggcaaucacaaccuguggccuaagagaaauggagucgagaaugucuggaggcugauggagaccucaggagaugagugagcauggcaagagcagacucuaagcaggcaggcuucagcaggauagcuccuuuaaccggggguaggaagggggaguccuauuccugcccaucucaggacgagauuucugggguuggacaugccuuaacccuacucuugcucuggaccagcucuucccagucccacugcuccagucccaguuucuguuucuaaugguuuaaaccucaucuuaacuuuuggcaugaggagagaaguguaagaauaauuauugcaguccugcauguaggaugaauggccaggaaauaaaguacaacauaaggcagugagauacagcaaguuuggauaugaacaaaggugaguugcaagagacuuauagcagagcacuauugguguaagaaguuuucuucaggcaccauuuacuucuggagaguucagaacacaugucacugaggugguguuucaugugcuuauauguauguguauguguguguaucucucugcaccacauuccugccuggggugcccaggcagcagaaggcaucugagcuccuggaauuugagauuaugagcugcuauguggaugcugggaaccaaacccgcguacuuagaagagcagugguggucuuaacugcugagccaucucucuggcuauagguuuacucuuuaaaaaauaaugaaauaagcacaguggcaauauuauaacuuaucagcuuaucaugcauguuagguccaucuguagcaucugcccaaauuaucaguaauggauaaauaaauauauggauauagaauauaugaauaugcuggagagauggcucagcaguuaagagcauugacugcucuuucagagguccugaguuuaauucccagcaaccacaugguggcucacagccaucuguauuggggagugcccuguuaugaugugucugaagacagcuacaguguacucauauacauuaaauaaauaauucuuuaaaaaauauagauggauauaauuuuggaaauaaagaagaaacuauuuccuuuggggcucuguagaugagcaguagagcuugcucagagcuuacaaugcccuggauuccauucccaccaccaacuuccagaaaacucuagaaaguuuaaaaggaccguuagacauagggcuguauuuuuguucuuguuaauuaacaaauaugaauuauccuuuuguaaguuuaaaggggagguaauuuucaaaacuugcugggacgacgacacaguuuuccuucauuuuaugucuguucuaugucuuuggaucccauguaccaucuguccccaaguuaaacauggcgcaguaggacagugucugugcuuagccacugggacuuacugcuugcuucaacuccagauauuuuuaucaggauuuuuggucaauuucgguuuuaaguuauaaacaaugaccacuuuuugauuaaagaaaugacauuguuaaaaaucuauagauaaauauuaacuuuagccuauaaucccaacacccaggaagcuggggcagaaggauuacaaguuuaagaccugccuaggcuacauacaucagaaaauuccccccagaauccauuagucuugaagcuguagcuucguguucuagguacauaccugggagaagaaaggagccaugucacuccuacaagcaucuccuaaggaccagguguuuuguguuugugucuugcagaucugggacacagccggucaagaacgguuccagucucuugguguggccuucuacagaggugcagauugcuguguucugguguuugaugugacugcccccaacacuuucaaaacccucgacagcuggagagacgaguuucucauccaggccagcccccgggaucccgagaacuucccuuuuguuguguugggaaacaagauugaccuggaaaacagacaaguaagcgccgacugcaguuacgucagagauaggccccgcuccucugggaccugagaguucagagcgcucucuaccaggcucagaauuacgugggaaagaaggugcaggugggcgugcuugucgucccgcggaccccagugguguggggcagccuuuguucucagagccuugguuacccuucuguaacuuaaaggaaggaacugcuuuucucauuuugggguagaaggaggcugugggcuugagucagguugcucugccuuaacucugcacggcacuuguguugaagcauagcuuuguuaauuauagcucagcuuauuucugacaucucuuuccuuuuccagauuuugucuguuguuccuuggcuggggcuggggcaggaaaggucuaaggggugaacacugcaaagugugucgccugccgcuucuagaugagaagaacaggguucauaucagagaugagcuggggaccccaggaucucucuccuuuggcuaagggccacguggucuggcuauggacagagguagcugcaguuugggucccucgugugggcagcagagugagccgaccugcaggucuauaggccacauucuuccuccuucccagauguauucucaccagcguguaauuuuccugauaggaggacugagucauuuucugcuguucaugucacuaguguccuucucccucccauagguggccacaaagagggcacaggcuuggugcuacagcaaaaacaacauuccuuacuucgagaccagugccaaggaggccaucaauguggagcaggccuuccagacaauugcucggaaugcccuuaaacaggugggucucagggcccucaagcugcaugaugcccucuggugaggucucacguucucuccuagaugccucuccccuaccugcaucugggaaaaacuaacgugcuucucuggguggcuaggucaugacagauucugcgucagcuccugugaggucuacggcuuuauuagucaucugaaagacguggggcagagcugggguauggcuugguauagcacacuuacuuaagauacagagcauuucagggcagccugguccuugagcagugagguccagacacagcaaaaccucaggaacagaacagggacauccuugugaaggacgugugaacuugucccuggguugguugguuuucaugugcauuuuagccaaucaggccacuuaggggucucucaucagaucccugaucuuuuuaaugagauaaacuugaaucaugucccagcugcuguugacacauucgugucugagcuugugcgccucauacagaaccaacgccagcuucagagggugugauuacccaacaacucaguaccaggaacuugcuuuuccugggaguagguauguacaugcacaaguaagagauaagaaaacaacaucaaggaacccagagcucccagcuacccucgucugugagacaauagcacugugagcuagggcaggauagaagccuauaauuccaucuauuggagaagccaagucaggauggcaaguucaaggacagcuugggcaacauaguagggcuggagauagauauauauaucaauacagaguuguuugccuagcauauguaagguccugguguuuguuacaguuuggggggagggagguuaaguaaaaaaaguguaggcuugggguccuccaaccagcaggcugucggugccaacucuuaacugcugacgcucaguugccaccuucaaagcagcgucccuuugagccucucauucuaggcucacuacugugaauggccagcauguucucaagagguuuguuggacaucuucguguuucaucuuuucuuuacugguguccuuuugaauucucccuaccaggauaccuuuagaauggggccuuuuacuuccgagucaucuaugguccuuauauaccaacaugugguccuuucugaggaguccucgggagugugcccagagugaucauaugaacucuuggugaacagacauuaccuucaccuacccuccaacaccuccccaccccccaguucuuuuauuugauagccuuuggucauagaaaaaaaaaggccaucuuagcuggguguggugguaucugccuauaauuucagcacuuauagagaggacagcaaguuccaggacagcauagacuacacagaaaaagacaugagaugugcuagagcaugcuaucaucccagcauuugagagguggaggccggaggaucacaaguucaaggccagucucagcaaccauucugggguauaaaagaccuaacaauaaaacgucaucucugugucagauacauuuuaaaggauccuucucccugcuuccagugaaugugagugcugggaagcagccauuguccccuugaaguguguccuuuguuuaaaucauucauguuucucuuccagcacgcacaaacugcccuggccauggcuggguuccuuugucucaguaguucucaaccuugcaaaggcugcaacccaugaauacgguuccucaugugcuagugaccccccaacucuuuauaacuguaauuuugcuaguuaauacauuguaaugugaaugucugauaugugacccccuaagguggucaugauucacauguugagaaucacagcuggaccaucuuuauuucagcaucucuuaaguuuuaugaauacacugucgcugucuucagacacaccaagaagaggguaucagaccccauuacagaugguuguaagccaccauaugguugcugggaauugaacucgugaccucuugaagagcagucagugcucuuaaccacugagccaccucuccagcccuuauuucgacaacuaggguacauccugccaaccuguggcuacccuaacccucucccacccaggccgacagcuuguugaguuuuugguuggaauuguacuggucuagccauaaaaaaauaccacagaucagacagcuuauacagaaaagguuuuauuuuguugucacaguuguacaguaugggacucuccuggccuguacauggcugucuugucuucuugcuauguccacacagggcggcauugcucagagagcagauguguuaacaugcccucuggguugucaguugguaacagauugcuguccuggcaugugugagauccuccaauccaucucuacuaccacauaaaucuagcauaguaauacaugucuuagacucccagcacuagguggaggcaggaagauuuaggaguucaacuacauagcaaguucaaggccagccugggauacauaugagacccugucugaaaaggaaaauugaaguccugugagagcugaugccacagauaaccuugucuaaucugaagacuguagguacaaguagauacauggggguaggugggugugugggggcuucaacauacaaacuugggguugacacccauucucuccaagguugucacucauauucuuugcuuuuuguguuaaauguguauauuaguguugacaugaauauaaauuuauugcuguuuauaauaaccaaaaagucagaacauugcagauguuuacaaacuggugacugucucaguaaguugguccauguacuccagacagcacucugccaacaggagcucggggcaggagcaagucuguaacacagaggucaaaacaaauccaaggccaggcugggcuacagaguaaggcccuggacuaacaaugagaaguguggcccauuggcaggcagaggacuugccuagcauguguggagcccuggcuuccuccugcauuuggagggaaggagagaacaugacugguugcuggggaauaagcagcucacucagcacaggguuuccuuuuggggugaugagcauucugacgugaugguggcccacaccgaaaccaauguguuacaugcacacuuggguguugggcccuaguaaaccucuuaacuguauauuuuuuagcuagugugaauaaaaugaaaauaacacuguuaggaaccuuuuuccccuucuuggguacagugcugugguugggcccuagcgcuugguguguaggcacucagucacuccucaggcgaagaccccagugacucaaguccaugcaacgugggggugacggcaucacgguagcucugccccuucagcugcuauguggaaacaaaggcugggaagaaccagcucccggccagcagcccagaagauugagugggagcaaggcgagcaucccgagaccauggagccuugagcagagcccuagccgacaguuaagaacuggcagugacgugaacccuaugacagaaugacagaaauccagaaccuuagcugugugugguccgcaguggucagaacuugaguuggcacacuucuggcuguggcugcugcugacacuccucacaaauucugccacccuuucauauggguacacagucaggaucugucccugugacuccagucaucaaccucccucccucucucucuccuauccaggaaacagaaguggaacuguacaaugaauucccugaacccaucaaacuggacaagaaugaccgggccaaggccuccgcagaaagcugcaguuguugaaggggcagugagcacagaguccuucacagaccaagaacacacacguaggccuucaauaugcgucccuccuccuccaaacagaccagaacgugagcucucacauccagcugccaaaagaaacuccaccgaacaguuacccaacacacacacauacacaaaacacacucgugcacacaaaaacacauacacacaacacacacacagcaagcaaacuccagccugugccugucagggcuccuggggcagcugcccgccucgugggcccuguguauggcaggcauauggcagagacccugggugcucuggggugcagugggcauggaaagcuuacucuuuuuguccacuggagagugagagaacuguucacaguucaucugugucuaauuaucugauuuuuuuuuuaacggucuuguggucuuuuaccccucccuccuugaagguccugugggaaggcuggugcccaggcuccguucugagcaggcuguuuuguauguaucuguuaaugcuuguuacuuuuaacuaaucagaucuuuuuacaguauccauuuauuauguaaugcuucuuagaaaagaaucuuauaguacauguuaauauaugcaaccaauuaaaauguauaaauuaguguaaggaauuccuggauuguguguuuaaguccucuaacgcaggcgugcaagguggaggguugaacccugucuggauuacagaguguuagagacucaaguuuggaaguccagcuagcggcaguauucuguacaguagacacaagaauuauguacgccuuuuaucacagacuuaagagccaaaaagcuuuucaucucucugaagggaaaacugaacuagacaguucccuucugugucuaaauuuuccaaaagguugauuugcuuaauauaguaguguauacaauggauaaauugcuguuacuucaagaauuaaaauucucauuuucucccuuucuguuuuuuuuccuuauauucaacacuuuaugaugcccuuuugucacuauccuacucaaagaggaaaggagaacccaccagaccugucccagugacucuaccuuuguucuagaaggcgcuccuuucaggguugugguaccuguagguuagcagacccuccuccuuucccacccacccaaguguggcccagcacuaacccaccgucucuuggguugagcccuggcaguucugucccuucccgagguccugcccugcaucauggcuugcuuccuggagcacuuccccuucagaggucuacauucuaggguguaggcugaguucuucuguaaagagacgaacgugaugccaauaaaauuuaacaagaacaaagaacagcugcugucugucuuuuucucuca

SEQ ID NO: 3188 - RNA, 13147 nt, Mus musculus
cgcggccgcgcugacucccgcgggccgaccagccacgccgcucacaccgcugccucccugcugagcccuggccguggccgcccgagggcgccgcccaccgcgccgcagucgguaaguuccugcacucggcccgcgccgucccgagccucccggucucaggcugggccucccaaaaacccgaucgcacgauccuucuaguggcucaaacccaggucauccggaaacccaaaggcccgccugggggcuccugccuuccguuuuuccggagcucuggaccuggagacccggcuuuccagagcuuugcgacgcgccccccucccaccccagagcuggggccuuugucuccgcgguuccccacccgcggguagcggcagcggaugcgcccaagccgggcugcccaggcucuggcugcaccugccggcuagucccgugcaccggcuuugcgcggcuuaacccggcucgcuccugcuugugccccccgcucgaagagccccgcggcccuuuauccuguguggcgagggugcaggugggggagagcguaggguauggaagucuuuccaugcccaagucggagucggaaucuuuucagugggauuucaauaagaacgaggccgacgcaggcuaggggauccgccgugcauaggcguagacggcgcucugggccugucuggacgcugggcauugaaccauucgguggcggccgggcucgaauuugagcuuaucccagcggugaggggaaaggucuuguauucagaaggaccucccgaguggcaucuucuccuuuaccagaaaacagggaaagaaauucguuuguuuuugaaaaaaacuugccucccaaggucgggaacauuuggggggugaguucugggucuacacugugguucaaaucgagauucguugauaagcaggcaggauccaggaaccagguagagccaaagugucugccaggcgucuggagagcguuccccagccggguugacaaauugcaagcaaauugcaucuaacgaaaugcauuuagcaguugucaagucgcugacccccaggccucugaguaaagcauagcuguuggcaaggagggacagccccccccccgucugcugaugggguauggaggcuagaaguuaaccagaaauugcagagcccuaggcaccuggcaccagcgggccagacaccugggacauugggucccaguccguggauuuccaaaagacucagaauaaaauggcagaugcuaagccuucugauuuugaggcgcuggaagcgaauuccaaagagcaaggagcaccguuuagaggcccucugaauugaugggugcuuccagggacauaucugaguccuucaccuagaggagacccugaccaguaauggacaaagcuccuccacuuucuucccagugucccucaaaccuugugaccacggauguugggcuggaggccuccggguugugaacgacuucuuuuuggaaggcagcccuaagcuagccgaccacuuagcugcccuuaggaaaaaggagagaauuagugugcaaggagaggguaacccugugauccuagaggauggcuuggaggagcgaaguuuaaacaaagggcaaguggggggggggggacagcgugaacugggggcucccaauaauuccaccccuuuccagaaugguuugcaggagccgggccacacccagaacagggccuggaucccagaacccagcucccacacaggagcaccccuugcacuguccccucucuguaaacacuuccaguucucucucucucacacacacacagacaggcacaaauggugguuagaaauuuucguuugggagccaagcucccucuggucuccguggaaggaaaaggacaauuuaguucagagaagagcucuggguaugcuccaaaaugaacaacaacaacaacaacaacaaaacauuuaaaaggcaaguguccaccugaagguaucuuaggaaccucagagugggcguuuguaaguugaaauaaaucugcuuucguugggggggggcggugggguuggggaaaaucgaaucuaagccaucuugggaacugacucggaccucccuguuguuuguuuggacuuuuuaguggugguucauuuuuggccuaguaguggcuucuuggcuuuguggaucuaccugauucacacacguucaucagcaucagcacaggcuccccucuauucgccaacucagugcucugcuauccuagccugcaauuuucccuuucagacggguuaguuccugcuggaaaacccagcagacccgcaucagacgcagggacuccaaccucagcaggggcucggcccagcuggcugguugcuugcaguuuccagaaggcaaccuuggguccucaaaggaccuggcaggaccacccuccuccucucccaugcccagucugugggcaggcuaggcuguugcgggucuccugaggcccaggcucaagcauagcuuaaccacccgguuaagcccuuguugcauggcgauuuucugagcugccgaacggaguaauuaaaucccccucuguacuccgcucugcgccagcaccgugagaaaccccgggcucucguuucgagugggaacccaccaagcuuggccauuuucaccucuaugacaggcaggacgcugcccgguccgcaauguggcauggaaaagacaacccccaucucguucaaacagggagauaauuuuaauugcgacuuugggagaaaagagggaaauuaccugcuccgggcgagggggaggguaucugcucggagacccccgccuugacagccgccgcgccgacucggucagggcaguuuccucugcgcaccgcguucuccuccuagaacucugcagggccauggaauucggccgcaugggguaccguugucgaaaaugggguuaucgccggcuuugagaggccuuuagaaucuccugcuagguuccagggacauagaacaaucuggaaacuccacgacgauuucgccuugcucguuaauggagaaucaugggcuaaaggcugggagaagccgagaaagccuucccgaaagcggguccuaagugaaccgcgcagugggagcgcgaaucuggcuggcacugagaccacccaccugcccagccgaccccgaggcacugcggucucgcgccccucuagccccuggaucccucuugcuagaccucccgccucggcugggcgcggacucccgagccuccugggccccugauggcucuggagcacagaggcgcggggaauacagcggacagcaggacccccccccccccgcgccagggagcaagaggcgcggguuuccgguccaguggaguucugcaccccgggccccaggccuuuaccuguuccagggccucggacagacagauggacgccagccgcagaggccagaggaggcccugccgugcgcgcgcccccucagcgcuguccgcagaggaccugggagggggugacgggggcgcgcccgagaagcugagcccuccuggcugggcgccccccgagccgaggggaccgagggcuuuccacccuccuuggauuauuaaaaaguucauuuccuggcgaaucgggugacgucaggggcccggcgucgcgguggcggggccgccgggccggagaagccgccuccaguuacccaauuacggacugucaauccugccgccccucccccauccuugggggcggcggggaccccagccuuuccccagcucgggaccaaccugggacuccucuggaauuauucuuuagggguuucggucccugcaaagauagaggagcuauguggagggcuccaagcuuggccaauccaucgcaccugucuagauuccccuaaaagucuuggacucacaagcuucuuucuggacucuuggaguuuaggucucccaucuauagccagggagggagcuagguuuguauacucgccacugaacucacuugucucuccagaauggagguguuguggagaaaaacuccaggugacuuuggggaaaaagugcucacaacauugcuucccucucccuaaagaccgucucggggacccuuagaaagaaaaaauauauaugguuaauaccccgggagucucccuucagccgacucuggcgccaguuucccgcuccacggccucgccccaggcaguucagccugguggucuacuaaggccccgcccggagcccuucccccucccugggccacuggcuugaccgcgaccauuauuggucuagcacagccucaagugucuuagugcucaaaguucgggugcccuagagaaguccacaaucccuagacucauguuguccagcggauccuaccagccucuugcacagcuaucccugauagaaggacagagaguuuggggagucaguuggauuugggcuggccgucguccguagcaguggagguggggcuccgcccgagaguagaaagcuguggucccagcagagagauacccagaaggugcacgucucggcuccugggaagucagggacccuauucgugccuaguugcugggagggcagagguuggaagaccugagcgucugccggaggggugcagggucugcccacggcgaagguccccuggggggggggggcguuggcaucagaggccgcagagagggcgcugguagggggccaggcagccuaggaggccagcuugcgggucauucccgaaguccagcggccaaagcggcgggagcagccaaugggggggcggaggcugggcggcgcgcggcgcugauuggcuggcgccggcuucauaggcgugcgcggcccccgcuucacgucugugcaggagucggcagcuggcgccagggcggccggaggaugcagaggggccggagccgggcgggccggaggccgagacgcgcgcugucccccaccccuaucccgugaauccgccggcccuggaacgcgcugucgcugggcccgccguacccgggcucuccuggugucucuuacucucuacugcugagcccuccccuucccgcgccgcugcgaguguaaguuugagguucagggggcuuguggacauuccuagguuggagggaucucuguggagcucagaccaggaucuccugugggcgauuacguucuuaugcuuuggggagagguuggcugacugcuagagagugcauuggggaccggcucgcagccccaggaacugcgggugcguuuuuugggguggcccgggguguuggggguuaguuuguguauauauugucaaaguguuacgggggcgugggagagcgugugccccagaguggaugucuaggcaacugucucuaacuuuuagucagaguuuauguguuugugugcccagaggacaggggcacggugugagaaccugauuucaguuccgcgugcguuuugggggggucaccgaugucaggaccuauccgugugugugaccucguguauguggaguugcgucugugggaacgcgaguuucccugcaaguguaugaggcugaaccccuuccuucaccuuccuuucguuuuaaaccuugcgcuuuccuuccacccgggacugguccucagugaagcuccgauggaacgucuuugcucucaagacacagacuuugggaaugggggugucagaaggcggcaguguccuucacauucccucuguuauccagggccgccccaccuucgccugguucccaagacacaguaguggaccauggagguggcgccugagcagccucgcuggauggcgcaccccgccguauugaaugcgcagcaccccgacucgcaccauccgggccuggcgcauaacuacauggagccagcacagcugcugccucccgacgagguggaugucuucuucaaccaucucgacucgcagggcaacccuuacuacgccaacccggcccacgcgcgcgcgcgcguuuccuacagcccggcgcauggugagcuuuggcccccgagguuucuggaagccuggcgcccgggccaggccuuggaggggggacggccuguugcugcuucccggaugugggauccacaggaaucugagcagcugcgaaaucgggccuaagaagauggaggcagggacuucuuagggagggucugggaccuguaggguuucgguccauuuccaagugucuuggcgggggugggggugggggaauccuucugggcccuguccgguggggcugcugugucacuuguccuucggccuuucacugacauugcugaugauuacaggcugagguguuacguuucugauguuuuaaaggguggggcugcugaugguaguucgcugaguugugauccugugugcccgggucauggcucugaagccccuggucauccucacccccuuucccucugcacagcccgucucaccggaggccagaugugccgaccacacuuguugcacagcccaggcuugccguggcuggacgggggcaaagcagcucucucugccgccgcugcccaucaccacagucccuggaccgucagcccguucuccaagaccccgcugcaccccucagcugcuggagcacccggagggccucugucuguuuacccaggggcugcgggugggagcgggggaggcagugggagcuccguggccucccucacccccacugcagcccacucgggcucccaucucuucggcuucccacccacgccacccaaagaagugucuccagaccccagcacaacaggagcugcuuccccggccucuucuucugcaggggguaguguagcccggggugaggacaaggauggcgucaaguaccaagugucacucuccgagagcaugaagauggaaggcggcaguccccugcgcccgggccuagcuaccaugggcacccagccugcaacacaccacccgauacccaccuaucccuccuaugugcccgccgcagcucaugacuauggcagcagucucuuccauccaggaggcuuccuggguggccccgccuccagcuucaccccuaagcagagaagcaaggcucgcuccugcucagguaaaggcaggugugggacuucagggccuguggguguggugugccucuguaaaagggguccguggucugauagaggggccaugcuagggcgccugauuuaagaaugggugguggucaucucugauaguccacaggcauuugaaguucccuguggggaggaagaaaccccuaaaacuuucauccugccguuaagugcuccuaggaacccccauguucagcuccucuccgcaccccuccucauggccuccucuccaagguugacaaguaucagcuaaaacacagaaugagguucccugucucccuccccaaacguucagcugagaccgagcagccucgugacugggcgugggggagaauggaggcuguaggugagggaaggagucaguguguacuuauguguacgugugucugugagcgugugugcaugccgugggcacugcagagaucuaggcccuagaggaaucugguucuccaacucugcuaguccaguuuuaggauugcagcggcuccagaucuccuuggagauuuccccaaagcaaaauucccaaggccugcuugcauccuagugacccugaucccucucccuggggguaggagugagaaccugugcgggugccugcaccccuuugccagcugcagcuggauccagcuagguuuguccagccauauggcccucaggcaauaacccguggcuccgaggcuccuucccauagcuuuuagcaagggaggggggaaggcuuccuccaaaguuuauuucugaguugaagaaccaacuucucauaggugacuuaguuccaacuagaucaggaagaauuuccaugguacugagcuacuaagcccucgcuccgcugaacuccagccccaacuugacucuugucuccugcucuacuaagaccagagacuuugcccuuuuuugcaaagucuuggccuguuuguagcccucucuuccguguuuguuuuguauucuauuuaagcuccagauggccaaaaacaacaacagaaaauaaggccaccuagccuaaagugaaagaacuuauuuauuucauuuuagaaacaacuuugaucauugaauucuaggaguuuggcugaaagggagcccaacuggaggaagagaaaagguuuccuggccuuagccggagcauaaagacagcgaggggcugaugggagagaugagaaaaagacuuagagaugcuggcucaguugggcaaagugauagagcagcagagaggcucccccagaccccaauccuggacaacuguggccugagcugagcgagggacaguagccugugcucuguaaaaccggccuucaguuccuuuuccggguaacuugcugcuggcucugagaaccccuggcagccugcauuugcuguuucucuuugcucuuccucagcaacaucagaaaugagaauuuauccuuaaaagacccuggacuucuuuuaaggggacuccuugagucccucuuucugccaggggugggucucccuuaauacaaccuugauccucuggcucuguguagaggcuaagcaggccuugugucuuuccuuguucccuuacagaaggccgggagugugucaacuguggugccacagccaccccucucuggcgacgagauggcacgggccacuaccugugcaaugccugugggcucuaccacaagaugaauggacagaaccggccgcucaucaagcccaagcggaggcugguaagaaagggcacaucauggggcagggcagggccacgguggccaguggcaaucugggcagagcggguuaguuaagugaagaaaaaaaaacaaaacagagagggggaaaaaaaacgaaaacaauccaacagcaaaccuucaaaugcagacacuucaccaccugaaauccucuuaucagucaaaucauuuggggggucagucaggucggucuucguucuggcggauucuuuccugccaaauuuccuguccugcagccucccuggcaccccccuccccccgcagcuaccgggcacccccuccucuggacacccccccaccccaccccccgcugaaggauucccagagcccauggucuagcagcccacccucaggcucuggucucuuauucgcucuuuuuaaaaauagggccaugaaguacuuuucccuauggcugcucuggccgcccucccucgccucccagcucccggucuccuccgcuuauuuaaauaacacacagcggccaccaaaaaaaccugcccuuuauuauuuuuccauggagucaccuauacuguguauuuucauuugagugauuuuuuaaaaaaauguccuuucggaucuccugccggaguuuccuauccggacaucugcagccgguagauaaggaaacuucguguaucuguuuccggaccggcaaguuuucagagccaccucgacucaguccugccucuugcugggcuguuuugaaauuucuaauacccuccacucugcaaauaauguguaaaaugcuaagaauaauaaauauauuuuuucagggcgaagugauuuaugaguuuaaaucguucacccgcuuuggggcccuuuuucuuuuuuuuucucucccccccacccagcagugugagggcggugcaggcugguggggguggaaggaggauaugcugcuggccccugagucagaauuccagcuucagccugcuuacucacccucccugcccccgcgggcaggccagcucugguccccuccaugagcaggcucaagcccggggccucucuggacucggcuggacucggcccccuccccacacuggcugccgagggaguucagugcuaggaguugcuggguggagguggggugugaggggaagaacacacaggaguagcgcucuguuuaccugaggcagaagggauggcagggggugaucuguauucuaggaaaagccccccucccucuuccucccuccccacauuucaguccuucuagagaccaggccuccccucuuccacgccucaccucuggcuggcauuuccugggggacugggacgaggggcuugguaaaagcagcaggugagcgcucucagggcauacggcucuaggccggcaggaauggaagcgccuuugcuccaauagucuuuuugaagccucuggcuaguaugacuauugauugcuaggaaugcuguuagugcaguaaaaggcacugaguguuuagauuuuaaacuguaguuaaauucaauuuaaaucucuccuggcgacuccuagauccuauauaggacaaagcaagaacacacuuuaauccugggcuccaacuuccucagggcuuucuggguucuccugggcagugcagggucuuguugccuuggccucccagccaugacucaccaggauucuggauuuccaggggaacagugggggaggaggcaugcaacuggagacagcaacucaggauggucacaggacuaaagucuccgugggaccuguuuccuuaccugugaaauuagacugcugggcgguuaggggaaguggugcuuuucccuucugugucgacaauccuuuagguucuaagaacucuuuauuccaaaguucugugauucccaacuaguuuccaucucaaauucuaaaauuccucgguuugagaugcuuugauuccccgguaggaccuaucgcuccaggcucggcgguggggcugggaguggugcuaagggcccaggaggaggucaagguggggcgugggagacagccucugacgcuaccccuccccuccuagucugcugccagaagagcgggcaccuguugugcaaauugucagacgacaaccaccaccuuauggcgccggaacgccaacggggacccugugugcaacgccuguggccucuacuacaagcugcacaaugugagugcaccccaccccuccccggggaccucagcucuuugugcugccuggccagccagcggccccagccacaaucuccagcuuggcuuggcuuggguagccgcagccgacagcccagagugccagaaggacgauaccucuguuucggaggugggaccgaugggggcagggcaggcagggaccggguaccugugauaggagaaguuggggacagggaaggguuagagguguuggaggacgcaggcugugcaggcauuuagugaucugggaacaaccauguggacuguuagaccauucacucuuucuugaaaagaugacagugagggcuuaagggggcuuuggugagucacauugggucugggcugaagguacaguuccugucacccuggggauacaauuaacucagccugccucgaccuguggagagaguuuggagggauuugugugggaggcaacuucuccuaagggcuccguggcuguccccagguuaacaggccacugaccaugaagaaggaagggauccagacccggaaucggaagauguccagcaaauccaagaagagcaagaaaggggcugaauguuucgaggagcucuccaagugcaugcaagagaagucaccgcccuucagugcggcugcccuggcuggacacauggcaccugugggacaccucccaccuuuuagucacucuggacacauccuacccacgcccacgccuauccacccuuccuccagucucucuuuuggccacccccacccguccagcauggugacugccaugggcuaggcaagccucccacuggacagacauggacaucaagggugguuuggcagaaccagagcgaggcugggcacucccaggauggguggaacauacucuuggcucccgcccaucccaagagacccacuuccuccugccagccuagccuggccgaagccaccucuccuuggaggacucccagccuugugccgccauuacugugaauauuucuaacugggcugcagcucgcgugugcccggggugcugcccagaaaaguguuuucacggagaguguuuguuuggagagcaaaauggacagguuuacagauuuauagcaagaagagacuggggauagaaaaaugaaaccuuuuuuuuucuuuuucuuuuuuucuucuucuguuuuauuuuuuugauggagaaaggaguaggcaagaagaaaaauaauuuauuuugcucuuauuucuuacaagaacgugaagacauggaggcgugugcuauuuguguucuugggguccuucuuugggaccuccugccaccagucagggcucucgggggcagacuuagagguccucagccugagccuccuucaccccagccugccugcaggguagccccugcccugacgcagcccuagagggcagagacaauugcaggcgguccugcgcagauucccaggccagggcugggucacaggaaggaaacauucucuggaaaggggaaacgucucccagaucauuccccuggcuuccagaggccaaagcuggugugacccaaaugggccagagcugcagccugugcucuaggccagucggaccccuguaaauacaaccuucuuuucugcuaaacccucggcccccucccccucuaagauaaauaagaaaauacucaaagcgaaaaccaaacugcauaagcuuaacccgcugaugagugguuuuauuuugaaacucguuuuuuggguccagucaauuguacguugccacagaagccccgcuauggaaaaaaauaaauaaaaccuacaaaccaggccugagcuucacaguccuuugagugguucuugggucccacagcccuggcagggggcucgggacaagggggaaucuuaugcucuugguuucugggagacagggggcaggcaggcaguggcccugugaucccaggcuucuguucugcuguggcuggcugaauccuucaagguacaguuguacauaaaaagugucccaagcuucgauucuguguguggugguggcaguggugcagcagccagcaagggggccccgagugagcccagggagacgauugugcugagucaaccaagugcaauaucgguguccaguugcugcagagcacccuaaccggaaguaacuuauuuugugcuaguacccgcauaagagaagaaucggcaguauuuucuguuuuuauguuuugggcuuguuuuauuuugaauuagugaccuaaguuauuguuaacuguguacaacauuuaaauauugucuguaaaaauuguaugcuacccucuuauuccuuuaaagugaauacuguuaaaaauaauaaaauacuuuuugugaaugcu

SEQ ID NO: 3189 - RNA, 13147 nt, Mus musculus
agcauucacaaaaaguauuuuauuauuuuuaacaguauucacuuuaaaggaauaagaggguagcauacaauuuuuacagacaauauuuaaauguuguacacaguuaacaauaacuuaggucacuaauucaaaauaaaacaagcccaaaacauaaaaacagaaaauacugccgauucuucucuuaugcggguacuagcacaaaauaaguuacuuccgguuagggugcucugcagcaacuggacaccgauauugcacuugguugacucagcacaaucgucucccugggcucacucggggcccccuugcuggcugcugcaccacugccaccaccacacacagaaucgaagcuugggacacuuuuuauguacaacuguaccuugaaggauucagccagccacagcagaacagaagccugggaucacagggccacugccugccugcccccugucucccagaaaccaagagcauaagauucccccuugucccgagcccccugccagggcugugggacccaagaaccacucaaaggacugugaagcucaggccugguuuguagguuuuauuuauuuuuuuccauagcggggcuucuguggcaacguacaauugacuggacccaaaaaacgaguuucaaaauaaaaccacucaucagcggguuaagcuuaugcaguuugguuuucgcuuugaguauuuucuuauuuaucuuagagggggagggggccgaggguuuagcagaaaagaagguuguauuuacagggguccgacuggccuagagcacaggcugcagcucuggcccauuugggucacaccagcuuuggccucuggaagccaggggaaugaucugggagacguuuccccuuuccagagaauguuuccuuccugugacccagcccuggccugggaaucugcgcaggaccgccugcaauugucucugcccucuagggcugcgucagggcaggggcuacccugcaggcaggcuggggugaaggaggcucaggcugaggaccucuaagucugcccccgagagcccugacugguggcaggaggucccaaagaaggaccccaagaacacaaauagcacacgccuccaugucuucacguucuuguaagaaauaagagcaaaauaaauuauuuuucuucuugccuacuccuuucuccaucaaaaaaauaaaacagaagaagaaaaaaagaaaaagaaaaaaaaagguuucauuuuucuauccccagucucuucuugcuauaaaucuguaaaccuguccauuuugcucuccaaacaaacacucuccgugaaaacacuuuucugggcagcaccccgggcacacgcgagcugcagcccaguuagaaauauucacaguaauggcggcacaaggcugggaguccuccaaggagagguggcuucggccaggcuaggcuggcaggaggaagugggucucuugggaugggcgggagccaagaguauguuccacccauccugggagugcccagccucgcucugguucugccaaaccacccuugauguccaugucuguccagugggaggcuugccuagcccauggcagucaccaugcuggacggguggggguggccaaaagagagacuggaggaaggguggauaggcgugggcguggguaggauguguccagagugacuaaaaggugggaggugucccacaggugccauguguccagccagggcagccgcacugaagggcggugacuucucuugcaugcacuuggagagcuccucgaaacauucagccccuuucuugcucuucuuggauuugcuggacaucuuccgauuccgggucuggaucccuuccuucuucauggucaguggccuguuaaccuggggacagccacggagcccuuaggagaaguugccucccacacaaaucccuccaaacucucuccacaggucgaggcaggcugaguuaauuguauccccagggugacaggaacuguaccuucagcccagacccaaugugacucaccaaagcccccuuaagcccucacugucaucuuuucaagaaagagugaauggucuaacaguccacaugguuguucccagaucacuaaaugccugcacagccugcguccuccaacaccucuaacccuucccuguccccaacuucuccuaucacagguacccggucccugccugcccugcccccaucggucccaccuccgaaacagagguaucguccuucuggcacucugggcugucggcugcggcuacccaagccaagccaagcuggagauuguggcuggggccgcuggcuggccaggcagcacaaagagcugagguccccggggagggguggggugcacucacauugugcagcuuguaguagaggccacaggcguugcacacaggguccccguuggcguuccggcgccauaagguggugguugucgucugacaauuugcacaacaggugcccgcucuucuggcagcagacuaggaggggagggguagcgucagaggcugucucccacgccccaccuugaccuccuccugggcccuuagcaccacucccagccccaccgccgagccuggagcgauagguccuaccggggaaucaaagcaucucaaaccgaggaauuuuagaauuugagauggaaacuaguugggaaucacagaacuuuggaauaaagaguucuuagaaccuaaaggauugucgacacagaagggaaaagcaccacuuccccuaaccgcccagcagucuaauuucacagguaaggaaacaggucccacggagacuuuaguccugugaccauccugaguugcugucuccaguugcaugccuccucccccacuguuccccuggaaauccagaauccuggugagucauggcugggaggccaaggcaacaagacccugcacugcccaggagaacccagaaagcccugaggaaguuggagcccaggauuaaaguguguucuugcuuuguccuauauaggaucuaggagucgccaggagagauuuaaauugaauuuaacuacaguuuaaaaucuaaacacucagugccuuuuacugcacuaacagcauuccuagcaaucaauagucauacuagccagaggcuucaaaaagacuauuggagcaaaggcgcuuccauuccugccggccuagagccguaugcccugagagcgcucaccugcugcuuuuaccaagccccucgucccagucccccaggaaaugccagccagaggugaggcguggaagaggggaggccuggucucuagaaggacugaaauguggggagggaggaagagggaggggggcuuuuccuagaauacagaucacccccugccaucccuucugccucagguaaacagagcgcuacuccuguguguucuuccccucacaccccaccuccacccagcaacuccuagcacugaacucccucggcagccaguguggggagggggccgaguccagccgaguccagagaggccccgggcuugagccugcucauggaggggaccagagcuggccugcccgcgggggcagggagggugaguaagcaggcugaagcuggaauucugacucaggggccagcagcauauccuccuuccacccccaccagccugcaccgcccucacacugcugggugggggggagagaaaaaaaaagaaaaagggccccaaagcgggugaacgauuuaaacucauaaaucacuucgcccugaaaaaauauauuuauuauucuuagcauuuuacacauuauuugcagaguggaggguauuagaaauuucaaaacagcccagcaagaggcaggacugagucgagguggcucugaaaacuugccgguccggaaacagauacacgaaguuuccuuaucuaccggcugcagauguccggauaggaaacuccggcaggagauccgaaaggacauuuuuuuaaaaaaucacucaaaugaaaauacacaguauaggugacuccauggaaaaauaauaaagggcagguuuuuuugguggccgcuguguguuauuuaaauaagcggaggagaccgggagcugggaggcgagggagggcggccagagcagccauagggaaaaguacuucauggcccuauuuuuaaaaagagcgaauaagagaccagagccugagggugggcugcuagaccaugggcucugggaauccuucagcggggggugggguggggggguguccagaggagggggugcccgguagcugcggggggaggggggugccagggaggcugcaggacaggaaauuuggcaggaaagaauccgccagaacgaagaccgaccugacugaccccccaaaugauuugacugauaagaggauuucagguggugaagugucugcauuugaagguuugcuguuggauuguuuucguuuuuuuucccccucucuguuuuguuuuuuuuucuucacuuaacuaacccgcucugcccagauugccacuggccaccguggcccugcccugccccaugaugugcccuuucuuaccagccuccgcuugggcuugaugagcggccgguucuguccauucaucuugugguagagcccacaggcauugcacagguaguggcccgugccaucucgucgccagagagggguggcuguggcaccacaguugacacacucccggccuucuguaagggaacaaggaaagacacaaggccugcuuagccucuacacagagccagaggaucaagguuguauuaagggagacccaccccuggcagaaagagggacucaaggaguccccuuaaaagaaguccagggucuuuuaaggauaaauucucauuucugauguugcugaggaagagcaaagagaaacagcaaaugcaggcugccagggguucucagagccagcagcaaguuacccggaaaaggaacugaaggccgguuuuacagagcacaggcuacugucccucgcucagcucaggccacaguuguccaggauuggggucugggggagccucucugcugcucuaucacuuugcccaacugagccagcaucucuaagucuuuuucucaucucucccaucagccccucgcugucuuuaugcuccggcuaaggccaggaaaccuuuucucuuccuccaguugggcucccuuucagccaaacuccuagaauucaaugaucaaaguuguuucuaaaaugaaauaaauaaguucuuucacuuuaggcuagguggccuuauuuucuguuguuguuuuuggccaucuggagcuuaaauagaauacaaaacaaacacggaagagagggcuacaaacaggccaagacuuugcaaaaaagggcaaagucucuggucuuaguagagcaggagacaagagucaaguuggggcuggaguucagcggagcgagggcuuaguagcucaguaccauggaaauucuuccugaucuaguuggaacuaagucaccuaugagaaguugguucuucaacucagaaauaaacuuuggaggaagccuuccccccucccuugcuaaaagcuaugggaaggagccucggagccacggguuauugccugagggccauauggcuggacaaaccuagcuggauccagcugcagcuggcaaaggggugcaggcacccgcacagguucucacuccuacccccagggagagggaucagggucacuaggaugcaagcaggccuugggaauuuugcuuuggggaaaucuccaaggagaucuggagccgcugcaauccuaaaacuggacuagcagaguuggagaaccagauuccucuagggccuagaucucugcagugcccacggcaugcacacacgcucacagacacacguacacauaaguacacacugacuccuucccucaccuacagccuccauucucccccacgcccagucacgaggcugcucggucucagcugaacguuuggggagggagacagggaaccucauucuguguuuuagcugauacuugucaaccuuggagaggaggccaugaggaggggugcggagaggagcugaacauggggguuccuaggagcacuuaacggcaggaugaaaguuuuagggguuucuuccuccccacagggaacuucaaaugccuguggacuaucagagaugaccaccacccauucuuaaaucaggcgcccuagcauggccccucuaucagaccacggaccccuuuuacagaggcacaccacacccacaggcccugaagucccacaccugccuuuaccugagcaggagcgagccuugcuucucugcuuaggggugaagcuggaggcggggccacccaggaagccuccuggauggaagagacugcugccauagucaugagcugcggcgggcacauaggagggauagguggguaucgggugguguguugcaggcugggugcccaugguagcuaggcccgggcgcaggggacugccgccuuccaucuucaugcucucggagagugacacuugguacuugacgccauccuuguccucaccccgggcuacacuacccccugcagaagaagaggccggggaagcagcuccuguugugcuggggucuggagacacuucuuuggguggcgugggugggaagccgaagagaugggagcccgagugggcugcagugggggugagggaggccacggagcucccacugccucccccgcucccacccgcagccccuggguaaacagacagaggcccuccgggugcuccagcagcugaggggugcagcggggucuuggagaacgggcugacgguccagggacuguggugaugggcagcggcggcagagagagcugcuuugcccccguccagccacggcaagccugggcugugcaacaaguguggucggcacaucuggccuccggugagacgggcugugcagagggaaagggggugaggaugaccaggggcuucagagccaugacccgggcacacaggaucacaacucagcgaacuaccaucagcagccccacccuuuaaaacaucagaaacguaacaccucagccuguaaucaucagcaaugucagugaaaggccgaaggacaagugacacagcagccccaccggacagggcccagaaggauucccccacccccacccccgccaagacacuuggaaauggaccgaaacccuacaggucccagacccucccuaagaagucccugccuccaucuucuuaggcccgauuucgcagcugcucagauuccuguggaucccacauccgggaagcagcaacaggccguccccccuccaaggccuggcccgggcgccaggcuuccagaaaccucgggggccaaagcucaccaugcgccgggcuguaggaaacgcgcgcgcgcgcgugggccggguuggcguaguaaggguugcccugcgagucgagaugguugaagaagacauccaccucgucgggaggcagcagcugugcuggcuccauguaguuaugcgccaggcccggauggugcgagucggggugcugcgcauucaauacggcggggugcgccauccagcgaggcugcucaggcgccaccuccaugguccacuacugugucuugggaaccaggcgaagguggggcggcccuggauaacagagggaaugugaaggacacugccgccuucugacacccccauucccaaagucugugucuugagagcaaagacguuccaucggagcuucacugaggaccagucccggguggaaggaaagcgcaagguuuaaaacgaaaggaaggugaaggaagggguucagccucauacacuugcagggaaacucgcguucccacagacgcaacuccacauacacgaggucacacacacggauagguccugacaucggugacccccccaaaacgcacgcggaacugaaaucagguucucacaccgugccccuguccucugggcacacaaacacauaaacucugacuaaaaguuagagacaguugccuagacauccacucuggggcacacgcucucccacgcccccguaacacuuugacaauauauacacaaacuaacccccaacaccccgggccaccccaaaaaacgcacccgcaguuccuggggcugcgagccgguccccaaugcacucucuagcagucagccaaccucuccccaaagcauaagaacguaaucgcccacaggagauccuggucugagcuccacagagaucccuccaaccuaggaauguccacaagcccccugaaccucaaacuuacacucgcagcggcgcgggaaggggagggcucagcaguagagaguaagagacaccaggagagcccggguacggcgggcccagcgacagcgcguuccagggccggcggauucacgggauaggggugggggacagcgcgcgucucggccuccggcccgcccggcuccggccccucugcauccuccggccgcccuggcgccagcugccgacuccugcacagacgugaagcgggggccgcgcacgccuaugaagccggcgccagccaaucagcgccgcgcgccgcccagccuccgcccccccauuggcugcucccgccgcuuuggccgcuggacuucgggaaugacccgcaagcuggccuccuaggcugccuggcccccuaccagcgcccucucugcggccucugaugccaacgccccccccccccaggggaccuucgccgugggcagacccugcaccccuccggcagacgcucaggucuuccaaccucugcccucccagcaacuaggcacgaauagggucccugacuucccaggagccgagacgugcaccuucuggguaucucucugcugggaccacagcuuucuacucucgggcggagccccaccuccacugcuacggacgacggccagcccaaauccaacugacuccccaaacucucuguccuucuaucagggauagcugugcaagaggcugguaggauccgcuggacaacaugagucuagggauuguggacuucucuagggcacccgaacuuugagcacuaagacacuugaggcugugcuagaccaauaauggucgcggucaagccaguggcccagggagggggaagggcuccgggcggggccuuaguagaccaccaggcugaacugccuggggcgaggccguggagcgggaaacuggcgccagagucggcugaagggagacucccgggguauuaaccauauauauuuuuucuuucuaaggguccccgagacggucuuuagggagagggaagcaauguugugagcacuuuuuccccaaagucaccuggaguuuuucuccacaacaccuccauucuggagagacaagugaguucaguggcgaguauacaaaccuagcucccucccuggcuauagaugggagaccuaaacuccaagaguccagaaagaagcuugugaguccaagacuuuuaggggaaucuagacaggugcgauggauuggccaagcuuggagcccuccacauagcuccucuaucuuugcagggaccgaaaccccuaaagaauaauuccagaggagucccagguuggucccgagcuggggaaaggcugggguccccgccgcccccaaggaugggggaggggcggcaggauugacaguccguaauuggguaacuggaggcggcuucuccggcccggcggccccgccaccgcgacgccgggccccugacgucacccgauucgccaggaaaugaacuuuuuaauaauccaaggaggguggaaagcccucgguccccucggcucggggggcgcccagccaggagggcucagcuucucgggcgcgcccccgucacccccucccagguccucugcggacagcgcugagggggcgcgcgcacggcagggccuccucuggccucugcggcuggcguccaucugucuguccgaggcccuggaacagguaaaggccuggggcccggggugcagaacuccacuggaccggaaacccgcgccucuugcucccuggcgcggggggggggggguccugcuguccgcuguauuccccgcgccucugugcuccagagccaucaggggcccaggaggcucgggaguccgcgcccagccgaggcgggaggucuagcaagagggauccaggggcuagaggggcgcgagaccgcagugccucggggucggcugggcagguggguggucucagugccagccagauucgcgcucccacugcgcgguucacuuaggacccgcuuucgggaaggcuuucucggcuucucccagccuuuagcccaugauucuccauuaacgagcaaggcgaaaucgucguggaguuuccagauuguucuaugucccuggaaccuagcaggagauucuaaaggccucucaaagccggcgauaaccccauuuucgacaacgguaccccaugcggccgaauuccauggcccugcagaguucuaggaggagaacgcggugcgcagaggaaacugcccugaccgagucggcgcggcggcugucaaggcgggggucuccgagcagauacccucccccucgcccggagcagguaauuucccucuuuucucccaaagucgcaauuaaaauuaucucccuguuugaacgagauggggguugucuuuuccaugccacauugcggaccgggcagcguccugccugucauagaggugaaaauggccaagcuugguggguucccacucgaaacgagagcccgggguuucucacggugcuggcgcagagcggaguacagagggggauuuaauuacuccguucggcagcucagaaaaucgccaugcaacaagggcuuaaccgggugguuaagcuaugcuugagccugggccucaggagacccgcaacagccuagccugcccacagacugggcaugggagaggaggagggugguccugccagguccuuugaggacccaagguugccuucuggaaacugcaagcaaccagccagcugggccgagccccugcugagguuggagucccugcgucugaugcgggucugcuggguuuuccagcaggaacuaacccgucugaaagggaaaauugcaggcuaggauagcagagcacugaguuggcgaauagaggggagccugugcugaugcugaugaacgugugugaaucagguagauccacaaagccaagaagccacuacuaggccaaaaaugaaccaccacuaaaaaguccaaacaaacaacagggagguccgagucaguucccaagauggcuuagauucgauuuuccccaaccccaccgcccccccccaacgaaagcagauuuauuucaacuuacaaacgcccacucugagguuccuaagauaccuucagguggacacuugccuuuuaaauguuuuguuguuguuguuguuguuguucauuuuggagcauacccagagcucuucucugaacuaaauuguccuuuuccuuccacggagaccagagggagcuuggcucccaaacgaaaauuucuaaccaccauuugugccugucugugugugugugagagagagagaacuggaaguguuuacagagaggggacagugcaaggggugcuccugugugggagcuggguucugggauccaggcccuguucuggguguggcccggcuccugcaaaccauucuggaaagggguggaauuauugggagcccccaguucacgcuguccccccccccccacuugcccuuuguuuaaacuucgcuccuccaagccauccucuaggaucacaggguuacccucuccuugcacacuaauucucuccuuuuuccuaagggcagcuaaguggucggcuagcuuagggcugccuuccaaaaagaagucguucacaacccggaggccuccagcccaacauccguggucacaagguuugagggacacugggaagaaaguggaggagcuuuguccauuacuggucagggucuccucuaggugaaggacucagauaugucccuggaagcacccaucaauucagagggccucuaaacggugcuccuugcucuuuggaauucgcuuccagcgccucaaaaucagaaggcuuagcaucugccauuuuauucugagucuuuuggaaauccacggacugggacccaaugucccaggugucuggcccgcuggugccaggugccuagggcucugcaauuucugguuaacuucuagccuccauaccccaucagcagacggggggggggcugucccuccuugccaacagcuaugcuuuacucagaggccugggggucagcgacuugacaacugcuaaaugcauuucguuagaugcaauuugcuugcaauuugucaacccggcuggggaacgcucuccagacgccuggcagacacuuuggcucuaccugguuccuggauccugccugcuuaucaacgaaucucgauuugaaccacaguguagacccagaacucaccccccaaauguucccgaccuugggaggcaaguuuuuuucaaaaacaaacgaauuucuuucccuguuuucugguaaaggagaagaugccacucgggagguccuucugaauacaagaccuuuccccucaccgcugggauaagcucaaauucgagcccggccgccaccgaaugguucaaugcccagcguccagacaggcccagagcgccgucuacgccuaugcacggcggauccccuagccugcgucggccucguucuuauugaaaucccacugaaaagauuccgacuccgacuugggcauggaaagacuuccauacccuacgcucucccccaccugcacccucgccacacaggauaaagggccgcggggcucuucgagcggggggcacaagcaggagcgagccggguuaagccgcgcaaagccggugcacgggacuagccggcaggugcagccagagccugggcagcccggcuugggcgcauccgcugccgcuacccgcggguggggaaccgcggagacaaaggccccagcucuggggugggaggggggcgcgucgcaaagcucuggaaagccgggucuccagguccagagcuccggaaaaacggaaggcaggagcccccaggcgggccuuuggguuuccggaugaccuggguuugagccacuagaaggaucgugcgaucggguuuuugggaggcccagccugagaccgggaggcucgggacggcgcgggccgagugcaggaacuuaccgacugcggcgcggugggcggcgcccucgggcggccacggccagggcucagcagggaggcagcggugugagcggcguggcuggucggcccgcgggagucagcgcggccgcg

SEQ ID NO: 3190 - RNA, 189208 nt, Mus musculus
cggcuuagcaggcggaccgcggggcuggcgcucaggcgacggcgugagaggcagcggcgggauggccggccggcggguaaaugugaaugugggcgugcugggucacaucgacaguggcaaaacagcgcuggcgcgcgcgcugagcaccacggccuccacugcugccuucgacaagcagccgcagagccgcgagcgcggcauaacgcucgaccugggcuucuccuguuuugucgugccgcugccgggggcagaacccgguucuagcgacacgcugcugcaggucacacuggucgacugccccgggcacgccucccucauccggaccaucauuggcggugagcgcgggccggggcgggagccgggcucgggguccgagcucgcgggauggauggcggccugacagccuaggccuggccaccagcccggaaggcuuguggucucgaacucacagcccgcagacgcggacacaguucucaccuucacugccgugcaccgagaugcuuuccuagaaaaaugauccaaagaaacaaacccugcaaaaaggguguauacaaguuucaaaaaaaaaaaaaaaaaaagucaccacguaccuguccuuuggucuccugguucucugucccaaacacugcucucaguuuccuguguguauggaugguuucaggaaacauacacagaaacgcagacaaggugcagaaaugaaagauccuguuuuuuuccuucuguuguacuacuuguggucgguugggguaguggguagagccuagugccuugauaagaggcaagugcucuaggcucucucaggaucucaucccccaguccccuuuauacacaaaccaucacugucuggagacuauaucuacacauaaaguuccuuuguacuuuuauaccaacauuuucuugacugacccucgugacuuucccagaguuggcugcuauucauaaugcagugaauaacucuagcccagaagguuuugggaugugcacuaguguaacaggauaaguuaugugugaacuagcuaaggcaaagggccugcguguuuucagucaugaugggcacugcuaaaaucugcuucuaggaucuguaccacuuaauuagucuuuaauuacaggccacuuaggaauaggccauuauaaauaaaaggucuuguaaccucccuuccuugcucagcgugaccccucccauucgucuacaggaaacuguugcuaugucuuuuuaaauuccuuuugcaaacccauuuaacuacacuuaaaucuaagaacagaaccccauaaccuguuuguaagcacccagcacaaaaggagguguggcugagucuaccugcuguagcuccagugacccauuuccugcuucuccgcuugcccuggguuucuuuccagcagugugcuguaagccuggaagcauguauauggggcaggugggucauuccagcuguguggccucccuuucucugugcugcaggcagccuaagacuguuuccuuguuucacugaaguggaaauggaggcuuaccugccagaguuacucuccugcacaguaucuauugaguucaggauucacucauuaaagacuaucaagggccacacaguaaacuaaacugaaaacucccacuaaauucugacugguuguguucaaauacauuuuaggaaauguacucuaagcuaguguaaauuggagauggaacacuacaggguagaaacuagaaagugggguuggcaugucccucagugguggaguaccugcuuagugugcaggaugcacuagauuccacccgccucccccccccccccccaguauugcaaagaaaaagaaagaaagaaagaaagaugaaguuuuuuucuggaaaauauagaaucugacuuguaauaacuauaauuuucaucuuuaugaugguguguaaguguuacaaguucaguggaguuuugaccuuuccugguucgucacaugguugguucucaugacacugagcagugcagcaaucugcagcuccuagucggcccugaggucgagagugcaaaucucuguguacccaacucugguugcugagcuggcaggcccagagcuucuguguauucagugcauuucuuagcuuacuauauuuugaaccuauaauaacaguguuggauguagcucaacuguaagaggagaaucuaaaaucuaggccagggcagaaggacagacauuguuuuagagauguacagaauuggguucgcagcuuuuuuccuuacuagcuccgugcccuuugaaccuugcucucaaucuuacgucacuagugaauaauggugacugugcaguuacuuucuggcauggcucuucucaaacauuucacuucuuggacaaacuuugcuggaagcguguuuauuguguagccacuaaggaaggcagcuagucagcuggauugucaaggccugccugccucccaagcugagaccuuucaaugugccccaguuuccugaauuucugcccacugcuucuaauauguacauuuacacagaaccuuuaugaggcaaaagcuuuagccagguguauaugaucaaauggcuuaagcccaagcagugguguuuugauugagacuauacaccuguacuaggggaucugugcucucguaucccguuguugcucuucuugcuucauagcuugagaaaacuuuccuuccuggucuuacaauguggccagaccucacuggagugauaagaccauccuuccuuaaggagaucggaucccuaccuucuuucuuaaggaagagggaagauggagcuuuuccuuuugaagggaagcaugcagcugcuugagugccugcucuggcccaggccugugcccaggaccuugugacugggcaguguccuguggagaagcaucacucugguuuucggaugaggccuuccugaacuggcuacaggccaaaucuugacagugccuuuggaauccugccauucacccucugcugccugaacaguggguggggucauuuucaggggcucaucagaucauguuagcccuugcuucuagauucucaguauguuuuuguuugauuugguuuuugaggcacggucucuaccucuaacuguucugggucucaccaaguagaccaggcaagccuagaacucauagagauccuccugucugccucccaggugcugggauuaaaggcaugcacuauugcucuugacuccccuguacauucuuguauuuggauuaauccagccucuuuguuccaggcucaguacccaggcucuccuucccuggagccuccucagcaacuacuuucccauguuucugaccuucagucaugcugucgacuuuuccacucuuuaaauaugucaacaguuacuuugcuccugcuguugcuucuuggucacagaagcugcugucacaguucagaugugacauccuauuuccucaugcuccuuggguguugugucaguugucccuugcuaggacugggacgguaugagagcagaauaggauuugacucaccaguguucuuuggugccugugcugacagcaggcaucuggcagguucuuaguagguucuaaggaaggaagagcuauguucuucuaauggccuagcuggcugcucuuuccucauccaggagaugacaagagaacacugguaaaggcacacugucauaguccgaggggucucaagcuggaguaccucauguaagcugggcauggaugcaccugucuagccacuccucagugggcuggagacagaggauugccugagccugggaauuugcgcccagccuggguaucacagugaggcucuguuuaaaaaaaaaaaaaaaaaacacuccucaaccuuuguugaggcccaggaugugggcacauuuaaaagaagagcuucccuagaucaaggaaccaccuggugaggcugcuuugucaggucugaguuaacugcuaguagcaugaggcccagcaggaugucuucaugggaugucacagguguauguucaggacagugaagaucuaaacggaguuuggaccuagagaguggugguagggauuucucuuaagggccuggaguacuuuggaaggcuguuguuuuguagauguauguggccagcugagcuguggguaggaaacugcagguagggacuccauaagcagagauguggucuuccucuuauccugggauccuuugaugacugagucaucuguucucaaccucuuggggaggucaagugacccuuucacagggguugccuaagccccgcagaaaacaguuuuauuacaauucauaacagcaaaauuguaauuaugaagaagcaaaggaaauaauuuuaugauuggaggaggggucaccacaccaugagaacuguauuaaaggguuucuugauaguuucuuaaguuaaagccagcugucugauucuauucuccaaggugaacucuccagaaacaagaaucccuccuucacgaaaacugggcuucugggcuggagagaugacucacucaguggucaaggguguucacuggcuucucuucuagaugaccccaguucucaaugccaagcaaccacauggcagcuacaaccauaggucguaauuccaauucuaggagaucugggcccuucauacagacauacaaguaggcaaaacaccaaucagugcucuaaaaacaaauaaauuauuaaaaaagaaaaacaaaaagcuggauuucauugccccugaggcucagaugcaguaccugguggugcuugggaucagagguggugacacccgugucaguuauugagugcuguccuucugguugguacauuaguuuguuuuauuauuauuauuauuuuuaacccucacagcugcccuagagagaaaaggugaaauucauauuuuauagauggaaaacuccuguaccucagagagagcagggacacaguuacugcuagccaaguuugaacugagugcacgugccucaacagccuuugucuggcuuucucagugguaaugaaaagugugcuguccacugcauccucuuggguagugcuucagggugauauuuuucucaaauccauuuuccaguauaaaucuuucaggguuagaacuucaaaaagauuaaacaauguauguuuuaaagacuuggguuggguaugagauguaagacucaucuuuaaucuaagucuaguaggagagaaaaaaugcuggucucuuggcuuagcaauuuauagucuucugguggcugcaaggauuaacaguguuuugucucugagucuuuuguucugguuguuuaugaugggucuccaagccuucccaucucauacacacugugugaggcagguccugcauggccagggcuuucucuggaccacucccgcguaggaaugcacaggaguuuguaugucugacccagucacugcacuuggagccuagggggcguugucucuuaccuuugagacauuuuucuuuguaaagcuuagcuauguacauauauaaagaaaagcuuuauuuuucugacuuucugugcucucggugccccagaaguacaaguuuuuggcccuuugaucugcuuuuccaggcucaucccuuuaagucccucuguauucugucugacaaccuuccuuucugacauuccuuccuuuggaauggaacaggguuugugugugcaaaagaauacaugccaucaaccaaauuucucaggucacucuauguagugcacacuggccuugaggcaugcacaccuaggccagaauguugcuuggcauaagcagaggggguuuggacaggggccuuggcugccggggacaucggggguguuauucuaguggaaaaaaaaaugaaaagacuuguuguuuuccuugccuguggccuuucugugagcaucuguguaggaacacauguauggcacuuacaugcuuguauaacauugacacuuauuaggugcuagaaugggaagugcuucccucaacacaggcuuugucaucaggcaucggcugugccuuggcuccuuguacucuauuuucagcaguaacacacacacacacacacacacacacacacacacacgguugcacucuugcacacacgcauaugggagauucugcugucuggaacagccucugugaugucuucuacuaccaggugaugcugagccaacaugaguugcuugcuuuuccuugcuucaaaggcuggucaguaggaagucugccucacugcagagagcugcuguagaaauacaagugcuucuguugugccuggcgcuuaucauucucugaccccacuugaucuccuuccgagcugcagugccuuuagcugucuccaggagacucaaguugagcuccucuacaccauuuucccuuggagccggacagcgggugacuuugcuuugguuggggugacagugugggagcggcacaacaucagacacagucuugaguuuaaauuaaugcagaauauuugagcaggaaccaacaggaaagaaaaauggaagcagguagucauauuucauuccguugggguacauuuuucuucucauggggcuugcccuugagaauaaaacauaucaaauguuaaaucaaagaauauuuuuguagucaugcuaggaauagaaaauaaugcaaagacuuugccuucuugaggcaaauauuuugcuggaagguuauaaucaaagucagaaggaaauuguagccacagcuuugguaaagcugugaucacuuaaaauuaauugcuuuuaagcuuuuugcugaacgucuccugucugcaucugagugagugucucuggguuuuccuucggaaccacuucauucaggcuaggguaagauuugggcaugcguuucggaagauaaccuaucaaugaagccccaggaccuagccauucuuggucauucuuuuguucaguggaaccucagccaggcugggacugagccuuucaugauucucuguucccuucccaguaagggcuuugguagcauguagaaggugaugcugucucuagcucuggccuucagcuaccuuauagucccaguuccagggagagugggauuuugaaggcagccucacgauagggcugggaaccagucugaaccgagcaacacguuguccucugcuguuggaaggaccauacaguacuguauggcuggaagcaccaugggguagggaugaugcuugugucuucuguagcucuaccuggcugccucacagaaaguacaugaugguuuuaaaagcaguuuaguucagauaacguguaguucagcaugcuuaguguuuucccauguguuuauggaguugcauggcuguccucuacaaagaggcguugugcuugcucacagucggcucugcagaccugggcagcugccagccuccuucacagcucuguagauuuuagacucugacagaaauggaauuauuuugugccuggcuuggguuugggacaugcuuuguaguuauuguuuugagaaagggucucacuggguagcccacgcuggccuugaacuuguagugcuccugcuucugccucccaggggcuggcauuauggcauucccaguuucaagcaugcuuuuuaaaguuaacccauacuguagcauguaacuauacuucaucucuucaaaaauaaaaucuguuucuaauugugauaaaaaagauacuuacuaccuuacuaaaucaucuaaguugcuucuuucugugccauaccuaaccuuuggggaccccucuccuagggacuuguaguaauagagguucagauggugaugucuugguggguuugggucuuguugcuuaaaaaaaaaauuuuuuuuaaagauuuauuuauuguuauauguaaguacacuguagcugucuucagacacaccagaagagggcaucagauuucauuauggaugguugugagccaccaugugauuccugggauuugagcucaggaccuucggaagagaagucagugcucuuaaccgcugagccaucucaccagccccuuaaaaauuuuuuuaaagguuuauuuauuuaauauaugugaauacacuguugcuguauucagacacaccagaagagggcaucggaucuuauuacagauggucgugauuacugggaauugaacucaggaccucuggaagagcaaucagugcucuuaaccacugagcuaucucuccaguccuuuuuguuuauuuuuaaaaaauauuuauuuauuauuauucauaaguacacuguagcugucuucagacgcaccagaagagguuaucagauuucauuacgggugguuguaagccaccaugugguugcugggauuugaacucaggaccuucggaagagcagucagugcucuuauccgcugagccaucucaccagccccuuuuuguuuauuuuuaagacagauucucacuacauagcucugacugaccuggaacuuacuauguagaccagacuagccuugaacucacagagaucugccuuucucugccucccaagugcuaggauuaaagauguauaccacuaugcccaguugucuuaguguuuuuaauccauucacuuugguucuaugugcauagcugugcaguguuguuuuggauaugaagccagauacaaaccuuguguaugucuucaaggguuuuguggucaggggaggcgggaggaguggaaugggcaguuaagauacaagauauaguuaaguuguuaagagucuugaucaggagaaccuauaucaugugaugugaugugugaguguguuguggcacaagcaggaaggagcccccucccaaccucccauggggacacagagccaagccuaaacagaugaucuggagauuugcaggcagaauagccacagggaauagccucagcaaagugcuggggugugagagcaggugcaucuggugaggaagugugaugaggugcuaggccaguccaggaagacuucugggaggaggggauaucuuguuguaacuuuguaggguaauugagagcuuacugacaagauggggacaguucagcuagagaacccagcuugcagacaaacaaggcaggacuagaacauggagucaugaaagagggagagaguaacagguccaguggcuagagguugucugggauagaguuuaggagcuggguguaccuugugggagagaguguguuuuaaccaaggguccuuguagugguuucuacaggcucccuucgaguuugaaaaagaguucaggucaagcggcuuuaaggccaaguguccugaaugugcucuuccaacaguaagcaagcagacaggcgggaggaauacagagcucuggagugcugguauggaaugccaagcaaggccacagagcuucugccuuucagaagaggguaauuauauguuuggaggacacauacuaccuuuuagacaccauucaagaccccagauacuuacuguauucucaaagccugugucagggagccucugguggaccuaagcagcuugcuguaggucucagcuggugagagcugccucaagcuuccccuagccuaguuccuggcugugcuuuguccaggauugcagucacgcccuuauccaugucuauccauguccauauaaggagaaagccauagcuccugaagagcaguuucuagacauggcccaugagaugucuggucccaagcacagguucucucagcauccguccuugcaccacuguucaccauucuuuuucuuuuuuuuuuucuuuuuuugguuuuucgagacagguuucucuguauagcccuggcugcccuggagcucacucuguagaccaggcuggccucaaacucagaaauccaccugccucugccucccgagugcugggauuaaggugagcgccaccauucacuguucaccauucuuuccuggaccgguugagcuuugcuuuuuguuaguugggucuuucauuucuugugcggugcaguuaggcuccugcugcuuugaaguggccucacuggguaggagggaggacuuagcuaaugggaugcuccucuuggcagcagaaaaaacaacuuugcuguugcgauccguugacuuuccuccuuuugcugucaccauauugugaugaugcucucuuuucuugaggccuucaggaagacuaaaaugauuuccuuugucucuaaccuacuuccugaggauauuuauuuggcagcacacacaggugcuaccuaaagauaaacuugacuuuuuucuuuuaaaaucagugcgggaaaugcacuaauguugcucugcuuagucgcagaaccugccuggccuagccuuugcuguagguuuaaagcccaggagaggucaaugacugcugcccuuggccaucugaccuugauauuagagcuaaaacugcucgucugcauugcauugugacacuugaagacagucacucuacuguggucauuuucaggugaguccuauuccuugcccuuuugacacaggcaccagaggccuaguauauguguacuucaguauuuccuauuuuggagugauggcuuagggcacgcucggggauggucugcagagcuuaccucuagaggagaaagacuggccuaagaaagaaggcucuguuucuuuaacacuuccgccugacaucuagagacuagaaaagcagaggcuggcagggauugguguccagcggugcucccuguugccgaugccccuuuacugcagagcuugacaaccuguugugaaggacagccacauuuccaacagaacuucccguugaauauuguugaaaacuuaccagugucgaagaaaggagacauuucagcuagagacaagucagacaaggcaggaccagagcaugaaguucacaaaagaggaagugaguaacagacucaguaaaguucugauuguguagcccagugguguggcuguaagccuuggagcguuuguguuaagcuagugcugcugaggcguggggacacaaauuuugccucagugcagcugacagugcagcccuggaugaacugagaaauggcugguucuacauuccuacaacggacuaggguugguguucuccucuaugugugguuuggugcugggggcuguuaucuuccugggaaagagcuuggggcucucugccuuccuugguauuccagacuugcucauuaguuggucugcacaccugccaagccccuucacccuguuugccuuccuaguggugcuucaaagaaugggcugugagaugacucucagucuuccuucuccuuuuccucacaggacucacuugcugaccuuguaccucuagaagucccaucaguacaacugcugcuuaggauaggcuucaccuagcucuagacgggaugaacucaguuucccuuuacauagcuuugagucugcagccagaaacucuuccuagguaccuuccauagguccuugcuuaaacuuucaguuacuguccgaaagcccaagccccacaucaugacauaaugugguccuuucugauagauuugcauuuucucccacugggacuacgugacacccuuuggauacuucuguguagacagaauaugcucucucaggcucugccuucugauaacaagcgcuucuuuuuguuuuguuuuguuuuguuuuguuuuguuuuguuuuguuuuguuuuaugagacaggguuucucuguguagcccuggcuguccuggaacucacucuguagaccaggcugaccucgaacucagaaauccuccugccucugccucccaagugcugggauuaaaggagugcgccaccacgcccgacuaacaagugcuuuuuuggggaaccuccuugucucccucccaggcuggacuagguaacuucauuuaugauuuccugcauccugugaauacucagggauugaauuuuuccaucucacucauuuuguauuuaguggguaaaccuucugagggcugggucuauuaucuucuaacuuggucucuaaggagauaggauaggacuuggcccaguuugaauaacuaaugcauauguguagacacucaggagcuauugaaugaaugaaugaaugaaugauggauggauggauggauggauggauggaugaagaagaggucauuuccuacugcuugcaccaagcaguccuacucuugugaugcuuuaagggacugcccaaaguucaacaguggaagaagccugccucgagguuagacaaguuaaucuuucaauggaaauucaauccucacuuuucauuuucaggccacuuugcguagcaaaguaguuuaacucauagcagauuucugccaugcugaugguuaauuucacggcccacagagggucagcacacuaaugccgagaacacggcgaccucaguguggcucgccgcacacagcgagggcccagcaccccuugucauuuuuuuuuuaagagaaccaguauucaaacauccuucagcaggcugauuuugaguuaacaggggugacccuuucaagaacaguuuuaagagcuauaguguagaucccucccaggcuguguauuuuccuuucucucugcaguucaaaagggcugcgucgucucaggguuuugccagcaaucuucagcuugacccugguuguuuaaaucugcaggaggaaauuugaacaaacuuguacuuugguaauucuuaugccuuugugaaccuuuaaccuuaagguuucuuucggagccacuggcugcauugucacccucugucccugcugaggcuuucaaagggcauugucuaguaugucuguuuucacuuugcuacuggccuucuuuugaggaaggguauuaauucagaccugauucugagucaggaggggaacuuuuaaacuugccccagagcucauggauggggaaaugagcauaaugcaagcccauggcugaugcuggugaaggagagagaggccuccagcugucuggugggcagccucagcucugucacguccugucugauaccauggccaaaaaccugauuugcucugauaagcaagccugcugaauguaagaucccggagugcuaaguucuuaggaaccugggaagucagcagugauuaugggguucaacugaucacuaugaaagaccacauacugaugaauuuccuggggucagcaagacuccucaagucugggggagagcucuggugcugcucugcccugucgauguucaagacuugcugaugcuuguuccauccugccucucucuccucccccaguuagccaguucacccuccacuacuuguuuguuuucucuugaugugacugugaugguacuagcacaaaguccuugugggcuuugcugcugguuucaugaacauauggugauugagaccagaccuuacuugucaugugucauuugaagcaggcuugcaggcugcaaaaccuccuugccugacuucuuggcuuuauuucuuuccuugggcuucuuaauauccuaaagguagggcuaggugaccuuauucuguaaguuugaugacacagaaagaguuucaucaucauguuaucaaguucauuuagcagucccuaagagaucugcaugcaaggaaggcagaaguuacccuagccucccagacaggugggaggcagguauuaggaaguaacaaaaccauaaagauugugaguuauggucaguaccaaggacaguacaggacuguuggcuuugggguaucucccuuacaccuuccugaggcaguaggauugaaaguaaauucuggaaaaguguggggccugugacuggugaguuggggauggauacuacaugucagaggagcagcgccugcaguggcucugaggagggcagguugggcuggucuguaauggggagagggggugguaggcagucauggcuaucuuuggacagauaugcacacuuggauucuguuagcccugguuuugcuggaggacaagcaaugguauauugugauccauggacacagagagacauucacacuagcccucuacaggugguuggccauaccagguuuucuuuacuggcuuuuauguguccuuaguccugccgguuucuguuaccaggccucagauucauguggguguuuccugcccuuuucuuaaaauuuuaauguuuuuauuguaguauuggagaaucgaaucucaggccuccuguguacugggaacacucuguacuacuuuccuguaguagagcaaugggcugagguggaaauaggguuggcaggcaauucuggcauggcaguaguuagccaguuccacuguucuguagugugaccagugguacacuggcacacuggcaucucaggcuccaguuacagggugggaagauagcaguccugaguggacaguagagaugucaaguaaggcauccauccagucacggagcuggccauacuuugcuagucuccuugagcauacugcccuugauguucccaccaccccuccugcaggauguccugggugaaagauaacacacagggucaggaagggacagauuuugccuuuucaggagaacugagguugcuaugguuuggucuccaagcugugcccgugagguggaagagugggugcugacguucugaugaucuguuguuuggaacagaacugcaaacugacuucagagaagcuuguuccccugagcuugcugcugagcaggaguuacuggcuuuaaauuagcacaggugucuucugcccuuuucuuaaguucuuuguguuauuuuuguugccguauugggaauugaaccuaggaucuggcaaacgccccgccucugagccacaucccuaguucccuuuccuuaaaacaggggaauaguaacugacuucagagcucucuugagauuccagcuuggucuccaggaagugauugugucugcuuugggggagucacuagagcaacuguaaccugagggauucuuuucuccucuggaaccuaauggguuuccuucccuugugcagacuucuuaaguaaauggaagugcuacuuacuuauuauugcaaguucaucaaucauuucucaaaguuuuuuaaagugcauaauaaaaguucccaugauaaccagcagcuuuuugaagagugaguguuuucuaggaaccaugagaaucuauugcauuaggucugauuucuccaguuggagcuuccuucuucuuaucucaaaaucugccucagaaggcaaucuggggaugcacagcaaacacucugguaacagaugugugucauccuuuuccugacaagucccuaggcugggagacccagcucuacucaguacgccgccauccacuagguguggguagacacacccugugcugauuagagcuguuggugcacaagagggcaguguuugcuugcagucucagacgggcgaucaugugcugguucacaggucagcagaguuagaaugaccucagauguagucaagacaaaauaaacuguaagucaagguugugaugaguucucauauaugccuuuaaauacacaacuccuucaaaacuuugcugcuuguuagccuucuuuuuccuaaaaagaaaaauauuguuucuuucaauguuuauuuuuaauuuuuuuuuaaaucaaugaaaauaugguugcaagucuuguacaacacuagcagagguuacacagugucacagaagcaaaacaccggcuuccuaauuaaaaaccagaugggcagauuuuuguuuggagcaagaggucaaauguauuuucuccccuuuucacaucaauguaaagcuuaucugccuuaacuuuugaagcguuugaagguguguacgucagcaguccgcccuguuucuuuuauucugccuucccccguaagguggcucccugcauucuguaagguggcucccugcauucuguaagguggcucccugcauucuguaagguggcucccugcauucuguaagguggcucccugcauucuguaagguggcuccccugcauccuggugucccgggauugauugacuaugccuuuuuuuuuuuuaaauaaugauuuucccguuuucaguucuuccaugguacucuucugcugaaaccuuuggaccagcaggacacaugcuggaaugcaguucuugcccccaccagauuucagcugcuacagaacugggagccccuuccuguccucagucaccuccugaucucagguguuuuuaggauguuggugucacucacugaugaaaugcuacagauggcagcagcuugaggaaacaaaaggaggaaaggcauaggauggccauagcuugucuuggcauccccaugggaaccaccugggcuuuugagcugcccgugcaccccagguggaggcaguugucuugcauaggacgacuguaucaggagcaugcucuuaaagcucaugcacagagccgaggcuugaccagcuugagugucaggaguagugggugcuauaagacaggaggauagagacaaggauagcauuuuugacuggagacaagccaggucuucccauauugcucauuuacuugaugccuugaucaucucacaacaaagcauagugagacccagaugcaaagggcuguccaccacuucaguccccugacagcaaucaaggagacaggcaguuccaggcugagcccuguauagaaucagacgucuucuucuagucuuauguaauccaaagggaguaugucuguaagaguggugccacauaaguaguugaggagggauaugacauccccuguggucuuuaauugaucuaugacuucuaguuuaaaugugaaugucacagcacugagugcaguguuaguggguggccacucacagguuuuucugugacccacaugacuucuaguuaggucugagucuaaaagaaagguuuugcugcaucagguuuguaaaagaggcucaccaaacauuuuuuucuaggaacagaauuuuugaaaaaugcuggagccuuucguuuacaaaagaagcucauuugucagggaugagaaguuguuuuuguguggcucuggguggcuucguccuuucacuuccauaguagggcuagcaauuaggaaugagacccauguucuagguggucacuuccagcuaggcuguguguuuguuccgucucugucagcucagagggagcaaaaugagugagaccccuguaacaagcaauaugugggugcaccagagacacaugcugacagagauagaguguaucucugagagaauggucugggugcuguucugucuggaauguagauagagucauuguucugacgaguucccuuauaguagaguucccuccguaagcauugcuuguggugaaauuuugagacaguuuucuguuugggucuugaggucagucgacuuucuuguguuugucccacuccauaagcuuugcauguugugccuuaagcauugcauucuguuaggaggguagggaagacaggucugcuucuagaucuucauagggagcuaagagguguauagacagugaauuauaucaaauuaugcacaugaagcccaaagaccuuaagugggaauguugggcaagccauccugugaucacauaaaugagccuucccuaaucuugcuuucuuuaccagaugaggggacauacccugaguguaugugagaguugcaguagcaacugggauaccaguaaauggaugccgaccucucaggcccugugccuggggguuggaggccugcaggguuuagcaucaggauauagcugccuuuuaggguccuugggauggucaggcauucuuucccucagcacugcuggcaccaggaaauaacauuuaauuuaugcaagaaugauguuucagagaaggaaaugaaauucuuuuuuuuuuaaauuuuauuuuaagauuuauuuauuuauuauauaucaguuacacuguagcugucuucagacacuccaggagauggagucagauauuguuacggaugguugugagccaccaugugguugcugggaauugaacucaggaccuuuggaagagcagucggugcucuuaaccgcugagccauuacuccagcccuaggaaaugaaauucuuauuuuuuaaggugaggaagaggaagggggaauacuucccugcuuucccuggugauggaacaggauggagaacacaucugcuuuuucccaucugagguuggcauccacucuuuuucuccucuccuuuuccucucucucucaucuccugcaucuccccugcuuacccuuuccucccucuuuuccugcugcccuauagagacccugcuuuugucuaagcuagucccagggaacucagugucauaguuuggagauucccugaugcugggguguuuuguguggucuuguaucuccuuuccagcauauaucguggcuuucaagggccauaccaggugcuugcccuguucugccuuggcuugugcaaagugcugcauguugcuuuuggagugugguuguacaguuccuuguggaguagccaggacagugcaugguuacaggaugaugucagggucgcugagcuuugggggaggcuggauguggaugggcuuuaccucuggguaaaguaggccugggcuucugggccagguggaggcucucuggaagaauugaucaaauucaaaguugcuugccauuuaaugagucccagguauaugagcucugccagcccaacacaugcaggcucuggaaagcccgaaggaaaagacaugguccuguuuggagaaacgccuucugcagagggaagcuugccaggucuuucaggagggagggaaacuguaucaguugggagcuccuggugggacacacaguuuagccuuggcacugacccaggucugugcccuuccuugcucugcucuugcugugcuuacuuaacagaguuaagcucucaaccucaguuuucuugucuucaaaaugggagaauaauuacguguguguguguguguguguguguguguguguguguguguguagaaucccacaagugaagcuguacauagagcuuaucugaaucaguaaauuuaugacagguauaauuugguuuuaaaauccuaucagaguauacauauaaaaauaaaucuugucagaaacucuccuuguccuuuggugggaggcauacuagauaagcagcguuugaugccauguauaauauacacaggcuugucucugucugagacuaaauuaacauacuucaccagugugguggaguuuagaggaaggccgugguggugaaaggugagguaacagaaggacggagagacacauggacuguuggugugugaaaagcagugcuuggucucuggagaggccaaucugcagggauccaugaccuguguuguuuggaagccuauaggcucuggucauggaaaugugugaugcaaggaacagagucuuucuuaaaaaacaucugacaccaaggaagagauuccacagaacagcacagagaaacauaaaggcagcugguggaguugacaggcuugaggccaagagccagggaaauggaauuugaguccugguuucaguguuuguuguaugaucugaagucgauuacuaacuucuuuggacuucaacuuccgucuucaaaaucaaagaaccauuuugaggaugagaagacauauaucuaguauacaguauucggggaguaaacauaauugcagccccugcugcucuuuucauuacuaugauaagacuuuccagccuccugggacugcccaucgccagcuauaagcauggaagucuuucuccaaaacccuguaaguuuuuuccuguaguauaaaugagugcacugaaccaugggucauucuuauagacagacuuauaaaugaauuuauaugaacaaauuuuggaaaucuauuuuucucuugauuugcuauuuuaaaaccagguuuuuagaagcccuuaauagcuuaauauauaagagccuaaaguaggccagugucuguaagucuggugagggugaggguuucauaaagcuuugggauauuuuucuaaaacacugcuucaauuagggaauguccccuccuccagguugcuguugauuugggggacguacucauguccagaugcaccaaauauaaaagaugaauuuuaaagcuuuuaacuaucacaaagcaucaaaucuuuauggggguuuuaaaggucuugaugacuuucaguugcccacauuugcaugucugugaagguuuuugacaaugaggaugguaaggaacgguuuagggauggcaggagcuccuaucaguucaucagcuucuggagaaccucccacgcgcuucacucuugcaaucugccacuugcuuaaacagggcagaaagucaguggguuuaaagugucuuuacaauuagaaaggcauauuuuuuugucaauuugucuuacaagacagauauauauauacauuuagguuucauggagagcuaaagugugaaagggcagcacagacugcgagcuaguguguacacacucauacaggagaaacugagcaaaaugcagugcagccacugacgcugcuccaacgaaguccuggaguccagacucaugggccggucuuccccacgaagguuuuaucauuuuggaggcauggcuuuuuaaaucaucucaaagcauuugucuuuuuggaggagauuuaaaauauacaagucauuuuauuuccccacaaugaaugacacuuuuccugaaaagacucccaucgcacaaagugaaacuggaaguuuuugggaugaguagccuggacccuggugcugagaacugcaguuuuaccucccuagcaauccacaccagccuggaauuccuagacgacagccaaauuuccugcuauguguuuagcuccaaacuugguauauggugaaguuucuaaaugaaauuucuuuguggaaacaaagaauggguagaagguaaaauccaaggacaaaauggcauguguagauccuugguucagaaauucaugucgaaucucuauaguucuaacagaauucagauggacuuuuuuccuugggcugucaaaaccuugcuguuguacagcagacccaugacuccucucugcuuguaacggcauuaucauucaccagucccucuugguacuguacguguuauuguauccugguaguucugucguacacgcuuuggauauuugguugugugauuauuguggugugcagcugagcagggaagcuaggauuuuacauacauuucuaggcguuuuugcuggaacacaggcaaguaagaugcuuguuuuuacaugcuagauagggugggagucacagcuuuaauuuuuaaguguccuuuugaaauaaaaguccaauacuguuuuaguuucuggaaugaugcagauuguacugaagcugugucuccucccaagguggacaaaauauguucugugugcagaaaugugagcugcugccugcaucaggaggaagggagagaggaagcuguuuguaaaacuacuuaaaauaaauuugaggggucaaacauggagcacggucacuaaagggaaaggaaaaaaugccuugggucaguugcacuggaauagcacaggcauucacacuggcuacagggcugugugcuucuugcuaauaagauacaauuggaguagauaauauuugaauaucuauggcuagaucucacugccucuguaucagggaaauuuaccuaaagggccauguuuuaaaaguuuggguucaggggaacagaugucauguggaagagugauggcaggcuguuuuccuccuugugggagcuugcuuagucccagccuucuaaguggcaucuagugucagauguaacgagcuauggcucaggcagaaggcaggcuugcguuagcauuuuauuuaaaagcgaucgguacuuuuaaauuaaacaugcaaaguuaucuuggugaggcauugaggcugcuggguuaucgaauuuggcucugaguuuagccaguucagcaggggugggcguaggaucuaaggcaauuaauaugcaagcacacuugagucagcaaggugguagguuacugucuuaucagggccaagaggaucuuucuagacauuuauaccuuuuuuuguaguuagauuaaaaacuuauuguuugagauucauauuugaaguuaggugccagauuuuagccaacaaagcaggugggaggagaaacaccuucuaucuaauacuuguguaauacugagcauggagaagaccugauacucagguuauuuauguuuuuucccucuuuacucacauuguuuggguggaaauuuuauuguuguugaaaaguacucacugagcuagcugaucagaauaguuguggugagaccaagccuuaaaaagaaaacugaggcagcaaagagauggcucagcagguaaaggugccugccacggagccugagugagagcccugggaugcacaugguggcuagagacaccugacucgacucccucauugugcucuaaccuccagaagugugcuauggauggcuugugugcaaacacacauauacauacacaguaaauaaguacgugcaauauauuuauaaaguggcaaguuuaaaaggacuuaaauacugggcugagcccugugugcccuauaagguucuccuuauccccuccacacacagacagccagagcucacccaccugcucuacccacaugauaauacuugaggcaugccaugcguuuuuuucguuguacacgguggcugugaugcaguguggggagaagcccgcuucaucccguaucuugcuuuuagacagggaaaauaaaaucuuauguauucagaacaccgugaagacgcuucuucugcugccuuuaguagagugcaaaaccccagauccagaacuacugcaaccugcaaaauguugcuugacucuagcagacaacacuggccucuaaaaaucagaugugacuuaaaaaggaacaagucagaguauagcucuuuguucugcguguuuggggguaaccacaacagagagccagguuuuaccagcgaagcacacaagaggaaauacguggacacccuucucucuuggaggcuuauccuggaucauuggcuuaaauucaggaauuuggggguuuggggugacaguauccuuugguaagaagcauagagcucucgcugcuucagggcugcuucaggacauggcccugggauacauggccgaaugaccuugucuuuuggaaggugacacagggacuuagccugggcgugaguggguguguggcuggcuuccucgaaaagggucuccaggguuuccuguggagcugugcguuguccauccagugccacagcccuuguacuucagaugaaggauaaaauacuugggagaauagcuuucauuguucccauucccaaaccccuuucuguauguggagagcuuucugaguuugucuguuuguuuucuguccucccaucucgacccacagccugugccgacauucuuuggagcagaucacaugcuccuggcaagcagugggcauucugaacucuuuuuguguuuccagccaugguccucaguucuccagggagaccucgagccuccauuccaacuuaggagaguaccaaaccaaaacaagaagccuugacauaaacuggaaguaaaacuuggcagcaaccagcacagacuacgauaagggguuuugaagugucuccuuugaagggucuuucuuauuggagaaccacucacugcugcuccacagcugggguggggcaggaaagaggccucaggacucuuauucuagggguuucaaauucagagaugcauaaggaauaaggaagagaaugcaggcaggcagcacaggggacucaacacuuaaggacuuucuuuccugggcaauggugcccaaauuguacuguggacagcgggaggccacugaagccauugcucacugucuguuaaugucaccacagacucuaggaggauaaauguguuucucucuugaucaaaagaagaaaaaaguaguagaaaaaguaguaauagaaaagagacccguccaaaguggguuuguuuguaacuguuagguuguuagguaauacguguagauguuuggcaauucagguauacugacaguggauauaaagagaaaguucugcccuccugucuuggagcccuaggcuccuaauuuucccuugccagguaugcacauuaagugcaugguucugguaaguuugagguggugcaccucagugggcaucucuguaaugacacuguccucacuguagaugaccugugaaguaucauuugcuacgcauaauagagccucuuucuccuugugcacugcuugagcaaacuccaugguucucuucugcaggcagagccucugugcggacaccauugaccauuuucucagagaagccaaagggcuccuaccauauacuacuucuagcagagacccuggcaacuucuacaacuucuagacagcugcugagggaggcuggucacugauacauauguguguguguguauguguguguguguguguauguauguguguguauauguguguguguguguguguguguguguguguauauauauauauauauauauauauauauguauguauauguacguauguacguauauauguauagucaucuugggcacaugaugcaagcuuccugaguuuuagggugagcugaguaaacaaggugcucagggucugccuguggggacaggaagaagcagggugaccauaccugccaguuuucacugcugaccuguucuucucaucuggcccuuagagccucugaucagucaaaguuccuaccuucuaacugguaugucacuugaaaucugaaaaaugggacuacuucccuuccccccaccccagcucagagucccaccugugagcuccagguugucagcuccagaggagacugcuucugucuguucagagcuggcagugcaugccagugggacucuacccaauaggucugaauaccuacccagaagacuagugaguaaagugcuugugucgaauagaaaccugacguguggcugggcugagcuccauuguagggcaaagcuuugccuagugugagcaaagcuggcuuccauucccaguaccauaauggggaaggacaggagaaaaugaaacaucacugagaggaagaucccucaucucugcuacucugggcagcaguauugucuguuucacuccagcaccaggguguccagccccucacauggcaccugacaaacccucaguguaauguuauuggcuuuauuauuacuauuauuauuauuauuauuauuauuauuauuauuauuauuauuauuauuauuauuauaauuuggcucauccauagacuaccagggagagauuugaguuuuucacauguucauaagacagccuggaguaaagucacuuucuaacccuuugugagaaguaguccuguggaacauuaggggaagugggauugguggaggugccuucugggguuaagaugcuucugcauugcuggagggcacggagccugcugugggagcaguggucuaccccagcugccuggagcucucaacacuuccuuuuuuucuuaagagguaugcuuuugccaggcgugguggugcacaccuuuaauuccagcacucaggaggcagaggcagguggauuucugaguucgaggccagccuggucuacaaagugaguucuaggacagccagggcuauacagagaaaucuugucucaaaaacaccaaaaaaaaaaaaaaaaagguaugcuuuuuguuguuuuguuuuuuguuuuuguauuuucgagacaggguuuuucuguguagcccuggcuguccuggaacucacuuuguggaccaggcuggccucgaacucagaaauccgccugccucugccucccgagugcugggauuaaaggcgugcgccaccaccacccaacugcuuuuuguuguuuuaagauuuauuuuauuuuauguguaugaguguuuaguccucauguauguauguacaccaugugugugccuugugucuguagaggccagaagagggcauuggauucccuggaacuggaguuaaggguggguaucagucaucaugugggugcagggaaaggaaccuggauccuuugcaagagaagccagugcucuuaaucauugagccaucucuccagccccucugggccucucuuaguguucccagaaaggagccaaguaccaguugggacacaucacagcagagcacuaguguucacaccuucugcuucuaguguguccuucaaaguuaagaaaugugcuauaauaugcacacaugugugugacacacauuuguauacauguguauacauuguauaugggcaugugugugugugcacucucucuaucuauaucuauaucuaucuaucuaucuaucuaucuaucuaucuaucuaucuaucuaucuaucuacacacauacacacauauacauauauaugagaacaauuuugagagguuaguucucuucuaccacccuuaccugaauucuggggauagaucucaggucuguagguuuguaagcaagugcuuuugcccacugagcugucuugcugucuucuuuuuagucauuuuuacaugcucauugguauuacauguauuccuaguaguauguggccaucacugccacccauugcucugacuuuuuucuacuuucccaagcugcacuuagcacuaacuuucuguuuccccacucuuugccuuuggcacccaccauucuacuuuguauggaccugacuacacaggagccucacaugaaugaaaucagcacuauauuucuuuuguaaggacuuauuuuacuuagcauaaugucuucaaauauauccauauuguagcauguaucagaacuuuuccuuauuaaggaaauuuauaauaaauauuuaaggguauuuaucuauaaccagcucuguaguuuuguuuuuugucuuaauacauagguuuucuauguuauuacuugaucuuuggaauguuacuucuucugauccuguuuaaaaugaaggacaauauuauuuauaauagucaaguaaaaauaauccaacuauauaucaacuaaugaauauaguucuuaaaaugugguaaaucagugaaaaggaauguuacucagcuuuaaaaaagaauagggcuauaaacagugaaauacaauuuuuuguguuugagaauguuuuaaguugugcugaauggagcagguggguuuuaugguaacuguuuaugaggaacaacaaaccauuuuccaugguugcuguaccauuuaauguuccucucagcaguauacaucaccaguuaccuucaucuugucuaucuguuaugcuguacccaucccaucucuguuuuaucaugguuuugauuugcauuuucccugaugguuaagaacagagaacaucuuuuuguguggccauuaauauuaucuuauuugcguauccaagcucuuugccuguuuuuaaaauugaauuuucuuuuuuuauuguuaaauuauaagagucucuaaaauaucccagguaguucuuuaugagaugugggaauauugucuuuuucuuuuuuuucuuuuuugguuuaucgagacagaguuucucuguauagcccuggcuguccuggaacucacucuguagaccaggcuggccucgaacucagaaauccgccugccucugccucccuagugcugggauuaaaggcaugcgccaccacgcccagcacauuucauuuuuuuauuagauauuuucuucauuuacauuucaaauguuaucccgaaagcccccuauacccucccccgcccugcuccccaacccacccacuccugcuuccuggcccuggcauuccccuguacuggggcauaugaucuaugaguuaucuuuuuacacugaaaaccaaaaccaaaaccaaaacaaauggacacuuuuaaaaaacaaacauuacucaucauacaucuacgguguaaccugugcuaaugguauccacaugauuggcauguccauugccucaaacaucucccugucauuugcacugggaacauucgaggaccucucugcuguuguuuuaaaguguucugaaguugccagccacaguugcuguagaaaguugaaaccugcauuuugaaucuuuuagccacugccucuccaccccagcccucucucuagcuucucagaccccauucucccuccuccuccucagaugacuguuggagcugcuguuggccucaucuuucuguguuggacacacuucccuuagcagaauaucuugaagacacaauaggccaccauaaguacaggaucucauuuuuaaugguuggacaauauuucuuuuucuuuuaaaaauaauuaauuaaaaaauuaaauuaugaguauauguguggaguggguacccacagaagccagaagaggguauuggagucccuggcacuagaguuguaguuaguugugagccacuuaauaugggugccagguaaccuggaaaagcagcaagugcuauuagcuguuaagcuauuuuucagccaucauauucuugauucugaagcagaaguuuuaaaguuuugcacaaguccaguucauuguuguuucuuuugcguuugcugucauauuuuagaaacuauugcaugguucaaggucacaaaaauuuacuagaaguuuuaugaaaauuuauuuggaguuuuauaguuuuaacgcucccccccacccccaccccgaagucucauuguguagccuguguagaccaggcuagcuagccuuaaccucacagaagucugccugucuccuaagugcugggauuaagaugugaaccccuaugucuagcuuaguuugagcucuuccaugaaaaucuuuguuccauuuguaugcugugagacagaggccccuguuguauuucacaugaauuuuuguucuaggccauuuguuaguaccuuugcugaagaccucuugucccucaguaugagucuuucucuuuauuuccuaguuuuuguuuuguuuugagacaggguuucucuguauagcccuggcuguccuggggcucacucuguagaccaggcuggccucagacucagagaacagcuugccucggccucccaagugcugggauuaaagguguguguacuaccauucucugacuugggaacuuaggaaggaagaggaaacaaggaaauuugguguucuggaaauuugcaugguaguagcaguaugaaagagaaggcagcuaugcauccaaguuugugcuggcggccgaaggcccugggauucuuucuuaagcccuucuuguugauguaguuugugagaaggaaaaacaaacccuucaucaguggaugggccuaugaggugagcauagaugccaucuguuauuucucauaaauguggggugcugggugcugagucaccucacccuccagaacuuauguccuuggaguuaguggguacgagacagcaugggaaguagaugugcugagaggaaaaauguguggagggcaugaagugugaaaccacuggcuacaguaggagcugggaaggccuagugggaaggaaccauucuaaugggguccugacagguaaauuggaaucuccuuggagacagaugacaugcaugaauucagugggugcagcaaagguaugggauuggcacacagcuggugaagcuaggaccagggcaugaagggcauuuccuggaggagugguugucuuugaagguuuguggcagggaagagaagaucugugguuuucugaguggggugaaagggagagaaugggcgugcugguuuaguuuucaaggagucaccugggaagagaacugcaguugaggaauugucuagagcagguuaggcugagaggccugucugagggcuauuaucuugauuguugaugugggaagacccaaccuacgcugggcagcaccauucccugggcaggagguccuggacuguguaagugagguaagguaacugaaucugaguaacaaccuagcaaacaggcacgcuucauuugucucucucuguuccucacuguggauauggugugugugacuggcugcuucaacuccugccuugauugccccucagcaacagauuguaaccugggguugugucaaguaagcccuucccuccucuaaguugcuuuugaucaggguaugugaucauagcaacagaauugaaguuagaaucccaggagacugcuuuagagccuagcacuugugccuuguggguugagaugaggggugggaaggaggaaguacaaguuaggaaacaggcuggugguguugggugagggugcuuaaagcagaagggugugagguauggguguagggagagggcugagagcucuguugcugccuccaggaggccuggugggugcacaggcggguggcaggcagggcggccucagggccucuuccuuggggaagaugaaagggacuccauuugacuucguuuuaugccaaucaggugcagcuuuuagauuccuggcaagcugccacauugcccccaggcgaaaguuggcggccaugguacuguugacccuuuguaguagaugggaaagucucugccucucggauggccuggaaucaggaauuuggaaugcauagcuaaugcgccccacuccagaccuuugguguuaguguuccacaggaucacaucuaauugacuauuuccaaacucuugugcauuuugacuguacaagcaagguauguugccagcagcccccuugcuggggcuuccucauuuguagugcucuggccccauccuuuccaagagcucccaguucuucugacaugaggggcucugugcuuacggguacauagugcuucucuagccacucaccugaugucccucugggcucgcuccuggaguucuguaaugcuccacugugugugaggagguggcucugccuuuucuaccuuuccuacacaguggaucugugugaccugcacaggcgaugaagcuggcaggcccaagcagggccccgaccuggggggugaggacaugucaagguauggagucaccgcucagauggaguggccuuggauccucucuccugaguucuuucucagucucuugagccuaugaacucuaugaaccuaacuuuguuucuuuggcaugggguaagacccagugguccacagugcucaguguuucuuuuugaccaccuucugacccguacauuagucuuucuaauugcagccauagaauguuucucucuggugcaacuuuuuaaaaaugugugcgguauuauugcaguaaaauguaaaggaugagcauugucgucagcaccacuuuuaagcauugagaaguguuuguguucagcaguguuaaaugcucauguuguuaugcagcccucacaguucuguuuccaaacccuuccagccacaccaccuugaacccucuugcaugacacagcucccauuaauucuagccccuggcugcuauuguugugcuuucuaccugggagccugacuauuucuagggacuguggauaaacagagucuugagcuguuuguuuuucugugacugacuaacuuauuucacuuagugugauguacucagaagcccuauguugcaacacguguuagcauccccuccuucuuuaggcuuguauaucuagcaauggugauucucugugcaucuauugguuugguugauagcgaagaaaauacguagcugggaacuaugggucuacaaggaucagguccuuccagccccuuuggguauuuaucuaagaguagaguugcuggauacaauucaaguugucccuuaaggagaaaaggcgaguuuuaauaauuaaggcagagcuagcuuucuuuuuuucuuuuacugguguauauauauuuaugaugugggguuggagcacacaagcucuggcaugccaguggaggucagaggacaacuuuauagaguugguucuguccuucuaccuuuacaucaguucuggagguagaacuuggucaccaagccugagcaguaaucaccucuacccauuaagccaucucacuagccccaagcauauuucuuuaaacuaaaacacuggguguagugguauggguagcuuucugacacagaggaaacagcaaagcuggcucuggaaugacagccucugguuagucuggcugaagacugcuguucugggcauagugcuccaugugauuugggccauuacuucacucuaguuagucugccaugucacucuugggcuaaugucugugugugagccugacaguccuccuguagguacuccugcaucugagcuccuacaguagaggagaaacaugcccggggaauucugagccaccuccccaauaucaguggcugucucuccagccccacuccuacccuuucuccaaugaugcccccugcccugacauuggagcacagccccaugugguaugcucaggguucccucuggccuuuccaggugcuguguucuuugaucauuauaccugggauagauauucuguuccuuccuggcuaccucccuaguguaacaacuuauuuuuuggauugauuguuguauucuuuccccaacauuuaccaagugauguugcaagaagaguguggagucuuuggggagagugcacauaagaucugcuucccuaagaaugcuaguuuccuuggaaaaauguaaaugaggcuuugcagauuugcagaugguaaugacaggcacauuggacccuggcaugcucuucucuaagaagccacccagccuuugcuuucuuugggacuguucaacaucauagaaaagaacacaggucuuagauuuuuagguuuaaauuugguacuuccucuacugaccuuaggacaaaugucgguagcgggggcugaaagggcuggcuuaucaacugugaaguccucagagaggucauguagacugucagccauugaguccugccucccugaaucugaaacuguuagccccaagcugcuccucugucauacucacacacaugggagcacuucuaucagagucugggggaauuagcagacacccuuuucuaguuguaauacucuugccuggugcacccuugggaagauagagcuauguaggucagcuuccaagaggcuguggauugagaccuguagcucccugugugaagcccuugccugggccucucaugcagcuuugguuauuaguaagugcucagguuuagugagccaguacugaccaaaugccuugccaaaggaggccugugauauagcuuggaaucugcaggauucucccaugcauuugcucauuugcauagaugugguuuuucggucuuugggugauugucuaccugguuacuuauguggaaauaauuuuaaaauauugucaaaauauauuaacuucuuugcuuaguaccagccaccauauugucaugacuuacaaaugccaucuuauaggagccucacuaugguccuauaagggugguaccaucacuuccugauaaggaaccuuagacauagaagugacuuggggguuaggguaucauaggcucauugaugugcaggccagguuuggauauggcucauuaacuuccuuggucuucccugcuccaagcagaguuccuccacaggaugccagcacaggcacauggcuuuucguuuccuuuggagugggaggacaggagagaaaagcaguacaccuuaaaggagagugacccacaccacgcagaaucuguuugagccaggggacuagcgggaagaaggaaagauucacugcaaccacaugggaaguggggccaccacagagcugccccagccuguguuccuggggaggagguugugcugugcuccuccugcugugcuccucauccccucugcugcuccuuaggaaucuuuccgggucacaaaaugcagggccuuguaagguuugugucauagugacaaggccagagccucugagcuucaacugggcuuccugguccuccuagcaggaagaaacagagcuccauccugguugaggaucuuguguacugugacagucaucauuccuuuuccuggcagaaaccagcagugucuggggaguaggagaguggcuauuucauuggcaguuuguuagaaagcuuccuuccacguggccaaaccauucaggggauuuaggggaacuuucuacccacaccugcaaucuguggugugauuuuugucccacauguucuagaaaaccacugaaaugggcugggcuucuuuucagcauuugucgacugaggccucagaggcagauaguaugugugugugcuuacagggcugcugugacagacucugaaacaugaagcacuagcuacaaggccaagugagaaaggcucuagugucuuguaguaacauucaaagugcaggcaccagggagccaccagcagacaggucucaacaggccacacccagugcuggggcugcagguagcugccaucuacuuuccuuuuuaccaaguuuuuuucuccagaguuauuccauuuuuagugauguuucccccagugucugcagugaacauuguuugcuugccuccuucuccucugaggcacaggucuguccacagaucugaggagaccucuggguugaugcagccaggcacgaggcuguagccagucggugcuccuugccauucuucuuccccagugugugguucuacauaguggcaauuauguaaugaacacaaaaccaucuuugugcuuucugacaccuugagauucuuuuaaagauuuauuuauuuuacguauaugaauguuuugccuucauguauauguauguuagacccugugauuagaguuacagcugauugugagcuacugugugggugcuaggaaucaaaccugguuucucugcaagagcagcaagugcucuuaacugcugugcucucucuccagauucuuaaucuagacucauuuccaugcauagggaccaggcuuuuggaguugaggaaacaugaaagaaaccuaucuucuucuauuaguuuagauguuaaagcaaugaaaauuuuuucugcuaccccuaccacagcuuaccuuccacugcuacacagugcuggaaccaaguuccugguguggaugauuaacagggcauauauuuaaaagagucauuaaguguaucugugauaauuguuuugucuccuaauagaaacuggagucucugugcuaggacuuaguacuauaccugguaacaucagagagaaacauucuagagucuacuuggagcugcuuuucucccuagacaccugucagacacagacagacccuagcugugcugccuucugucucugggguaugaaaaugucucuuguuucuuacuuccuacgaaaugccccaccaucguuagucaguucucaauggcuaagccuccuagcauccugaaaguuauguugaaccugggcauggagucaggaugguaaagccaaugucaaggauaguggauagaggacccuugagagaacucaaccuucuuccagcaaagugcacaccacuauuucaggagguaucugggucccaagcaagaaguauuguucaaagcagcaguggguugcccuuguugacuuucuguggggcccuguccuuauggguagauuuguauugcagcuagaagcacaucugcuguugugugagucaguaucuaaagaggaaaggaaggaagaaaaaaggugauuuauaacacuucuaacacagcucaucucaaauaacuaaaaagacaagguacccugcugggaaugguaguaucugccuucaucucagcacuugggaggcagagacagguagaucucugugaguucaagaccugccuggucuacagagcaaauuucaggacagccaagguuauauaguagcacuguuucaaaaaccaaaaccaaaaacucccauagugccuagccaagugaaauuguccauuuguuauggugagcagaugauggaugugagcacaggguuuccuacugcauagauuucacaugcacauugcucuauggguagaguuuuuacuuaagagugauugguguguguauguguacagugugugcugugauacaagaccaugguagccuauguguaucuuggaaauguaagguuauuuuuuucuaauuauuuuuugauauagggagaacuauaagaaaauaauaaugagcugguuuucaugguuggaauuguauauuuguguaauuuucuuguguuacuuuuuaaacuauaacacugugcccuaagcauuuucccacaccaucauuuuuucaugccuguaggcagucuaccaugaugaauagacaguuguuuaaggaugugaugguaauggaaagaauugacuuagagaaauuuuguucaaaaauuauuuuugucauucccagcccuggguggccucugugcucguuggcacaaaaugacaaguaccuuguuggcuuacugaaagcccuguucaguaggggcagguucacaggaaggggacacugcugugaguaguggugguagggacaggaacagguuucccaugaaguccucaugaggacauccuguucauggguuagaaacuugcagcccaauguggccugccucucuugcugaaggcaugcugucccuucuguaacgacaguuuccuuccuugcuuucccuguucuguguauuuuuguaagcugcuuuacauccuuuuucagcaagacagauuaagaguaaauaaacauaacuguucucucuaaugcugugcauuuagcuuguuccaauuucuugcugcuguaguguggaauaucugugcauugagugcucgucugaacuggauuauuuccugggacugcauuccuacaagugaagcucagggccaaaggguauguacaccuuuacaugucggcucuaggaugccuaguugcuucucaaaaggucauaccagucuauaguccccaugacagugugggagagaagaugggcacacugaggccauccugagugugguguccuuuccaagccuggcuccuggcucaaguuagcagcauggcuuuucaccuggcuguuguguccuacaucauugucaccagaguugaggucuguccugccucuccauguaaaucuuguuucuggggggaggugguccugucgccagccaguccugccugcgaggacugccccucugcuagacaaugggcacauucagacucaacucuguuuucaguuauuaaaaagcggagccggcugucugccugagacuuuaaucuuugagcuuuuauucccucucuuuucuccucccccagccuuuuguuugugcaguuacgaacugagcugugggauguguggguccuggagucugaguauguugggccuucucuuggcagugacagagaguuggagccugagcaguguuauuucagaguaggcaaggguggccauggaugggagggcacacagagaggagaggcuggcuccagcagccuuaggucuuugcaaaagcuaugugguuuacauggcuguagggcagaggaccaccacuucauucugucccaaugcuuagucaggacacuucugcccuugaauuacuuagucuuuauaaagccuacuaacuuguggccuguuaacauuuccucuugggaaauaguugcugugguugaauuaaguauguguauauuugaauaaaugcaaaaucccaagaaaauucuuccauaacacccucaagacuccuaaaacacacccagaaugucccaaacccaaaaaaucuuccaguuuagacagggcacucugguggucuguaggguacuugugcccuguaguaacauuuuguccaggaucacuaaacagcugaagaucaguuggcagagccauaauucaguccuaugggguacagagacacugaccucgcucuuggagggacacuagggcacuccugcucguggaaacuuguggaagcacuuuuguuagccugaacucuuucuucucuaagacaugggcauguuucugccuaggacuucacuuuucaggccaagcaagccuuugacaugaacaugggacacauuuuccucaccuuuccccccucugauguauacauuaaaacaaaacaaaacaaaacacuucaugcacaugugugagucugcagaugccagaaaaggguguuagaucuccuggaacuggaguuacaggcuguugcaugcugccugacuuggguucaggcaguugaacuccuguccucuugaagagcaauaagcacucauaacugaguacagccaucuuuccagccuccgauguaucauuuuuauaauugaauauaucuuguuuuuaagcuuuuuuuuucagaccaccaaguuccccauacuuagacauucuauaaaugguucagagaaagugaguguugccuugccuucuauuaguagguaacagaagcgagaguggccccucacucgguugucuuguucccgugugcacguguaaggcuguaugcuucacagugcucugggcuucaccgacuuugcacuguuugccuccucuuaguggucagcuucuuucagaccuucagaguucagcucuccuuagugccauggcuguaggacauggccugugucugugcaccauuuaacccacugucagccacagguguuugggaggccuuucuagaugaacauaucuuuccgaaccuuuguauuucuuucuuagaaguagaaauagcugggcagcuguguuguaauagauguugccaaacugcucccccuaaauguauugauugaucguuuuauaaaaauaauauuuuaagugaguugucaucuggaaaaauaaaagccuugucucuauuuauuuguuuguuuauuugacuuuuugcgccuuggcaaacuaucauagacacuuagguuuguaaacuuggacuuggaaaccccagccucaagguuagucagcuuucauccauuuuagacuugcaaugugcugcuugccagaccuccaccucuguggccuuaaccugcagaggcauccagaagacuucccaucugaccuacagaagaauccccccuguggucuguuuucagccaagcuuugguagauaggaaacgaauaugugcugaagcugugggaaagugcuauuguggguucauggaggaaugaacuugaugcagguuuccuaaacagccacaacugcuggaagacaaaccuauguucccugcaguuucucuuugucuuuaugccaccuugacugugccagcagugugucuucuuuucagaaccucuguggucacuugauaacugugucugugggauuggcuagagaagcugaggaccauauaguuccuuucauuccuggguugaggcaguuuacuguugcuuucccauuggcugcuaagaaucagagguguguguuguucacagccuacauuguaccccuuuuacuuuuuuaauuugcauuucuuuuugggggaauuuuuuaaugacucuauugcuccuuuguacaagaacacugcagaaaccccucuccuuuguuucuuuguuuuuguuuuuguuuuuuuguuuuuguauaugagugcacuguagcugucugucuucagacacaccagaagagggcaucagaucccauuauagaugguugugagccaucaucugguugcuuggaauugaacucaggaucacuggaaggucagugcucuuaaccguugcaccaucucuccagcccuaauuugcauuucuuuuacuuaacuaucgucuccucgaagucauagauugaacaugcuaguaucauuuccuuucauauaaguuagaauaaauaaccacuacaguaaaauuuguaugucaccuaaaauauagugcauauaaauacacauaggcaaaacauuaaugcauauaaaaucucuaaaauaugguggauaugucccauacuuugggcaacuucauacucuuuccuaaugguccuuuacucuccuuccugcccaaggauuuggagccaaacucugaaaacuauagauaggaguuaaggggugguaucugaccuagcggucuggguauucucugcaaagcagaggucuguggggagccagaaucgcuaugcuggggagagucugaaggagcuauagaacugcaacauugguaccucugggaaaucccaagagggagggaugaaagcccuagacuaggagcuagccuacgaacucgggacuucugcauuuauggucucuuacuggcauguguaagaauaacugccuggcucagcaaaggaccaaacucagucuggagugggaagugcagaugcacuuaccuggcauggguaagaaggagccuggugggcagugcuauuuuguuucauuuaggaugaauaaagcagucagcucuggguaucucuguuuguuuaauucuguaguguucccccacaacugguuuacucuuaaaaaugucauaaugggcauaaguugaaagaacucacaguauauuuccccuuagauguaacgauucuagcacuucccuagaucugaugcuucgaguuuuaacauuagaaguucucauggacagaggcagggcuucacugcauguaguggggccaguuugguuacaugauggucucuaugccagccugagguacauagcaagacucugccucaaaaaccaaacaaaaaccuaaaaacaaguccaacccaaagcacaaucagaaucuauguucuuucucuugccuaauguggcaagcagaggaucaucuuuuuugguaucauuauagggaugaagcuuuuacuauuucugcuaacuauguuauuugcugugggguuuugagggcuuguuuggagggucuaacaggggaaggaugcuucucauagauccuugaccaaagaacacucaguucucgucuaucagggaaagacaucuucuucuacuaagcaaaaagcuuugggagggacacacugaguggugagagaggaaagggaugcucacuuagccagccaggucagccaggucagcucucacaaucaguaggggcacagauguggcaacuagguuacccuccuguccugccauggauuuuauguauguucuuuauuguauugaacauucacaccauguguaguuguggaaauugguagguuuuuuuuuguuguuguuguucuuguuuuuguuuguuuguuuuaaauaaaacugcaucuacugcaaugaccauagagauuuucuuguucugcuaaauuacaaauggaauguuuugaauguuaaacauaacacuuggcuauaauuuuucuguuuaagcauuacuucaacuuuauagcuuucugcuggugguggugguguuuuguuuuguuugagacaggguauuagccuuggcuggccuccaucucaguauguagcugaggaugaccuagaacucuugguccuauugccuucacaucucaaaugcugggguuacagggcucuaugcguauuagacaggaacucuacaaacagcuacauuuccaaccacucaugguguguuuuaguuuuaucccaguucuaacaagcucaugcagauuuuuauuuucuaguauaaguacuaugguacaaaagggugguuaugcccaaagguagaaauuugaggcagggaaggucuuuguuccaucagugccauucuaauggccuuuguugaggccauguuacuugguuugauuuguagcccucuaguaaugcuuauauaaaaccugugcuauccccacuucccaccagguaugcacaggucuuagaguugaaucaugauaggcuguuugcuuacaaugguguuguuucuacuuggacagaagaggaggguuggcaaccacauaggaaaggcacuaguucuagggucggggcagugaagguuagccaguagugucaguuaaguuggacauucccagucaggcaaacauagcugggugagguucugauugggcucaggcaggucuuacucaagcccucucucuuaguugcacucaaaaugcacagggaaggcaugggcaccccagggugugacccuucuacagacaccugagcaagugaucgcacauaguucauauaauccugacaugaaguauggcugagggaauggaggucugugagaagucacuaccugucaaggauggccuguggguuuguacugaagagagagaacuuaagucucccaaguccaauuggaaauucauccagccauguuugccugauugcgaaugccaaacuuaauuauaggagauuuauuuaucuaggcauuagugagaagaaagggacaugccugugacacaucccugucagaugaagcugacucuugucagcuucauugcuuaaguuuucagugagaaguuggcugugagcagaaguugguagacuuacuaauucuacaaauucuauacuauuagaacuaaaaugaaugcuuaagaugugugaggugaaauuauucaagaugauagcaacucucuucuuacugagucgucuucucuuagcuauucauuuguuuucucacugaucuguuuaccuaaaaauugauaggccucucuucuaggccagacagauucucugcugagcucgaggcaaggaauuagcuucugaaagcuucaguacagggaaugcagacauggggaccuccuuuucagugccaucaagcaggcuaguggaagggagccauagggcaguagugggcugcacugcuggggcaaggagggaccuaaagaggggcucucaaaccacuagaguagagggucuuccuaaaguuuaguuaauucuauugcagugaacucugccuaaggagaggccucgagccucagcagauggacugcuggucuaggcaguacuugucugcaaggauccuuugcccuguaaacauuuuauuagaccauuaaguugucuucagcuucucccacacccacuaaugccugagaagacuaagcauaugcuuccauuuuuaugaaaacuugccuuucuagagcuuauucuuuguauuuuuuugcccuaacuuauccagccagcauccuuauccuauagaucuggccuggaagagaggguggccuagaccuaacuccaggguccuuguuuugcuaaggaguccauuggugcuuuauggcuggaugccuuuguaggcuguucuuuuuacagucagucacugacacugcaguguaggcagugggaugucucaguguacuaauguuuuuagaaccuuccucugucuuccuuuuucaaguugaaauaauauccugugaggauuuuacaauacagucuaauaggggguucaggaucgcuacuaaagauauagggggugaaugccguguguaaagaauugcaagcugaaaugguuugggaccacaccauguaggauacuuugguucuugcagagaggggacugagugacaagcuuagauccugggcccuaagcagaaucuuugagcucccugauggugucuguaaagagccgguguuggauucuuacgcucuuuaggaggcagaaggcacuugucaugguaggcuaccuuggaggcguuuggucagcccugaagacuuaaaguguaaugaaagcuuuggagcaaaggaugauggucuaugaaaugaaacuggcuuagggccaaccugucacccaggauuauaugagcacagaacacauuuauuaggaaaaugggacuaucguggccagcaugggcucuuuuaguggcuacgggucucugcaaaugggaagauacucuuuguuuugaaaguuaggcuagacauuguaaucacaucguccauccaccaaaguugcucaacacauauuauuucccuuacucauccugacuagugagguuggugggcuagugugccucucagauuaggaagaccccacacuacuuuugcuguucacugcuucccacaaggagggagaaucuaggauccugaggacaguggucaguaggugcuggagcccuuugcagacaggcuuggcucacuggacuagauugcuaagaccuaccugccccacaucugaaggagcucuuuaagcucuaguuuuuaaaaccucgccauauuuaaacauaaaacaauaaaagaacauauuuucugaggggggugucaaggcucauugcuccauuuuaauacauuaagugugguucugcccucccuccuccaucccucuucuccaucuuuaucauuuaacccuuuuccauuggauggaagccaggugccugagugugcugccuccuguagcuuccccugggagguggacugugaaggaauggcaccuuguuuguagcaucaagugauggugcaugcucagugggguugggacuacuuauugacuuguuaggguagggucagcuuaucauggcuuuccucacagaugcaccuuagucaucccugcucccagugcuucucagugcuacuggggagauguccauggucauuuagcugccagucucuucuggcugacuccuugaaugucagugccaagcuggggggcaauaguaccugccuguauguaugccuuccugucugucucuuuuguuuuguuuuacuuuuagagagaugacagguuucuucuccccagucaagacuuuuuaccucaggaaccugaacugcuacgacaagggaaacuauagguaguugaacuggggcugcaucucagugagggaguuacuugcagcagagaggcucacagagcagauggcucagaguuucucucagagcuucugcugaggccuugggcguaguuggaccuauaaccaaccccucuguuucccucagcacccuugggcuacuggugugaauuucacuauauguaaggugacccugagcuccacucccuuccaucuguucaucaucuagauacaggacaccaggagcccacaguaugggaggagguaggcuucuaaaauggacugcauuuugaauuaucugggggagucacccauuccaugaaaggcuggugccaagucagggugcugucugaaucacgcacccugagaauccccugggaaggacuucccugaagugauuaucuccaugugaaucgccuuuccucuggcacacuguggcucugggguugggaaggcaggcagguaagugggguuugggaagcauacuggguggaaagugcuguuacagccuccucucccaaaguuaccguagagaccuaguuuagguaggacauuggcagagacguggaggcugacucaggaacugggaucugcaugucugaauagacaguucaggcagaaagaccaugcagaaacuugggagacuugguaugacaagcaucagagagcugcacugggugaucaagacaauguuucucgauuguaaucauuuuagaaccaccuauauuauccccguucuuggcuuaauauguuuuuauaauccaauuuaaaacuuuuaggucauuguaaggaaauguuucuccuagcaaguagaaaaccaaugucuuuugcauguaggagccccaugucuguguguagaguucccugaaagcaaauaguuaucagauuccagccagccauggguugugaguuugcuccauguuuuggguuuguugcaaagaaaacuuagagcaguuuguagaauuaagcagauuaugcucccaguugggacuugcucauuguuugaucagaaaaguugaaagagaccaaaaaguuaauaauuuucuuacacuauaaugccagaucauuacaugaccauaaauguccccuaccggaagauuuugcuuuagucacugaugagccacugaugguugugacuaggagccuucuaugcucuaaaaaaccagcauguacaggucuguggaggguggggugucaggacuggagaagccugugucacagggcaguaaccauagugauggaaggaucaucaguggagggggugauaucugacaguuccugguagugcauaguggccccaaugacgaagggagaggguucauagaaacuagccuggggcaguggggguacauucugguaaugagauuucugugucgcccccccccccaacacccauacccacacccaggcagcacauguaugucugcaacucaggguugcuaugauagaaaggacaacugaguuccauguuagaucaaccuaggcccacccuuugccuguaaggacuuuaguuccuguuuggacaaugaaauuccugaacuauggagaggguucuuaguugguaccuaguauaacugugguacagagcagaugccagaaacuagcagcaugggguuuaagguuccuucugguuuccuaguaacauuuuuuuggagaacauuaucauuaaagugagcagauuacugcaugcuuuccuuggagugaaagaagcauuggcugcugccugucagauauuuggugcauguggaaugauggcgcgcuugcugcugcuggggucccacauucaggcaucaguccagcuggcucgacuggcauucuuuaauuuuauuauugucuguuuccugaacagcaaaagcaaaaagauccugcuagaccaacuuuaaaaguaucaagcagcugagaggaauaguggcguucucacuaugcugaugcgagccugggcagugacaugaccuuaguuguuugcaaaguaggauaaauauuacggugcuauuaguauccaguuuguagggugccugaugcagagauguuauauacugagaucugacuagucuuguguguguaguaugcuuaaacuguggauauuauugguuguccuuuuuguacuucacagagauacaggaggcuauuaaugagauguuaauggauaacaauauuacucauuuauccuucauucuuccuucccuuccuugcucccuucuucucucccuccuuccaucccucccucccuuccuuccuuucuuccugauugcuacaguaucuuaaaauauuuaggagccaggcaugguggcacauuccuuuuauuucaacauucaggaggcagaggcaaaggcagauagaauccuuggguuugaggcccagccuggucuacauaguaaauucuaggacaggcagagcuaugcagagagaccuugacucaauauauacuuauauaugaaaucacagucaguuuaccuuuguuuauguguuucuaaaaauguugccuuuuuuuaaaguuacauucuuuuuuuaaaauuuuuaaaaauuuuugagcacguuggcuauggaagaugguucugcaauucuuugagccugggggacugugagcuccuaugcagagacugacucucaucauaaguauuccugacacagcccuguacccugaguccccuuuguuuauuguuacaucugcuucucacaugcuagucagagaccacuuccaugcgugccgucagccuuaugaaccuucuuguuaaagugagaugccuggaaagacuuggcuguuguaccggcagcccugugcugcccugccuccucucccagauacagugugcaucgagugagaguacaaaugugaugggaaauuuggagugggcagaacagucggucauacucagagguguucugaugauacuggggaagcuggguguuuguguaacuggccuuuugucucaugcuauuagggauggcuugcaguaagacuaaugguaagauuagagauguggcuuuuguucuaagaugauggaguuauacuucagacuuuucuguggacuuggauacugagccccagccaccacagagaaaacaggaguggcaugugcaguacagugcucaaguugaugcagugcuggcugggcuaugcauccaccagagcccuacccuugcucuccucagugaagaggaacucuugacagacugucacugaccugcagcaaguugguugcuugugccuacugcuuggcuuggccauugggaagacaaagauacuggaguccaggccuaaaguguggugacuacugcaugcaaaaugggccauguuguccagggccauguuccugucugaguucuugguucuucaccuaauguggggcuggcaauguacugccuguggguauagagaucuuuuucugaguauguggcaugaaugugguaggugacagugcuuuugcagcccucugaucugaaggcuuuggcagguggcaugacugcugugaggcccagcuguuuugucuguaaacagaguggugacacuucccucagguggcacuggcuuaggacucaggauuuggaagaugucauaggcaagagcuccugggaggcagcccuugagguguaagugccugugguggagggucaagccaagcaggaggcucagcaugcacugaggucucuucccaaaagcuguaugaggggguacagugucagaccuauuuuaaugcauaguagaaaaacuaaaguaguacacaaucauguaauuuuuaugaauauuuuuguuuggggguuacuaagagaggauuuuacuguauagcuuuggcuguccacugggauuaaaguuauggucauugugacuagcugcuuucuucaguuuuuucaguauaaaaaguuugcugacuaaggauauaaacaccaucaauaauaaaggaggcgagacccuucaaaaguacuagaaucaggaacgaggccccuuuuucccucagaagggcaggcagcaguauagauuaaaggaaucuagagagaucuacccugaaaaaaaaaaaucaagaacuguucugagagacauaagugauaaugaggaauuugaauguaagaacugacuagcuaauguaucuuaauguaucauaguaucuucccugauucugagguguuugaagacaugagugucacuuucuacaagcuacuugaaaauggcuuugaggccucauauacgcagacauaaacauuguuuuuagauuuucuuuuuguguacuacaugugcacaguaccugcagaggccagaagagggcguuagguuccauggaacugaaguuacaacuucuugugagccacuauguugguacuuggaacugaaaccagguccucugcaaaagcaaguacucuuaauugcugaaccaugucucuagccacucaacacagacacuuuugauguuuuguugcauuuaguagacuguacauuugaugguaguuccuuaaguauauaucagagacagguacccucuuagugcaagaacaccauaugauguuuuuacaguaacaacaguacauuuuccaguacauguuccuaucauuaagcucucucucucucgcucuguguguguguguguguguguguguguguguguguguagcacauaggagugcacauagcagcucagagugggugagagcaaaguaucguccuguucuuucagauaacuuuugggauuuggcgcaagaugacugauguuugaaagugucaugcuguggagcuucucuucaaguccuugcugagguuucauuucuggaauaugucucuaauaauauauuauaauuagauaagaaaaaguuuugaccuaaggaaaaucauuuagugacauaucacuaauacaauguaacuugguugaaaaauaugagaucaagacugucucucagcuguauaaaaugagaugacuaaauuaaaauuuuucucaaaucagcaaggcagaaauucauucaguagcaauauuuucagccaccaguuaagauccuuauuaaauaaaaaaaggaucuggcccaggcccagaggccaucaguuagcccuggaauauccaugauuugaugugggauuacagaguuaccuggaucucuuuauuuccaaagggaaaguggaaacuaucucucugugugucaccuaacagucauaauuaagauuuuuucuuuuuuuuuacaaagguggugcauagcaguugaugguugugaucuguguauuuccuagugugcaguugugaggaaaugccugcacaguuggagaggagacuguaauagcaaagccaccaaacauaguaagccaugguugaagguggaugcaagagaguagaggagccacggugaccagcugaaguagaugaacugucucaucauuacgaccaugacaguguuaguuuauuccacaccacaucuagcccagaaaugcauuccuuucaccuugaugccuccugccauguggcuggcauaugaaugccauaguugaguuucaguuguauuuuggccuuuccuaagggguucauagauguauaucuuguuuugagguuguagccacugauguuacugagaugucaggggcaagguguucacuccuuuuugcucugcuugcauuugggaugagacugagcucguggaagugggaggcauggcuauccuggggguccagauuccuagucccuggguuuggauccagcuccacuuucuagugucuauguaacuugauauaugaugaugguggugguggugguggugauaaugauggugacgacagugauaacagcuuuggcaggucccugagucuugaucagagugugagcagaauauacuugguguaguguuggggucaguagcauagagauacagucuaaggauggaaguaauggugcuucaguugccuggucaaagcauggguugaggcauccuuuuauucauaaucuuagcuuauaaagaacuaaaaguccaccacaaaccacaucuuaaaaccaggacguuugaggcugugugguagcauacacuuuaauucuagcccuggagaggaaggugauagauaauugaaucagucuggaccacaaagcacucguuucuaaaauaugcccuacuuucaaaucuaggagaacuaacuuuaagcacagcgaaaucuggaaccuuuagugauaauggucacugcccaccucuaagguuacacuuuauguugguacuacagaguuccugcaguucuauucucuggccauuuuugacuccuauacagagaaauuuccagggagaucccagagaaguaucagagaaggugacuugcaccugcuugggggcccuguauaccucuggagucaggccaccucaauguugggagagaaugaagucuuuagaacaagaguggccauguucuggcuggaguuacaaaccucucagaaauaggagcuuuucucccaugucacauggccuagcauaccugccagucuucaugacaaaccaagucuuuugcuguuuccuuucuauggagauuguugauaagacugucauguuuaguuggaaccucacagaaguuagacagaagaaaauaaacaagccugagguucuggccaaguuguagaaugguggaacaucaaagcuuggccagacaucaggcuuaguuccuacagggugccuucauggucaccaacaaccagcaggcuucagucuaguguagguucucuguggagaaaugaguugagggcagcucugggaauuaagauuuguuugggagaugcagaucuggcuuuaacccaugcuagagcugguagcuguucacaccaguguuguccgcacaguuuuaccaccugccucagcccaggucucuuaacaaccaaccuacaccugcaccagcucucugagucugucuccuggugagugcucacaagacuccaaggccucaaggggaucuuguuagccugcuuacagaccacaggucuagauuacuccugcgauacucacagugggucuuuuguuagagagagcuggaugugaauugacaccaaaucugcaggcauguugcugggccaugcuaauugaaguucacccagguugaucaccugcagucuggguacuguauggaccucaucccaaggaggggaggguuggaauagaagcaggauccuagcucuuacccuaguaugcagcauagaugguaucuugccuaccuucucuuucggcagaaaggagcuauaguuugccaggugacugcaucaggcuuucacacaaauucccugaucaucuauacuagcucucaguccccuaugccuggaccuucuucuuccaaccuguccuacagacugccgggaaggucugaauugagucuaggaaccagugucaugucagcaccaugucccucuuuccaccucccagguaauacuguguugccuaggcauagucuucuguauuuuaacgugauugugaccuuggggggaggcggaacagcaucuuggggauagguugauaugggugccaagacuuggucaaguggcugucaucugagcacccuugguguuucaagcccugugccugauagaguggaaauagugacccacugugaccacucucugagaccuuucuucauucuuguucugcauaaaaggcucaagagcuuccuugggucgcuuugucuacucugcagaucaguagaaagagcuaaagcugcagcccacauccagggaacaggcugaggccaauccaaaugcaaccuaagguuacuuucugaugucuuagcugcuuugggggaagcucuucacggggcuacccuuugugauucauguaaguaaagugccuggagaaugagaaugggcagcagagagagggaaaaaaacaaaaaauaaaaaaaaaccaaaaaaacaaaaaaaacccaaaccgcagaggcuuaaguccucagacuacucugcugggucuggcccugaagcagacauagauuguaaggacugcuccaaaacagcugguaacaggacaccaugcuuucagucuuucuuucuuccuuguugccagaaaaauaaucagcucuguaucuuaagugcuugauggaguagcccagacacagcuguaacuuaaaacaauuuuuguuucaguuguuuaaaauaaacagaugcgcuggaauucagucccaguccgguguccguaccuuugaguggguggccucuggaugcugcuucuugcaccuucaugccaugcuggcauggguuguauucucugggacuucccgugugugcuuucagaggccagggugugaacugaaguggccuuugggcugcauugucacggauccccuuccuccuuucaucgugccgggugcugugcuguacuaguucauagcaugagcaggaaaagguccaaucaccuggagcagaugcuuacagagccucuguaugagggccgcugccuguugucaggaaguauauagcugugggaagagaugccaaggaagauguagaacaaguuucucccugucaccagugccagccuacaugguagauggguucauucguggcacaugcucuagagcacugcauugcuaucuucccugugauuccugguccagccaacuuccuuucccuggcacagugguagccaccucccaaauagucucccugcaacagucuuuucuucaauaacaauaaccccacuacucaugugacagacuacacaucagcaaacuacagaucaugccauuccuccaccuaacggccucguuaggaguaacacaacccaucucaugcugcugccaaccaggcuccaugugacugcuucuugcaccuucaugccaugcuggccuucaugccugccucccuguugcuauuugaacacugccuucucaugguggcacucucuuaugugacuguugcccucucugagacgucuugccuaucguggccuuagcuuggcccacucuuccuuuccaccuucccacggagccuccugccauaugcuuuagaacaucaucccgcaacaccuguucugucccauaaugcuguuuugcuuucugaauggcuuuauguagaaaaacggcuaggcauaaauauuuguuuuuugugucaugaggacaauuauauuuccuuacaauaguaucugacacauagaagauacuugaaaaacuuacuguuuaaugaguuaacauauccuuggaaccuagcauuguucugcugucugaaguccuuugugaaaacacccacuuuuaccuacaguugugccugaggaaugcaguacugcuggcaaauagcaugggcagcagaaagaauaaguggugguaagaacaguggcaagcaagcuuguuuuuaugauugcagaggggucagaacccagguccuggcauaugcuggcuacaugcuccagcaguagcugcacugcagggcuccugugcacuuacuguggggauguugcaauaaacauaucaauguggggauguucugauauggcuccuugggguguguaccauauuuccuuuucugcagcuaaggcaccuaaaggacagagacauaacuaacucuuaacagaguuagaagcuuuacaaguacuagaccugguguuugaccucagacauccaugcuccagaaggcuuucauaagggaugauaccucuguuccuuucaggggaugucaggagcugaaugaauuaacaugguccaucucuacaggaagauguggaggaauagcaguucccaaacacagaaucuucuguuagaauauuuacuuggcuaugaggucagaguuguuaccaaggauaaugucucaacagccguagggaacaugaaaugccaggugacagggcucugagugaugcaggaggucuaguguagcaugcauucuuucagcaggguguagcucacaagcuucugcaccuccucugaauggccacaggcucacucuuucuuuccuugcacagcuuugugcuguuccugcaggggcaccucccauucagacagcagccugcagagcguuuuuacugcacauuauucuuuuuuguuguuguucaugugcuuucuuuucuuuuuccagauagagcuucucuguagaucccaggagcuugcugaucacuuggccagccuaaccaaaagggcaagcucuaaacugaggaggauucucugacaucaaccuuugcuguccacaaaaggacacccgaugagcaaucauucaccaggacaccacacacacacgcacgcacgcacgcacacacacacacacacacacacacacacacacacacacacgcauacacguacacaggcacgcacacauacacucgcaaacuagggugaacacaguaacuuaaaacuauaaaacagcaaggaauguuuaauugugauauggagcaaggccccagcacugggguuacagguguguacuauggguguggcuuuuucuuagcuacugaaccugaacacaaguccuugugucaugcagcaagcauuuuacacaccagguugucucuccagccuugccgcagggguuuuuaaugcucuucuagggccugcucugagguucuaaccaccugcuugauguuaccagacaaagcaauauaguguuacuccacuaugcacugggaaacuggaagauggugacaucuugggacauuuguuuuagccagcugaugguggcuuucaguuaggacuuguaguuccuuccaaaggauugaguuuccaucaguguuuggaugagaguggcaugauggugugccccucuuagauguauugcaucugccugguguuuaaccaaaccuuuuucagauuccuguuaagcaugguaggccaugguagccuggagaagccucaugcuccagguacauugacuugcuauauaaagugaagcaguacuaaggaaggugacacaugcagccagacacuaaugaggaaagaauaacagaucuacagcugugcccaaaaugucacacuggagucacaagaaucacuuacuacucuuaaauuauuaucuacuuauugaaauuuuuaauuuuuuaaaagagaauuuuacacgagugcugucuuuauguaauuuuuauacuucccugucucccuuccaacaccuccuuucaaauucauaaccuuuuucuuuauuauuguuacauaucuaugcauguguguauccauacaaccugcugagugcauucaguguugcuguauccugugggguuggauaaccuacuggggguuuguucccagcgagggcugauucucccucacugagcagcucuuggcucggcaccuggagcucguccuccaucuuugcuggucuaguguugagauuucauggauucagcuuucuugucagacauagaagacauuaucucuuaguagcuguccuaguccucuggcucucaguccuucugccccucuuccuugugguucccgauuuuagguguaggauacagaugugucagucaguuggguuaggcacccuacagucaguuguucuuugcgcuuugaccaguuguggauuucuguaaugagcucugccuccugcaaaaagaaacuucuugugaaacuguacuugucuguggauagaaggauaagaauugaggauacaguuaggaauuagguuguuuuaggaaaguggcaguaggagaucuuccucuaggguucuuaccagccaugggugguuagcuagguuacaguaguaggcaugaauucccuccuacugagcaggccuucaauuagguggcuguugaugauccccaauaucaaagugccacuguugcacucuuggggcucuccuccugggcugcacgcuguugugccuuguagguuuuacagcugggcaggacuauuguuuucuuauuuauucccuuggcagcuugaauagcaccuucagauacucuugagagcuagucugugggagaggcuuccagguaaguucuagcucuauucuuguaaaucccauguccuaaguauaguuuccucagcaauagguucuucauuuuuuuggucagcagccaagggcaauggccauaaccuauauuguuauguuuggaagucucuuggacuuucaugaccagcaaggagguuucccuugcuaaaauguuuuccuaggacuuuccuagaacaccaaacauccuguguuccucugcccucuguauaaauguuggugaaagugucagggaaggaaggaguccucauucacuguugguggaguugcagaccagggauagccaccauggguaucaguauggagaggucuccaaaagcuaaaaguagaucugccauaugaaccgacuguaccacuccuuggcauaugcccacaggacuugucauccuacucugcagacccucccucagccauguucacugcaagucuguucacaguagcuaggaagaggaggcaaccgaaaucucuccuucagcagaugcauggguggugaagauaugguaaauauacacaguggcauucuguuuggcuacacagaaaaauaaauuaaugaaauuugcaaguaaauggagggaaauagaaaauaugagugagguaacccagacccagaaagauaaacacuacguguuccuuauuuguggaucugagcucugacucuucagauguggcuacauauccuauaguaaccacagaaaccagaaaauaaaaagggaccuuggcaagggggugggguggugcacuggagagagggguaugguaggacacagguacugugaaagcagaaaugggaaaagagggccauagccugggaggaaagacaggcugcaugcuacccucuucagggaguuucugggcucaagugagccuccuuccucagccucuugaguauguaucccuccuucccucccuccuuuuuuccugcaguaucuuaaaacauuuaugagccaggagugguggcacacgccuuuuaucugaacauccaggaggcagaggcagacagguacuauggguauuucuaguuucagagugagagaugggacuccuacaagaaacuaaugcaagaagcugguagggugcucagcucuugggcucugcaagaaaauggagcucugcuuagccugagaguggagcucguggcugugagaaucuugcugccagggguguacugagacauuccuucaucuuagaggaaaugaagguuuuaggaagaggucaggggcccagaaccuugacaaaaccagaguccauacagugagugagucacauaagaaggacaucagaaccaguuggcuagaagggucuaauaaauugugucccucacaagaaccggcauuuucuauuccuugggugggccacaugugcuuugcucuuaggaagauugggaacagcuguccugaaucguugcuguugagucauaucugguccaugggccagcgguuggcgccucuggucauucagucccuuuuuagcaagacucuuggggaagugcaugcucagcauccuguguggugcuggcagccuggcuuccguggccuccugcuguggccuuagcccagagcugccucuccugggcuuuuuagcuccucuagaaacuuuggcacuugcuuagcauaucuucaacuuuauuuuucucuguuauuccucugaguuacagcguguguaugcaugugcaugugucccuacagauugugcuccuuggggacaggaacaguguuggacuccugaguccuggaguucuauccauggaauaccugaacagguguucagaugggagaggaccagacucauuucagugccugguaccagguggaacuuggguagcuaguuugcagguauuaggguggggcaucuuggagaugaacaguggggaggagagccucgauggagauguuucccugacacacugaccuguccugccuaccacuuccuccaggggccucuguguccuggcaggccucucauugauuucaucccuaaguugcuaacuguugggcccacaggacauuguggacucugcagcccuucacagugagauguguuccugcugccccuucugaaaugaggccugcggugccucuucaguccccagucuccauccaaaaaaaugucuaauuguaucuugaacucauuuacauugcuugcuucaauggccucacuuggcagcugaggccguaugcuaauuccauccuuuucaugaaggaauucugcugauuuuacuugcuuuuuaugguugauccuguccuuucuucucccccugugccccccccccccuuuuuuuuuuuugucugcgcucuccaggcaguuuuuccagcugcucuuucacuggcccugacagccuguuaccucuggcuaugcuucucuaugguagagcucgguccucaguccuggccuuucugcacuuccagcuuaaggcuagugaagacugccuugcuguggcuucucuacaaaaaaggacgguuuccuguggccuguggcacacaucuuccaggacaugugugugucugaggccguuaggagggugccacagcagcaagagccuugggaaggagggccuggcuucuacaccagguggggccuauagugaggccuagagcagucucugcugcccugaguugagccuuuaucugcucauggauagaugaggaccgauccucuucauucaguuuguugaguguuuuccaaguagagaagcccuggaaugggaucuucacugggcugauccuuacuugaccuugcacuucaggggcacagcuguucuccuuuugguuucuauacucauacaccuuguuuuguuugcagugcaggggauugaagccaggccuuacauauguuaugacacaaccacugaggaguaaaaaaggguuugaccauugcgaugaggggaggggggugcucuuuguguggucucaggcuauauaacagucugucaggugauauacagcuaaauauggagaccacauuagcagggcugugaaaaguugugauguucuuguguugaaaucuucccaccacaccucucuuagaaguugucccugcguugaguaacaugugacuaaccucaaagugcuagaccacucuggccuuguaauacuuuucauucacuucauguguaaguguugaauaccuacugugugcaggugguacaaggggaaagagcacgagucccagaagcugcagaggagugagcaguacagcagaacugcccaggggcaugauggagcugagggaggcugaugugagaggcacaggucaaggugcauguugguguuucaagagugagucuggcaccagaacuggggagggaaaguagucaacucugguagcccauuuggaggucaaggugauacucaaguuuguggccacuuugaaaucagagcucaccaccauguuaccuuuaguugacccuucuuggcagcuuccauccuugcccucuucaagcacugaagggcucccaggagcaaggggguuccugugagccuguaugcugguacucaagcuccuucugacacaguagguaaaggaauguguuuguucuauuucuuccaauaugccuuucuagagaacauucucuucagagagcucacacugggagcugcuggccagacuuggcccauaggcauguuugguuugggccauauaguuuaaacauuuuuuugaauuaguugucaaaguuuaaaauuuggcaaauuuuauguaauaguccagauuuuuggcuucucuugaaaagugggaagaucuggcagccccaggccugcauuccugccugucuauggugggcaggagcuggagagacuguccccucuagcagggcucaggaguuuccacucccuguggucuugcucuuugcuucaucaccuacaugaugcucccacagccccagagguguugauguuuugaauuacuguaccuuaugcacuccauuccagaaauguagggcauuaaucugugagaauggucuccugucccaggaagugguucugggcuucagaccccaggugagggcugcaaauucaucugggagcuuuacagugcccagcaggugggagaagcuaauguacagacauggaaagguucuuugacagugucacuuagugcaguuggggaacugaaguccagugugucccugcgaagccuguuccacaauccacucuuaccuaacacaaugucccacagggcugaggugugccuggaaccguaacgguggaaaggcucccugugggauggaucacaguucuguguugagaggaagcggccccauggaauagaccucaggcagagcuaaguuaggccuagugccccacauucaagcugugguucgugcugccuccugccucccuccuccacaugacugaguacuuucuauaugcuaagcaaguccugacuuuucuaaguccacauugcugaggcaugucugacaccauguccugccaaauuaaggccuccauagcuaguagaugguuaggaacgaugggcucuaauugcuuauuuucacaauggaauuaacaugggcagacccacacaguuaccaacauuuugagaaaaauaaugacuuagaaaaugaaucagguguaaugguauauaucucaagucccaacaacucaggaggcugaggcaagaggauugcuggaagccaagaauucccaacaagucuggguaacauagugagaucucgucucuaaaacaagcagaaugguacuucccaggugucuugguagcucuuacucucuccuguuuugagggauaaggugcucuccuaaaccacaugcuguugcuggguguaugacacgcugauuugcaguggcuggagcugugcugguuagauggaugcuggccagagagcaagguaucuugugaaggaucaccaauuggggaccauugcaggauuuagacaggaguccaaacucugcacuguggggcauucccccagguccuguucaugaccccagguagaauggccuguggugauggaucaaaaauuucagaaauuccucaucccuguaaugugcacugggcccugguuggccaguaagccugucuauucauuagugucaggaagguguccaggcuucauguugguacugucugguccucugugcccacuuuaucccagagccauagcacaaggucuguguuuggaccucagacaucaccaugugaaguuugcuccagcugcugacuccagcaccguucauaguugcauucccacauccccuuucacugauuguccagaaguucugcauccauauuuggagauucaucuguguuccccuuccucccccagccccucaaggugucugccaaaagucuguauaacucauaucaucucccaagcuguuauaguauaugaaggcagaggauaacuuaguuauuuuugaauacagauucuuagcagaaguaagauguguggugggggaguuuuuauacucacugcaugaaauagacaauauuuccugaaacaggagauaugaaccucaaagaauuuaaaauaaaacauucauuuuauuauuuuuuuaaaagaaggaaaacugggggggggggaaguagaauagucagucuuuuuauccuaaguacagaugaaauugauuaaaccuuaaagacuggccuccgcacacccgguuuauuaauugaagaauuuccucuuacccagaaugggaaguucacauuaacauugagcuugcccugagugcuggugacacuugagaacugaacauuuuccacaauccuauuuucucuucggugcuagaggaaauccuaaaauggcuaaaaugggggaggggcagggggagcagaacccauacuuuuaaggaagccuucuuucauuuccuuguaaagcaugaaaucaaauuauagcucgugguccagaauuauuuuauuucuacauuucaaauuccauuuucugcuccuucucgcugcucuugaacaggggcugcacuguuguacaaagucagcugaagagauuaccccagauagacugugacacaguagcuuaaggaagcaagcagccaggcuccccugcugggucaggagccaggccccaugaacccuccugcauccggaagguccauggcgucaccgcuccuguccagggagccucugcucugugugcagacccuggcuguaccccuaacucuugagaaagagcagcaugugcaguuuucagagcuucccaagugcuaaugguaggagguggcccaaggugaggcugguacuggcguucugcuggcuucugggggcuaaagaaaugucuguuguagacugcagacaagcugugucugcauuuaucuaucaggguuuauugacucaugaaagaagaaaugggaggcauaauggacccucaccuaagauuccagcuguuccucccagcuguuauaugcagcucucucccuaguguguugaggcauucgagucacuugcuagucagaggcuggaagagguuaacugaaggggcuccaccuaugucuuauagggaagcagucaucaacacugggugggugacaacuucucagugcagcuacuuuggggucaccagcacuucauccaguaaucucucauucaugcuuucuaaguaaagucaauaaacucauugguuucccaggggacuuuggaaucauacuuugaguuguuguuauugaggcuggguagauguggauuaugucucugccuggaacucucccagcccuucagcucuuggucaguagugcaauuuccucaucuguaaauggggugagucagugccaggcacuguuaauucugucuuggguccuuuuacuauggucuguauuacauuguuaauccaauagguaaaacauguuuuuuguuuguuuguuuggguguuuuguuuuguguguguguguguguguguguguguguguguguguguguguguguuuguuuuuucaagauaggguuucucuguguagcccuggcuguccuggaacucacucuguagaccaggcuggccuugaacucagaaauccaccugucucugccucccaagugcugggauuaaaggcaugcaccaucacugccuggcaaaacaugggauuugagugugguuuuacugauuuuucccccccugguaguucuaggauaucuucuuuuaugugugggcugucuguguuuauuuucuuuccuccucaaucucacuucaccuccuuccuccucgaaccuaugagcuuccucucuucugucuuugcucaaaaaauggguacuggacaagucccuuccauugaccugcuguguauccaagccaccuguccuagcauaguucugagcuugccuguccuguguucuugcccagcuagaaauccauuugcugaguuagguguuugcuuucuacuuugcaucucuggaucgugaugggauggaauccuguuguuuuggccgugcaggugugccaagcucuuaccauagacuagaacugugggagugcucagucagcugcuagcuguugaccucucuggcaccguccauuaaguuguugguguucuuaugauuaguuuaaacuucaauccauuugaagcauuaagguuaguaguuuagugugauuguuaggacuuucuucagccuuuagauuugucuuuaauuuuuuucaugcagaaauguuugaguuuauguugacaaguuuaucgacuuccuguuuucaccucugagcuauguacccuacuaggguauguuuuaccuuaaaguuauauuugcuucccuaugccuugucuuccaguacuuuugugucuuuauguuuguguguguguuuguuuugagacagagucuauguaucccuggcuggccucaaacucauagcaaucuaucugccucugacucccacgugcuguuacugaaaguaugugccaccaucccuggcugaaauauuuuauuaaauuacacuuauuuauucuguguuucuguguauaugcuuguguauaucaugacagguaggcauguguucggagaacagcuugcagaaguuuguucuuuucuucccgcuguguggguucugggaauugucuuaguggcaagugccuuuauccauugaaccaucuugccugcccuuauguuugaaacuuugauuaauuuggaaucaugguguaaaguauaaacuggagaucacauuuuauuuuuaccaagaugcugucuguugccccuaggucacagucgagaggcuguccugauuuguagauaaagagcuuggcgaacggcggcggcuacucacuuguggcaucucagccuauaacacugggcauugugugcaugcccucagcucuggaccuuucagccaauccccagccucuuucucuuuuggcauuuuuugcucuugauuggaguccaacuccugcuuuucuuguccauccuguugaaaauuucccuugaucucuuacacggccucccuuuguuguucccucuguaccuccucugcagacauggcuggcauuguucuucugcguauguccuuagguggugaugacugcaauggucucagauggcacgugugucccagagaacauuggcagauugucuucacuugagucugcucuccuuccuuugccaacugcuggaccuugcuuaccugcucuuugggaugucuccagguuccuagaggucucaggaaugugggauucuggcgaacagguagcuggcgauaggaaaagggaaaaaaaaaacuugaagucagacaacaguuggcucuagugucucuuuggcuuugaugacugugcagguuggucaucagguuugucccuaggaaguagaagagccucuaccacauggagcugaggugaggaucagggcuaacugggaagucacaaguucaaacuugauagaagccaacacugguguaaauccagggcagggggucauuggaauggucugcauaggguguagcucagaauucaucuuuguucucagggauccucucuuuagcuguguuagauauaaguccaaucuuaccacaugugcuaauuuguaaagguuuuauguggacuuguugaaugguugguguugaccacauauccuuaccuuauaacacggugcaggcuaaaugaguuuuguuccaaguccaggcucagcucuaucugguuuauccuaauaguggcugcuguuuugggacuuuuggcugacugggcagcccacaaaucccacuggaccuggguuggcucuacuccuaccuugguauucuggguauggacaucuggaccauguccuucugaaccacuugauccacuuacuuggucuucaaccucaagaacaagagaccuuacugcugcuuuugucucaaguucugggugauggggagaugucacuaucaccuacucagccuuuuccacagaguucuccacccaggauuuggcucagauguuuggaagacccccaccuuuguaggucaguugauagaauaaggauucccauccaagugccagauacagugcuucaugggauauucuaguggagcaaugucaguggacugagcuucauucccuuaaaaucuuugcuccuugaccuugacaagauugucaaccuuucugagccuuacuuuucaucugaggucaaccuguuuaucucaggacgggcagcagcuaaaccuaaaggaacauagaccuccacagcacauguaacaauagcagcugugaaaauagaaacagugauggcugcagacauccuggagggcuguuauggccagguuccauccuaaccuaggugcugucaucauuucccuccuccagagcagagagcuguggugcugguucccagagcccaagucaggcagcccagaacuauguauaacuccagcuucagaggaucagaugccuguggcucugcaagacacacacacacacacacacacacacacacacacacacacacacggugggggagagauaaaaaaaaucuuuuaaaaaauaggauaaguuaucacugcagcuucacauagaugacaacaguauauuuacaguaugacuggguaccuaaaaagucaacagcugaaaacaaauuuuuuauuauuuuaaauuuaauauuauuuccucuucuuagaaugcugauccuuuugauuuuaaaaaaaauacaauuuuacagauucuaaaauguuuaguuuuuuauguaauuuucuucagccaaaacaauuuuuucugaacaguuuuuuccuucaaucccugaaagaaaauuauaucucacagauaauucagacuuuguuaaaugcugaccuuuguaaguuuuucauuauuuuuauuuuugaaaugauuaagauauguaaucuacagaauugaagauuguaauuuuuuaaaguagggagaaacuuuaacccugucauaauugcucugcaaaccuuucaaggguucuguggucgggguggcugaugaaaagcccugauagaugccuaaguauagagggucccuuguaagacuuggguuuuugucuuauuucccacccacucacucacucugucccucuaguuucagggugauuuuuuuacccuggguucgugggaauugggaaggacacugucugauucauuccaugaacauacuagggaguuugaaaaggcaagacaggcaggcuaguuguaucacuuccuguuggcugaucaaaugucugaugaagaaaugggaggaacuaggagcugcugcuggacacuggguauuugccuggagcugaccccaguuuccagcagugcccuuguucucagugcgacagucaaguggcccugaccucugcuuuccuuagaaguucccggugcuggccaugcugcugagaaucuccuggaacagagcugugugcuugcugcaacaaaggccacuuguggaugccagauaagacugcagaugaagccuugcuggcuccugugcuuggguacuggcuacaccaaacaccugggugugguggucaguuucuuuuuuccauccucaagauggaugagggagggacugcuguguggagcucaugagcuagcuagagcucaugagcuagccucuccagcaaccaggcaaguaaggcuuuguggauaguuuuauguacugauagaaaauuggauuuugagaaaaagaacagaggaggcgggaaagcuaacauugcuuaguucaccccaacaagggcuucauaguagggucuugugcuuuacacagagacugagagaccaagcuucaggugagaacucagccuggggucaggcugagugaccaggaccaugggcaguaaggcacaggugagcaucaaaauagggugccuuggucuaacuggagccugggugggaacuaaggacagggauuuguugggcuuaucagguucccacggagacaggcaggcuguacagcacagccuggugagaguucagguacaggcauucaaaucucugcucugaugcauuuacuguguaacacagacacucauuuugugccuauacaguucuguuuucucauuugugaaguccuugugggacugauguucugagaaccuggagaguugcaauugguccggcaucaauguucugcucugagucugugcagacaggugcccaggccaugacccacauccucuuuaugguuugcccacacacuuuaguuccucuaguggcugaagagccaaccacaugaucuuggaaccaagcccaaggcuuacuauaugugggaacacuuguggguggcuagaugcaucuuauuggugagaugggcacagacuuaucucaugggagacaagaacacauacaacuaggggcaagguuuguguagcccaugguggcaggccaugguaaagcuaccacugguuaaggagaaggaagaccacauugaugaguuuguguguuuagggggcaaugggaucuuuaauagaaaagcaacucugccaggucuguguuucauucuuuaacuuaaguucuuauaauauuacuagaucuuaauggaguccuuacacuccuauuugaaauggaaagggauagaguguguguguguguguguguguguguguguguguguguguguguguguuucacuccugccacucuuucucacucuuuuuuuuuaacauucccuuggauauuucaugugugaaagcaaaugcucauucaucugcaggcacacacuggcauaguuagaacacaucuuauucugcccugugcucuucuccccccugcagacuauuuuauaguaguacaaagaucuuuuauucuugucaaugguugugcacuauucuauugcaugguauaccuaccuauuuuaagcuuguucccuacauucacauggccuccaaccucaguaacaauagauguguugcaaguguguccuauguguuuaugaacuuggcuggaucaaagauuauaugcauuuucuuuucuuuucauuuuauuauauauauauuaguguuuugccugcaugcaugucuguacacuaugaauaaaauacccuugaaguccagaaggggacaucagaucccauggaacuugaguuagaagacaguugugagccaccacuugguugcugggacucaaaccuugguccgcagcaagaacagauaguauuauuaacugcuggguaaucucuccagcuccaauuacauauauuuugguacuugucuccaggauguuuucauaucaguuuaaaggucucuggcacuguggaucaguuauguauguuuaguaaguucuucuggauguucuaaaguucuuagggauggauuguggaaagccagucugaggcagugucccuagauaacaacugacuagaauugggauggagaugguuaccagaggcaaguugguauccauugcauaguggggccuuuugcuuccauucugugaaaaggguugugguaauauguucuguucauagaaaugggagaggcagugucucucacacagcaguagagggaucuggaacacugcuuaccaaccagugaauuaaucaaggacaugucucauuugaugcugcuguguacaccuguacuuccagcuguauuguauucuuaccugaccaugcaagauagaagaggaggcuggcaaaagaggacaucuuggccaugucaggccugccuacagucaaacacacugcuguuccuuggggccagggcuuuagcuaguacuaaguaggaguccucugagagcagcaggccaauuacuuuagcuguucucuuuagugccaggcagccaugugaccuugagcauguacugguguguuuugcaccugaaacaguauaaugaagauuaagcauugcuggugugguaaccagggacagaagaccuuuuccuuuccuggcacccuucugccccagcaguagguggggcugaucaucagacucacuuucagagcaagcuucuucagacuugcuagagaucauagugugguccugaaaagucccuaugaggaggucuuguaaacugaggauauaauuaccaucauuucagagagggaugugucucuuuucuugcuuucucuaacuuacaccuuuucucuuucuucuaaauuauugaaaaugccuccaacuuaccuuauagcaugcauggucacucugcuucaaaacauaguagcuggcacucuccuaucacugacaccucugucauaugagcaccuccuauuguccagcucagacaugcuguaaguauauacacagccagccgugcauauagcacuucugggugauccaaccuucuagaaagaacagaagugccauaaccgggguguaggaccaaagguaaugauggugagcaucaggcugugaagcaauuguaggcaacccaauacuguggggaaaagcacucugaaugacccucuuaucccucuauacauugaugggggcccuguacuuuuaagccuugcugucuuucucaguaagggcagguagcuagguauuggagucuuuccugcucaacaucccucuuguugagugaaaugaaaaugagagcagugguccaacagggagguggagagcucuugagccaggcauuccuuauccaaacucagcccugcuguguacagccaugggguccugagaaggccuucagcuuccuugccacuccugaugcucauuugguuggaugagguuaugccagguauaacuuggacuggccaggaaguaucagccauuccuccccaucuacccacuauugcagugcuuuucugggacuaggaugguggcuuccuaugagucucacuagccaacucuucuccuaaccuuaccuuuuauugccccaggugcccagaucauugauuugaugaugcucgugauugaugugaccaagggaaugcagacacaguccgcagagugccuugugauuggccagaucgccugccagaagcugguuguggugcugaacaaaauagaccuguuagcagaagggaagagacaggcagcgauugacaaaaugaccaagaaaaugcagaagacucuugagaacaccaaguagguuugcuaaugagagcucauguguaaggucugggcaggcaggucagccucccauccugguaaguggaguaugccuauucacacagcugcugcugcacuaagcaagacuaacaugcuuuuaagaucccagaaagcacugcagcauaaggaaauggggugcccuuacuugugggagaagcacagguggaggcuggccuccucuggugagcagucuuaaaccugucauuucugagcucugggaaauguuccuauguauguacuaagagccaguuacaaggcuauacuuuagaccucagaugugcgcccagcuuucuagcucuuggaaccgagggcaugggucccaugcuguguugcuccaugagaacucaggccucagugcuagagccuggggaucauguucuccaacuaccugcuuugugaugccuccauugucaacuaggacaaaaaucgaagagucuugucagcucugcuggcagccagucgggggcugggggugggagagauaucauguaaacugaggauauaauuaccauucauuucagagagggauguguuucuuuucuugcuuucucuaacuuacaccuuuucucuuucuucuaaauuauugaaaaugccuccaacuucccuuacagcgugcauggucacucuguaaccaucacuggcuacaggggaaaagcaagccugguuggcagaaucaggcccaugagaaaaagaggaggugggccaaugguugugggguuuuccaagggaauaaaaggcugugugugguugagggucaaguaagagggaggagauaagacuguaagaagguauagaaaaccucaguugccucuuugcaguugggguagcaaaguaucagagcuaugggcaacauuaggaaguaagaguuagaggccacagggcucaaggggccacagaauucugauguggccaagaaaaugaguuagucacuuugcugagcacacagagcuggcgugccuuguuguuugaugucucucucucucucucucucucucucucccucccucccucccucucucuggccacuccuuucggucaguucugaagaucugucacugggagacagggcuugcuccucugugcuaugcugccugagacaauaucuucuuccugugccucuccuucuccagccuguggagggcaagcaaguggagaauguuuuuguuucccugucauaaagauugauaugccuucccauuuaugauuuuuuuccuauccaacaccugcagcucucucucagaaugcucaaguugguuaaauuaaagcuucagcccugugaaugggccauauaugucauaaaagauuuccuugcucugccuuuuguuagcaaaauucaucaaucugauaaaaucgacacauuuagauaaguguugcauaagaauucagacuucguuauuccuaacggaaguggauaugagacuguaaaaaggaagauaaaaauuauaucuucuuuuuagagaguuauugaucuuccuaccauuugauuuacuugucagaaaggggcgagcacauuuuuggagacucgcguaaaccccaacagcgccagcucacuugcuucauggauagggacuuuaggaguccaagggcacuucuaaaacacuugcagcucugaccaaucacagggaggggagagugcuccuuguuuuuaagucaucuuuccuauuuuaauguauuggcuggaggccaaauuaugaacuuuaccacacugaaagaggaaauuguccucagagagguaucugagcccuuucucuccucccauacccagcggcccggcagcagagggcagggcuguugcuuguggguggcguccuggggcccugugcccagacugaguauuaagagcucugcugcaucauuuucagugucgauuccuuccguuugcuguccuuguuaacuaaauucgaggaacaaaaauguggaaugguggaccccaacauagucaaaaccugaaaaauguuuaagacaaacuuauuuuucucuacuugaaguuucaauuuuaauagaagauauugaaaauagagaaaaguaguuaaaaggcaggacuaccuaaugauuuuuuaaaaaaaaauagcagcugcugaccuucgagcuugugaucuccuaucuuuuuagauguauagcacuucucuaauacucauugaucccagcacuuuggaggccgaggcaggggauuuagaguuugaguucagcugggaucacagguaugugauaccuguacucuuccaaguucuuuuguuuuguuguuuuuuuuuuuuuuuuucuaaguuguggcagaauacacuugacuacuguuuuaccaucuauaggugaauaauccgaugaguugaugcauucagcaugcguacauccacccagaccuuucuauaauccuugucaacuucucccgggugguaacucuccuguccccugcacagucucuucuguuuucugucuucauguuuugccugacccguagucauguauggguuucauagagcauuugaguuuugucuguguuacagcuuuaucagaauacuguugccaagacuuagccugcuuuguuauauuugugccauguguuuaucuccgucuccccccuuuucccccccgccauugaugggcugugggcuacucucagcuguuggaaugaugaacugcuuaugaacucugauuucaguccuucuggagcuauguacccuaguacuaggaguuggggcaggcuuguucgggagucuguaucuauccuuucugaggcacuucugaaaugcccccauaguagcuauaccauucacacucccagcagccauaugugagggcucugggguguucauagucucucaacacuugcuguuuugugauaaaaugccagaacaaaggcaccuuauggaaggaagaauuuauuuuggcuuacuguuccagaaggauaagaggaauccaucaugucagggaggccuggcggcagagguaggaaguugagagcucauguccucaaaugcaggagcuggaagcagaaagugugaacagaaggggcacaaggcauugauucucaaagccaagcccagugaugugcuuccuccagcaugguuguacuaucuaagccuugccagacugugccaucaacuagggaccaacaaagcaaaauaucuaagccuaugggggaaauucucauucaauccacugcaacucuaguccauucauguagauuccucguaugggaguuccucaccucuuuaacagcuagcuuugagguguguuucagagucaggaaacagaauccccauagcucugacccuuuuugaaacuguucuggcuggcugaaacuuguacacuucuguaugaauuaaaggaucugcuuuuccuugccucugaaaaggcugcuaaaguuuucauagggaucugaagguaacacuggcgcauuugauuccugugauaguuuguauauucuugggccagggagugacaccaucuggaggugugcccuuguuggaauaggugugaccugguuggaauggguaugucacugugggugugggcuuaagauccucacccuaguugcuuagaagucagucuuccauuagcagccuuuggaugaagauguagaacucucagcucugccugugccaugccugccuggauacugccaugcucccaccuugaugauaauggacugaaccucugaaccuguaagccagccccaaugaaauguuguuuuuuauaagacuugccuuggucauugugucuguucacagcaguaaaacccuaacuaagacaauuccuaaacaguauucucucccaauccacaaacacugaaugucuccccaucugucuagaucagugguccucaaucuguggguugugaccccuuaggagggggcccaaugacccuuucauaggggucauaucaggugugugcagaucagcuauauuuacauuaugauaacaguagcaaaauuauagucugaaauagcaacaaaauaacuuuauggugagggaucagcacuaaaugaggaacuccauugaagagccacaccacuaggaugcuugagaaccacuagucuagagcuuugauuucuuuccucaguguuucauaacuuuuauuguucaggucccucucggagcuggauuuaucacuguuuaauuuugcagagguuuuugcaaauguagacacuuuuaguuucacuuggguuguuaucucuaaaauaugaaaacaacucauuuuugugugucaauguuauaugaauucaauuccuuuaaaauaacaauuguaaucaugccucuuuuuuguuuguuuuuuucucuuucuuuuucucuuucuucaguuuuuugagacaggguuucucugucuagcccuggcuguccuggaacucacucaguagaccaggcugaccucgaacucagaaauccacccgccucugccucccaagugcugggauuaaaggcgugugccaucacugcccagcauguuuguuuguuuguugguugguugguugguugguugguuuuucaagacgggauuucucuguguaaccccagcuguccuggaacucacucuguagauagagcaggccaaccaccacaccuggcugucauggcauauuuuuaauguugguuucuguguuuauuacuguuuuaccuagcagguucuuaaguaacuagcacucuguucucacccuguagacggggcucaguuuuucuuuuuguacccaggugaaccugaacugagcauugacuuuaucucugcaguuauucccuugugguagacucucagcugugagagcauggaagcaaaagccacgaacgcuuaagcccuuugugaacauuugaacauuuuccauauuacacgggucucugcagccgcguuuggcuauguguauaagauggaucugagacuuaggauggagguaguguuucacucugguuuuagucugcaggugacuacugagggaguuaacaguaagcaguuggacgucugugauuuucacaugugugccuugucucuucaccucuuggcauuuuaaccuuuccuuuugcuuuucaggaguguugaugucagugaggaccuugcuaacccuuugcccaucacacuugcugcaaacgaggcugcagcauuuguucuaaccauuucaguugcuuuuguuucagcaucucaaguuucuaauuuucguguagucaaacucuuugauuguuuuucuucgugauuucuuuaucuuugaaagcauuuaaaauuacucuugcauaaacauuuaucaauguuaacagaaaucagaauagaagauaaaaauauacucacaaucuccccagugcagcaaauuaaaaugcuuccucggaggaucccugucagucucuuccacauggacauaauuggaggugguuguuaucaccacagugacacuguucgguguucugggcuuuucuguuuauuuucccauaaguguuaucaucugacagcacacuugaugcaucuuucuuccagauuccugguucuuucuucucuuaaaauacuuuucucuuucuuuuacagccagcguagagcccugcuuuucccaggcuccccuggucuugacaaccucccuggaccuggccuuacucucagucucuagggauucauuuaugacucuguguacucugcaggccugcaucacacuggugcuguggccaauugccacaugcucuugggaaauacuuccucccugagguacuguugcuuugugaaucgggagcuggugaguuuagccucauagccuuucgaggagaaacgcuuggcagccugcguguagcaaauucuaagcagggaaaacuguaaugaggaggcuuggcacuacgccagggauucccacacacagaucauuaaguuagcuggaucauacaguuaccccagaggucaguuuugcaacuugcuugacugcugagaaaacaagacuugauaaaugauggccauuuuggaaguccacuauuccaaacuuaaaauuuucacucuguuugcuuagauuucuuuaacaugacuuauaaauucauauauauauauauauauaauauaauauguguauauguguuguuaucuaggaccgcaugcugguggaagucagucugggugcacaguuggugugucuggaccacugagcacuaugauauaucuguguggguagacuggaggagauggcagugggucaggagaugugcuugaaugcuucuggugucagccaugauuucauuacagggcugagggcugcuaucagguuagagcccuucuuuuggaaccucacagcagccuagggauuccuggacagcguuccucuuugugccaagagccaggguggcucaugugccgcaggccuagaaaguaguacaacugucucaguguggugaaaauggucaggcacccagcaguguguugcccagaaggguuuggauaaaaaccacugaauuuccagauaguuuacaguaaauccuuggagcccucugcaugauauauacauacacacauguacacacacacacacacacacacacacacacacacacacacacacagaacgagagacacagagagagacacagagagagagaagagagagagagagaagagagaagaggagagagagagaagagagaagaggagagagagagagaagagagaagagagagagagagagagagagagagagagagagagagaaaacacacucggcccuagaccugaggcuggaagcagagucagaguagguaugcugcuggguucuaguuccagagcuuugucaccuauaacagaacuuccuuacccuguuuccuguguagaaggugcuggacucuggcuccugaagggcugaugguacacuaggccucugguagcccuggccgguuccuaguuuuuuauuguagggacccaagcccugcuccuaggcauugggauucuuugcugagcaugugccuaguucuguguauagagcagggcugggguauuuacuuuuauuuugcuuuuugauuuuauguauuagcuagggagaggccugcaggugcaagagcccaagaaggcagggacucucuugaggacaugaaggacauauguaggaauagguuuuggugaugugucaagaagcagggaucagaagaaagcaucuauuucuauuagugucacauagagguagaaacucuggcaagggcucuagccccuugcuugcccauggcuccaggaauccuuggguucaguugugugccauuuguacagccugguacaagugagauuucaucaaaaccugauagggggagaaucaggugugggaggagacaggggagaaguacagaggauugggaaauugaauggugguguauagcagugggguauggggaacuguggggguggggggagaggaggggaggguaagccacuagaaagucccagaugccagggaagcaagagguuuauuccuaggccccaacagggaugacauuagcugaaauacccaacacagggaagacagaagcuauagagaccauacccaggggauaggcacagccgccauuugagggauggggccacccacccauuucaaaaauuuuuaacucagaauuguuccugucuaaagaaaauacagggacuaagaguggagcagagacugaaggaaaauguauccagagacugucccaccuagggauccaucccaucuucagacaccaaacccagacacuauugcugaugccaagaauugcuugcuaacaggagccuuguauaguggucccccaagagggucugccagagccugaccaauacagaugcagauguucgcagacaaccauuggacugagcacggggaccccaagagaagaguuaagggaagaacugaaggagcugaaggggauuguaaccccauaggaagaacaacaauaucaacuaacuggaccccacccccacccccagagcucccagggacuaaaccacuaaccaaagauuacacauguggggaccccauggcuccagcugcagcuauagcagaagaaugccuuaucuagcaucaaugggaggggaggcccuugguccuuuggaggcuugaugccccaguguagggggaugcuaagguggugagaugggaguagguguguggguggaggagcauucucauagaggcagugcagaugggagauggcauagggggcuuacagagggaaaccaggaaaggagaacaacauuugaaauguaaacaaauaaaauaaccauuaaaaaaaaagaaaaagaaaacuaagcauaagcuaugggaauagcagacacuggguucuuuggaaaucgcuggauaagaggguauuuuagugagaggacuuuuccuuacagagaagcaaaaucuaggcuguaagaagaccugcagaggucuugagaagaguucagcagaugaagguugggugagggacagacuuggucaaagggacuugaaaaggcucgacaugggcaguggggucuagugguacugaguucuucccagggcucaucccuucagugaccucuucuugggcaccuaccaggauagugggaguaauggcaguggccaagaaucuugagaaaagaaaagacacgugacuuggagugugugacucacuguagugcaggcagguugauguggcacagcugccaugguguuggagaacacuaaacuggguugucucuacaucuuucuuaccuguuucaaggaaacaccucagcucaguccugccaugucuuuauagcaucccuaaguuuagccaggcucugugccuucagugggaaacaguaucuagcuagacacuaauagcuuuguuuuguuuuucuuguguuuauuuuuguagcuucaaaaguagacguuuuuuggucccccagagacugggcuuucauuaguuaauuuuaaaaagucuguuagagcaguuaacaauuuuuaaaaugacacauucauaccuuaagcauaauauuuucacugaaaacacuugcauucauguucaccuaauagaauuagugucuaagugacagaagacuaagcacauucauacgccccagcccucuucuuccucuguggugcuuugcuggcaucugucccgccugucuagggugucuuugcugugugagcacaucuguauuuggaauuuggggcaucuccucuuuauggucugauuuugaaauauguaugcuuccugcuuuguguguaauuucaguuuuccccaaauggucacucccauugucuuggauuccuuggaugaagugauguguggguaggguauggaggagaugacaggucuuuguggugcacuuggguaccaagaacuauucugguaggggcuuuccauucccucugucaugaccccacaagguggaugucacuucuccagaccacuuugauggaaggaaaucuuaaagcuggacuggcuucaguagcuuguucuaggucacacagcuagugaaugaugagaaguguuucaaagccagcucuggguuagaguggucaaccuaaguuguauggccagauuaagaagaguaacuaaaagccaggcgugguggcgcacgccuuuaaucccagcacucaggaggcagaggcaggcggauuucugaguucaagaccagccuggucuacaaaaugaguuccaggacagccagggcuauagagagaaacccugucucaaccccccccccccaaaaaaaagaguaacuaagccugagcuaguaugugcaguucucaauauaauuguuguaugauaauuguugggagccugauuaauuuuuuuauuuuggaagggcuaauguaauuuucugauuguaucaugagaaaagucucauuuuguguuaucaaauuucaacauauaaauaauuuuaaagacacagacuauauguuguuaaauauaacaaguaaaagucuucuaggaaucauuaauaaaguuuugaguuauaauuuuaaaagccaguuacaugauagguguaauuguaacauccaauauucuggccauuuucuaucauuuuaaauuacaacagaaacaccugcauaucaauguucauggaacaauauuuacaauuaccugaguuaugggaucagccuagguaucugucaacagaggauuagauaaaauagguguggccuauguaugcccaauggaguucuguucagacauaaugaaauuaugucauuugcagggaaauaaaugcaaccagaaaccaucaaaauuuaaucagagucaaaaauacauggcauguauuuuccucccauuuuucuauccuagauaucauauagacacauaaaaccauauauggauaugugagauauggaaguagaaaugaaacuaucugugagaaagaauagcaauaacaaaaaggggaguggcugguaaguauguccacuuucaugguacacaugaagaaaaugucugugcauccuauugcuguguaccuuagauagccuuaccuuucaacuugauacaaccuggagucaucugagaggagaagccucuaaguugaggaacugucuagauuugguugcuuggugagcaugucugugaguaauugucuugauucguuuuguguuuuaaauuauguaggauugugcucaugaauagacauuagauucuccuggaauugaagcuuugagcugccugauauagguguuaggaauugaacucugguccucuguaagggcaauguuuuuacucuuuauggcugggccauucccucagccuucaugcuaauuauuguaggaagguccaacccacuguggguggcacuaucccuaggcagaugguccuuaaguguaucagaaagcuagcuaggcaugcgcuuaggagcuaaagugagccagcaaguagcauuucuucauagugucugcuucuacuuacugcacugaguuucugcccugauguccaucagugaaggacuauggucuggaagugaaaggcagauauaacuuuuauccuuuuaaguugcuuuuuguuagauuauuuuaacauagcaacagaaaggaaacuggaacacuauguaaaauaaauacauacuguuacaauuuuauuagaaaacaagaacaaauuauagacauuaauugcugaauccuuaaugacugucagacacaaaggcaaaaccaugauuguucuagaaccuuucauucauuucuuagauaauauagaacucacaagacgugcuggguaccugaugagauguuuucauugcaguacuucauucagggcuugaaguaauuguaucagagauucuacuaucaucuuaaugaggaaacugaggcacaaggguaaacggacacucagagugucauggggaggaaauugaggagccaggaaguacuuagagcucagugcucuggucuuagaagccucacugcagagccuuguguugaugcugauuguccuuacaaggacacuaauuccucugcuacuugccaucacuuguucuucaaaaccggacuagacaguggaacccggugacacucugguagccuuugccacauacagaacugugaguccuuugucuguuccuucuccuucuuccucagggagauuugugagcucucagcugcuggugcugcggucauggauucuauugucugaaaccauaagccuaauuaaacauuuuccuuuauaagcuggcaugaucaugguauucugucccagugcugaaaguaacuaaggcacacguggacauguauucauuuccucuuuccauuccugugggcauguauaguagaauuccucagcuacaugucacuucuguguucuuuuuaauuuucugaagcguauuuguugauuagauauaugaucuguguugacaggcuuccuauacuuuaaauaugacauccuccuggucuccauggcugggaccagcuccaugcacuacugcucucacauaugagaugguuucuucccaagcuggggaaaugcccucaucaacggccaaggcuguuuucugccuaguuguagauuuugaguuaacgguuggaguuuguucagcuucuuaaaugugcagguuaauauuuucaucaaauuugggaaggaacagaccaugauuuugucauccaugaugcuuccauucauucuucuugcuucauaaaccaccauuguacuuaaguugcuuugccugagacacagcuuugccacugcaacuggguucucuccuuccuuuuccccagauggaucgaucucaguugucagcucucuauucugcauguccagauccccuccugaccuucacuacugacugaaguuuucauuucaguucuugcauuuccaaacuauggauuuuuaaaaaaauuucuguuguguuaacuuaccuagggugauaaaaaaacaagcaucuacuuaccccagauagggaacugaugacagaccaaaguccaccuuagcacguugcugaauuuauuagggcuacauaacuccaagagcaugggcaguguuaaggaggcuguaccacuaaacucccacacccccugagugaccugcugcugacagcugggagccuggggcucucugggacuugcaggcagccccacagcuuuggcucucucuccuuagcaagcauaaggcuuacuuaaccuagggaaggaagggcccugugaaucugauuucagagacuuccugacacuugccauuguuuccuuccuaacuccuaaggaaccugucuacuuuagaacuuccugagucuuaaugagcaucacagaagaauaaguguuucaauuuggaggaaauugucacaguauaucuguguguguguguguguguguguguguguguguguguguguguauuuugagacagggucucuauguaacucuggccauucugaagcacucuccauagccuaggcuagccucaaaccuauagagaucugcaccaacuguuacacucucucuugugguggaggauugucaaguuguuuagacuugguucauuuauuugaacacacugggugggggggagggaaccugcuaucaagucugggagagcuuccuggggacaguuuuuuauuaauucuuucuuauauguggacucuucucuugcuucuuugcaguugugauggguaauguugguugucagcuugauggauugauugauugauugauaagugcuuagaaggcuaacauaacacauuucuggguaugacugugaugguguuuucagagaggaugaacuaagggguaagaccccucugaauauuggcagccauaccauaggugaggggccaaauguaauaaaugaaaaaaucaugggcauucucucucucucucucucucucucucucucucucucucucucucucucucucccucucucucucccucucucccucucuccccucucuccccucucuccccucucuccuccccucuccccucuccucuccccuccccucuccccucucccccucccccuucccucccccucucccucucucucuuuguggugcuccuggcuaucaugaggugaguuguucugcuccaacaugccccuccccuuuguaauagacucugaaacaccaaaccagaauaagccuuuucucuauuaaguuguauuauaucauagcaacacacgugcgcacgcacgcguacacacacacacacacacacacacacacacacacacagacacacaaaaaucaaaaaacucugaacuaugccuguauaauaaauuugguuugguuugguuuuuugaaacaugguuucucuaugcagcacugagugucccggaaaucacccuauaccaagucaacuuguccuggaacucagagagaucugccugccucugccuccugaguguugggauuaaaggcuuguacuguggucucugugccuggcuguaaaauaaauuuuuaaugaauccuaggcauuuauaauagcauaaugaaguaguauuagaaguuacauaaacccucacuauacuuuguuaauaguuugaugacuuuucugggcagauuguggaaagucguuauucuuugucauggagacccugagguguccacucagugaucacuaaggacaggacaguuuucccugaugccuggauguagggugcuccuugaggacgguuucuguauacauguggagccaagcugucaagaguuccagcagcaguuaacugugccuuagcuuuuacucucuguuugcauagaaccuugaagucagaggugagggcccacguucuucuacgucucuccugaacaugcaaguccugugccuguggucaccccaguucucaggauaugugagagcuuuucuaagccagcucugagcaucugauuccuuaccuuuuccugcuaagcuuuuuacucuucuccuuguuugcuuaaacaguuaccuuucaccucaucaugcuguugacuacuucccuuuauuuucaacagagacccucagggaaaaggcuuuugcagugagaaaaugagcugcucauugcccuauccuggguuuccgucuaccaucauuauaagaacuuagugggaagacagcaaagggaaguuaggagaaacuucauuucccaugcaggaguaacaacuuaaacaggaaaggaaaaaaaaauucgaauaagacgcagaaaaucagggucccucagcaucagcaggaugacaaaaaaaaaaaaugcugucacucucauaacuccauuuacucagcaggcuuuggggugcagcccagagaaauugguggugguauugcaccugaacucucugagggcuucagaugucaauugagagauguuccuuaagagcaggucugcagaaagcagaucaacaacaugagggcuaugucucuugucucuguggaaggcuggagucacagguuucuggagcagaagguucuuagaggcuggagacagcuacaggaacaaaugucuacagcuggagcauggaggcuuacaggcugggucaggaaugagucuccuugccugagacagaagcccucauguagugaguuucaacagugucugucucuggcaagucuucaaggccaucuuccuuuuccaaagaacacagcaucugggaguuggccuacugaccagagcuaguaugaaugaagucaucauucucuuccuccucuaauaaucugacaaguuucguucucuagaacuuauuggcucagauauauauauauauauauauauauauauauauauauauauugccagcuggggccugauugauugagcugaauauguguacaugcaaagauggugaaaacugggaucaguuaggagggagcugucagaccuggguggggaagagaaagccucccaaacuuugagcauguuuucaauuaggucgcuuucucuaucucuucuucuuccuccauguuguaaggagagugagaauagaggguggggaacccuccuuuggccuuccacauuuguacccgaugccuugagcuugcuuucagcugcaugcagagccuucuuuuagacugccaugaagccccaaucucaagccauccauucuaccacugcucucugucagauauaccccacuauguuagggaucuauucuugcaugauuccacuuaguucugaaccuuuguugccaugaaaucucugggaaguggguacuugguugucagaaagguggcagcccaugacauugaugcugaggucagggucccuucaaucuauuguugggauaucaaacagcccaucucugucuccuugccuucagagguuucugcucuuucuacuccuacagcaaaggcuccaaauaggccagauacacauagccuuucugaugggguccucuagggaacuaccagauaggagaauuauuguauuucuuggggucaagugcuuugauagaacucaaacccauucugccccuucuaggguccagcagacacuagcuugguuguaguugucaaggccacuacagaguugguggguagauggaacaaagcagguuuaaaauaucuauuuguaacuuguucucagauucccagccauuuucacuuuuuuuguucacauuuucuuugguuaacucuagaguucugaaaauuuugggucauuucuuuucaugcucuuguugcuuccaugaagaggcuuuuacauguguuuguucaccauggccauugaucuagguguguucagucugagguucauagcugauggauucuccuaaagccgacaaguccguuuuuugcuaguaugcuguugcagugaaugcucauaaaugaggaacuuccaaggcaugaguguaaauuguggauuuuauacuacugugccaccaaaagugauaaagaggagaccaggagggcauccgugaggaagggaagaaagccaagucccacacuuagaaggucuauguuuaaaguuggcucugaagguuacaacuagugucuuuuaaucugccucuccagucuucauuuccuuaucuacaacaugacagagccauggugaugaguuggcuuaagauaucauuguucuugauauugcgauauugcuguuauauaaucuauauaaaauccccccccccccccgcccugagacaggguuucucuguguaacccuggcuguccuggaacucacuuuguagaccaggcuggccucaaacucagaaauccaccugccucugucucccaagugcugggauuaaaggugugagccacuacacccggcuaaaauucuucaugauaugaugaugaauaagauagcaggguaugagauagcacccacacaguagcauaugaaauauuuuauguaagauauugaaaacauggaaaugggauguguggcaauuugaaugagaauggaucuuuuguuuaaauacuuguuccccaguggguggaccuguuuuggaaggauuagaaaguguggccuugcuggagaaggugugucacuggggacaggcuuugagguuucaaaagacucauacucuucccagucucuuugucucucugccucuuacuuguaaaucaggaugugaguucucagauguuucagcucccaugccugugcucugugaucauggacucuaacccucugacacuguaagccccuaguuaaacucuuccuuccauaaaaugccauggugucuauuacaauagaauguaacuaagccaggggaaauucauugguacaaagcaugagaaagcuauguuuagaagaaaagacagcauggggcugggagggauuaugaacugcuuuuuccuucuucccugacaguguuauuguuaguuuuguuuuaaugaagauggcuuaaguaagggauucuccucagcgagaagggauuucuagaugcagcuuuaggaacuuugggaucaccaguaguccuaaauuucagagaaccagauuguauggaucuuuuaaagagcuuguaguuuacgaccugccuagaucccugcugcuuccugagggggcucaggaggaguugaauuucuaggugaaccucuuagguucugaucuaagucuuucuuuguaggacuucuguuucaccuggcaaugcagagcaguggugcuaccuucccaugcucaccugcaggcugaagaggaggcacguggcgugcucggugaugugccagcagcucugcugucugugccgggcugugcugacagccucugugacuguccugaugguuguucuauuucagauuccggggugcaccgauuauucccguggcagccaaaccugggggaccagaagccccugaaacugaagcuccacagggcaucucagaacucauugagguacugucagcuugaaccuaggcugcucucugccccaacccugcucaaguaguucuccauguuccacucugccuaagagggagggagaggcaauccuaggaagaggucuccaagggccucucucucacucugauaucagacucuucaccucccuuggaaacugcaaaacaaagguccauagaagcccuggacauuggacucugcaaaguucuuccuacccacuguguuuccuauucugccccuccucuuucacacuucuuucagacaaagcagugccuuucucuguuaccugucccucaagccucccauugcccccaccccuuccucucacucucagagaagacucagucuuguacgcauaucugaucacaagcuccauuccuguccuucagauugugcagucugccuccaccuaaagcuggagcagcacagcacagccuccauccuggcagccuccacuggaggaguagacuuuuuuuuuuuuuuuuuuguagaacuaugggcucaggcuguuuuuccaggcucaguggcaaugggcagaaacggaaccgaaucauccagguaguccaguguuguuccccucucacugagcagagagcacugagaacacagcagaagcacagagcacagugacggugcucaccagcuugccagugaauggagcuuccauaagacaucacccuagugcuccugcugaauacugguuucaccacuguccuuguucuuccccucgccuggcagguggcagcaacaucccagaguagccagcagacagggauguguucaagguaguauggauagugauguaaagggagaaggcagugaggaggaaguacaguuacuucacugggugcaggagcuagaaugugugcucgcauuggccugccuacuguucucugacuggacucaagagauucauggguguggcugcauacauccuuagaggcuaagacugagagaugggacguuugaggccagcccgcuuaguuagacccuaagucaaacaacagaagaauuacuugucuuagguaacucauuucaugcagugaacaaaguugcagugcagggaaggcagcaccacagagauacugugaggcuaagugaguuacuaggagugcuguguuuuccacaacagugacaugauuuggcucaccaggcuccauacuugaguucuuuacguacuggaucucuaacacuuucaaaguuggaaggcugaggaagagugagauucagagaaguguaaugaccugccccagucccuuuguggcaguaugugggcacaucccuccuaagauacuucaucuauggucuugauuacaugaauuguccuugccugggaugcaggcucccagaugucacacaagccucaucggccauguauuccccccccccccccaaucaaacacucaugaugggcaaguguggaaugccaacuucucuuggagaaguuaccuccucuugagaggccucuucugcagggcugagucuccccaucuaucaccuaccucacccccacuguaugaaaugaauuggugugggcaguucuguuauugcugcgccuuucuguugggguaggaucucauuaaguagcucaagcuggccuggaacuuuuugucauccagccugaaccuucgagggugcguaacauaaugccugggcuuuuuacuguaugucagggaacagaagaaaggacauagaucauguauuuaccugcauaucucagugguaacucagacccagaccauggucaguauuuguuggagucaccuguacccagauuccagacugagguucacaugugacucccauguaccaccccugcuguguuucacacuugacagauguuuucuuguuauuuuguguucuagagaacacaaaucugggacccugggacaauuuaagcaaaaucuagaaaaaugugacuuugaaacaugucuacaaaguguaacaucucagaccaagucuguuuuaaaucucuccauuauuuuccuaaaggaauuguuaccacaagacaguacuuugagaacacuuacugcugaccugaauaccuagacauuauuacuacucucucuugaaaucagaaagcagaaagcucaacaagcagcgcagacucugugcucuuuaaaaaaauauauaucaauuaguucugacagcgucucaagcacauaaauagccugaggaacacuggccaguuguacuagugcauguggaaagucagccaugaaggaaaggccagaccccaggagccucugguccagugaacuuaggucuccauuuguuagggccuuccuggcagagggcacaaaagcucccuguaugcagcccuuugccuuggaccucaggcaucagcugcugccccuggaagccagccuuccacccucucaccuggaguuuccccucguccauuuguccuuuccauuuguccuucacucacaugcuuucccucaagcacggugccagcuacuggcgaucucuuaagugcaugaccuuguggaguagguggggauagacaggcagauguuaacagcagagaguggacuguagugauagguggggagacucagccauacagaagagagcucuguagaggucugccugcuaugggugccuggcacuggaguguggcauggcaggcagggccuggaugacaucuggaaaccagaugaagacucuuggagcuuggagcuuggggaagaacuguacaugaggaccguagggcagauguccuacagcagcugccucagcugcagcauggaggccucagcaggucccucuucucacugaguuaaguugcagcaaugguacucuggccugugccagcuugcaagguggcccuggaggaugccagugguguagccccuguacccauagguguuuauagcagcauuucuuuuccagcuccugaagucccagauuuccaucccaacgagagaccccucuggaccauuccuuaugucuguggaccacugcuucuccaucaagggucaaggcaccgugaugacugggacuauccucucaggcacuaucagccuuggggacaguguggagaucccugcccucaaggucaguccugccuugacuuucauuugucucauacaccccccaccccccaauaacaguaggagagaggccaggcccuuggucuucagggcaacagagucuaaugaaccuuucucaaguucucuucuaccuaagggaugagguagccugccccucugugacaccaucuguuauucaacccucuggcuuccuggauucuagaacuacuguuuucccuagucucauaguagugacuguauagugugagcuagugguggcccacaaaagagauuccuaaaauaaaccaagucuucagggguagggugagcuugaaagcacauggucaagaaccuagggugcugggugaaaguccaagcuuucugaauauuggcaaaaauauguguagaacuaucucuaugcuucauaccccagccuuaaaucuguagccuuaaauuuaugauucucuugccuuggccucuccagcacugagauucauaugagggguguauguguguguaugcacacaagccaccaaaucuggcuuuagaucucugggcaccuuuuucuuaacuaagagaaucuuaaaucauacauagauuugggguacaguuguucacuuuguuagagauacagaucacucugcauucucagugacugcagaagguacccugcaagccuuuugagaguggaggcuuaagguccaucuccuccuccagauacuguggccuggauggccuugauagugacuuauucagaagguuacuuaauugggccuaguggcacccaccuguaaucuagcuacuaaagaagccaaggccaaagaacuuaauaugauccuaucccugaaagaaaaaguggagagggaaccugacuauagcucaucagugcuagcucgccuagcauaagaccuugcagauaauuugcccauguccaagcacagugguucagccaugcaggcacaugaagugagcacguuacugcacaagcaggccaaaaaugcagcccucguccugagccugaaagcaccauccuauuccugugccuugugccugcucuuguuuagaacaguguguuguacacagggaaagugcauguucuggggucagggauggauaaugcucuaucccacaugaaggguugguggcacagggaagaauucccuaagcagggagacccagcuggggguggggguugggggcggccuuaguucuuacaaauccaaagacuccuggacagugcaggcagaauggggcagcgaggcuguauccuuuccugaggagaauuguggauaaaaaucuccgcuagucccccaggauagaucuucucugaaaaacacauaagccaaagccauuuuaagccagggguuaaaagcacacagauugagcaaaacaaagcauaacauuaugaaaauaaacuaaaguauauuuaacaaaaacaagauuagaguugugacuuugugcaaacccuuaguuggaacagaaaguaaauugauccugaguuucugaacaguuccuaugaucagcaaggcagaccuaugggaccagcuugaccaucuccgacccugugaagacauguugaccgcuugagagaggagcuagagcuaggaaagaggugugaugggagagagggcucucuggugagcuuugaucuggggcuccaugugcauucaagggaguagagaaggcucugauaacagggucaggagcugaagugcugagaccaaggacuuggaguaaaggugagaccaaugucuuccucuuggguaggcagacagacaugugagugaggacaugaucugagaccucagccacccuuuuuacccauccacauccuaaccugcagccucgggcauguggcagguguuuggcaccugcauaucuaacucuugucuuggugugguacaccugcacccccugaugaugugucagugaucuuacuggucaggaaaaacagaacuuguaagcaguguauuugaauauucagcuaagauugccaagcaugguguggaggaugaagccuucuuucuucugcuucaaguaaggugaggggagagaggaacaaaucagggagaacuguuaggguguagugauucuacagcuuccuggauuuugugaccaccaaggcugcugaaauugggagaugacugccgagaaagcacgacugcaguggggggcauccuucugcugaaaaaacuagggugucagguggacccagucagguaucucugaaaaagcugggaugagguagacuuguugaaaaaguaugugugaggcuccucuuauuuagugauacagaucccuguggugcacgugacauaccccuacauuucagacuguuguacuagcaaaacccccagacaggaagagggagagggaaagaaagagagaaacagagagagagaagagagagagacacacacacagagacacauacagagagaaacagagggagagacagagacagacacugacagacuaugacaacuccaagcacagggguggacuugggcuggggcugcuaguguccuguucccaggcaaggccugucacaugcccagaaucuuuguggacaugcuggcauucucugcagagggcucguaggcuguaagugcacagaagcucaacucaguuucuugaccuauugccccugcacaagcugugauuggccagugccugucaacucugucaagcgugaaggcaucauaaacuguggccuucuuccaaugcacagugccauccuugucagaucccacuaauagcugcagacacguuugaccgcaugaacucccuaggaggaaggacauggccauuccaaauaaacagugcauuccccuggccauaccuuggccuguuucugcugccauguccauucccagcugggguugauuagcuaagugaggaaaugcuggggaacaaggaguaaaugacagagguggggguggaaaucucaguuagaucccagagagguuuaaacagcaaacaucccaagagucauagcuuucugccuaucuugguuuacagguugggggaucccucuggugagauuuuaucuggagauuuaggugagucauauuccugguagugauuggauacuggguuguaauaccagagacugugaaagccacagauguaggaaagaacaugcuaggccuucggaaaacccauagcuagcauuuuccagcucuuugggcccagguaaguugcacagagcugccggacaggggacguagaagauuggagaagugcuuggccaggcuucugcaucagaaguggcagugucugaguggaugccuuuguucuuuguugccuuugguguuauaugugcagcucuuguagguucagaaagguaaaugugguauggccuggcuguaaagauaccagucucuaaggacuacuaaaagacuuacuggaaagagaugugcuuugcagacagcuguggccagccaagaccagacacugcuuggauaaugaugagguguauuaauggcauauuuagauaccuguuuaauucaugaaacauguagagagucggauuuuaaagcacauuucuucagguugucauguucagagcuacucagccccagagaagaacaggaagaccuucaacaccacagugcaugguugcuucugccuuugccuuggcucuuagagaguggugacaaggagguagaaucguuuuccucacuuguacagaccucuacuuucuuuuacuacuaguaguacuauuuuaaauuaaaagaaaaaauugagacagggucucuguguagcccuauggucuggaaaucaucauacuauugaauucagagaucugcccaccucugccucccaagcacugacauuaaaggcuugugacaucaagcccgacuccauccccguuucuuagcuuagccuugauguacucugcuaacugucccugagguucuuggcacucucaagacucugaaagucuuuuuuccuuuagagagcuacuccccuguccugggccugugaguguuaagccugguacucaccauguuauggcagcauuugucucugagcuuuuguguguauaaugcugaccuccuaguuguccaucuguccucaggacuagacccagggugggcucuacaaaauauguuguuaauaggaguaaaaaccuuagagcaaauaauugaauuggcuuuuugucagcauuugguuggaauuggacagugaguguccuuggagguuauguguagcuucuccuggggcugugucuccuuuuugaggcaguauccugaugcuucaucaguaagccaagguagagaugugcccuggaucaccauguggucuuguuugggaggagcaacugucaucauguguguagggcuaaacagcugccuuccucgggcccuagucuaggaagcagcuuucuuucucugacuuucaucuagauguuauauccuggcuucauugcuaacugcuuucugcuuuggaagaggcaugcuggaaggcaagccucccuaugaauuugauauuuucacgaguuggcuuuguggagucuguucuucaggucugcaugugccugggggugccagaugcaugggcuuggagaucauuacuggcucugguagaacagcagggcaggagggaggcagagguagaaauuggaacagucgugggagaacuguguggcugcccuuuaagcagaucagccuuugcauagugaucacacagcccuggcuaugcucaggcuuaucagacucacugaggccacugccaucacuccaucuaguauuuuuuaaaaagauuuauuuauuauauguaaguacacuguaucugucaucugucuucauacauaccagaagagggcauuagaucucauuauggaugguugugagccaccaugugguugccgggauuugaacucaggaccuucagaagagcagucaaugcuuuuaaccgcugagccaucuuucgagccccuccaucuaguguugacagaaaggccuuacacagucaacugccuguguccagguguccgaccugcuauguaacccaugguucucaguguucugcaugacacagcagacuguaagcuucugagacggcuacuucaaccucaaggucacauucacagccucucaagaucaccugcugcucucaaugucugccucaaguaauguaggaacugggucagucuugucaugaaaccugggagaccuucugcagaucuagcucaguucugagguauaaagccuacucucugugucauauacaucuaucuuccuacuuucccccuucaaaccugagauggcauacuccugugcuuaaucccuaaugcuacucuaucccagagacucagucugaugggucaagguugcccuucccugucggugagagacaaagcuaaaaugagaaccugaggcuuggaaaaccagcguauccccuuccucagacacuggagagagaaaggagguaaugccuggacauggaacaugauaaaugcuaucaacugcuagcccuggagaggcacaagaaagagaacagaggcaggaagaggggccuagaaguagaagacuuguaggcuucugggaagcaccuaccucaggucugggcuuugugagagccacaucuuaagucuucuagguaaggaugucuacgcagcuggaagcaugccgagagacaggagcagaaccuugucuucagcugucaggaguguaagcaagaugcauacaugagcaccugagagcugcaagguuucuggggaguucucuuggagagcugggaucugucaacagaaaguagaagaguagcaguugggcaggaaacacggguggcaguaaccuaccuugcagaucaggcuuuggacacauggacuguauuugaagcuuuccucucuacucuaugggauaguugcauuacaucucaaggccaguguuucuuccuugguuaguccaugaugacuugacaagaucuacacagugugccugaggguagggcuggcugucucugucucugccaucagcuugccaccaacuucacauaaaaucccgagucuugucuucucuucccacccauaauccuuuuuacuugguccuuagagaguugcagcucaagugcuggucugagcuuuacacacaaacaacccaguacacacugguucgugagacuugccccgugaccugcuuucugucuuaagaaugugaaucacguuuuucaugaagcuguaauauccuguggauagacuaaggauggacaguuacaggcaaaggcaggagauuaaucucaggaggcagguagcagggaggaagguucucugcugucaucugaagucacauucagcauuuugcacaaguuuuguuccuguggaaauccugaaggcuuucucaccccucuaucccaauaacuuaucacaccauaucagccugagugucagcugcaacuugacacuggucccaacauguaccuccauggugcccucauccuuccagugcuauagugaguaguuguugugggccgaccagcagcucaugaggaacgguacaacugagauggcagcucgagcugaaagagaggaacuagacggauggaagaaagaacagagccaagucaaaguggacucugaucaaagcucaauuuuacuauuccaacacgcaguuaugaaggaggggaaggggggagcuaauucccgucaaauaauccugggguccaguagcagggugaccacguguauggcucuggaacagcaaagcggcagguuccagcagugggcguggcagaaugauugagcggcaagcuccaucccgauguaaacaguggaaccuuuaaggcugggggaggggaggcuacagguagucucccuuucuucugggcacaguucuauggucugacagucuacucucaggaauagugcugaggcccacaguacucccagggaggcucugaugggccugguccuacaacugugggucuacccaguucucuuggggguugagcacauaugguuauguucagggagagccaagucuaggucauaguuucaguaugggagauguacaaccuggguauccuggaagggggaaagccuagaggagcagugcuguccucugccuagguugcccauugacuagcccuccaaaauaucuuuggacuucuaggucugagaccacagauaaaaucaaacugcugaagagucuugucugacccuaagccuugccccacugcagacugagcucuacccacuggagucuaagccuuaccugauggcugccugccagugagagcccugccuagguggacugguagacauguacagguccauccauccccugcccaccuacagucugaguucauacuuuccaccacucuuucugcugcgaggcgguguguaugaggggucagagcuuguagagucaugcugcccagcucguacuuccuacacuggcagguuaccugucugcuguauagcugggagaagaugucaccuuccucagauaagagugugaggaucgcauagcuguucuaguuuacuuuucucuugcugagaaaacacuaaucaaaagcaacuugggggacaaaggguuuauuugucuuacaaguuauggacuaucaucagaggaagacauggcaggagcuugaagcagauaccuugagaaacacugcuuacuggcuugcuuccccuggcuuguguagcugacuuuuuaaauacaauauagguccuccuguacagaggugacacuaccuacagugggagaggcucucccacaucaaucagcaaucaggaaaaugucccacaaacaugcccucagaccaaucuaauggagaugcuguucucucuucucaagcauagguuuguaucaacuugacaaaacccaugauaauggcuuagcagguuccauucucgacaccucaaugccuaggugaggucacaguucuuguggucagcacuacaggauucaccaguuucugcccuccccugcuggugauagggcuuaacccaguggcugccuguuuggcagauagguggcaggagagucugaucacuucaaguggacaucucuuaugggagcugccuguuaguagaguaccagccuggggagccucacaggcuugcaaguggccauugcaucuguauguccuacugcaaggcaagguccccuguccuauacaggcuuugaguuggacuaagucaguuuuuguuucuaguucaggagagugauuuggucagaaauaacauuuauggagggcugggcuguauccccgggcaucaugcccugcuagagcccagagucuagguccccagucugcaucccauuguuggagcacaggugagucauuccucugcaguccaggcuaccuuccugaugaggacagcauccagaugggccugaaggcacuuguccuuuuuaccauugcuuaccucccaugguggggaaggcggccaggaaagcucugacucagguuaggucauggugaaguguaguggauaagggcuaaccacaaacuuugcaccauagcuuuggggcugcugugcccuccuucagccauggcauauggcauuugucaccaaguaaaaugugagcugacaguaaccugagaucuggcagcacuacaauuuggcacaugaaguggcuucucuguugggaagugaguggcagccaggguuuggggaccaaguagaaguagccuuggugcaacaaugcugagcuggucaacaucuaucuagugcuggacugugcccaguacaggcaugagugcuguguggcaccuagcagcaucuauucugugcacuaucuggccuucuuucuguauugaaaacaugcuuuggcuucagugggcaaugugguaggguaugguccaaguaauuacucuggguaccucugugaagccagugcugcccucucuagauugucacugccaucuuaugguaaagguagaccgcugaauaugaucaacucuggggagccugcaguggauggaaugucccuuauccccucauguaggaaguaccuagucuugauccucagauaugugcacuguugcucugccuagcaucaggaaugcuugagcccgcaggugaguggugccuaaaguaguugauggacaugugaggcucccuuagcagcaggcugggagcuagacugcuugguagauuaugacugucaaagaguagagacaggaagggacuaucuggaaggacaguggaggaggcuucagggaccuaagcucuagagugcuguucugggggcuucauguggucucugggccuuugagcacuuuugcuuuuccuaggcucccuuugucacagauggccugugaccacagcaugagcuuguucccgcucccuaguacccaccugccucucaggaaggccuccuacacuauguagaauaaaucccacagacaggaaugucagucuuguccuuuccugguauugaauuugaggcccaguaggcccuaagccaacacuuuuuacauguaaaaacagcaggagucuaugcuuguaaaaauucaaggucacgucacaguugucugaauuccagucagcuggaaucaaggaauugaugucuugaauagagagagcaucuaaggcagagguuuucgacccccaggguuaugugugugugugugugugugugcgcgcgcgcgcaugugcacuaagaccauuggaaaacacagauacuuacauuacuacucauagcaauagaaaauuacaguuauaaaaugauuuuauguuugggggccaccacaacaugaggaacuguauuaaagggaugcaccauuaggaagguugaaaaccacugaucuaaggagauucuuaucaacugauuuaggagaucugacucagucugaccugguacccguaccugccuugugccugugcagccaaauggcuuaagucugcagagaggaagagucaagaacugaguuugcuuugcagggcuguaguggacaauaaaaggagagaauucauccauucccaugguguucauucagcacauugugagcaccugcugugugcaggagccaggccaagucucggcuguugucaaagguuacuucuucagugcagggcacugagugccuuauugaagugauaaugggcaagagagcuagcugccuuugagaauaggcuagaagucuuccacaauucaugggacccaacuacucagugaucccugggaagagacuggggcccagccaguacuuccaugacccaggaaguacuaugccagcaccuccuuacuucaccuuggguaaccagccugcuggcuagggacaggaaagcuacugacccucuccagugcagcucaccaacuacaccuauagcccaggcucagcccuacccugccugguuucacucugggccuuagcuggaaccuugguuuuguuuuucuccugaaaggaaaguugaguauuuccugaguaucuguaaagccaaugcaccacguaaacugaauacuuacauucuuucuuuaaaaauaaaauaaaacaacaguaaaagcacuguaaacauugcuguaauuguucacaggcuuuaacuuguaauaauuacagggagcaggcaagugagacgccuuauuaaaauagagacacuugccugcuuuuguuugaaauuuugguaaaauacuccauuauaacauauuauuuuaaaaacuaaauucuguccauucggaguuuggguauuuuuguuuuuguuuuguuuuuuucuucagaauauuuaaaugagcugacucugggcaagggccauucaggagucugggucugccuugugggucacugaacuguuagcacacagccaugauauagccucuuccuggguuggcuauucaggguagcuuuugugaagagcucaaauguggacauagugcugaggaccuaccuggccugugcugcugcugaucuugccaucuacugcuucacccccugggacauauacacagaugccuacaagguaaagccggcaucucaagucugagggagcaaagacuucugagaagaggcugagcugcugaggccagguuuacaggcuuccaggcuaaugccagggucgcguggugagaggagcucaagguacuguggaccauggcauagcaguacagugauccuuaaaaguauugaggagguagucuuaccaggacuuggugaagguuagaacuuagaaauggugugggaaagacaugagauggaugaccccagaccucuagucugaguuacugcugaguaacaguacacuugcuaagaaugagaucccugaaggucuggaaauaagcagggcuuguagccagggcuguggcuuagguuucaacaaaguagagauguaaggaaccucccccaacacacacacacacacaugcuugauaggaugcaagcuaacaaacaaguuugcagcucaacauuugggauaguuuucuaucugucaguacauccaagccuuguacuuaggcuucuaguaugagaugauugggaaaguuuuuuaaaaacauagccauagaggacccgcuagggcugcuucugauaucucagccucuugccucaggagcugucccuauucugaaagaugagggggugccucuggggaccccugagagaggcaacccuuuccugcuagggccagguaacagagagggcagcccccuacuucccagccuccugccuccuccucuacugcugccgcugugaaacaaacuggggugccugggcggaaggucaggaguuuaaaagcuuguuugauucaagacugggguaagagacaggaggggagugcgcugguuuuauauguggauccugguauuuucuuuugagcuggggcggagaguggaggggcagggagggaaggcaggcugccagagggaacauugccaagcagagcacugcuaaugcaaaccauacggcuggcgggcaggcaacaaggcccaucuccuggccugcuuaaugcaguccuugcaggcaggcaggcaggcagccugggcagcaaggcugcuuaacccuucaggugcugagccaaaagcaggcccuuuuacuucagcauguggccauuucuguccuaagccauaagaaauagaagauuuaacaguggcauuggauucuacccacugggugucagcagcacuauuccucccagcccauuugugacgauucaaaaucccuccaacauucugggagucugcuugucugggauugggaaaaccauugugaacagccauaggucuacagcagguaauuucagccaacaacccuccugggaaaggauggccauccauuacugggcuauucuuaaaguguuguuagggaugaauaguggacaggcagcugcacuucagaagggaagccagauuugcccagggcugcauauacaguguucaccauugucugcccacacuccccugcuccucccaguccccaacuccuccaccugcuaguucccagcacagcaaguguagcccauaucagucucuggucauaaguguggaggcaaagccuguacagaucagguagcaaugacgugagaguaauggucaaccugugugcaaagcccacugcuggcgucaagugauagacggagacagagacuuaucuaaauagcuggaguagaugcaaagccaggugcagaagcagguuucagaacgccauggaacuuggcuccauuuacauaugcacucaaguuuguacaaaugcgucagaagaggucuggaaggagacagcacagugcgagcaguggcuaucuugggggagugacaggcaguggaauuuagggagcucaaagagcuuucaugucuuagucuguguaauugguguuuaacucuuuacaacgagccagcagucaucuguuucucguggggcuuuuaugaaagaaaaaaacauaaagagucagagaaagaagaacuuuuguuccauucucccaugucuccauuaccucccuuuugugcccucacccagccuaggcccugcaaagccauucuaugcuggggaagcuucugguggggccucccuguucuggugggccuguggccacccagugcuuuugugugcuaucuacaggcgagucugacccacuuggagcuuagcacagcugaggcuuacugcaagguagcccagaucugggccccccugugcuggaccugcucuccaaguggcagccuugcucuggucaugagcaucacuccucacuuccccuccagcuguuuucccuuucagcucccagccuuugguucuguaucugugugcccuucucaagaaacacacauggucuguuguuuagugcaccagaucugcggucugugaccuccugugcauauauagaugguucuguccuuuucucaggggcuccugucuucucuguauagaugcagcacuuuaguacucuuggcuucugcuaugacagugauaccaaagccuacuuguuuaccaaagccuacuugcucuuccucagacaccaaaaccaggcacuuccuguucuuuaauaggcaaggagagagaaaucauggcuauaagaagucaaaucacauauuuuauguguagaucuugcuccaguguguauguaccuuccacccagccucuguagcuccuguaagugaguguuacaugguuugaagcacucuuggucuucccagcugcuuuguggauccuaagagaacccugcccuauagcaauucuuggcaguucuuagcuuugggcucugcaggccuucauggucauccucaguuuuaacuuagacugugguauauauagagagaccacuuucauccaccaauucaagcaguuuauuuccagaaacuguauguagaggaggggcaggggugucauagcagaugaaaaugugggcauaccgcgaucugcuucuuggagauucuaacaccccaguuagaaagggauuugggccuggcccaaguuccuggagagcuuuucuguggaacccuauguugaagaacagugcuugaggugguucaggugacuuccugaaggacuuagcagugaggacccuuccuucuggucagugcuauggagccuugaucuggauucucaagauccugacuuguugaagcuauguuccaaggacgggcaaucagguaucuuguggccugcccugggcuuugugcgccaggcugggucauggcugauagcuugaaccuucugcuccucuggucuuuauagcucagggaugugugauaaguugcugaauuccacugaauuguggcucccagccagaccucuuucuaucaggagacaccaggccauugaacaugcccugagaacucaagaccuuacuggaaguaucuaacagaggggaauuuuggaagagccucugcccgcucuugcugugagcagagcucuagccuucaggcucccaacucaauaccugaccuuguggcccacaugaaguguugggagacagugguaggaagcagguggccagcuugugaaggccaggaguaggaugcucaagccuccuucccuuuccauggccaagguccauagggagcccugugaagcuuuugaugugccgccggugcuuggcucuaccaugcuuguuugccuaagcacugcuccugccaguucauucggaccuucuccuucuuuuaaaaacaugcuucuugccaaagguuauuuuggaucuguuuuuguuuaucagguaggauuguuccagcacaauugaaagcagacccacauguugacacgcacuggagcugcuugccagggcacgcgcacauacacacaugcaggauaugugggagucagccagagcccuugaguguaagugacuuuagaaugggcuccaggagacgucuccauagaagacuuguaucuuauagauggccuuuauaugcaaguauaggcugaauuuaagcagaagcuaggacaagaaccucuuaggauagguugauaggguuuaggggcuaccugucucugcugugccuguguaggggccuucacuacucuagacuguggguuccuucaucgugacuggguucccucauucucaggcugcugugugaacucuguguuggaccagagcugaccagauauaggucaguggcaaaagaaugggacugccaggcccuguggcuagaccuuucuuuggaacacagcugggugcuuucugcugcaagacuuguaauggguuucuucugaacaucacuccccauacacaccauggaccuggcugcauacagacugcuuagaggagccaguucuggaauacacucauuuguauccugcugucccuugagagccuguggcaucuggaggcaugcacauugcagagaaacuaggccugcccucuuuucaauuccaggccagcuuugcagggaggcaagugcaccaguucagcugugggucucacugaaaaggaaacagcccagagcagaugucuguccgcucauauuggguuaccugugauagcaaccuaagucagagaguucauuuacuucuccaacugaaaaaucagagggcucuuucugagcccaacugccuagcagagaugucucucucuuuguguccuguacuuuuuacuguacuuggcuccaguacaguguaauuugguacagcuccaggcuaaccugcucaggaugcccuccaguccuuccuaccugacaguacucugccacuccaggguucaccuuccugcugucuaacacuaacugcugaaguccagggcugggaccugagccucuggugcacauaaaguggucagcagcuuggcagagcaggacccacaugcuuggugacaugugugauacuacugucacccauucccuuccauaucguccauuuggagucuuagaccaacaaaggcacacagugggaaacacagggauacugcagcuuuccccuuaaauaggagggagaggcauuuuaggauuuucuucaacguuuucaaaauaagaugugcuuaccacuaagccuuuagcccuaccgaagaauaucuacagcuggcccuccccugcuaaagcagguaccacaggcugguuuuuccccaauagcuccauagcagccauaccacauacagccugcugcacaguucuaugacagugcuuugggggacccccccaacccaaauaucagggacaucuuuccuuuucaguaaacagaucacacagucacaaagcuaacugugaaacacaaaacgaacgaggcuucaucugagccuggacuuuuucuaaaauguacucuacucguucuuucuuugaaugucacauuauuccuagagcucugcauguaaguccaucuuuacuugaugacucagcucauuuugaugagcccgguguuguuauacugaugcagauuauggacauuuacuaagugacuccaugccagcugacuugguggacuguccuggguaaaaagguucugguccugugcaggucaccagguacagugugaacagagagucucuguggucacugggccuaagaagcauaaacaaggggaagcagugagggacugucauaggaaggaaguagagucagggucccuggcccuguggcuagcauauuggagacccauuguagguguguggugaugcacagcccaggugagggcugcugguaguucacuugaagaugagagugcgagcuagcuaaaggcuagccauuggccuuugugacgcuuaaugaacucuugacccuacccuccacuuccucuuaaaugcuggauugcaugcauauccuauaauauuuacucucuugcaccuuuuguguauguggcacuaaggacugaaccuaaagcuuuuaaugugcuagauacaauauucugcuaccaagucaucuacugggacacaggacuccugacaaugagaggauuuggaaagagaagaccuuccuucuugaauaccuggcaugugauggguggguggagaguggggagggggaggaguuguaaagaaggccaaaggguaaaggaaagccagagcuggccucugccuugcucucucacugccugcaucauuugcacuguggagcgguaggaugggcagugaucggauaacccuuuucuuccugcucugcagccucuccugagccuuagucuauuuuccucccguaugcugccacuguggacagugacccagcuuccccagugugcuccuucagguuacugcuugccagcccuggagccugcacucaucggccucagggcacuuggcacucuccccuuugugaaaagucucccaagucuguaguccauagaggcuuuaaaucagcacacuuaaaggauuuuaauuguaccugggaaaauaccuugauagcaccuguaaacuccugaguuugcucugugagaugcuuuucugucugaaaccugaaagaaauacuucuuccacagguuuguagucauaaauacauggcauuauuuuguguguuuuaaagcuacauguuagugguaauguuucugccuuauucugaaccuguucucuccaguuggcaaugugauuugcaggcuuaucugugcugcucugcagccuuaguucaugaagucuuccugcuguguggggcuccguaugccuguuaauuaccauucauuuauuucuucuuccagaugucgugguaccuggcaccauuucuguuguuacuugguuuucaggcaucucucuugcagcuuuaauggucuuuuuguugucaugguauauuguaccuguggugugauaggaggguucuuuucuggccuuggcuaguuggguuuuugaauuuccuuucuuuucuuucccuagaaguggggacuuucugcuauaaugucauugaaaucacuuucuauguccucagucugauggcugcucccuggguuagucuuuucauguguuccagugguuuuggaugcugugguuaagaccgucagagugguaacccuucagccuuaccuucacuugcugauauuuucucucccaccuuguucagucuaucaagcuuuuuguauuauugauuucuaguuuugcuuuaucuccgauucucucuaacuuucucauccaaguuguugaauuuauuuuuuaagguuuuuaguuuuuacgugugcaugccugcguguacaugccucagcagcacaugcgugcaagagcucaaggaggccagaagacgguguugaauccacuggcauuagaguugcagaugugugggagcugccaugugggugcugggagcccagcagggccucugcaagagccaggaagcacucuuaaacgcugagacuucucucuagcccuuucuuauucaaguuggauuuuuuuuuuguccaggucuugaauugacgugaauuuacuuuauuugucuauuugaauauucuuugagguaacugguuauuuuaaaaaccaaaauuuuuagaucuuugucuggcaucucaggcauuuugcugucuugguuucuagagaguuguagauuguggaguuauugucuuucauuguugcuuugucaugugcugucugaauugugguacacauuuguuggaaugggcaucauuucugguuucaucuggggaucuucuuagucaucagucuucucuugagggcucaauccuaacaccagggaggagaaaauaaacuucaacucaccaagacaaaccaaauauagaaauacaguuaaagucaguuaagccagcuggcacagccauagaaaagaggaucgcaacaacauugugaacugaaguuaaaaucagucauaauaaacacgauaauaaaugaaugaauuagaaugggcagugaaagggaaaaaggaaagaaaaggcaaggaaaauagaaaaaaagggaggaacuggggauuagaaaagagugagagaugaaucuaauuacucacuaaggaaaaguaccuuaaugaaauuagaaaaguagaaagagugauuuaaaaacuaaacacagaaaagauccuuaaaauagaaaacugaagacaauuaauaauauaguaaacagaaugaaaacgauuuuuaaaaugauaaugaguugagaggcuuuuuucugguccuuucaaauuggaaucugcugguauuggguaguaguuguggcuguugucuccugcccuuuuuccacagcccuuccuguauuacuuuugagcuucuaggagccacuguuggccuaacaagcuuugcagccugugaucuaggcaagauccacauuauccugagacuccccauuuaguacagucaugacgaucaaauauucaagcccaggagaguuucgaagugcacuggagagugggagaaccaaacagcucugagacacuggaggggagaacuagagaaagcuagugcucugucugcugacccagcacuuucagaccugcccagcagugaaccaaccugcaaggagggaggcagcugcagcagucaggccucucugcucacucugggcccagagaucucaauucaaucagucaguagagcacauguucagggaaugggcuccugggcuagcauuuuacugaccaugggcucagggccucgucaggaauccuuagagagauuccuuugccguagagggagggcaggaccacagacuacagcaugagcccuucuacugaagcuucucugaacccagcucucuacuccccagcccucaucuuuuugccaaggcugucuccuaggcaaauaccaaagcauguguccacagucucccuaaguugcauuuguuccuugucugcagguuccagaguagcuuggcucuccuuucaagguggcaccuggcuacagcacccccaagauauggaaaauaaucaaauggauuuuuuuucuccaucaguguccugcagcacaggaggaguaagguucguccucuggcuagaaugccuguuggcaauucaggacugccuuucuuuucuugaagugugauuuuuggccccaaucuccaacagguccugugaagacugagguuuguccagcuucuucugcuaccuugccccuuuccauaaauuccaauguucuucuuucucucuggaacauagucuauucuuaguuaccugggaucuuggccuuucauuauuagaugaauaugcuccaggcauuuuucauccuucccuuugugacuguuaugaauauuugaauccauuguucagugugcaccuccaugauccccccccuccuuaugggcagaguuuggucugguaggaagaggaagccucaccuccuuaaggaaagaguaucuuauccgggugugguggcgcacaccuuuaaucccagcacuugggaggcagaggcagguggauuucugaguucaaggccagccuggucuacaaagugaguuccaggacagccagggcuacacagaaaaacccugucucggaaaacaaaaaaacaaaaaaacaaaaaaaaaaaaaaaagagagaaaaagaaaaaagaaaaagaaaagaaagaguaucuugcuacgcauuauuuggaaccuuucccacgggaagugugcuuuucuccccaucugguaauuuagucaggcaucuugaucaguguggacuguggauuuggacuuuauauguaauguuauaauuauuauuuugcuacucagaaggcuuaauccuugaccacugggugcucucucagucuggcuccuguguucccuugacauuuugaguacuuccugauuuucagguacucucugcucauccuacaauuucacucccuagcccuggaaucugcuguuuuucccagaagccucugguucuuuuaacugguaaaugaucauauaaaccaaggucugggcacugguacugucauugacacugggucaucauuacuucugagcuuuguuagaaaucaaaaaauacacucugguuuaguaacccuuacauacauauauguaauuacagaugaagcuauguccacccacaugaccuauauugcagcuuggaagagucucugacuacaaucaaagcccaugggggcucccucuggucuucccuccuccuugucaauaaugucuccuaauaaaggagccugguuuaauuuuacccuugccuguagcuggcuuagaccuccccauucucucuauuaaguugauagaggugguuugaugaugucaccuacaauaccauaagccaauaugaugcuauucagacagucacuuagaaaaguagacccccccccagaguaaaguugauauguaaaagaugaccuuaaaacauguaggccagggaguuguacacaggaaagaccuuggugaagcaacucagaaguggaggcuuguauacccuucugucuccaagaaaggcuaugcagagccaugacuaccauggaaagggaagaggagaugggaacuaccugcagaucugugcaugugugugagugugugugugagugcaaugcagacacacacuggagguucuaauggggaaagcaaggcuggcugagaccagaggaaagaauguuguaagaggacugcucuucugggguuagucuaagagaauuagucuaugggacugcuucucagugcuggaaauaaagcuuggggccucccaagcaccaggcacucuacuagugaguuguaucucugcuuuaaagaaaauaaacaauacauucucaugauaggaaaaaguccaaauguauugcaaaguguuucccacccuagcaccauuccauauguauaccugugcacagucaggcauaucuuuguuucccacuccugcacuuuuaauggcacaguauuuugucccuugaguucccccacaaagaaggggaaguauuuugucuuggaagguguuucugaguaaggacagaccugccuguauccugcuuaguguuuauuuucagcuuaauaccaacuaagucaucugggaagggggaaccucaguugaggauuuccuccaucaaauuagccuguggacaugucugugggauguuuucuugauugcugauuaauguaggagggcccaguccacuguggguagugcccuuccugggcagauggaccugggcuguguaaggaagauagcugagcaugagucgaagagaacacgccaguaagcagcgugacucgaugguuucuacugcaagcgccucacuuguauuucuguccugaccauccucagugcuggacuguaaccugagaguuaaaaaugaaauaaacuuuuuccuccccaaguugguuuugguuaguguuuuaucacagcagcaaaaaugaauauagcccauuucccucugcuuuacaccacugcagucacaauagcacaaacacaccuuccuucaugucauaaccagugugccuguuuccagucgugguuggaugucuauuuugugucuuagagcauacauuuaugacacaggucuuuuuuguuuguuuuuguuguuugagugauuuugguuuuuaaacaaauuucccagaaaagaauuucuaaggauguaagugguuuuggcagauguuacaaagacaaaagucaagcugugacagcugguauguuucacucggaguagaggugccaaacaggaauuugacugagucucuugaauccuuaucuuucucacuacuggaaggaaggaaaguguacauucacagugaaccaguuaugccugaacaagacugagcucuguauuucucugacaaugaucaacaggucagggggcuuggguucacucaucucugggacccagcauagggccaggugagggaaagaaucaagagucaggugugaacaagcgugcacuugcacccuaggaauggggccccacauugacucucuaggacaugguacucagcugguauguugggcuggagaagaccuguagcuuacacuucgcaggugagagagcuagaaaucuauacuuaucugguguaagcuaaauaaaacccuugucuauggauccugccuuuugaccaccuuugggauguuuguucaccugccucucugcaguacccuggcaucuucucucuuuggaggcuucuauccugucugagggggcuguggagaauggccaguuucuguaucauaugaaccaaguacucaguuucagccagguaucaguauggauauaguuaguauacauggaaggguacauuuguaucuuuauccugucuagggggcuauguccaguggggaggaccagcucccauguccagcacugguaugggcucauauugcuugguauuuagaguauugugaauuagcugguaagugaucuuuuaugaauaacuauaucauucuuuuguacauguucuuuaauguugauaugaagaauuucuuuuguguuugggacacguguccucugucagauaauaguuacagagauuauuacuuccagucuguagcuugccuuuuucuugauaucugagaucuuuuauuuugauaagcuucaguuugucuuuauuauuguuauuauuauuauuauuauuauuauuauuauauuauuauuaauagcaugugcuuuuuguguuguagguugugugccaccccaaauuaauuuuuuuggugugaagaaaggcuugaaggauggguucuuuauuguuuuuucauaugucuauauaauuguuuugaaaagaauugccuuucucccauuaaugccuugacauuuguguuuuaaaaagcgaauuacuugggcuggcagguuggcuaaguguaugaggaugcuuguuaucaaggcugaggaccugagguuaguccccaugacccaugcuguagaaggagagaacugacuucagcaaguuguucucugaccuucacaugcauauuuacauacauagguagauuccguggggaauguaaguaaaugugugaaugucguucuggacucuguucagugcuguugaucugccagugugaauuacaagcucaugcugucuugaucauuguuauuuuagaguaauuuuuaaaugaaguagagucagucuuucagcucuguuuauuucacacauuguuuuagcucuuccaggcucccugcaaccauaggaauuuccauauuaccuuacuuuuuuaaguguauugggauuguagcuggcacuggcugagauccauggaacaccagaggcagcugaccucacgccugaguacccuaguccaugaacaugguauaucuucuauagcuuuggggagauaguuuuccccaguaaagaucuacaguuuuuaauaucacuuauuaagcuuauuucuaaguauuauuugauauuacugaaaauauuucuagcuauuugcuguuugaauauagaaauacaacugauuuacauauuuuuaaauuauuguuauuauuauaaguaaguacacuguagcugucuucagaugcaccagaagaggacuucagauuccauuaugggugguugugagccaccaugagguugcugggauuugaacucaaggccuucggaagagcagucagugagugcucuuacccacugagccauuucaccugcccccugauuuacauauuuugaucauguacugcuugcugcgcucacauauugaauauccacuccaaagcucagauuguauacuguagcuuggcuuuuccuugauaucuaagaucuuuaacucugaaaacgucaguugucuuuuuuauuaacaggcugugcuuuuugucuuugagguuguguauuauuccaaaucaauuguuguuggcugugaagaaaggcuugggggcuauugcugggguuuuguuuguuuauguguuuauuuuuucauaugucauauagaauuuagccaccauucuaacaguugccagagccuuuaaauaagguuuaggccuacauuucuaacuuaaguauggauauauauuagcuuucccccuuguucuauuauuguauuuuuaugaacguauuuuaucuacuuauucauauaaaaauaagaaauauuucuuuuuguauucuuuuauguuuuccagacucuguuaugaucuuccauuuugcuaauguugauguuuguugaacaaucaacuuuuggccacugauauuuuuccuccuuauuuucuuccuaugccauugucuucuccuuguuuucuuucuucugauuucuuuggguuauucagcugugcucaucuaaacucuugaggugagagcuauaucauuaaucaccagccuuucuucuuuucugguagauacauuuagaacuguaaauuuuccucuaacugguuuaacuuccucuaguaauguguccuacuuuuaaucaccugacuaaagcuuucaguauuuugguuaugguucuuucuugggccuguaggugauuuauaaaaguguggcugaauuuucuaaaaugaguuuccuaauaucuaagguuuguuuuguuuucaaauuaacuuucuucuguuagucagagaaccaacaucacuucugucuugaugaggaaucaccuuuugacauguacccccaagccucugcugugcccacuggauaggacugugcagugguaccagggaugaggauugcuuacgaccacugaccaugaugggacaguuguccaguugcaugcaguauguaugagugguguucagccaguucugguacagcacacucagucacaggauguguuugucuggucacccaggcuucagagaaacagaaggggcugaugcaagaagcugcagcagguuccaggcucuccaagaucccuccuugcucagcauugacaggcaugucauguccccucagugcugccucuggugacggccaaccacaagagcagggguggccccuggcugcugcccgaggucugggcagaaaaggaaacaaguucaaguaugucaccuguuuauaguuuucaugauuuuucauuuggcauuucgcgaucugucugguuuuggucaaggaaaugcacccguaucucauaacaggaagccccuuuugugaucuuuacuucaaggcauuuuucucucucuacuucccuuuaccuuuuuuuuuucuuggcaaaaauacagaccuaauaugaugugcaucuuauuaaaguucagcauaauuuauugccauugguuuguuuacaaaauaaacauuccaagcugcaugacauggccuuccaaccaucacugcuccuuuuuuuguguguguggguuuuuuuuuuuccaucuuccuuggggcuaaguuugggcugggaagauggacaagaacucaggccugagagaaaucacaugguucuaugccugcuuccugugggagucacuuguuaacugccuaguuccaggcagcuagcugcccuagcagccaguauuagugguguggucaggcaccccaccaugugaagcuggagcacaucccagaccugucuuugccuucuaggugagggccucaguugggaagugagagccagggaauucuugacccuucuccagccagccauccuucugccaugggaaguguguggugggaagaggaagaggaagacaauaagaguuuucucacuguuccucagccccaucagagccuuacaccuaguggagcacaugccauugccaugguccaaguauuacuccaucaauccagaggagcuagaaggaggguaggagagauaauguuugccuagguaccuggagacagacuagccuggcuguuucuguggagaaggagauuaggaagcaagaguucauccucugcuagaagacuaguuguccucacuagauggaccaacuuuggaagugcccaaaagcuaagaaacacaguccauguaggaucucagaauacacucaucaggaucagauacccugccucugauggggaaaggugaagugcaggcuagguaaagaaggcaaccugagcugaucugacccucugaagccagcauaguccaacuuugccuggcaucuuuggccucuccuguuguucuacccagagucuagugcugcagacuucaugaugggcccauuuuccucuguagucuggauuucuccacucuuucccuagcagagcaagcugcaaguguuuucugggugaggcaagccuugaaacuauccacaggccuuccaggcuacacugugugugccuuagagaggcagcccagggguuaucucguugaucuuucuaucccuccacucuaaacacacacacucauuccuguccaucucccaagaaucuaaugacaacugccugacuucaggguacccacugauuguuguguuagaccacauuuguaguggcuucaggcaauaugugcacaagcuaugcauguagcacaagcuccuaaugugauauaaaccagaaaagcuuuuuaggaccuugcccaaaauugcugauauuuugcagauuuacucuuccaguuuuuuccuaugcaauguaaaaacagauaaccaccauuucuuacauaagacuucuuacuguucugugcucaaguauuuuucuguguguuuuacauauaccaugaauuauuuuuccuuuuuggauauuuaaagugacauuuuuguauuucauuaugauuccaauugaauagggauaaagguaaaauugugugcuuaguuccuuugcucagcucaugaacauagaaaugugacuuccugacagggcaaggggcugucccauugucuuccuggagcacauaauguauguguagucuccugugccaguggcccucuuauaagggacuuggcugaguuggaacaacaggacaauacugcauuucuguagaaugguaagaggcuaugcagccucauacccucuagcuuugaugucuauguagagcuggcuuccucucaccuguaccugagcaguucuuagucagcauacucagcccaguccugcagagccccguacuaccuagggcugugggugauuuuugggccggaacuauauugaaagagacaguuuuggggugucaaaaccuuuucuauuggaaaugagaagccugggucugcuuuggaagcauacuggaaagccagucagguguccagguaggcucugauuccuggcugagugaauccaccuucucuuaguuagcuaggguuucuauugcugugaaaagacaccaugaccagagcaacucuuauaaaggaaagcauuuaauuggaguuugcuuauaguucagagguucaguccauucucauuauagcgggaagcaugguagcauuuagcagacaugguacaggagaggucaccaagaguuuuauuucuggauuggcaggcagcaggaagagagaguaagccacuggguaagagugggggaaaucuagacuacagaggaaaauaggcccauugggaagucugcaguucuggacucuugguaaagcaacagaaaaguucaaagauaccaggaucauguuugacuaguugguccccauuugguggaacuguuugggaaggauuacaaaguguggccuuacugaagguggugugacacugggacaggcuugaagucucaagacuucugccauucccagugugcucuuuaucuccugcucaugggucaggauguaaacucuuagcuauucccaccauaaugccuuuguucugccauuauggaguuuaacccucugauacugucagcucaauuaaauauuuccuuuugcaaguugccauggucaugauauuuuguuacagcaauagaacaauaacuaagacacccagcgcucgcucgcuugcucacucuugcgcgaguucucucucucucuuucguuuuguuuguuuguuuguuuguuuauuuggucuuuuuuuuuuuuuagguuccucacuuuaauuuaucugccucaaaauagcuuuaugucuauuuccacucuggacucuuuccugaccugaaggagagaauuugugggagaaugggccagugaugggcugguaccagagggacuuaacuaugugugaucauugaaugaggauggguaguggggauagaggggucuuugaaagagggucauguggcagcuguggggcccagaagaaggccccauuuggaagguggcugcagaaauguauggucagcugccccuggccugaguggcugcacuuuaugaaugaugacguuuuucucacuacaguagaaaaacuaccagauuuuuaucaggacaagucauugagaguguuaguuaagacauuugucaaaauucauuuaguugucaaaauuaaaaucauuuuccucuacuucuuggaggauaggcaauaaugauaacaaauuucauggcaugacauuuaaucagccugaucaagagacagaggggagcugggcagagagcagagggcaguaguguuaggggccuugugcccuugauggauagggugaggucagugucuuaguguuacuauugcugugaggaaacaccaugcucacacucacauuacaguucaaaggauagcaggaaccuagaagcaggagagguggagaggccauggaggaguguuacuuacugccuugcucaccuggacugguuuagccugccuucuuauguaacauagaaccgccuucccaggguguucccacccacagugggcuggacuccccuacaucaaucacuaagaagaugcccuacgggcuuaccuacagcccaaucuuauggagacauuuuucucagcugaggcuccuccuucucaguggcucuagcuuguggcagcaggacaugaaagucuguguugauaauggaggccaaauuccugagauucugauaauaggcaaggaugacuggauaggccaacagaugcauuguucuggucucaaguaaguucaaaaauaaauacccuggguuggagagauagcuuaaguaaagugcuugccuuauaagcaugaggaccugaguuccagccccagagcccacauagaaaggccaggcacagcggcacauacuuguaaccccagcacugggaugcugacaguaaauauuuuguuguuggucucugcaucugcuuccauuagcugcuagcagaagucucucugaugaugauggggcuaagcauagaucuggacuucuggcagcugacauagugccucugugugucuucuuuuaaaaacaguacucgagacaggcauggcaguucacaccuauaauuccaguacuugggagccugggcaggaggauuucugugauaccagggacaacuuuggccacaauaugaaguccugacucaaaagcaaaacuaacaacaaugaaaaugauaagaaaugagagagagaacucugguuaagagcauguccugcucucuagucgaccugaguuuaguucccagcacccacaugauaccuugcaaccaccaacaccuaacucccaacucuuggggauuugauaccccuucuggacucugcaggcaucugcauucacaugugcacauauccccacacaggcaugcacacacauaagcagugcuggcuuucaugaugcuugucagugugcauauuuacgucugacuucguucacaucccauaagcuuucaguuguuugacugcucuguuuuauguagcccuuugauagacugcugccuuaaaacauuucaguugaugauguacacacagccugcuucuuaugcucaguuggauuguaugaagguagcaugugugacuguuuagugauaaggcugcccauagcuuuacauccauaguucuuaaaaaauauugucuaauuuccucccggaagaguggcauuaauuacaccuacagcgcucugugaagauuguuccuuuccccagacuucugccagguugguaagcuuuacucagugaaaugaggccaccuuccuuugcugccuuugaauuucugcgacuuaugaacaauaugaucuucaaacccuguuuacuggacauuuaugucacugucuuuauaaacuuguucacuuuuguacucggcuauuuuugucucuuuaguuuucauaaacucuguaaaaugaagaaauuagccuaugccaaauguguuacaaguauuauuguucuuucuguguuuuuuuacaguguguguguguguguguguguguguguguguguguacauaugucacaguguacagguggggucuaaggacacuuuguagagcucaguucucuccccaccaugugggucccagggacgagcucagaucaucagacuuggcagcaagugcuuuacccaccaaagcauuugccagcuucuuuugguaaucauuugacuuggcucauucuuuuccacuugcaaguuuauaugucuuguguguuuucucuccaacucacaaugaccucugagguuaauaucucaccccacacuuucaucuaacugccccccccccccaguuucuccauuccucuguguauagucuuugccuuuauucucaugagaaaguuguauucuaaccuuacuccugucaggugcaggcaccauguguugcauuccccucuuaaccgucccuuuggugucacacuuaggaaacauucaggccaucuuugugcucucuuagagcucacuguucugcucacacccccauugccagcacucuguuuuuuaugauuauucuaguuuggaagggguggggacucucuucccuuguuuuuuuccuggugucucuguugcuauuucacauuuauguuucagcuaaccuucacaccauuuuaguguaauuauaauugauuugaauauagaacaguuugaagaucaacucuuuagucucccuaaggauaaauacccauuuuaacaucuggucccuuuuauaugagagaaaguauuuugugucuucccaucaacuucacauauucuucuguuucucuacauuccuuggcuuuguacuagacaugaaaucuuuuauuuuuauuuuuugcuuuugcguagaaaacuguuggcuuaggguuaauucuauaaacucccaacacagcccucauugcuguuuguauuguuuguuuguuuguuuguuuguuuguuuguuuuucugauccuccagaaccuuugguaugugauuggaucguuuuucaagcagugauauugauauuucuguuguuccuuauaaauacuuagggucacuuccuuucucuuacugcagugcugacugguuauagaacaagauguuaguuucuggacucauuuaacuuuuuccuugaaauaaggaaaauuucuacuuauuuuuuaagucaacaagcacuauagaaauuuaccaggaaucuuuauaauauuauuuaggaugauuuuuaaucuuuuguucuacuaaugugcuggguucucuaguagugcauaacagaauagaugcugcuuaguuaccugucauucuuuuuaauauuuggauuguaauuuugaauacuuuuaagauauuuauguuagcauucauaauugagauauaugguugacacuucugucaaguuauggugucauaugaacagaagacuucagaggaagagcuugcccacuuuccucuguguuuugucugcuccuuagaggaggaagggagcuugucucugcaagcaucugaacucaguauuggagggaagggugguacucuggucuuuuuuauuucagucccuccuaucaguuugguaacauguuuuccugaaaaauggccuguugucuauuuuguuuuauuuuggucuuuuugagacaggauuucucuauuaucaaguuggaacucccuguguagacuagacugaucuaccucugccuccugagugcuggacuagaggugugugcccaccacugcccugcuucuguugucuguuuuuaaauguguuuguauuauguagcccuggaugcccuggaauucacuauguagccaagauggccucaaaaaucacaaagauaugccugccucuacuucacaagugcuuggauuauauguaacaacgccuggcauucaucugccgcuuuuccuuuuaaauuuuguuuaugcaguguuggcuuuaacaauucccuuuuguacacgaugccaagccuaccauuauuuguauucugacugaauaugccaccaugccuccacuucacucugccucccugggcuucaugucccuuucuuacccugggagggucucacaaccucuccucagagauccaucagcaccaccuuaggugcucuccacugagaacugcuacuucccagaugccccugggguccuuuaccugugcaacugguuaaggaggaguuucucaucucagguucuaggcucuuucucucgggucuuuaaggaauucuuugucuauacaguuuuuaaaguccccccacacuuuucccaaguguuccugucuguaagauggguaguuuuaaagccuuuggagucgccaggacuugcgcucccuauuucauguuuucucaccugcuuuggauaacaccggccuuuuaguuaauucuuacucucugacaggcaaugaaacuaaggcucaggauggcgacucucccaagguaacacaguugaagcagugauuugcuaagcuaugauucacacuuaccucaggggucccuaauucccaagucuuuauuuguuguuucuguuagcagcagccauagcacuguggguggauuccaggucacccuguauuucuggcuuuugaggugaacuauggcacauaauguaaccugguaacuagacuuauuuugugcuuaauuggaagcagacugcagugggcucaaaggucaagcaaacagccuucuggccaguaccuugcaacccucccaggcuccucgagugggggcggaucugcugccuggaauguagcuuggccacaugcaggcgucuccugugcugcccuccaagcuuuaccucagcucuagagcacuccggacaguguuucuagccucaguucugugucgcguucagagacaguagauggagccagagacuuggagaaaaaugaaauccaguccagagucccuuacucuuggggccaagacagugugcugcagguaaagaaaaggcguggcucccuggggcugaggaguggccaaggcuuuuucuuggcuucuucucuguggucauauauuaagguuuauaugagaaggaaggacucagggcuuagucgaaggaaguucauugaaagucaggccugguucccacaggcuacauggcugcuuuauuggccgugcccuggguuuucguucguaacagagagucuucuuucuguuacguuacccccacaccagcgacuagaaacccgcccugagacauggcugaguuucaugugcaguuaggacaggcaggaaguaugcuguaucugcgccacagaggaucuaauaggaagggucaggcugagaagaguccccacucuguaagugcagccauggcagcuuggcugaaaaccuggccuugcacaucacccugggucuccucuaacgaacagagcugcacugacagcagcuggccuugcccuguugacgggaccaugcuucucuccuaccuaccccuggacugguuagugcggcagacauguacccagugacccugugugacucccacuguaggagugcaugacacaccaugcuauucaaacucacuggcucuguggcagauuaaacuguugucugggguuagauggagcaaguagcuuaauuccuuaacuguuuguggcacacgcugccugcauaggcucuguagguagcuaggaaagcagagaggccuagcuuuuguuuuguucuucugagcucccuuggccugucagugguuauggaugggccauucugacagaugucagcugggggcuugugcccaggagcucaagaacagucugccuuuaccugggaaccaggcuaugcagcauuuggguuuuuucuuucuaucacuuucucacaaguacucaccaaggacugaaccaggucuggucaugggagauuguauaacagcuuuucacuuauuguugggauugucuuaguccaagguuugcagagaaccggaauuccaggugguagccaucacaaguagagagagguaagguugacagagugggccuaguaucacaugguggggcuuagcagcuaaucagggaacagggcaagaagaaagggauggagauccuggcugggaacuacaaguaaagagaugggaaagcccagcagcagcauuaaagggcaagggucaacauacaggaugcggaaaggaaggagggcccuuagcgaucaucugucuggguccaugcagauaaccuccauacccacuauguagcaaaaggagaaacugagguucauagaggauaugugcauggguuauauaaccagugaguggcuguagauggauuuauaaaaagcugccaguagcuauugguuccagccagaaguuauugugacucuccagccguaagguucaaauggaugcucagguuuuaagagaccuaaaguagaguuagaaaaaaacacaaguggccaguugcaaggagauaagacccaucaggaccaacagagagcuuugcuuccagccagagaaguaucugcuccucucaggcuuuucucaggacagccuggcagcugcccugggccucauccugucugacuucccuaccuggccuagccugacuugcugagaugccaccuccacauucugggguucuacucaugugccauccuuuucagguuuuuacaccauccauccauuuaaagucaacauacuugagaaaggaaguagaaaacaacagaggauugguuguuuucuagucacacacacccugugcaguuuaaugaagucauaacagaacagaaggaggggccugucugcucugcaguucucaggaagaaaagcaggugccaccauuaucuccaugccucuggccacugugcuugagagccuaggaagcagagccaugaguaacccauaaccuuggacuuggugugcugagccuguaagcaggaugacaaaauuagagcucaccucagugucucuaaucugagcuggggaagacacugguucuccuacuuuucuccguccugccauaagcaggggcugugucuguuaagcugaaaaguaucuguuccuggccaaggaagacuucagcuccccagccccugggguagugagugacagggcugccacuugcagccuuggcccuggacucuuucacacuuggcaguugauuucugaguguuccugugcaugcaggguagagcaccccagccuccugacaucugcucuuuugcaguccaccuuuuguucuguuccuuuucacucaaaaaagguuagauuugacucacugaacugccaguucacaggguggaagccugcaguggggcucaggcucuggccuacguagcagacucugccaccuccugaccucugucaucuccaggacucugcuauuucccaggcucugcagucuccugggcuuaucaccuugacuauuccaucucccgucuccacaccuccaagacuguaaucuccugugaaagucccucuggauaaaacuauuugauuuuagaaaggcaucucaggaaagcugcuaccuagcgguagaaaccaacuuugaaacuaacucaaccaaaggugguuugcaucucaggaaaaagccuauaaaauuuuuuaaguaaauaaaauucagacucagagugaaaccgucaggagaggguggcaguaugcuucaggaagggcuaacuguggaggaccuuuaauuguaugaugccuugguucucagaaaguuuccuuauuuuuacagaaauaugaucuuucugcaguuuccaaaagugcuucuuugggaacacagugauguuccuuucagagcauucgccuguccaccucucuuucacagacccccugcuggaucugcugguuuucugcagggaagagcuugacagguaguuagugaaagcauggacauguuacaggguuagaagcugggcauggucaggaaaaggggaguguuucauuucacuuccuucuccauacaugaacuguagcccuaugugguccuugggccuugagggcacagccugaaaaccuggccauuugcagcuugggaaggcccaggcccuagaacuaguuucuagguuccacucagccucuaacagugcccugccuuuugugaccuuggguugggacucuuguacuaucagaaccucacagagauggugcagaggcuuagcgcucauugacaugcugagaacagccaccagcaguacugugacuugcaaugcuuuuguuccaucugucccugaccauuugaaguaccguuagaaauauuuccaguucucacauacuccuccuucugaggacaagugggcccugcuuugugcuguggcccagugacuuguucagugaagucuccuucuuuuauaacgguauggaguuggcacaguauacuccagaacucagacugccuggcccccugcccuuuacccacagguggguuuuccagugcuauagccaucuagauguaguguucaugacaagacugagucagaauuuggagaagugaagagcccacugccugucaugcugagagcugagcuguuccaucuucuguucugagccuggccuggccuggccugcccugccuuauaguuguacugaugguauuucuuucucagaggagcaaguuagagugcuucaucacauauuagcauuagguacguccuuccaucuguguccagcuacccauagcugguccacauaugugucuucuagaguuauagccacuucuacccacauagaacagaguaguggggucuucugucguuaugucaccagccugugcugggauaaggggagccuuuguuuaauaugagcaccuagcagcacucagauaccagcacucagcagaggguccaccuucacucuccaaggaaggacagagccauccuugguuguugaaaaguagaauguuucagcuaaugagaagcaguugagagauggguggccaccauccuugcagcaggccucguguccugaccugcuuguugaggcgcagaugacaagcaggcuguaacagguguggcuucauauggccagaugacaggcagagaaacaguggacuaggcugggcagggccucuguuuccucugcucuucucugucuuguagaagaauaucagaagagaguuuucauguucuaagcuaccaauuguagaaaacccugacccucucugccuaguucuucugcaggaagaugacuugguuuggggaagugcugguuuuggucuuauacagacugugauuagaauccagggguuaccagcuuauuagcugcacuguuggguugaaucaagaaacccuggaggucucuguccucucuuauuuccaaguuccaucauggaagagggggccuacuuaggaaugcacacuggcaguuuggaauauagguaauacuuuuucuaugcuuggcagugcaugagcggcuacguccugcucaucccaccaaaccagaggaagccuuccccugcaagggaaauugcugcaccugucacuauuucuugggacaacauggcuaccugaggucagaggucugugacuaccuauugaagccaauguuggauauggagaagauacaggguucacugucuuggcaguggauuccuacugugcuucuugugggcugugcucccaaguucagaaaaguccugggcaguuccuuuccaugccacacugaacccccagggggcuaguagguguuugccaccauaagcacaugguacauaugccucucaucuaagcuggcuuguuaucgggcuagcucuaguagaucuguuccacucucccaagaaaauauugcuacccacgaugugcaugugaaggucuguauguaggugcccugaagacagagaagggcauuagaucuccuagagcuguaguuucagguuguugugagccacuggacagcaguccugggaacugagcuuagguccucuaguagaauaggaagugcucuuaaccacugagggaucucuccaaccccucacuuuuguuuuaaaaaaagugauguccugagauggaaaauaccacaaaguuuacagagugacagaacccugaacacuucccgcccuggguucugugucccagggagcugcugcuauugcucuucuaauaacacuccagugucucuccucauuucacuucaggcucugcagagugcaacccugcuuuuagcucuccaggucuagauuugacguauacauagauaccucacuccuaaacacugccuaggagggaaaaaugugcuuccagaagcucucaaauaccugccccccugcucauguuagaagcacagaaagaacaccuggccaagcagaguucuuucuuuuuucccucugaugugagcucucaagcucagcacugcuguauuuggaccugauaauacugcccuaagaaucauguggacucuauggaacaguuagaugccucucuggcuguacccaauguuguguccaugacacaguaacaccuccccacauuccuuauugccauggugacaggcagcaguugguucaugcugggcauugcuaccuucuacuagaggggucucuccaagauggggagccacugcagcacugauagaauuuggagaguuguacagagguagacacagaugcucgaugugggaagacaguagcagaggucagauagagacaucagcaugcauacugccugcucuucaguaccaccaccccucuccuuucuuuuccucucucucucucucucucucucucucucucucucucucucucucucucucucucucccccccccgucccucccucccucccucccucccucccucccuuccugccucccccucacacacacauacacacacauguucacuuauucccucacacaggaucaggaucucauacuucuaucaaagaggguguaauaugaugugcuguagguguguuauaaagcuggauuucucaauggcaauaccauugagaaauagugugauaugcagaaagagacuucugaggauaaugccgaccacaccaggaccugcuuccugugcugugaggaauaacacaauagugaucacacauguacguggggacagaagccauguacauucucuaagcauuggguaucucuguucuuucugaggcagcagcuuaguuuguagccuggacuggucucagcuuccacacccaucagacauucuaugaaggaagugucugucaagcccuccccaggugcugggcuucucaaguucauguccacaguaaaauuuggcuauacugguaggcauuguaggccuuuaucaucuuuagauucaggaaacagaggcucagaagauggggccuaugcucaggaccacacaauguacucaaagggagaagagccaugcucagacugccugguucuuguacauccggcagacagggcugggucugagggaggaagggggagauagaaaagaagggaggcuguuguugguacucuguguuguagccaauuaaucacugucagggucucuuugccugaggccuuugcacagugucaguguguggauaagcuccaugucuugaaaucugcacauucaccagagcccuuggcaggaugaccccaaccagccuaccucuugggcucagcccuccccugccacggccaagaaccucaaguugugggucagcuuggacccccucuuucuuuuuuuuuuuuuuuuuucuuuucuuaauugauagucuuuuucugauuauaaaagcaaugcacaccuacuuacuggacaaaauauggggagguguaaggaagaauauuacccagacguucaacaugcaccauuguguuaaugucuuguuugcauagcaaggcucacugggcucaauuuuuacuuaauauccuauuuccuuucucucuccuacccgcccuccccgggcuuuuucugagucaggguuucacuguaaagccccagcuguccuagaacuagcuuuguaggccagacuggccucagacucagauauuugccugccucugccuccugagugcuggcugggauuaaaggcaugcaccaccaccgccuggcuuaauaucuuaauucagacacauuucaauaccauuguuuugaguucccauguucuugacagcucuuggccaguugcuacuuuauuggucacaugauauuauguuuauauguuuucuuuauuaagauucucaaaauaauuuuaacuggacaacugacaccugagauacauuuuuuuaaagauuuauuuauuuauuauauguaaguacacuguagcugucuucagacacaccagaagagggagucagaucucauuacggaugguugugagccaccaugugguugcugggauuugaacucaggaccuuuggaagagcagucaggugcucuuaccugcugagccaucucaccagccccugagauacauuuuuauugugacucugugcacugccaggaaggauagugucuuugaucacauccuacuucuugucuagcacaaggccaugcacacauacauuucauauagcaaguauguugucaaucuuucauguaccugugcccacacacucuggcuucucuggcccugcagggcuugacuucucagaaggagccaaaucugccacagccucccuuaugauucacgugaagauugcuuggcauuuaugcugcacagcuucuuuccauguauaguguagucuggggugacucuagcuuucuaaagaacugucacgugugcuuacugucuggagacccauagccacuggggggugagagggggguaaggagccugccuggagccuaguggagcucgggugcagaagacccagggugagagccaacaggcggggcugcugcuugguccgccagcguccuuucacuggggcacaggccucccucagcgcuguguggugccaucauuuuccccucccaugacauacgacagcagggaguugagugguuuguuucaucucuucuuaagaaaaaguuaaauuuauaaucccagucucgaccuuccuuguaacucaugugcucauccuguuagcugguuuaauauauggcaccacuauuucauuaaacaacauacaggaauaauuaguucagcaacgaugccucagaacaaaagcccuugauuuaguuuaacuuuauaaguuguucucuuuugaugugcaagaacacaucuggggucuuaaagaaagcagaaagaaaaauaggagccguuuuguuaggcuggguuaggguuucugagcucaaccaguaacccuuugguaccagaccucccaagccagcaugagaccugaggggagggcaugaaguguggagacaacaggcaggacugucugcuguggaccucggagcacagagucccuuucuaacugugucccccacauuuuccuccacccugcagcaguccucagagucccuuggaguuugcugcugugcauagugaggcaggccaggaagggaauggaccccacuuguaggacacucucuguagcccacuggguacucuggguuugucuuuuaaauauuucucacucagauggcaucucaugccugucaguuaggguugaggacagccuaauucuuguugaaccuguagauucauccuuuggaagagcaaccaguguucuuaaccacuuuggggaugguguugcaaaacuccuaacugagcuggguggaguaaacaccauucucuggccgccauaagcauagacaucuuggaggcacaugaucccugaacacuggcuaccugcagguagggagaccagacccugcauuagccuccagcacuuaacagcuauguagcugugagccucgugcugggcaugcaugaagucuguguuacccucccaugaaggacuucuaggagucaggugcuuagcaggggccuuaccagaacuaagaacauagguuauucaguggcaagcacugucccuuccaaagguuagucagggcauacuucccagacuccauccacucccuuuuaguuuugacagcugaagugauucuuccaucugugguuucuagucucucggaccccagguucuaugguaggcugaagggcauuuaggucugucgguggcuggcugcuuucauccacccuuucaggacagucucuuaugcucuguucuauuuccucuuccccaaccuugugcccaggacaggagaagcaagcugcuacucagcuccuucugcuugcagaauccagauagaaguaccaagaccuggagagauggcugcucuuccaaaggaugaauccacagguucaauucccagcauccacauggcagcuaaugacugucuauuacuucaguucuaagggguuuggcacccucacucagacucacauacaugcaaaaaauaccaaagcacauaaaauaaauuuuaaaaaaggagugccaagccccaguaugaauuugacccaaguaucuagguaggaagcucagaccaaucaguucccuuugucuguguuaucugucaccagugaugaaccucaccuuugacaucacuucauauccuagcccuuuccaaauaaugcguguagcaccggcagcaaaugcagccgaccaggagaauguguccugggcaaacagccugcagacaucacgcuaacagagggagagaggcuaugcuuauccugcugugugugagaaagcaagcucuaaagagaugaaauggaacacccuauguucaggccuggacaccgucuacaccagaucugugggagcuucaugucucugcuccuuuugcugcuuggcaucuguccucaggcaucagaaagggaagccugaaacuugcucauacauuuucaccugggucacguguccauguugacucucauuuguguacuguuucugaaacccuggccccucugaccaucuugccucuuucuauggcugccaccccucaaggcuauaugcaccaggcuagcaguuaggaaccaacucggccugcccagcugccuugcuggggacagcagccugcagaggccccuuguaaucucucuauccacagcccucauuuuaauuugcaaaauugagcccagaucgagagcagcaaagccaggggcgguaaauauucaugccucagugagcgaggguggcuccauuacuggucugagguugggagaauuaccuggggauuauguauauucaugggccgauuuuuauuugcgauagaacaugacucacguuggcccgugugcugcgcagucuaccccaaacagacugcacagagcuuaugcccuuaagcuucugaaagucaucuguggauuggccucuccucggcuccuaggagacaguuuggaauaacaaucacagcagagccagccaggggcucccuuugaauccgucuucucuggaccuaggucaucagugccaggucauaggugagacagacaaugauggccauaguguaggagaaauguggaugucauaccauguagguaccucuaacuacagagucaauucuuacccaucuuugcuucaucugcaagggcuccgagcuugagugaugccuagugagacagugcagaucugcccacagcuaggcacugcauguccagcugucauauucagggccuuggguaagggcaaguacucugcaaaggucagugaacuacagaugggggagucuuuauugaaaaucuauauguuaccuauauauuuuuaauuuuuaaauuuguuuuucuuguauguguaugagugcuuuaucuacaugaauguauguguaccacaugugugccuaaugcaugaggagaccagaagauggcaucagauugauggaguuacaaacaauuaugagauaccauauagguauuaagaaccaaaccugggaccucuucaagaacagaagugcccucaaccacugagccaucuuucccuguguguguguguguguguguguguguguguauucaaaucccacacuauuucacauugaucaucucagucuuauaggugucuaaugggauugguaccuuuuccauuuaaggaaauggagagagaaacuccuuuguucaaugucauguaguuacuguaaccuagugucaaaucccacaagccagacuccaaggccugcugucaauuauaugugccucuacaucaaaccauuacugcacagagaacauacccagccaccuuguggaugugcagagagagaggugaccuagagcagcacucauccucagggcccuuauagaacaugcaagugaagcgagagccagucuacccuguauaggggcuaguggcuggagucagcccaguggaucuuugccuccauuccaccauugcugaucugggugaccuuggguuauucacccuaccucccuggguucauuugaucacuguacacuauggggcauagugaagcugccagguagaauuuuuauaaaguuuuacgagcuugccagaguugcaccuagugcaguuguagggcaagaauggggguagcaguggccacuaugacagaaacaagugccaggcaaguggggguggggugcuggauaaagggcccugcuuguuauggguggacacuggcugagcucccuucagcaugacaccccuguggguccuugugugcuaggauuacuuguguucucuaaguaugaguggaccagaucaucuggagcagccuggagugaugagaggagaaccaggugaugguggcuaacuccucggugccuucacaagucucugucuacugcucuuauccuagagugauccugggcagcaauucucucucccauguuggccucacagaccuccagcucuaggguuuccuacauugccugcuuccugaucuccacugcaaaagccuucccagaaaccuuugcuuacucaguccuuguuugggcaucacccacugggugcugacuagcuguccuacugaucucugcugguacccugcagugugccaugccauaccagagauaaacuucucauggaucucugugcuaaaaguaaugagggggcauggaggccugaguggaccuaaauguuaagggagaaaagcaaagagccaccggcagagagagaugggucggggggugggggggggggggagagagagagagagagagagagagagagagagagagagagagaagaaaagcaggggucccugacccuuaugaccugcugaggacacaaggcaauggucuacaggggcugagauuuuccucuugagccuggaaaccugacaaaguuucaugccugccucccucccaccccacucccaccccaugaccuaacagagccuaccucagccaccaaccacacugguuagcaugugaccagauauguccugcccaggaguaagguggugagcaccagaaagcaugcagagccauggcugcuugagcagggaugguuugagccuugcuggaccugccucugcagagccaggugaucuucuugaguuuaaaacuaagacauugaguuguguuuguuuugugauagauuugcuauauagccccugauggucuuuaauuuaagaucucucugccauagccuccugggugcuuagggagugcaggcacaggccugcacccccugcuuuaaauguacuccuuaaacguuuuucauucugauacugcacuuggaaaaugcaugagaauagacagauagaaggaaaguguccucaguaccuggucccuuggugaugugugucucaguccacagcuggucuuuccauuccagcuagacagcucuggccuucacuuuauaauuagaaaaaaaccuugaaccaggaaaaaacugauggagagaagaaucaguauuuccuaugguuagacaagcugggccaucccucuuaauuccuguagucuacaggugcugcaauuuuucuuuuaggccugaaaaccuggcaaagguuuaggcccuuaaggugggccuaagucaggguacuacuauauacccaaguacacaaucucugaaggcacuggcgaaaggagaagggaggcaacaccuuuuucuuuaguucuggagucaaacaugugagccccacuaauagcaucuguuuuguccaagauguagaguggagccugucugccuugucagaagcacucugguccaauggauaccgucuuugcaacuaggugugaguggguuagaaccccugucagccgcuuuccaccaaguggucuaggguaaugacuuggcuuugguuucuguuugucaaauggugguaaaggcuagaggguaauagcagggccuggcuucccuguagggcauuggacugaggaagagacuuguagagggcuuuugucaccucauacaccaguuuuagauagcacauucuugcagcaugcugggguggacuuuguuucucuuuuaaccuagaguuuuuaaaaaccuuuauuccaguugucaaagcuaugcaugcuuacuuuaagaaauuguuaggaaguauaaggaaaccagaaaagacaacacacacacacacacacacacacacacacacacacacacacacacacacgcacgcacgcacgcacgcacgcacguacacgcacaccacacuuacuuacagggaagcaucucuccaugcuaacacaauuuccuaguauaagugacauuuuauucucuguccuguuuaucugucucucuguugcuugggugucuccaucuuuuggugaucauaaacagugagguaaauuuuagugagccaucauccuugccuuuuggaaaguuucuaagagguagggugcuugggcaucaaauggaggcauagugagaacuuugcagagggguugggccaauguuaucccugauggagacaggagacccaggauuuugucuccuggugacugcaacgaggagcaugccccuguugcagggcacauuggugcagcgacaguccauacauauuuggguugagugcccaauucuuggaccuggacugaguguucucugcuggcgugcugaccagaggaacccugcuugcgguaaagcgguauuuccauuaucuggacauugguggacagaugacacuuucuuuuauccacuuaaaagaaaacauggggcugaguaugaaucuguccuagaccuacaagucaccuuucauagcagucggggugugacugcucucaggaggcccaauagugucagccaaugagacaaauaaagacauugucuuguugcuccuucuguuucucugucuucaucaccccguuuucacuucagcuccugucauugaccuagauccaccaaggagugggccuggguucuccugccugggcuuguuguguauggucaagauggaugcuagcagugggaugcgcugggagacacuacucccuccaacuguguugugucaugguaucugcuccaucagucaagccuaguggauuacuaagcacaaaugccagagaagagaugaggccagugcugcccagugcucccaucugcacagggagaccaccaauuucgguaugccacaccuugugccacagacucuaaggucaaggcaggaggcaugagcaccagugugguaagcagugcagccucucagcuacagggaggcugugggaugaugguguagaggacagaggagggcuugacccugccaggacacaggccugggacacguuguaaccaugcauggugugaaugucugaugccugguugugacacuugcagccuguauggcaggggaacuggagucugggagacucaugggagugcgcuuaaugcuggacuuugaugaagaacaggauaguccaagaacugggggaccccuccuguccaccuaagauuaaaacccacauguuguuccucaccaaggcccagggauccagauguggccacccuugcuguuccauuaugcagugggccucuagccaccaagaggacagcuggucuccucagcuugccuuguauggauuccauacuccaaacccagcagucacuuaaaaacaaagcacaguuucauggaagacauaagaaucuaauguugauguaauucaguuuaaaguuuuaugggaugacaaauacuaggaguggcuuggaggaggaagaaggcuuccuggaaggccccuugucacuuuuacaguuccccuuuguuauagccacgggggaaggcuaaugggaagagugaauuugugaaguugacauggagggccaugaaaugugccaucccagaggucagggaucagugcccugcaaaguaaauguauucauuuuaggagcugguguccagcauggagcagcaugucccaggaggcagcaguacaaaggcauaguagaaguuacagcucuugaaagggucuccugagguggauguuggagucauuuguauauggagugaggaggguagagagagcugagcagaggaggagaauuguugugggcccagauaauaauagccagugcucaaagaccuggcgcccagugaaacugaaaccaauccgagugagcaaaguagagauggagcuuggccuggcagacaggcugaagaccaacugcugcuuccucuggucuuacaggagguaauguuccucuuccucuaagcaugggacucccuggcucccucccaggggacaacuagucuuuuauuuaagaucugauggaauuuuugcaugaaguagaucccucuaguuaacauauccucuaguuuuguggagggcccuggaagagagaaccuaagccaggugaaagaguagccuccacucucaagagcuucuagaaaaguccuuggccucgugcccagaggcuauaugaagcagggagggcauauuaugcacaggccuucucaccuguccuucccuuccguaaagacugaaucuggcucaggagugcauauucacagaacacuguucucauguggguugguuuguuuuuaagcaguuuuuaugugugguacuugggaguaggacaaaugagaagccuucuggacaggcuugucccuggugauggggugacacauuaagacagcagcaaacacugaguuuaucuaucagccuaguaagagcagcagaccugcagccccaggucaguauguaggagagagacuuccuugcauuguugauaggacuauagcugaccacugccaagagcagucuaugagaccugauaaaaucagaagcauacccacugugcuagagaaacugugugugugcaagcugaggcuuguucauggcagaagcuaguaacccucaugaacaucuauggugggaauaagugauuugguggggaguuggcucagugcauacagagcuuguagaccugaguucugauucccauauacacacugcuuguggcagugcaugucuguagcucuagcuccagcuccagcuuccugaggcuggcaaccauuuagcugaaucggucagcuucagguucagugagaaacugucuuacauaaagugaaaagcauugaggaagacauaugauauugaccucugacuucuacaaguguauaccaugaacaccaagagagcauauauagauacaugcuguuauugugugugcccgauaugaauagaugucagaaauauaaugucaaagaaagagggucaguaguagaguuaaacugugaugucaugccaucauauacuaacaagugugucuacuacucagaaacacauacauggauguaaauauauaaaacaggacacagugaauucaugaggauaguugcuacaggacagucaggagggggaauaggauugggauuuuagucagcuccuggcagaggaaugcaggugauaucacuugauucucuaugguuuugauuggcuuuaauuucucuaaaacuaacugguuagaauaaaugccccaaacugaccugcauuuugcuucucagcaaggagccaucagggaggcccugguaucccccggaggcucauaugugcuguccucacacagagcccugaguuugccuuuguguguguguguguguguaugugugugugugugugugugugugugugugugugugugugugugugaugcgauuaaaugcauuagagggaggaaaaugucuuaucugugcacagccuugcucaaagaagagggagaaauaagagcagccaaauugaaaccuuauuaaacaaaauggguuaggucugauggagcccaaccuagacugaucuuuaaaagcuuauuucauuuuuuccccucucgucugagccucuuugaauugaaguaacugauccugcuguuguaagcucauuagcgucagaccugugugucucuuuucugccccgauuuacauuuuauuaagucacagcaaaguugugcuugaccucggccaaggcacaggcucauuaacagugagauuggguagucaguccagucuccucauagcugguaccaccucuccagaaucuacagcaugucgcaaaguauguucagcucugucugucagcuucacaagcaccuguggacuaugcagaaaucuggagggcugcuccucaaaagagcaugcuaaguuggacucaacuggcaagggcuaccagggcuuaaagcccucugcaugguguugcaccucauccuagucauaguucugguacuaguuucuaaccuuggcaggccucagguuccugaccuauguagugagaccaccauuagcaagcuggaagacuauuccaugagaguugcaugaaauacaucugaaauuccuuuaucugcacaccagcugaugguaaguuaucugaacugucucccugaaaaauagugcagcagaggacugggaguauauuagucaggguucucuagaggaacagaacugauagaaugaaauauauguauaaacuuaauaguagcuuacaugcucugguccaacuggcccaauaauagcugucuaccaauggaugguucaagaaucuaguaguugcucaguucaaaaucuggaugucccagcuggucuucgguauuuauacuggaauccugaagaagucggcucuaaugcgagugagagaaugagcuugcagcaagagcaaggucaaucaggcaaagagcaaaagcuuccuucuuccauguccuuauauaggcagccuccagaaaguguggcccagauuaaagguggcucuucccaccucaaaaacucaggauuaaagguaggucuuccuacuucaaauaauuuaauuaagaaaaaucccuugcagguguacccagccacuuagauuguaguuaauuccagauguagucaaguugacaaccaagaguagcuaucacaggggauauagcucaguugguagaagaccaacguagacuaauauucagccuaauauucaugaggaccuggguucaaguuucagcacaacaugaaccagaugugguggcgcgcacacacacacaccagauaauccuggcaccugggagguagaggcaggauuaccagaaguucaagaucaucguccucuacauagugaguacaaagcuagacugaguugcacaagaccaucuaaaaacaugaaaaacaugaaaaaaaaaaaaguagugagagacucaacucaguuguuccaggcaguggcaucaugcacaaccuucagaaaacuaaguugcaugaggaguugccacccuuugccagggcagacagcaagguggcucaaagugagauuuuagggguagguaggccuggcugugucugcuagcacuacugaagcuuucauggcaagucuuucccauauccuuccucacccauaaguauaccuuugcgagaacuugagugugguauuuaggaaugaccugucuagaacucuguccacuucgagucuguagccuauaggucagcaccccaacagcuugguagggagggugaucuaugcccagcuccaguggccuggguuucugugaugagacugagugucaggccugccuugcagcccuggcauuuauuggcucaagucucagucuguuugcucugugaccuuggagacaucacaaaccucuguuucuucauccauaaaauugaauguaaaaauauugaccugccccguaggguuuuuauguagaagaacugacccaaaugauaguaaagccucuuuguuaaucagaaaagaccaaagugcuuagcaagcacaaacuugaguuuuagaauauuguuugccugcuugcuauauuccuccucccucugcauccucccugaguuuacaccuuauuuucucagcaggacugagaucagggcacagcaauaucccagcccuauuagccugugggcaguucugacugcucaccagagaagcagggcaggaccaaccacagaaggggccaugguaaggcuaugcugugcccaucuaaaaagugagggugauguucuuggggagagagguauagcuaugugaacauggggagaaggaaggagccuacacauuucaucuaagaucuggaaaugagagcaaccauuuucagacaaugaagccuaagaagcuuuuuggguuuguugaggccaggccauuaugggugggaugggguggggugggaugggacucugucgucuaauacuggccucucuucucuaggauucuacugcgaggccauuggcuaugugacacugagaccuuuccugaguucagagccucuguucccaaacaacacaagauaggucuuccacuggagaccugcaauguguccuugaucccuaugucuuccucauccuaacauagauucugaagcuaggugugauggcacauaccuguaauguugggagauagaagcuagagagucaggaguucagaacgugaggccuugucucaaaaauacacuaacgacaacaaaaauagaacggccucugaggaucuucuguggccaguuucccucuguccugcuucauuucucuuccaucgguagccaaaguauuccuuuaaagaugcacacaggucaggcaugggggacacauccauaauccuugcacucaagaggcuaaggcaggaaaaccucgaguucagggccacccugggcuauauaacaaaauuccgauucagaaaacaaacucaaaggcaucuucccaggcucaucacugguuugucccucugacaugguagaggucuucgucuacagccuuagaccccaaacaaaccccuagcagccuguacacuuuuagcuucucaaagaaccaggcucuccuuacaggaaccuuagguuugcucugccccaacugcugggucuccuaugcaugguacuucuuccuccuggucccaacucagugcuaccuccucaggaaugcuggcuacucuccuagagccuacuuuguuuucucucacugcacuuccccacaguugugcaauuaacauuuauuaguuguagauugagcuauuguucccaucuccagguagcagaccccauagacccaaugcugcugguuucuuggaccuggaauuucaugugagcaauacaugacagacaugcuaagugauagacaugugcuggcuccgcccaccugcaucugugaggaauguucagugguccuugagugaguggcuagagucucacaaaacuagaaagggaacaaauggaaggagagccgauucuguacuuuuagugucuaggucagcccucuauucuuagccucccuggguggaaugcaagcucacugacgacuggugauacugugugcaugugcccugaagagccagaguagcagcaugccgccuguucccaucuuuaucugcuucacaauuuccugugucggcccuuggaaucuugaucuucaguuauuugccucucugcucuucugcccucgcaaagcauucuuuauuauuucaguccugagaacaugagcccguugaaaggagagcaugcugugagagaaguccgccuggugcuggguggggacaacaagcccccagccaucucugugaagaagcuuuaaucaagccuagauaggucuggagucucagcagggugugcugugguuacaaggggcaguccaucucuucaggugggcuggaugcaugcugaccugugggguauuagggugcuggcacugagggugcagcaagaccucaaguagaucacaccuacagcccacaucugaauuagaaauggagacacccagaucugacuggcaaacacuaagaaaucuggcaaugccagacuauaaagauguacugcagcuaggaucauacccugaugguagaaguauauuucugugcuuagcagaacugaacccucacuucugaaaucuucgaguuuugcuccgggaucugaauccuugagaggccaccuugcauauaggugccuggugagauccuugugagaggagagacuuaucucagcacuucuagcaacgacagcaagcacuuuagacauacuuagcucaggcagucccagccagugaucugcaggucccuaucccucagguaccugaggcauauguaggcauucucaguaaccucuauaaaggguacucccucaaaaagcacagccacucacauaaggcagugcagucagcaacuacuacugcacggguuguacaucuauauacagucauacauguguggaaaaagaggggaaauacugagcaccaaauucuagauagcggguccugcacuaccgcaugcagcaugcuugcagggacuauacaguaagauccaggacuggugacauuggaguucuggagggacagucauugauaggcuugcagguggguacucacugccuugagaguuaagcuaccuugcagaaguggugauugccccguaaagcaggaacaagaucagaguaugcaccuugguaugcauguaggagagaccuucccauagugcccugggugcucaggucaagauagcaagacuuugucaagaggaagaaaccuaagcaggaagcaaauccuggcaaaccacagggagguucagaaucacuguguggaggacuuacuucagaggccucuagauguagcucauggcuuaaagggaguugagcaugugggauguggaggcuguacaacugggcuguauggagaguuucacugaaggugcggggaggggcaccuuuuccagaguacuuaccagguggcuacggucugagcacuguggcagccuacccauguaaaggggcccuuaguugacaaaagguccuucuuagugcugaagcugaaaagaaggggaagaaagucauaagccaggagcccaggugaggcugugacauacuuuccuccugggaucuucaggguagagcacugccccugggaguggagauguucugugagcuuacagccucagcacccugcccccaucacccacugccuccugggccaccucagagaaggcuugcauuugccuuugauugaugugagcggcagcuuuugacacugcuucucacuuucucugcccucugacccuguggguggggagucaaugaucuuuaaacaaacacuugaguuugauacucuggugaaaggcucugggccagagugccaccagugcagcaguuacccucuauccaggaggaaaaguguggacgcccaccuccagccuugaugacaggguugcugguagcugaaucacaaaaaucuaggcucauucuauuccuuuugcuggguuuucugaaauggguuucauguacucugcuuuguucaacagaaaguguuugauggcaccucaugaauguggcuuaggagguaugcccaccaucuugggcucugaugugucugcuccugauuugcaggcugugaaggcagaagucugcucuguauggagucaguguuaccuuucagaaacugagauaagaucuuauugccccuuccggugacuccaggcaggccccuguauauacauggcgccuaggccuugaccuuuggccuccaggagcccuccugccucuuuauugacugcuuagccucacagacagcaccaucucugggccuggcccuuacugaugucucugccuaaagcuauuuugcucuggaucuuuauaggccucagcucaggggcugcuucuguagugcuccucugcuugccugugcaaaaaaaaaaaaaaacagaguuugcccaacuguaggccuugucaugugucucauguuucaugcaccuacauuguagaauuguguuuugguaaauaucaacacauuuuuauaugcuaguuuauguuauauaaaauaacauugauauagcugugugaccuguguagaucauuuuccuuguuucuaaauauugagcucuuugaacagagcuagcucuaguccaucuccugaaauagaggcugacacauaguaggcacagagaccauguagaauaacuggaggaagacccuucuuagagagcccucagccuuggcaggcagacacaagcuagacagugggaguuuuaugugugaggagagguagagaccagccccucaggaaucaagaacaaguccugccccuagucacagacucuauagccuugcaucggaccuaagccuucaauguaaguggcacacugguaggcugaggagcgggaugucaaggcuacacagagggcuagaaugugcuggaauggcugaugaaggguguauaaucuggguaagucagcuucuagagacagagggaacugaggugaccacuguucuugugcuggcauagggauaagauuugaaaaguggucuaguguuacauccuaggccuuggcucuuugggauacuucuuucuuugcccacagagggcugacugaacccuggccuccauucuccuguuugccuggaccucuacuagggcugggggagguggauguuagggcuacagaggaagaaugaccucagccccagcugcaagacuuaaggguucacauguucucccucuugcuccugcucagguggugaagaaagugaaguccaugcagauguuccauacacccgucaccucugccaugcagggggaccgacugggcaucugugucacccaguuugaccccaagcuguuggagcgugggcugguaugugcacccgagucucugcacacuguucacgcagcccucaucucuguggagaagaucccuuacuuccgaggaccccugcagaccaaggccaaguuccauaucaccguuggccaugagacagucaugggucgcacgcuguucuucagcccugcuccugacagcuuugacuuggagcccgugcuagauuccuucgaccuuucccgagaguaccucuuccaagagcaguaccugugcaaggauuccaugcccacagccacagaaggugaugacgaggcggaccccaaagccggccacgccccagggggccacugcccccggcagcagugggcccugguagaguuugagaagccagucaccugcccccgacucugcuuggugauuggcuccagacuagaugccgacauucacaccaacacaugccggcuggccuuccauggugucuugcugcaagggcuggaggacaagaacuacauugagagcuuccugccagcacugaggguuuacaagcugaagcacaagcauggccuuguggagcggguaagcacagcccuuggguuuuuuuccucuccuugcucaguacuaggcccacaggcugggcugggaacagagucaaauguccucagguuucagaguagauaaguuaaggccaggguacaaagcagccugagucuuucccaucaugcccucauagaguuggacuauagcuagauucuccaaguuagcagacuagcuucucccgaggccuccugccuuugcuaggcccaguguuucaugccacuggauccugccaggcccagacaagguucucauaaccagugggggguaccugggacaguccagguccacuucaccuacaggguaggaaagggcuuguggguucagagauacaaggaauaaggaaaaaaauaccagaaaagucacuggccaucugggcacauuggagucacuuugacuggacaaagcucugagaugcuguccugucacuggagucugcacaaugugguaucuuuccugaacuguuggcacaucuucuuguugaauggcaguccagaccuagaaugaaagguuccucaauguccaggccucacugucucuucugccuggcccucugacuuuaccauggagcuuaguagcuguguguggucccaagauguagcugggcucccaccagaucaguacaaagacagcuccuccucccaucuugguacagcugcuaguacaaggccugacccagugacguacaaaccugggacacauaggcguacacuccuaggacucuuuuucuaguucucggguauuugauaaagcucucugccuucuccaccucuccuccuucauccagacccacagcucaggaccuuggccugggugaguuccaucuaccucagcacagcagagaugcuucugcagauggggugauacagugggcguuaccauucacccaacuugauuuauuagcagcauuauaggguguaauuauucuguaguaaaguaucuaucggagaauaaugucuucuugguauggcuccaggucuaauuguucucucucaggccugucacuuccuuagagaacugggaggcacuagugaggagcaagaaaacacacucugaagugacccaggccucccaagaacaacagaaaaugucuggcagcaucuuuguccuaccacuagucugaggcagcccgggaccaccagccuuuucacacuuaguccagagagucaucagaccauagaccugcagucacaggguuagucccuacauuggcagcccugagagccacagacuucuccagccaccggggauggcuauuuggucuuaauaaacacauccauuugaauguagacaaucuugaccucacagcaugaagugaaucuagaacauagcauaguucccaagugaacagcaaaguuguucugaaggguaguuauguuaggcaaguucucuaaggaaauugaauacagaauaauaaggagggaggaagggagggagggagagacagacagagacagagacagagagaacacaaauaauguauuggauuggcuuacaagauucaagacuggagaguccaacaguggucauauucaugcuggagagcuacaaaacuuuguagcugcuagaagccucaguacucaggggaccaaugauguagccccaacucaaggaugaaggccugaaaggucucuggaaaaucauguugaacagcugaagaaacuggagccgccugucuacagcagaagggcauugauagacucucuggcuccaaagaguagagcuuguacccacagguggucuuugcaaggcagaaaaguguccugaacccccauccuuggcugugcuggcugacuccaaacauuccuaagugugccucugccaaagaaguuucuggguggucaggucaucuuacagagguuaaaucugauaucccuaggcagaucuuuaccucaugcccuacuauacuggauagacuccgugcacuggcccuaucuuaggaacacucagucagcucaggcacuugagguguucugaguugcuaguaaagugaagcccuacuuucauagacauguaugguacauguaugauacauguaucauauaugauacauguaugauacaugggauacuucccaucugagcauggacuaauaagcaccuuggccuucuguuucugcuaccuauaaaggcaucaucuuucauagucagcuuugcugaguuucuguguguauucuagcccuagauauacagaagguagcccaagaucauccucacaguagaggcugagaaugaaauaguagaucaucaaaauagugcuaagcauuauucugcaggcagugcuuggacccuggagaugcuaacucugggagcacauagucucuucugugcucuccuugcucugcuguguaggucaggugccugaacauauggguguucccgagaguaagugguaccugagcccagccugagcucuuacuccaauucuagucaucuuaaauaggccuauuuucuccagauccuuuuuuuuucccaacuggugcaaucaaauacauuuuaauuaacuuaccuuugguaaauggcuuuccuugcuuaguuaacaaaugagccacccagaaacuuuggaaccagcuccauucccauuuuuaauuauuuugugucuacaaugaugaaauacgcuauuuuaaauguucuuguuuuucuagucauuguuauucugugaguuagcaauauuguaaugucaggguauguugagcuaacacauaauuauaacacacaaggcuuugccagugggggcuccauaagaugguuucccauacccuacugaaccuccauggcgugccauuugaagcccauuuuugucauguuuuuacaugagaaguccacacugcuaaccaaaaucgcuagcacuucagaggcagaggcagauggaucucugugaguucaagacuagccuggacuacauagcaaguuccaggccagccaggacuacauagaaaguuuacaaaguuucagugaagugugguuuuccacuuaaguauaaacugaacaugaguuccuuccaaagaggacaggaugaaaagugaaaggcugagaaaacuugcaagccugucucaaaagcaaaaauaaauaaaucuccaggggaauguacgguguggugggcuguuagccaucaauguuccugcaauuccaagucccugaaugucuuggucaguaucuuaaaugcuuucuugccaguaacacccagaaacaguugugaacugcaccugaauaugguugugcucaaauaaaugucccauuagugaacacuaaaauuugacuuuuacuuagauuucauguaucaugagauauucuuuuuuaaaauguuuuucagcucauuagacagacagcuauucuuaacuaagaagccaucuaagaacaggucuaggcagagucugacccucuggccaguuugcuguuccuggucauagcuaaagcugacuuguucugcuugcuccacagcccaggaauuaggcuaugggguagggccuuacagagguaaagcuucuggagcaucauucaggaggaggagaaggggaggucugaaggccuagaagcucccuggagaugcuccacaggcugacccaucugggcgaugacuaaaauauggguacaggggcaucguuuaaaggugcacuguucaaauggauaauauaaaacaugaguuagauuuugaucagaaagaaagaaugagugaaauggaagaguuggaagaagugcuuauucacagaaggaaaacuggaaugaacuugauaaaucaacacaaauaagaaaaacaagaauaaugcuaaaaaugaugacagugauuggggagacaaaauuaagaaguacuuaccauacuaaauaaauuccagcuacaaagacagacuaggagauugguuaaaacacaaacuccacugauacgcugugucaaagaagcaaaaguaaagaauaaaagaugucaggagacugagcaggaagaccacaggaguggacagucaccuuuaucagauguggggcaguggcagagauauaacgaagaggugguaagcagcaacaggcacaguuacagccugaaccacgcacguuagaaguaaagcucaaaagacagcuagggugacaaggcuugguuuucagaugaagugugcaacuuagguacauaguaguguggauuauaaagucugacagaagcuaugaguuaccaacagucugucaaagcugggcagaaccacugggcccuguccucagcaagcuacuaacgcaucagauuuacacaagcugauuuaagcuaggggccagaaaagugggucugccugugguccaacaggggcaaaagcccauggagggggugggaaacuuagaggcaggaaaugaggaacagaauuccaccuaagauggagaaagcacagaagagugagggccuuugaggguuucagguccaggaacugcucagugacacagaggccaaccagugccuaacucugagcuaguguagaagcucucagcugcucugccacauccugucauucaaggccuccugacccaguccaucugggucacaagaauccauggagccacaucucucccccauagcagcuuugcuuuccuugccauccaacaagaggugaggcaggugcccuucagcaacugcacgcaggacacccucucugugucuuccagcacccaccuccucccaccuacugugguccucaacaccuggcagcucacaaagcuccacauaaauaaugauacaugggagaaagguccugccagcucuuacuacauaaucucuuuagaucuagaaccuuuauagaaccaggcaaugcugugcacagcacuaaagugggccccaggguguggcaaggagauaaacaaacauggaaagugcuggugccuugccagucacaaggcggcccuuguuaagcccugugcaucgugaccauaguucacaugagcauuguucauggcacacaucccuggguccaagcugaguagugacaagaaacuguccccacuacagaggggagaaggucaaaccaggcauauuggcuacugcaggucuggccccauggcgccaacaaaaaaggccucaggcugaacuucaggagccugaggcauggacccaaccaaguguaaacauacagacgccaccaggagcacuggccagcuuugaagucugaccagcacugccucaggcuccuggcucuacuuagcucuacugcugaugguuuguuaagccugcucagggccccagggaaccuaccaccugcuucuuucugagcagggacagcccagguuggggggugcuaugcaggucaacuguagcacccuaaccccuagagggaguugcuuccuggcuauucugucuugcuguucuugcccauaggcucccagccacagguuggaggcuguggaccccuugaacagaauugucccaggaggcagagauuaagaagguccacuuugacagguugcuuucucauguucuaaccugaccauagcccagcaucucuccugguuccuuccagggucagagucugauagcugaagccaggcuucacugcuuuggagacugcauucauguccagaggaagaugcagggucuguggguggacacaguagaaagcuagcuuuagaagcuaggacuaaguuaaggcacagucuagcauaacuguaacaugucacuccucaaacccaacuccccuguaagagugcugugguggggaguugagacuacauguaagaaggaccaagcggcuagcauauggccagugcuucauaagauacucacccccuuuucucuguggagggcagcuggcagggggcugucacuuaggaccucuuuagccccagcaguugccuuauuuacccaggagggacucaggugauggcuacacauauagaucagguaaggaauguucagagaggaaggaggccuucgccugaaggaggccugagagucugugguagguagagguguagggcagcugucccagguaguagccugucgugaggcccgucaguggcuggcaccaggccucaggcuuugagccucuggaguauguuugaugagaugagaucauugcagguuaacuuacuuucccuauauuuacacagagcuuacggagaauuugcauguuucucacagacuucgauaccaggaacauugucuuaucccuugaaaagcagaaaccugugucuuguguuacagaagcagagccugagguacagcagagugaaucagcuugcccaggugcuacagugguaaagcaagaaucagccccauccacggguuagcccggggccucugccuucuaccaggccaggcauuuagggaggaagaaccaggagaugguguuuucuggugaugugcaaagagcacagcguuaugguugucaccaucugugacuuugggugaacuggaagaggugucaccucaauagcaggggguuccuuccuuccuccugugauuggaggucccugucuucucccaggauacuguccagaagggaaguggagacuaggguacccugugcuguggcaugugggucuugcccuccucccuauugauaagucuuaaucacugcaucugggguuucugggcaugcuagaagaucaccugcuccacaugucccuccaucccccacuucaccuugacauucaccaauacagagucugcucuaauggucauucuccuaucaagucuugauguucuggccaguaucagugugcuaauccuaacaaccuaugucaugaaaauacugaaguuuggagaaguccccuggcccaggccauggcgcuauaagagccagagccagaacucaagcaacuaaaaccauuuccauucugggaacacagagcccucccuccucacuauaguggggagccuagcucagcucucuucauagugacuucccuuucugcacggugaacuagucgaagcuucagaacuugggcaauuaccaagccucauccugggaaccaagcccuggaagagagacacguguaaugacauaauuaugugcaccagcagccaagucccugcucaaaaccuggggacaauggggacucuccuggcauggcaacaagaguuggacuuggaugcacagcuguaacugcugagggagcuugauccuuccagcaaccacaggcggauagaugaagcaaauuacucaugcaagcagugaaaguccccacuugagcuauugugaccacuggccuguguucaccauuguccccaggaacggggccaccagcaaaccccacaggcauugacaucgugauugauucagaauacaagcccuccaacugcucuggcagggcucuccuuguggugugcuggugucugcucucuguagucuccucucagugcaagagcccaugaguuguguuccugggcuucuuugacaugucuuauaucugggucaagugccacaccaugguuagcuagacagggcagccugcuaggcaccagguccuaccauauuaccagcucuaccuucucucccugccugcucccucuagaccacuuuugggaaguagagucccugacuauagggacugucuccucucugacaggguuuccccuaagcuggggcaagcaggguugaggcugcucagcaccccggggcugggccuccagaaccacugagucagccaguagcauucgcccaggggaacccagacaccagagacagccaugugggcucacucacacaaguaucauuucccuugcccuuaggucuuaaugaggacuagccagaacaacuccauuuggccucugcacagcaagaagggcacccaccugacaggcuaugauaaaauuggcucaauggccuccucuauuccccagcacuguccccaggaguagccacauucauaauaccacccuaggucacccucaaucuccuagguagaucugacacagugcaauagccauuuacucuguuguaagugguaguaggagcuguaagcagccaccacuauugagggaaugcacagggaccuggaggcuauaguccauccccacccuccuagggccuaaccuacacuuggaaaugaagacagcgcagguucauggaggacauagugaauauacuugguacuaguauaucuucuggucaaggcauaaaacaagaaaguagaagugacaaagacaguuccuuuagauuuuaagaccuguuagcugccauucuugccauagcagaacaaaggacagccagcaagauggagcccuguaaccucuccguagaaggucacaagaagcccacuaacuccguaccuuaaccuggauauuuaaacaauauuguggugcugggcacucaccuuuaauuccagcacucaagagggucucugaguuugaggccagccuauuauucuauauagugagcuccaggacagccagggguacaugaaaaacccugucuaaaaaacaaaacacccuaaggggauagaaauuccaaaggaaguggaagaccaacaguaucaacuaacauggacccuuggggcucuaagagacugaaccaccaaccaaagaucgugcaugggcugaacuuaggccuccccgcacauauguagcagaugugcagcuugaucuucaugugggucccaaacaacuggagcauccuaaaagcuguugccugcaugugggaugauauugucuagccugggcugccuugucuagccugagugggaggggaugugccuagccuaacagagacuugaagugccaggguguccccccugcucaaaggagaaggggaagggagaugaggaaauauuguggaggggagcaaugagugggauguaaaaugaauaaguaaaaaauaaaaauaggggagaaaaaagaugaagcgagacagaugaagacugaagcuugcugaguaaacugcuguuagaagaacuggugguugugucguucuugcuggucgagagcagacgcgacaguuguacucuugauuguccugccuagaacucccagcagcuaugauuucauauugugaaagauuugugaagauuugugauaguggauaugcaauuccucugucuauuuuaaaagaaaaccuaagggauuuaauaagagcuuuaaaauuuauauguaaccccugugaaaggauuauuggaucuccacacugagagccacuguucuacauugccuucauuuauuggaugaauguuuggcucuaccaaaaugugugucuacuccauuucugugauggugguacuuaaaguaggaccuuugggaagcuaucagcaugugaaagaagagcuccuaagauagaauucauugcccuuaugaagcacucaagagaacuaauuugcucuuucuaggguaugaagauacuacaaaagaugaaucugagaauuguucuuuccaugucuuugaagaauuuuguugagccuuugauggggauuaaauugaaucuauacauugccuuuggaugcuuguaguggcgauuccuggcugucaacuugacuauaucuggaaugaacuacaauccagaauuggaaggcucaccagugauccuaaucuggaggcugggagauagaaguuucugaccuggaucuugaauuuguuuauauaguggauuucauugauggauuuccauauauugaaccaucccuggauuccuggggugaagccuacuugaucauguugaauaauuuuuugauguguucuuggauuucauuugcaagaauuuuauugaguaucuuugcaucaauauucacgggugaaacuagucugaaguucucuuucuuuguuggucuuucuguggauuagguaaagauucccaugcuaaaaauuugggagguuuaacauaguaaaaauggccauuuuucacaaaggagcuaaaaccacacaguagaaaaaagaugguauuuucaacaaauggugcugguucaacuagcagucaucauguagaagaauacaaauugauccauuuuuauuucuuuguacaaagcucaaguccaaguggaucaagaaccuccacauaaaaccagauaugcugaaacuaauaaaagagaaaguggaaaagaaccucaaacauguaagcacaggagaaaaucuccugaacagaacaccaaugguucaugcucuaagaucaacagucaacaaaugguaccucaugaaauuuaaaagcuucuguaaggcaaaggacguugucaauaggacaaaaaggcaacccacagauuaggaaaagaucuuuaccaaugcuauaucugauagagagcuaauauccagaauauacaaauaacucaagaaguuagauaccaaagagccaaagaacccaaagaauucacaacugaggaauaucaaaugaugaagaaacacuugaggaaauauucaagauccuuagucaugagggggaugcaaaucacaauaacccuaagauuccacugcacaacagucagaauggcuaagaucaaaaacugagguggcagcagaugcuggcaaggauguggagaaagaagaacacuccucuauugcuggugagauugcaagucgguacaacaauucaggaagucaguuuggugauuccucagaaaauuggaaauaguucuacaugaggacccagauauauggguuguccuuuugacccggguauaaacuggguccucauaacauauaacaaaagauacuccaacauuuaacaaggacaaauuauccacuauguuauuaaauaauagccagaagcuggaaauaaccuagauguuccacaacaaaggaaugaauacagaaaaaugguacauuuacacaauggacucugcuauuaacaacaauaacuucauaaaauucacaggcaaauagguggaacuagaauauaucauacuaacugugguaacccagucacaauagaacacacaugauauauccucacugauauauaagccagaaaagcuagggauaucacaugauguauaacucauagaccaaagaccaaagaguuuuccaggauccaacagggaugacauuagccaaaauaccaaagaaugaguagaaagaacuucuagagaccauauccaguggauaggcacagccucugagggaugaggccacccacccaucucaaaaauauuaauccagaauugcuccugucaaaaggaaaugcaggcauaaagacuggagcagacacugaaggaaaggccaucgagagacugccccaccuagggauccaucccauauacagacaccaaacucagacacuaucacugaugucaagaagggcucgcuaacaggagccugauacgccugucuccugagagguucugaaagagccugaccaauacaguuauggaugcacucagcuaaacauccuacuaugugcagugaccccaauacaggaguuaggggaaggauggaaguaccugaagaacaacaauaucaaccaaccaaauccccaaaaucuaccagggacuaaagcaccaaccaaagaauacacauggagugacccauggcuccagcugcauauguagaagaggauugccuuaucuggcaucaaugggaggccugacccuaaguccuggggagacuugaugacccaauguaggggaaugcuaaagcagugaaucaggaguggguggugggagggugggugagguccuucaucgacacuguggggggaggaggaaugggauaggggguuugugaagggaaaaccuggaaagggggauaaaauuuugaaauguaaagaaauaaaauaaucaaacauaaaaaaauaaaaauaaaaauaaugaaaaaaauaugguaaugucggucuguaaacaggacuucacacaugccagcagcccuacaguacugacugccaccacuggucagccaggagagaacaugacaaauauggagcccuagacauucacucuccuccuuguuuagguaucacuaaaacuaauuucagggacuccucuggcaagaaaguggugaagcucuuugacauucuccugauauuaacagaauuacccugcucuuugccaaggaccugguuuaggaaaagagggaaguuccacugucuuuguggcauugaggggagaguaucaacaggagauaaagccaugagccaugugaguguucaguuggcguggccaauggccacucugucagauuaugccuggggugacagggagguuuaggagugcccagucauuggguuagaauaguguguguguguguguguguguguguguguguguguguguguguguguugauuuuuaaucuguagauacaaggaaaucugggugggggcugguagugcgguucaccuggaucuuaaggugggguagcaaaaacuacaugcuacaacauuuuauagccaaaagaugggaaacagagguugguaaggcgucuucuaagguguaugcacuguauagcaugccugccagucagcucuaugucaggaagccaggccuguaagcucacuggacagcuagcucuggccaccaagcugcaggguuggguaggcagcaucuagguuggaauuugcccuacuaucuucuaaagagaaaacaaaaccaaaccacauugcccggugcuagcauuuggcccuuucguagacaaguccugucucccuagacuuaugacacgaaugauaaaguuugucuccaagaagcaaagagcuacuuagcuucccacccuuucuuucccccucaguucuaugcaugggugacuguucuuccacuauucccucuaaacauguacuuaccaagcucugugagguguggcauauaagaaagaacccccuuccuugagagacauuuaauccucuagaggauuaaguagacaagcuauauuggauuuugagacagaguagccaaacucagaauagagguuccacuucaacccuggaaguaggaaaggcuaccugaaacaagauucagcgugaaaccagggugaguagggaggacucccccaguggacagaggaugcaggugagaggcauggcagaggggccuggaggcuguagagugacagauuucaaagcuuucccugaugguggugaaggccucacaggucuguguuuaauugcaguggugugugugugugugugugugugugugugugugcacgcacgugcgugugugugugauuauguagcagguaugugauauugagggugguaaacaugaaaguuaccccaggugaguagcauaggcugggagcagugcuguggagggcugggaaauggcccugcucugauuuaaguauugaacaaggggauaaagaugacauaaccucaguuauaaccugagaacacacagacagagggaaggccacaggaucacggaggccugagaucccauccaggccuguucuggcuagucaugcauccccacagaugccagcuaggugugugccuugaugucgcacuagaggugcuugggaauaaugcaggucuuugugggaagaguaaguaggaugaguuugguuuugguuuggcacugguaaugagcuucuuuuuuuuuuuuaaagacagagucuuacuaguaguauauagccugggaugaccaugaacuuucuaaguaucccagauucucuugaacacauugauuagccuccugccuugacauucugaagaccuggaaucauaggcauguuccaccaaguccuacugguaaugcuaagaacucagagcuuacuuuggucugaggacuuccuuucucauucuuggacauagugaugcuggagggaaucugagucucaggugcaucuguccccagugagccucgguaccauggcaggacucuagccacuacuucaguauugagggagcuacauuaggcuuuacaaagggccuggcaggccugggcuggaucacugugugcugcuccucaaaucugacuccccuuagguaggaugaagucccugaaggugaggagggggcagaggagauaugauagacagcccauggcaaccaagacugaucaugacuugaacuuucagucaugagaucaggaauggacugcucaagccggacccauuaggccaguuaagcuaaauaugcaggccauggcaggcugggcuggagaggugaacaguaaauggauccugcacuguugaucagggagccccacucugcacagugauccuaacaugguugugggaaugggccucuaugaagcaacaggcucuacuauauaccauuuguaauuggggauauauaaaucaauggaacuucaaggugccagugagcacaaggcuggcaaugcugucucagagacccaaguagacauacccacucuccaagagcagggacugcccugggagaaugugcuggagccaucucagagggaaagguggaguugcuguauuggaaagaggcuuauggguuacagagggcugcacaaguggagauuguaauucuuaucauuguuuguauccaacucaucagucaccaggagagguuugugcugccuuuuaucuacugcuaugaaucaaggagaauaagauauguuuuccagaaggguuuuaggguaaaugaaacaguuucuacuuuucaaaacaauccauccaggcaucuuuauuagcagugagauguuucugcaccuuagcaggagauagcucaauggcccaggguaugcaccucagaaggggacagcuauuaaaagugucuggaaggaaauguccucuauguguggcuaucaagaaagaauacauuugccuuuuaagagugaaagagcaauaauucucuauuuauuuuaacuuucuaacuuuaauuuugaacagguaauuucauuucaaagaccagaacauaggaaagauauauagugaaaaacucuccggguucuccaugcccuuccccugaggcagcagcuucuccugauuccauguaccguacugcacacaguucugccgaugccuauccaaugccccauguccuucauaccuauccuucucuggggucacaaggcggccaucaggagccaugcacaguuuuuucuaugcucaggcugggacuucggguuguucugccuuugcuucuaggcacugcuaauggggagcaccuugacaggcauaucuaaagggcaguuuucuagaagcagcaugcauggaugaaaagucuaugagugcauuuuccauagcaguugaaaaaaugaggaguacuuuuuauaauagcuucugacuuaguggcugagugcagcaucugcagagugggcuggugagggcaaaaaccagucagguagaggaugggaugucacucccagcugugaugaagcucuuguugaccagacccugacaggcuagcuacagauacagccaggcuggguuccaggaacaugcaugggagaaaagaguuugcaguagaauccauucaggcugcccccagccaacaacuucacucacaugugccccacauguacccacaaagagguaaggggacagccacagucccagcagggaugugaccuugaagaaauaugccuggcaagucagcaggggccagggaccauaaggaaaccuaccuggagauugacugacauugggcaucauagagggcagauggcuggcuaagaaagaguaguugguacaacacagugagcaaagaggagcuucagccaaggcauguggguaagacaggaugguaaggcagggcugcuccuuagagucuccccuauggaaaaggcugaggcaggugauagaauagcuaauauagggaauaugacccaaggccaccucugcuccacgggcucucugacccuggcacacuuguauguuggcuuuaguauggggcccaugagguugccaugaauguugacccuucuuagugcccguguuaacagaguauggagaaugugugaucuuuagaccuucuuccuccucuguauacaucauuauguacgaggugggcacaucaguucucagcaugcacuacuaaugccuccucuccuguguggggacagguaauggaugacuacagcgugauuggacguucccuguucaaaaaggagaccaacauccagcucuuuguggggcuuaaggugcagcuguccacaggggaacaggguaucaucgacagugccuucggccaaaguggcaaguucaagauccacaucccuggugagugcagcugcgucccugcagagugugggagagauggagggccuggcagcauugcuaaccuugaccucugccuaagaagcaagcauggguccuaauuggggacuagacgggaacaaggucaggguugaauuuuauaccacuguuuaauauuuggaacacacccuagguuccuuaugaaguagguauugaucuuacagaggagaaagggaaaggaaagccugccagggcuggcauagcacuaugaugcccaguaaauucaagcuaauugcagagaccaucaggcucagggccaugugcacggcugggucagggugugcaccugcuucugaaaguguagccuguguuuuuuucauguagucaucccuuaggucaugugugugucuguaccaacugcauuuuauugaagcugacuguauaucaggccaaugcuugguacuagaggugugcagauucucaugggaaaggacagauagugagcuguggauauuuauuauauacccccaggcauugcaagacaagugcacagaccugagcugguauauacaagauguaugaagucuugagguggaaauuagcuggguguaggagggauggccauccgagguagggaugugcuggugugggagugaugacagugugagguaggcauaugcuuaguauuugaaggcugcaagccccaggguacuaagugccagagguuggaugggggcaggaucaugcacgggugugugagggcugcauguuugauuugacaugcugaguaugcaagagcugggggucauuggugggaguauucuuggggaaugggcagguaaugcacagguugcagguagggcuugugcaucguuucuuauggcacaggaaggacugaagggucugucuguaguaaugcaugaugauccccaaucuuugguaauuuucaauugagcaaaguugaaauauuuauagggaaccauauacgauaucacacagacucauacaguccucucgggcuccagaacccuguguuggaaaagaagguugggugugaagagaggcugagaugaggugagcaaggucaucaucagcuugguuuguaauuuuuggcuagaucaucccugacucagucccaggaauaaggcuccuuugcuacuccuccgguaaggcuagggaacguacaaagccacagauaauauugcccucucacaaaggaaggcaguagucaccagagacccucucuaucaucucuguuugaggcaaggaagcagcagguaugccugcagcagaggcaaggaccacucauuguccuguauagccagcugcauaccagcugggcacacagcucaacuggaacacagugucugcacucaaagaauucacagccagccaguucugcaucuucucugcagugcuuuugagucuccacugugacaucccugugccaggcccuaggacuaacaacgugaacacaguugggaugacuccaugucaguggagcuuacagugucaucuguaccacaggaguuccacaauaucacucuugaacuguucacaacucuggaaggcuggaggcuggaaacccaagaucagagagugggcaaggcuagcucuccuugguuuacaaauguccuuucucucuguguccucugguagccaacucuauguguaucugucuuaaucucugucucucucugucuccguguguguguguguguguguguguguguguguguguguguguguguguguguguguguguguguaggggcacuuggucagguaugaaguauaggcauucucaauguuugcaugucauuagccaugcuaaggcugggcgggaagauguaugguguugggucaucucacagcaaagccccucauugaguguaggguuuggaagauuucccaaaaagguaucauggcucccaagacugugcccagaacacacacaagccagugugcauccugucaugcacagugcucaugagugguagcaagaagaaugguugagcagauagagucagagccugaaaccaguuacuaugggcaggagccaaguucaugcuuacuggugggucccaggucauuagugagccacgggaguguguguagaggaugccuguggaagucagagccaaagccugggccagcauuauaaggcagagcuugaccugaaaugcccugccccccuugugcucauggagcugagcaaagagggaggaucugcucucucaaaacuuucuguacccccuguguuccagccguggccugugucuuagugacaccugaacccagugugcugguuuuagcuccucccaggagcaaucugguauagaagacuauagaacuagcuucuuagggaagcacugggagaaggggugaugggagagagagcauuugacccucugccuccagaggaaugggaagaaaaguuccccagacaacagaaggaagaaaaucauccaggauggaaagaacagagagugcugagcugucacagacuggacagaguguaacacaauuugagauucuuaaauaauaacaguguaacaggcauugaccauuguucugugugggacauuguucuaagugcuuuacgugcuguagccguuuacuuugguguguccaaaaugcuagucugggaacaguguuuaagcaacuguacuucuccccgcaacaagaucuuacaggacuggugccgcccucuguaccagcacagaggcuuguccuuggauggugagaagaaguaaggacuuuacuccuggaggccuugaacuuguaccuguccuaacuuuggguccuucugcugugggcauggacuguguacugaggaugcuuuccaauauccccagccucuucucccugcacagcgcugagccguggccuuccaccugauaucucaggguacauucaaaaauagguuucccugugcagagcucuguacucagcacguuagcacagacacuugacuuacugagagccucugugguuccauuauugaccuggagggugguaguagcacacaccuuuaacccagcacucagaaggcagaggcaggugaaucucugugagcuagaggacagccuggucuagagaguuccaggauagccagggcuacacagagaagccucucucaaacaaacaaaaaauagcuauuaaccaggagggguguuacuagcccagaggcaaccucugccaggucacaugccaggagugcaaaagaggucuggaagggacggaagaacauaugcugugucaaccauugcuggcacugggcaccagcuucugcccaagagguguuguagagaucaguuuuugaucuugugcagccuuugugguaagcucucggggaggcugucacucacugcagaucugacaauaaaacaauguucccaucauggaggcuagacaggugcugugcccucccugcugaagcagaguucucaccauggugucuacaggacagagacaaauagucaauauauggcauguuggcaauagcugaugcaccuauaaaggucaucuuuaucauuuuuggggcuccuuccuggugaggugccugagaaagccaaaaggugaauggucacagcagcagcaguccccaggcugagugagccuuaacccacaacucucagagucugugggugugacaaagugaacaguccaggucaaaugccuuaacaaguuacauggcugaaaaaggacuucauugggcccagugugucugccuacagagcccauuuuggugcugagaacugggcugcaaugggagaugacacuuagucugggaaccaaguggcugggguguguaaggacauagugccugccauguaggcuccagauucaccacauucuugccgucauccuccagcugaauuuagauugaccccuggucuacuacagguaucccuagagagcaccugugaccuaaagaagauccacucugaacugaacuugguuaccacugcccaacaaugaguuagucagguccucgggcuucaguggguccagaccaaggggccaugauguucuugugagguuuagaggacagagcacuauaugacuguggcagagagcucuuccauccuuggcacggcugccugcagcacaggcugcugcuccaaccccagauucuccacugaggauacaccuacucaguccccaucugucugcauaagauguguaaggaaccaggacucagguauccuggucuugaauccgacuucacuggacuuacagauuacguuagccugaaaagcagggaaguuguucauagucuccucaucucagguuuuuaggcuugguugguggguggguggguuuggguuugguuuuauuaagacuuccucucucaucuguaacuccguaggccagcaaaccuccagcucuuucacaagugcugggacugcaagcacagaaagccaccauaguagauuuuuuacauuguccuggagauugaucucagguccucaugcgauguaugcagugagcacuucaccagcuugcuaucuccccagccuuccuccuggcacuucucacauacaagugugaggaggaggggacacugaaguguccgcagacuguaguaucccaaugugagugccaccucaucagaauacacaggugggauuggaaggccagccccuccaccuguugaaauaucaaugacugguucccuuggaaaaugugauaugccacauugccaacaacccugauaccuuugucugacccagcagaauuuacaagaggucauccugaaucuggcaucugugaaacagggaaguuccugugagagaucaggguagacugacuguguggcacccagggcccuuaccagugagcucauuggccucugcccuagguaagaggcuucugucuggccucuucccaucucagcagggggagugacuucucucacaggggcuagggcgugcccugugucuaucuccaaaugggaaaauaggaaagaaaacaauuucucuaccugcaaccuaaaagcaauagcucagugugucucugcugugagccagcucgggcaggaggagcucucuguucccacuauccucgcuuagccuucuuucucuaucuuacuucagaagaggcugcucuacauguucccugcucuagcucacaccccacacgagcaccuacacuccucucccacacaguguugggugcuaugaauuuucauggcagcccucccugguggaguguagcagcagacagccaccugagcugaggcugggccuggagacccagggcuccauacaugcucaguguuuccagcgccugagagauaacagcagugguggcacaccuuccuaagcuuucaguaauaugaacuguuugcuuagaguuggcucuuagaaguuaaauuguucuaauuuucacuaggaaagcacacguuuaaaaguuuccugccagcuucugcgugcauguguguguaaaacagaggcuguaguuuccaaccugaaccaagccaacugcacaguucccacuucuggacuuaaacuuaggcugaucuuuccuuauucuaaccauacaccauauagcauaagcacauuaccucaguaacccacacauguuugggguacugcugcccauauggcccuuaguccuccauagcaccugcaccugugauccuaaagccuugugcucugcccugaacccagagccagguccugugguggcagcucugccauccacgaacccuugagcucucggaaguuguugcucagggcagugacagaagggcgucucaaagguacaauccuguccugggcagccuaggagccaccaggcacccugcugugcuuuccuaccugcccuggccagauauuauuucuggggcuguucucccccaagggugccuggcagaggaggccagugucacaguauggugggugcuaaugguggaugaaccugguaacuaacuaccuguggagacccgaaagcuucuggugagaacauaagacuguaugggggugagacugacugagaugccaauucauccaaagugcuggcuuucuccauccuuacaaggggcccccagccaacuugggaagacagcuggggcucacccaugauacccaaaaugaaacaacgcuacggagcagcaauucauuccacuggguucugccccacagcuagcugccaacuccuacagggaggcaggaaaauagcucacugggaaaagagagcugaacaagggugaggggugaaaguugagguuucagaaaauccuauaaaaaugaaaacaaaccauccaucuuucucccggcaucuuaccccgacggugcccuuucuggaucuugcccugaagucuauagagacaacaacucugaaaucugacccagcccccauaagcugcugccaccccagccuaaggcugcccuagacagagacaaccugguacccugaacagggaucacuuuggggugucuucucccccuaaaugaauagucucccucagcuuuggccauugaggcauuucaaagcaauuguaaaaauuauaugaaccccaucgaagaacuguuacaacaauguuuauucccagcauuugaaacaaggacaaugauauuauaaauaauuguagaugaugaagauaggcaagaaaaaauaacauaauuaaaagaauuuuacaagacggcccguucacaaagauggauggaguaacacaauacgaugaaaauaucugcaauuaacauaaaccggcgcaguggacagaaaccagcugcuggucaaccuucccacaaugccccgucauccacaugggcagugcuggggcuucucacaguggucaucauggcucuggggcuccaggaagaggcagucugaggguucuuugcuggcagcaguuggaggucuggaauccaggaccucuuuaauagaauuuucacaaaccaaggaaaaccuaggauucagaaagucacaggacuugcuacagaacuucccucaggaaccccucccuagcccaggaugacauuaacuccuccaaguuccccaucguagcauaacaccaagcccucccauaacuaaacuuccuacagcuucucccagggacuguguccccucccuacacugccccaccucaggauuggcacaugccaggugcuucguuacucuggguuggucaacagauugguagccucaggccauuugugugguguagggagcauagugagguggcuaugcuuaugcaguuagaaaguaagcagaguacagucuggcugaacacaggugcuuuggaugccuggugucugcugcuggacccacauccuuaccuccugucugggcagggacagcccagaaacagcaggucacuuuaugccuccuguaugucugucuccucuucaucaugacuugauuuuucuaaaauaauaacaacaacaacaacuuguuuucacugaaaaacguaugccagacaguacagagcuagauaguccuguugccaacaaaucagggagaugggacuuuguuuggaucucucuacagccucaccuagauggucccugccuguaauccuagcauuuagggggcagagccaaggguuugaugccagccagagcuauauggagaaacccugguuuggaggggguuacuuuggguuuuuuuugcauauuuuuguauuguuuugcuuugcuuuguuuuauuuuuuuaaggagguauagauaaagcugaaguugagcccucccuggaggugaaugucacucucuuuaacuggccuugugcuccagugggucaucucucccuguuugaugacucucuguuaguccacaagcuaagcaucccuuauccaaauaccuaagaccaaauguccuaaauuuuucagauuuuauaguauuuagagaaaucacuagcuaagcaucccuaaugcaaaaucaaaaaugcccuaaaaucugagacuuuuugagcaacacauaggcacucaaagaauuugagcuuggaagcuccuggguuuugccuauguuguuuaauuuuauggacauggcuauagguuguuucuauuccgaggcucccuguccuauggccauugcagcuuacccugucuaaccacaguaucucaugauuugaaugacauuuaaccacaugucaccugucugagguuuccagggcaucccacuucuccacuccacagagauacaugagcagcucuggguagaugcugacagcagagcuguuccaguaucacaggugccugcacaucacccaguuugcguaccugccauccccagcagugugcucucugauuggccauuucuugccaguuccagaugcagaaggugguuuucagagcugcugugcucuccugguuucucagauguuucagguugggcuucucuaagcagaguggccuuggguuuucugguggacuugugaccugggggcugucaagaagccuuuguuuuuaguuagaaaucaggcucuugugugugccaccugguuuccugauagcuuugacuuacugucaguaacugagaaucaaaaaaaccuuggcuuugugggagucaacccuuugcugaacccucagacagugacacaagcagaagugcuuuggcugcaguucaugggaagggagaagugauguucuagaggugaaggaucggguggcaggaauucuucuaaggcaggaggcccugguucaagaaacaagcccagccuggagcugggugggguuccucagacaagcagcugucuaaaggccccagacaagacccaagguagugggauaauaggaggcagaggcuauggggaggaaggagagggauacagugggggagcacagcguggagaaccagugagugguguggagaacugagggggagguagugggccuggaagccaggagagggcucaacacaugugcuuaugugaagccacuuucuugguggcuucaagcaaagcucuaggucucuuuaaaacuggagucaauucagcuaccuccuauugcucugaacaauaaugucuguagcccaaaagcccuccaagacuccaaaaaagucaucuauggcugccuucagacucuugggccuccuggcgaaugggcugaggcagccucccuaccuaaagcugggcacagaggcagguggaggaggagaacagagcagagggcuccaggcacuggacuucuucagucaugucuucgugcaucccaccugugugugccguccucugacaagagggaggugagggagaggccagcuuccugacggggcaguugugagacauucauaaaacuuuuauuggacuugccacccuuccagauaaauauuuuucaauuuuaugagcucguuuuagggccuaggcuuaauccuggcuuuguagcugccuuuaaaaaaauuaaauauuguuuuggcaaaaggagccccucccccaugccgccaaaggcugcucauaaaucccugugcucaacucuugccccugcccucuucacccgacucucuucccucccacaccuuguccuagaacaagaugggauccagcguauggccacaaaagaaaguccauagcagagucccugagguucuccggugggguucacacagguacagcugccccccugugucccaggccuucaguaaagccccuugcauccuguccucuaucugcugucuugaggacuguccucucaggccagcacccaugguugcuccuaacuuagaacucugccucuucccugaugacucuggugcugucagaaacuuucuguccuauguccuuccuuauugggcaugggcaugucugacacucuuagaaaugcaacacucucuuccccaugcauggccucagaucugagugccuagcagcacccagcaggcacagguggcaagugcugagugggaggugugugguggcucuggcggaagaaugaguugacauaguucagacuuuguuuuuaugugauacugcccuaaacacugucauguuaauucacagccucaucacaacccuguacaauaaauguuuaacucucccauuucucaaauaaagagauugaggcagaggcaaccaacaucccauaugaagcugcacagugauuggauacugggccagagucuggaccuuggugguaaacaaagagucugugcucuggcagcuaugcagaugccuaacucugagggacaauggcccacugaagaacuuggcucugguucagaggugauugggguauucacacuuaaagagaauggaguagugaacgagagauggugaacaaaguggggcagagaggcauuuagacuccaccacagugccuaugguauugccaaguccuucagcagucuugugucacaagcagggcucauccucgccuguccccuguccccagcauacacaaggcaugaaugcagcugaggaugaggaggguucacgagcauggcaccagcuuucucauucaucugcugcuucccgaccgucugcugggccagaugcccugaagauuuccucacugacuucuuccucugcccaccaaaaagcaggcauugccacauaucacaaaggguagcuaugggucaguggcacaagggcuggccaaggcaucugcuuggcuggggagaauagcacccugcccagcuacuaugcucccuccugacccacagcccacagcaagaaaagguaccaggaaugggccugcuguuccuaucccugccucauccugccccugcucuaaggccccagauggucacccagaguauaacuggcagucaggaugccuauagacuccagagguaccaucacucaacugacucaagggagguugucccugucacaauaccuguagcgcuguagauaacugagauggccaccaggcaagcaaggaguacaggaaaguugcuuuucuggggccaccauagaaagcagagaccagguguugccaugggaauguaggcucacuauuuauaaaguguacguacccaggggccaagguuggccugugauagccaaauaugccuguaucuauagaguacagggcacccagacucgugggacagcuccacaugcacaggcauaaccagucagggccacacugguuucuuguacacagucaccuugagaacuuccgagccucauucccacuucccaggcggcuugggcaauacagaccucccagagccagccauggcuugcaaacuugcauccuugcaaacuccuguugcuuacccacacgggcagaggaggcugagccuauggcauugcaggcagaauaguaccagauaggccugagugggcuggugcuguggaggagcagacagacgucccuaauaggcuacuggugcugcuagcagcaucccagaccucucauggcacucagacacacagcaucacaguggcccauuuaugucacuggaugugcucuuuuuuacaaaaggccagguuuccaagaacaguaacacacaaugcucugggaagugaauugaucugaagaaagcuuucucgaagaauagagggaacugcaagggacauugcaaaacagugcugcuacaaaguagauaugugagcuaggaguauggugggugaugagagaccauagcuugucucaaguuaaagaaagaugcaacaagccagccacaccuugacauccauccuggcaaacauaauucagaguuucgagacgcaggguucccuggucaaaauugacauguucccuccugacccuuggacaccagagcccacuucuuccuugaauaugugggcaacuauguuggaacccuggcaucaggcacagugcaugcagggauagguagcaccacagccagcuuguguaagcucugcuuaccacugcccauacagacugccuuguagugugucacagagcaauaagguauaggccuucaaaggagcucuccgggcccccugcuuucccaccaaugcuggagcugccuaggggagccguggaagucuuaacaaauaugcaggccguaguacuuagagcccuguucuggcucuucucaucggucugguuuuccuuguaaaagaaaagcagaacucagagugaguaaaaacugcacuguagguuaaaagcuggguacaguucucccuacugagggcccugauagcauuugcugagacaaguucugauuucuccucaguuuacugugcuguuaauggcagagucugggagacagggccacagauaguauaugucauuugggcauagcacuggccacgagucccugauagacuagccacugcuugccauggaacccuuuucuucaguuuacagaugggacuggagaaggagcaugccuaaggauacccacccugagcaccagggagcaacccuagcugucucuaacaccacacuguuagacagccugacaucaugguguguguguguguguguguguguguguguguguguguguguguguguguguguguguaaaaagaugguccagauacagggguuuugguuuucauuggacacaguuauuuuauggauauccugacuuaauggggauauugcauuaauccugcugucuucaugauguggucaggagugggccuguguuccacuuccugcaagagcaggaagcagacuucuagugcagggcuggggcugacacagccaagccaaguuguucuucagaacccacagagagguagacaguacucuguacuagcggagccaagggacaccagcauaggacauacaaggucccugccagagaccugagccaagaggacacaaacauauauuuauugagagcaggcugugcagcugcugggcaauauccucagauuauagcaacuaguaggcugcaaugacuucugacagggcugucacagaagagagagagagauuuguauuguuucugugugccaugccucuaccccacgucccucaguaucccaguccucaugcccagaucacggaagauggugcaagcaacugguaagucgcuguugugcucuucaguaagcacuaguaaggaucugguuuccuggguuuggaccucaaggccaagaaaucugagguuaaaggucacaggcuccaaacaccccuuucuuuguguguacccuaguaugugguagcauaugacuccuaauaacccauacuguccugacaauccaagguuauagugaagguagugcucuuugaauuuagagaaucauugaguuaagggggccacauugcacacagcagaccuagaggagucacucugagccagaaggcaucauacagcauaugggaggcagaggcagcgacaggagcacuuuaucugaggagccugucuauggcuccacuucuaaccacuguguccugggaacuggagggacaagccugaccacuaaaacaagggcuucagcagagguggcacauuuuaucaguagaggaagccaugucccaugacaagagccacccucucaccccacucccuuacggugggaggcaggcaagugcccaggccacaauguucuccugucuaaccuuacccuaguacaccaauuaccauccaugguaacaagauaucagaggaaaaugccucucucucucucuguguguacacugcaugauagggaaugaaguuggacaggaagugauagacccaucuccuucagagcacacugguuccuguccugauuccucuggccccucacuagcccuaacuacgcggcacuggguagaaaggagaggcauugcuugcuaguggaggcagagcugucuuuguucuccaggaccuugccagcacagcacgcugucccucaggcucuguaacugaucccagagaugauccuacgucccuucaaaaauagccuucucauagcacuggccaggcuucgaagguccagacuggaauccagaucuugacaauggcuguuguuuuggugcugugcuagacuggaaccaagaugccacagagcacacauuagguccccagugaggagcccaaccaucuguggcccuuaagcucccaagagcuucuagaaaggcccaaaugugagaaguauuccacaucagaggccugccugagggccuccauauaugugaguaacuccacuagcugugaugaaccacaacuuggagccauaaggacaaaccucagcugggucagagcacagugugguauuuuggaaaaugucacaugucaguagacaagagccacuuuagaccaucagccacuaugcugcaugguucuauaagaggucgagauagcugcugugaaggcaagagguuggaacacacgggccauuuggggagaagaaccaaggcauggucacugagggguacugcccuccagaccugcuuugggaacaaggacccaugugcucucaguacgaggagaccuagcugaaguggaaacugaaggguucuuuggagagucaguuauguuggaagguguguugccagggcaaacacaugaaagaguguuuucccagaaugaacagaggugaaagacuaaggcagacucaugaaggaacauuucacugaagcagacacaggcaggaggauguucuguuaaagcaaacaugugaaaggacauaugaugaaggauucuuugcuaauacuacaccguguaucaguccaauuuacacugcauaguugagcugcauuugucaggacucuauggacucaggcugauuggaugcaugugcugaggcaagaccugugcugaggcgaggcacguggaggacacaugauguuuggaggguguaaauaggacuccacggagugauggagacagagcuuggcuugcagguacagcuagcuauacaaugcuuaugggucucacaucuuugcgaucuucgauucccuaagaaaggcacagcugagaacuuuuccugguguuccucugggucccuccugcugacuggagccgaggcugaggccuaacucucucugcuaggucauaucaccacuguugcuaacccgacucuacagaacuggacugcuaauguauccaugaaguguuugugaguggaucgagcugccacugccaaccuaugaacugaacugcugguuuccagacaacacagacaagaguuacucuaaagaaccuuucuaaacagguccccuucccccauguccuuucuuuuccacuaccucuugugggugguaggcuacaagggagguuaaagcguuuaagaaccaucauuaaaaauaagguuugaaaaaaauuaaaguugcaccuagccuuggcaguuauggcaggaaagcaggcuggagugucagugucccaaugagacauaccacuucaagccacagccaggucugagauacucccuagaggcuacacagguauagccaaucaucuuacacagagcauugacugugugauuagacacccuggguggcaggcaaauggcgaugagggauaagcugucagcccgcagcuucaggagcauagauguggaccaugcugccaugccaccccugcccuucaucugccagccacagaggacaguauaucggucaccugggcuuguuuuucccucugcucuggcagcagagcugauacaguaaucaggaugccacauaugggcccuggaaaaugacugcuccugagccuuuguucagucucauuauucucuauggcuuuuucccccaagucauaaaaaugacguuuuuaauauguggauuuuuuuuaaaaaagaaaaagaaaaagcaauaugaagguaauaugaagaugacuuuuauugucaauagcucuaccuuuuaaaccaguuaucguaauuucugcucuagguauuuuaauugaagauuaacuuauguuaaagaguguacauguggagggugagagcauuaaaauucugccuuccugaguggugggggaaaauacuucuugggaagccaucaggacccugcccucaaccccuccggcauuagggcugccuuuccuuaaucuuucccacuuaccaggaaaauauagguccucagaaccuguagauuggagcagaccacaccauagccagcacugccccuaagcacaaggaagggaagguggaagagguguacaaaguguugaaggcauugaucuaaaugaggaaguccacccugugguccugggcaacuuccugagugucucuggcccucaguuuccuggcauaugaauggucuagaaguggcugcaguuaagguaugacugucuggaacauagucaccaugcagugagcauuuucucugacuggcccagagaucuguugacaguggggcacuaacuaagcuuucuguggccaguaagauggucuuccuucaaggucccucuagguagcacuuagcuaauuucaaaacaacuuuccccacauggggacacccagcagcccucagaugcagccaaacaacauuuccccauggugacccagaguguagaagccuaauucccaaaagucucuguagagauguccugaagccuagaccucccuggugacaguaaagcaguaaaggaucuggccugccuugagcaccaggcugcagugggcacuucauaagcacagcccuggaccauagcugugagcccuuaccugccuggguaguggcucaccugugggauacccauguggcacuggcuagguaagaggacaugugaggggaugcuggaauggcaguaucagaagugacaugagauuaacaucccauggacccauuaaauaggagguauucagccaccagcacacuucuugcaacccugcccugcagagaccacucaucucucucccuuuuucauucuuacuaccuacccaccccacuuagcuuggucaugguucuaucccacucccaacacaccucagcucugugcccaugcugccccacugcccucucaccccguccauccaacaccauggcccacugccuaaaaggugugggcauccccaccuggcaacucugauugagccugaggggaggggacagauagaucugggacucccuccuuauccucgccccaaagggcuccaagucuggguggauauggccagcagaguuggaagagcuccuguuuuccaggacucccccuuccucaucugcugcugcagucagaagcuaugcuccucacccccagccucuguggguuuagaggcugucuggaacagaaccauacucaggaacccuucugcugguuccaggcaagcugaaaggacuaauauggccuugcugaagucucagaggaaaguucagggccuugaucccaggaggaagacuaccaagguacaacacuccucuuauugaaagucuaggcagaaggcacuaaggcaguugccauaaucaauccagugagggagcccagcagagacuggaacugaggcagcugaagcaugagaaagguucuguaggaggcaggcaaugugguaccuaggcauuauagaccaucugagcacauguggggaucuagagauuucuucaggagaggcugaacugggagagaugguuaagauuuguucuaaaaggauuuuggacagcacagaggugaauaagcagagaggggcuugcaacagugacugggaaguucacauagacuaaaccauggcccaaucaacaggaccugcacugaagaggcccuggaaccuuuaaggagcauauguuagcccucacugugcacaggggcuugggguaggauugccagaaaguccaggguuccauguugcacaugaagugccuccuugucagugaggaccuggaccuggggaugucuuagugccaacacaugcuucaaggagcugcaguuaccucaugggguggcaaccucucaggaucaaguaguaggaagcuggccuuaggugguugacagcucaauggcugacagaaaaugucucccuaggcugcccuccauaggcaaagccuccaucugagucucaagaccaagucauuuccugucuggauuagagugauuuugguuuucuuuuuuagaaagcuuauacauacuaugccauuuuuccuccgcacacaccccuaucuccaaaguaccucaaucuccaaagcugggcugcauugcgucuucaguuaacuuggugcgggaauaucucugcaaaggguccuuuuuuguuuuugaagaauucauuguuguugcuaagaagcuuaauauaaauuaaagaaggaauuaggcaacauuaagacaucaaaaugggcaugcagggcccguugccucuguuuccucccaaucaaagagguaugcgagccaucaagugugcuccagagccucagagggacuugguucugugguuacacagccugccugccacccccuccccuaauuccuuuuguuacugggacagcagaauacaguucugcuucuuucuuuaaaaaaaaauuaaucaccuuaucucuuuaaagcaaauugcaucuuuguuuacauacaugaccguugcagagaaggaaagagggaaagcagggagcugguaccacagcuggcagggauaggcuugugagucugugagcacagggccucaccuaaacacacagcagguagacgcagucacucccacacaaguucagagggagcccaggaggaaguggauuucucuccccagaucuguccuucugccuguccccagccaggugaggagcugaugacagucuguuguggcagacaggagaaccacauucagauucagcuucaucacacagcucaauggagaacauacaccuuggcucaccucaucuggaccccugcaaauccuguguaacagaagccuccugucuaucagauguuacugucagaccagcccaagccuuauagccagcacccugacuccacccaauuagcuucuaccuuugccagcagcagcagcaggccccugugcagaagcacgucacuucugcucagaguucuguugagcauggccccgugucuuguccagcuacaagccuguugaacuuggacccuguggcuauccagcugccagcccagcaguccuuaccaggaugcugccccaggaaaaccccuaagcccauucccccucugcccugcuucuacagcccccugauagcugauguggcuucagugagccccugagggggcuucugacccuaagaugcuuacaagggauccguucccacuggggggugccagcuacccaccagugugaaggccccucuucuagucuggccccugacaugaaagcgacgccagcaauuggaggcaauuugcuggccuuugauggccacugccgggcggcaccgcgcuaggcuugaaaaacuucacuucccacauucuucccugauugcccagcagagccaagacccagccgccugcagcccauugugccuuuguguggggcuggcgcacagugagaaaggccagccaggcccugggagagguccccaugggaagccaugagcaguggugucacacugggucacugccacccucacuaugccugggcucaaaagagaguagagcaggcuccaggaccgcuguaggacaugguggcuagggagagugggccuccugaacagaggacauuauggccuaccucaacccaacacccacccucccagggagaggaccaguccagcaugaugucugagccagacugcucucuggacaauucaagggcaggcaugguuuucccaggccucaccgaugcccuguucaucuggguggaaugcauccagguguguguggcauggagggguuaucauguaaauguguguaauagagauuagugcagguggguaugaaugugguauggauaaagauacaaauacagcucggagcugguaggguucuucugaaaguucugccugcugcauuuuuuuaacuaaauuuagaauacaucuuuuguauagaggacaaaggucaacuuugggugucuuccuguuauugacccuauauacauacauacacacacacacauauauauauauauagagagagagagagagagacucucucacugaaccuggaguucacaaaacucagcuagauugucuggccagaaagccccaggaaucuccuuucuucaccuccuagaugcuaagauuauaggugcacaccacuuucccuggcuucuggggaucugaacucagauccuccagcuugcaagcuuauuaccgaauaagccaucucuagccccuugccccuagcacgagucuguuuuuaaaugcucacugaugauacucaguccuacugagcaugaguuuacuacagcaaggggauuugucucaucuucucuugguuucaggcccccucuaacugaugugugguucucugguacucaaacacagauggggaucagacaaccuuggucaccaggucugcccccucccccacugcaggacguugggcaagccugaagcucuuugguaucucagguccuccagcccugaccagugaggucugcucagcuccucauggagacaccucugcacaugggccuacguggcacauacuugucuggucugcaucccugggagcagacuucuugguugacauugacuugcaggagcuaucucacaaguuguuccuaaaugcaugcucucuggauucuuggacugggaauuugccuccagcccuguaggaccccaucaccacugauaggugggagccagaguccucagugcagaccacaugaccacagacagaaaccucccuuggugggaguggucacagaaagacaacauauacuaaccauggagauaauaauccaccagagagaugaaauuacgggaaagaaguaaugcagaggauggccagagaggcuggguacgguggccagguagcgagcaggccugagagauaacacauggccagggacuggaagguaauaaaauaguugcucuuagaacucuagggauuacaucaucugagcugagaggcugacaaagccagauacaggacagggaagcugauguuuggugggaaucacuguguuugccuaugcacauaggaaaagccaguagaauagacuggcauggugggaaacuguccugccugagggccccuggacuaaagaugcugguacccuaagcugccuccugacccccaugacccagucagcaccuuucuccuacagaacuaagcguacacuucauggacuuggccauaucacagguucccucugccuauucagccugccaggaaucucugugguggucccugucaucuggccaugaguccagcagucuuuuucagagaucccugcauuagguauaucaaagcuguuaccaccacccucccagcgacacaagaucauuuccuuaagaucacgcuaucuggggcuaucugcuuccaggcuuguugacugucaguccuucugaaucuagagucuccaggggaccuggcuuggaccacaugccugcucccaguuguccacugguccuacagugccaaguaucuuuaaaaggaaagccccagggaacugagagacauuuucagccugagcugggccaggcuccuaugguagguacagcuccaacuccucagccuaugccaccuggccaaaggaaaaaggaccacuaaagaaacagugugauaucugcuacaugccccaggagcuuggcacagguuuuuuugguagacccuuaguguuguucccauaucccugugaugccacggugaccaagcugcugaauggccacaguauugcuaaugccagacuuguucuugcaucccugccuacucugagcugauguguguaaccagaaccaucacagaugagauggacugccgauugggccacaccugucucccuagcauggcauagacgcucuggagcccugcaccucuucagcaaucagaccuccuggcaccagagagagacaggcccuuaccauuugucagggucuggugccagcaggaggaaggcccagcucugauucagggacucagauaccugcaggccuggcaccagcccaggaccuucuuacuccaggacuuaggcaccaucugagaggaggcaaagccacaauugugggacuacagaucaggccgcugcaggaagacaccuuuuccugugugcacucaggcaggcaaccucacuccagggcccuguuagcagcuucaaguccuuggcuuuccccaggccuccagguuuugaaauggcccacggucucacuuuugcuugucagaguaagcccagacucuucauacagugagacaagccauuccuaaccugaaugcaguuaucuagggauguacuauuuuuuuaaauccagagauuaagggccagugcaaggugcuuggagaggugguagaucucuucaagaucauugucagaggcagggcagugguagcauacgccuguaaucacaacacucaagaagcaaagcaagagugucucugaguuugaguccagccugguguacauagugaauuccagaacagccagagcuauuuagagauauccugacucaaaaaaaaaaaaaaaaaaaaaaaaaaaaaaaacauugucagagacccacaugcugguggauuuugcccuucagaauuauagaaugucaguagauucccccaagugcuaguagguaauagcagacauggccugagccucuucccagcaucuaucucaucugcaaacuuaagacaaucaguugaauaucucaauacaagacuaaaugagcauguaggaugcuggacucaguaacuacugcagaguccgcagcugccagacacugucaggauguagcauaacuaaaaaauggcuaagcuucgaugcacagccuuucacugagggaccauaggacgucuuccacuguggaaguagaaagagaaaaggcaguuguaggugaagaaagaucguguugagcucuugagaauggccaggagcccagccuuauucuggguugguagugaggaugaggagcuggcuauagacagugucucccagagccuggguaagauccugcaagagcucugacccaggagagcugguuaaagcucccagcugcuccccugaucacugcugaucugcuaaggcucccuccucugaacccacccagaggcaggaagaagacauuagucagccacaggcucagacucccaauauagagguaagagaguaucaccaugguguccaggaacuuuuaguggcauaucuggcagguagaacaguguuccuagagagcauuuggaccuuagggacccgaugagcagccagaagaucagagaguuaugccccagaagugacuggcugguagugaauuggcaaagguagugauacugaguugugggagggcagagcuaggagacaaggacagcugugccuacaaugagucagugacacuuuuaucccuugcagguggccucagcccugaguccaagaagauccugacaccuacacucaagaagcggagccgagccggccguggagagaccaccaagccagaggagggcacugaacggccagagcccauccagccugugacacucaaccugucuuucaagcgcuaugucuuugacacccagaagcgcaugguacagacucccugaaugaaccauccugcccagcugcaagccagaccacagugccagaugcccccagacaugccucaaccuccccagucugaggcagucaaccccaucccacugccauugcacuguuauugagccccauugagaaaaccuggggaaaaugaggaacagugccaggagggccugccacuccaucccugaacccacucaggauagcaacgaggccuacuagaaaauggccuuagcagagccagcaaccugggucuucccccgauaagagugugcagccacucagccuugccccaacuagcuggcacccuccaacggaaaauaaacaucccauaugugaccuagugugcccauagucugccugucucccagggcuucccaggcaucacagggaguugugugcauuggguuuagggcucgagagcugcuagguucaaccaaguggcuccugggauguugucaguggaccuugaagaauggagguuuucugaacagcugaguuuccugggguccucuggccagggguuaguacccugggguuccauccuugcacgagaggucaauaggcccuggccuccauuuuuggaaccauggacucccaagggugcuagaccagggguggaguaccuggacccucuccaugcucaucuucagccccagcacccucaagcuuagcauggggacugagauaggggcaagaggauagaacugaccaacgaaggaaaucagagcuuuuccagacaccuguaaggggagcagaugucccaauguuucucgguuuggccuccagacagacgugaaggccucccuuuaucccaguaaucggugcauuaugcuuuaauuuucaaaaauggcauuaaaaauauuaacaggggca

SEQ ID NO: 3191 - RNA, 1421 nt, Mus musculus
agacaauuaauaauauaguaaacagaaugaaaacgauuuuuaaaaugauaaugaguugagaggcuuuuuucugguccuuucaaauuggaaucugcugguauuggguaguaguuguggcuguugucuccugcccuuuuuccacagcccuuccuguauuacuuuugagcuucuaggagccacuguuggccuaacaagcuuugcagccugugaucuaggcaagauccacauuauccugagacuccccauuuaguacagucaugacgaucaaauauucaagcccaggagaguuucgaagugcacuggagagugggagaaccaaacagcucugagacacuggaggggagaacuagagaaagcuagugcucugucugcugacccagcacuuucagaccugcccagcagugaaccaaccugcaaggagggaggcagcugcagcagucaggccucucugcucacucugggcccagagaucucaauucaaucagucaguagagcacauguucagggaaugggcuccugggcuagcauuuuacugaccaugggcucagggccucgucaggaauccuuagagagauuccuuugccguagagggagggcaggaccacagacuacagcaugagcccuucuacugaagcuucucugaacccagcucucuacuccccagcccucaucuuuuugccaaggcugucuccuaggcaaauaccaaagcauguguccacagucucccuaaguugcauuuguuccuugucugcagguuccagaguagcuuggcucuccuuucaagguggcaccuggcuacagcacccccaagauauggaaaauaaucaaauggauuuuuuuucuccaucaguguccugcagcacaggaggaguaagguucguccucuggcuagaaugccuguuggcaauucaggacugccuuucuuuucuugaagugugauuuuuggccccaaucuccaacagguccugugaagacugagguuuguccagcuucuucugcuaccuugccccuuuccauaaauuccaauguucuucuuucucucuggaacauagucuauucuuaguuaccugggaucuuggccuuucauuauuagaugaauaugcuccaggcauuuuucauccuucccuuugugacuguuaugaauauuugaauccauuguucagugugcaccuccaugauccccccccuccuuaugggcagaguuuggucugguaggaagaggaagccucaccuccuuaaggaaagaguaucuuauccgggugugguggcgcacaccuuuaaucccagcacuugggaggcagaggcagguggauuucugaguucaaggccagccuggucuacaaagugaguuccaggacagccagggcuacacagaaaaacccugucucggaaaacaaaaaaacaaaaaaacaaaaaaaaaa

SEQ ID NO: 3192 - RNA, 850 nt, Mus musculus
uagcaggcggaccgcggggcuggcgcucaggcgacggcgugagaggcagcggcgggauggccggccggcggguaaaugugaaugugggcgugcugggucacaucgacaguggcaaaacagcgcuggcgcgcgcgcugagcaccacggccuccacugcugccuucgacaagcagccgcagagccgcgagcgcggcauaacgcucgaccugggcuucuccuguuuugucgugccgcugccgggggcagaacccgguucuagcgacacgcugcugcaggucacacuggucgacugccccgggcacgccucccucauccggaccaucauuggcggugagcgcgggccggggcgggagccgggcucgggguccgagcucgcgggauggauggcggccugacagccuaggccuggccaccagcccggaaggcuuguggucucgaacucacagcccgcagacgcggacacaguucucaccuucacugccgugcaccgagaugcuuuccuagaaaaaugauccaaagaaacaaacccugcaaaaaggguguauacaaguuucaaaaaaaaaaaaaaaaaaagucaccacguaccuguccuuuggucuccugguucucugucccaaacacugcucucaguuuccuguguguauggaugguuucaggaaacauacacagaaacgcagacaaggugcagaaaugaaagauccuguuuuuuuccuucuguuguacuacuuguggucgguugggguaguggguagagccuagugccuugauaagaggcaagugcucuaggcucucucaggaucucaucccccaguccccuuuauacacaaaccaucacugucuggagacuaua

SEQ ID NO: 3193 - RNA, 32166 nt, Mus musculus
agagaaguaucaucaaaauaaccuauucaguuuuauuagaaaacaagcuagguggggaagggauccuuccaaaccaccauggagguuugauaauuuacaaagaaacuguaacacugcaaagcaugcuugaggcgagccccugugcacggugugggguccgucucugggugcgccuccaucccaacguuacuucauguacuuguccugcuggucagccaaaaucuuggcagaggacuuggcgucauagaagagcucgcugaucucuuccacgugcuccuucucaaugcuguccuugccauugaucuuugccagcagguuggcuggggucagcagcugcaccgaauaccuacagcagacagcacagcggugaacacggggccacugaagggagccccaagucagcaggcacauggacaccgcuggcauggcugagccgucugcuccagugagcccagggcaaggguggcagagggcuuccugccauaacaguggagagcggccacccgggcaagggcagaugacacagugcuccucucacauccacacuucagaggacacacuaacacucagagcacguacgcccuggcagugugcacagugccagcucagauggggacuuuuaacauacagggaaacaacacaggcaaccaaaagcuuaugcggguccaagacaugaaaauccaaucacugaaaguucacacagcugaccauucccccuuuacuucaggaacaagagccugaaguaaagggauacagggagggcuagggucugaagaacuauuuucuccacucacugccucugagcccagggagaacagcugagagaacacugcgcaugcacugauccccugggcugcagccaccagaucccuggaguacacacccagugugagggugaggggcaggcccucccugcucugcugggaacugggaggacagugguaugagcucccgcauggggccugcagacggaauucuaaaguucaucucuagauccucagcgcuagggacuaggugcaaggagaaggcccuugcuacagcagaaggguuccagcugggcgccacuuggcucaccucagaguggucuuggugccaaucuccccgaggugguucagcgccuccucgcugauguugaugccuuccgucugggcucggaucuuaaugaucuuuggagaaaaaaaaaccaugguuacauaucgaacacggcugagggacccagggucugagcuacugaugguccccagcacuggggacaaccuguccuucugaaugaugucaccacagccagggcuccaggguacccccacauccagagcagcucacagcugccuuucgcccccucuuucacuguuacagagaacuggaguuacucccagccuugccggggaaccucaagguuccaaccuccccuggcagcucuggcaccaucgccuaugagcacucaagcaagagaagaaauuuuuguuugcuugauaaauacaaugguuaaauaaaucaaaaaguuacuuuuaaagauuuaccagcccuccuaauaucacugagauaucuaaucuauggagagccuaaugcuuguugcagugaguauccugugaggcuggaggggcagccagcaggcggugagacgugcagcgguggcacggggucccacgggcgcagcggcacugagugauaagggccagcgggauaaugauguuguguguugcggggcugagauaacucgaggacuucgagccucauauaauacaggaauuuuucacucuggcagcuucguaaacaagauaucaagaagccgucguuuaaauuaaagcuguaaaaacagccagaguagaggcaugggggcuggaagacacugaguccuagcaccaggcuccagagagagaggagaguggaagccugaggugcugagucugacaacucaggacucugccaggggucaggagucauccugucacuguaagcagccuggagcuaaggccagcaggccagcaugcacuccugagagguggccagcaggccagcaugcacuccugagagguguccaggccacaggccagcaugcacuccugagagguauccaggccacaggccagcaugcacuccugagagguggccagcaugcacuccugagagguggccagcaugcacuccugagagguggccagcaugcacuccugagagguggccagcaggccagcaugcacuccugagagguggccagcaggccagcaugcacuccugagagguggccaggccacaggccagcaugcacuccugagagguggccagcaugcacuccugagagguggccagcaugcacuccugagagguggccagcaugcacuccugagagguggccagcaugcacuccugagagguggccagcaggccagcaugcacuccugagagguggccagcaggccagcaugcacuccugagagguggccagcaggccagcaugcacuccugagagguggccaggccacaggccagcaugcacuccugagagguggccagcaugcacuccugagagguggccaggccacaggccagcaugcacuccugagagguggccagcaugcacucuugagagguggccagcaugcacuccugagagguggccagcaugcacuccugagagguggccagcaugcacuccugagagguggccagcaugcacuccugagagguggccagcaggccagcaugcacuccugagagguggccagcaggccagcaugcacuccugagagguggccagcaugcacuccugagagguggccaggccacaggccagcaugcacuccugagagguggccagcaugcacuccugagagguggccagcaugcacuccugagagguggccagcaugcacuccugagagguggccagcaggccagcaugcacuccugagagguggccagcaggacagcaugcacuccugagagguggccagcaggccagcaugcacuccugagagguggccaggccacaggccagcaugcacuccugagagguggccaggccacaggccagcaugcacuccugagagguggccagcaugcacuccugagagguggccaggccacaggccagcaugcacuccugagagguggccaggccacaggccagcaccgcuggugcugcuucuauccagacaggcugccagcacagaacuggggaaaaccucuugacugguucaagcauguccacaaacauaucugcugucuuccucaaggaucacgacagaagugucuacaugggcucagccgucaaucauguaaacacagaggggccuaaggcagucaccagauaggugggagggcuguggaagcaagccagaaaggaugccccgugcuccauccgacagcuacauggcucaaggaucugugaccaacaguuggacaaggaagaccucaaagcaacaguugaaaauggcuguuuaagagucuuugggaacuacaagagggacugggguguaugcagaccaguggcagaacauguucucagcaugcauaggguucuaguuauaucugcagugcugccagcuccagagagauacaacacugaaggccagagcucggcagagcagccgcugugcuagcagagcaucaccccucugcugugcuggagcuguggccuggcuuccuuccauaaugccaagcaucucugucucaaugucucuacaauaggccagagcagucaucagagcgcuaccucagcugcuuggaaacaggcagcucaugaaugagaucuuuaaucauuuaauaagccgcagggauguuuaugagguguuggcacugguggcacccuacauacacguuuucaguugagcucgucuguguaaaaccugccccagcuccagcaaaaggccgaggggaucccugaagccaccaaggccaaaccaagacccagacaggaagccacugagaacagccugggauaguggcccaagugggccugucagucacagcacagguaugaggggagacagcgcuccagaggagcuucaccuggggcuccaaggugagcuacucuggacagaacccuagcuuaguuuugagcugcaaacucugguuaucacaaagcucuugaggauggagcccuguuacucucuagcucgcagaauucaugugauaauuccgaaaagcagggagucuccugucaccaucuuaauggauucugaguggcaauggccaaagcccaagguaggucucuccuuuaccagagaggguauucuagacugcuucuguuguggugcaacaaugaccaaggugacuugggaaggacagguuuauuacaucucacaggccacagaccaccaugcaggaaagccagggcaggaacucagcuggaccuggaggcaggaacugcagcagacacauggaggggugcugcucacuaagaggcacccaggcugacgucuagcucguuucuuaaacaguucagggugaccuagggauagcacugcccacaaugggcugggccagccuacaucauuuguaaucaagaaaacgugccacaggccaaucugagggagacaauuccccaacugaaguucucucuuccugaggugugucaaguugacaaccaaaaucagcucccacaggugcccaguugcuugagccacuaggccagcaaagggaagccacagaacggugggugucacuucuuggcaggacuaaagcuuugagcucaacagcaagcacuuccugaucugcacgguggcuuugcuccugcuccugcucagcggccaccuagcacuggccugguaggcaaugggccauuucaagacauggggcccagggggaggaagcuggcccagugagucccucuaaggagauaaugggacccccgagucuuuccuaucuuucuucaccccaagcccaucaagaguaagcuaccuacucuguucugucuccuucgugauacacuauagagcucaaaguucaaaggacagggcuagaugacaagccaaagccaagaaaccauguccacaauaacccucuccuuacuuaaguugauucccucagguacugaccgucacaggaauggaggagacguuagacaggccauggagcugacuuccuaaauaagguucacaaguggcacuaugaccuuuaacagcuggucugggagaagagagauuugcugguaugucaccaugaaucccugagugcuauuaaugagaaauacuggcaaggccacacugcacgggccauaggagagcacacaguuucagagaagagccacagccaccacaaugcuccagccacuguccuagccacucgcuggcauuauauauaacacugagacaucugugugcuacgcuuaguaugcucaucuaucuggguuccuguuuguucuguuaaaagucuagccuagcuuccaccucacuguguggcugaggaggacccuccaccucaauuucucaagugcuggccaaguacaggaaagcuucaccaaguugaguuuauguggcacuggggaccaaaaccgaggcuuagugcaugcuggaaaaaaaucagucuagcaacaagguacaggcccagaauguuuguguuugcuuguuuguuuccuuuugagacaggaucucacuaugccuaaaaccugugauccuccugccucagccuccugagugcuggaacugcaggugugcauuaccauaccaagcaacuacaucauacuuccuugcuccuuucuucaggcugagggcaucuggugaccacuaagcccauguuuucuuuccucccuuuccucaagcucaccagaaauagcugggcaagaccaugggcucuaaucuaaccaucuaagaauguccacucagaagaacccaucugucagagccucaaggacacugggauuugcucagaagagugagcagagcaaggccuaggcuagccaaguggucagaagcggguagaaaggggggggagagcaugagauuccgggcuuaccugcuucaucuccuguggcguguauagcaugguccugaugaucaucacccugucuagcagauccaacgggaugccguguggagaagugauguccucagugccccugcaagggccaaaaucacucccaucacccaaaaaaugcuuacaucuuggacaacagacacaugaguggaggcacucacaguacaaguagguagcuagcaucccugaguaucagagccagguggcccugggcaacagcuuuauuaucccaguucgggaagggaacacaccgaaaccaaauccaaaaucaaacagacccaucuauuugcuaaaccuucaaagaguauuuuauaauuauaccgcuaauguauacauuuuucuguuuugucuguugcuuuagucuuaauagccagaccuaauuuccacuugacagcacacauucaugaauugccuccucugaaaugaucaccaggcuugagcaucccagagaucuacugcguggaugacugugccaaccugcacagcuacgugaggggccuggucucagcaccacaggcagcaccgaacauuuuaauuccuaaauauuugcugcuuuaauaauuuagaaaaagaaaagggaacaccuugauugaguugcauuuccuugcuuacuaaugaggcacaaauguuuccccucacauccaugcuuuucuuccugagaauuguccaauuacauccuuuguuuuucuuuucaaccuuuagccaagcccuagucaacagccaggagaggaagccugccaaccugccagccugugccagccgccugacgggacauaugcugggcagacgcuggugcccuacagccagcccagccacagcacgggacgcugagcaacuguggggcucugcaucaagccauccugacccaggcggccaucagucucccuaacagccaucacaacugcaagaaauaacacaacugauuagaauaacagagagcgaggcaugccauuucaauuuaguuguuaauaucaaaauauuugguuucagggcuggcgacaugguccagcaggcaaaggugcuuaaagcccaauagucugaguucaauucagagacccccacaugugugcagugccgugggcgugagcgugugcacacugacaaaaaagggagaagaaaaaagauucaagcaagcaaaaaauaaauaaauaaauaaauaaauaaucaauuuuuaaauucuuuccauacaggugaguaucaguguauauuuauuauaaaauuaagugaaaguaaauuguauggcaggauaaacuugaaacacgguaguaaacaaccagacacagaggccaauggguaucagacugcaugccaggaaaacaaaguggccgugcacagaagguagucagaggcgaugcagccugagcagggaggaugggacuggaugcuaaucggggccacagcagucuugguuuugaggugaggaaaagguucuggaaacaggcgcuggaggacaacucugugucgagggcucuguguaagcucugugucacugcuccugaagaggcccugugauuugguuuuccuagcacccacgugguggcucacagcugaccauaacuccaacuucagggggucuaaugccuucuucuggccuccacaggcucaugcaugcauguggugcacagacaugcacacauguaucuuuauacacauaagguauauauauaaaaaaaagaauauauccuuuaaaaagcuuggaacuauagauagcacugaugguugugucguaugucaaugaguuuuacaguuggaaacgggucaaacgguaaauguuaggacugggcugcucagcagagugcuugccuaacaagcauggcacucuaggccugauccucagcacagcacgagaccggccaugaagaacaagccugugcuacuaccgcgccucaggaggagcaggaguucaagguuaccauuaagcuauacaagaauaauaagagagaauuguaacaugacaaguuuuaucaggauucaaaucacaguacuuagaauagcuaccaucuucuuuaaaaaaaaaaaguuuaaaaaugauguuuaaauuuuuguuacugaauacccuuucaacucuucuuaaaguuuauuguggguaguggggaaggccagaauucugaggacaucuuaauaucugaaaucugccauguugaaguagccuaaaaccaaaaauagucaaauuuccacagucuuugauuuaaacaugauaaaaaaacacaagaaauucacuggaaaucuaugugagaaaugaaguccccagccccaaaagaacagaacuuacacagaugggguaacgagcuuucuuauagaugaguucauaaagcuaaaauguaaaccaacagcccacucaguuacuaagggcugccaagcacgacuuagucauccaggcugagucucaagcauaaagaugcuucuggaaaacacggucaugggcaacaauuuacagaaucccauccgagaugagcaaagcgcagagacccugcucaguggcagcucccccuaccccaacccccgaccaaggaacggaggggccacaccuuaucacagauuuguuaaggaauggauuuuggauagugggcuuccaggcagacaguccggggugugagcccacagggcaaugcuccuugagcuuaaguauggcgccucugcagagauaaggcagggccucuggaaacauagcuugugcuugagcaagugacgcacccccucuuuaacacucuuccauuggaaacucugggcucuuguacugggccacuguugacuccuagaccccucauguucugucagaggcugucguaugcacugugagaugcugugugacacccacagcauugagucaugagaaauaaaaccgucuacagauaucaccaaauguucacagguaacaaugcacuugauggaggaucagugccugcuacucucuguaauccauaaugacagagacaacuaagaaugugguaaacaccugggcaauuuaaugggcaguucccugacacgugccugagccuggcuggcccaguagacacaaugagacauuucuaaagggcagccguaugcuuggcugcaaugcaacuugguaagaaaaauggucauucugggcugaggagaggcucgcuaaguaaaagauccuacugcucuuccagaggacccaaguuagguuuccagcaccacuaccagggacucacaaccuccuguaacugucccaggggauccaacauccucugaccuccauggcacuuguacacacauauguggugcauacaaaugcaugcaaggacagucaucucaacaaauggcucuaugacagcuggacaucuauaucuaugucuagauguagaaucggcccuucuuugaccaugcucaaaauuaaucccaauugacuuacaaacccagagccgaauuauaaauucuugggagaaaacaaaggcaugugccuguggucucagguuagacagugcuccuuauguaagaacaaagcacaaagcaggcagacugcacuucaaaguagccuggaauuuguuccugggggcaggggcugaagaccaaggacuuauacaugcaagguaagugcuccacugagcugaacuccuacccuaaagauuaagaguuuugaauaaaaauuuuaaacugugucaaaagacugccaaaaaaauugauuaagacuacccaaagaauaguagaaaauacucaaauacauucauguaauguucaaacauuauugauguacauaauaauuuacuacucaagaguaaaggcaaacaagcaaaacagaaacugggcacaucuguaaccccacaaguugaaaagcaggaagauuagacgucuaaggucaaccuagggagccuaguguccccugaggccagcucugcaccaugccaugcaacacuuuauaccuacucacugcccagcuggguugagggcaucaugugggcuuuccagcaagcuaaguggcagcccuugcggcuugcagucuaccaccgggagacagccucaucuguccuuggguggcaggguguccugacaccacuccauaggggcucauacagacuuuagaacccugacaaggagcaagcccucaacaugucagauauaaugcugauggugcaagagguuggcagcuccuccagggagaaggcuaugacgacuuguuacagauugucacacuguguagauauuccuaaaguucugacuuuuagcauccuaaccacacuaguguacucuggagcucagucuucacccaaauccaagccacaugccuacguggugagagcccaggcccugcuugcccaagucaaugggagcagcaguguggugggucuccugcggaugaugucagcacgacggagcugguacucagcaccaacccacucuguagaguucaugcagcuggcuagagcuugguucucacaagcaggcugggaucaagggcuccuuccucuugagaaagcccuggcaacgggguccaagagcugccagccucuguuggcacccgcugguuucaguuagcucuguuggcagagcucccagcagggggcaccauguguccauacugagcccagaugaagcugugcaagaaagcaaguguccagcagagccacaggugccaggcuuccggagccaggcccacauggagucuauagacgcugacugggggcccugagucuccccagcagccggccuggaccuggcacagcagcuuccccaagacuacaggacacaccugugauauguuccuauccagauggcaucacggggugccagaacacacaaugccaccaucuacacuugaaccauaaacauaucccaacuagagugcauaggggacacaacugaggguggcugcuguuguaaugcacuacgcucacagcaaauaccagacuacuuacuccccagggccaccagcacccgguguggacaaucucaguguguagacuaaguuucuccagcaagggccaguggcauucuauaugguccaccaucauggacaggcaagccagcagucuggguggcuucggcuguccugaauacucgagggccauaggaccauagugucuccagugaccacugucaagaucacacagccccagggcacugucucuuggaacagcugugggcuugaaaagaagcccuuuacaucccagcacugcagagaccagcccugacugucccacaggaccacagaaaaccucuagggcacuaaaaccgcacaugagaaccugacaugggccucagacaaaagcugguacauucucugcagcucaggcucagaguacuuaggaaaaagugagucuggaaaaccccuccaccccagcauuggggcuguauuaacacaggagagacuguacgaagacccacucuccagggcucuacugaaccucucaagaaaggucuggggugggaagaguuacaccauucaguucccucaccugaagugaagcuagcaauaccuaucccucugcaggagacaggaaguuagcuagcucaugacaucccacuaaagaccagccccuaugcgaccauuacuucgcacacuccauagcccaaaagaccccugggaagaccuuccucaucagaacaacccaagacacauccuugcuucuuccccaucugccucauggcaugcaggcaugcgaaccaaggagaacacucguucagaaggaaggugggaagccuuggagcaggcgugaggcccuaccugaugacacaguugccucgguuggaugcaaagaugacaaugggggcgauggaggacuccagggcucggugcagguagguaaagcacucgauauccagcauguggaccucaucgacaaaaagcacuccagggaccagcucggccacacccuggucaauguauuuguucaccacuuuguugaucuccccucgaaguuuaucuagaugugggauggcagggucagcaccagcaaauagcucccgcucugagcucggacuuccacccaaacccacccuacaccuguuuccccaacugugaggccccagcaggcccuggccccauuccagcuucaguuacaucaucuaaaacaggaacaaacacaccuaaaggccacagaacuggcagcuuucccuaaaguuguuuggcuaaccccaaguggguugugcacaggaaggccaugaccuccucacacgccccacccugccuuauugcucauccucccaacccgauguccagcucccacuagaacucaagucuagcagauuugggagccugggacgacaggaguuuucauaugcaaauauuccuauguugugcucugugaaugacccugucuuauggcccugugugacguugccuucaaucacacgcagucucaguccucuccaaacaggaagaugguuucaggccuuacaagauguuauccauagucaaauaggccaccacgagucacagcccagucuuaaccgcagcaguagggucuggucauaaacagaacuguaagaucugcuggaguugcuaccucuucuaccaaaucuaccaguaagaauugccugagaacaaagagcaaauucagggcaaaagacuacagugguugcugcugcaugcagcacacacaccugugaccccagaacuaggaaggcugaggaggaaaugcagcaucucuuagucaaggugauccuagacuaaccagugaaacccugucucaucagccacacaaagccaggcaaaauccagacacagcugcucuugggaucuggaagaaccgucucagcugcucguccagcugagaccuccaagaucacagagacuucaugcuucacacacagucaccaaccuacagguugcuaggaaacgauaacagaggugggaagaguauaaaggccacaccagagcagggcagagggaagaagguggugcugccauggcagcagaguucgcuccacuucucaacaucccuaggaccccaaagggaccagaaacucuaggugcccaggaccagagagcacacuacugucuaaacagagcacagaugacaagguuuaagcugugaucucagaggagggaagacaccaucaccacgcuuauuuuacuuagaggagcacauacagccacuggguuuggcacccaggguccugaucuacuguaggcucugggggcaggcagaucaccagcucuuaccugugaucucugucuuuuuuggcuucaucaacuggcccaucauagacagaauaucuugcccacccuggaaaagagaagacucagucagccagagaagacugaaugaccaugcugucuaaggaggcuaccaaaccuaauuccccugcuuccuacuggucuccaaugucaacucacuuggagaugccaacacaagcccccuggaaaguuuauauuuucauguauguguuuucauguauguacauuuuuuuagacaggguuucucuguguagcccuggcuguccaugaacuugcacuguagaccaggcagccuugaacucaaagcuccaccugccucugccuccugcugggauuaaggcauguggguggcaucaugcccagcuuccuugauaagcuucuaaacacagaggaacuucacaggcuccagaccucuaggaaucaaacaaacucuuuccauugggaguagagugaacagggugaccucuucucccacuuuaucuuuuaaaauuuguuacuccuggauuaugcacaaaggaccaaagcuaugacucaaagcucuggcugucugugccaucuuccugcgaggccccuccuguuaggaagcugcucugcugacacucuguccccacacucugccuaaagcagaggcuucugaggucaguuuggagacagacaucuaccuccuaaaggcacuugcuggucuaggacugaugucaacaaucucuugaacaaagccucgaugggcccauucuccacugcugcugcagagguggccuagggaggaugaagauaaauguaaccugaaaggccaccaguaaggaauuuguguacuuugguucuuugaaucaugucccucagaauuguggcuauggaaugacauccuuuccuacaguuaucagucaaggucuaaauauuuacugucccuccagaguugcgggcuuggguccagcucaaagcuaaagguggcaaggcucugcuaaguggagggaggucacaguugugcgaggcuuucagaaacccugugaggguucacacagcacucaugcccuccugucagcaauaccuagagcauccaggcacaagucacugcuggagagaagccagggaggaaguuggcuagcucagggcgggaggcuuggcugcaagaagaaauagcccaggaaaucaucugugacuggugcacuagaaugggaacaaaggagugcugcguagcucaugcccauguuaauugccgaacaucacagagagaaaaggagcgccugccuccaaaguggcagcaagaccuugccgauucauccccagagcuuccaggcagagacaaaaggcugcccgagagcuccucccacagcagcacagcaguaccugaggccgcgcauuagccacauccaggucaugcaaggucacauccuguaugauuuccuucuucuugugcacaucucccuuuggcaaagggacguacucuucagcuucaaggucaaacucuguggcauaggugucacaccugccuugccucuguagacagagagacagugaaugcuguguggguuuucacugcccagcccucaaauggcagagcucagugagauagagggucgggucccaacugcagccuaacaacgacagccucccugacaauccccccaugugcccaacccagugugcccacuacccucugccaagagaaggaagcuaccggcgggucacagauacccgauacuuucuccagaguccccaacacccguaacuguaugcacuucccgauaaagggcaaauccagcagauuaacuggagacagagggagcugcucagacucuuuuguaggugggugauuuacugcuugauaucaaguauuaugcucauccauuaaacagugagcaacacuguacaggacacugggaaucagauacgaaaagaaugccagcuaaugccgcauuccuucccacaugcauauaucuugggaagaaaauaccagagagauaaaggaagauuaaauacacugcacauuucaauuugaaaaugacuaaaguuguuuuggucucucacccuguucucccccucuaaacaggucuuaguauuucuaacagacugucucuuuucacgaugagaagguuaaagaaugaagauaaggaaaagaaacuuuauaauucgcagagggacaacucuguccuucccauggcauggccccagacagugcccaccuccuccagcaccugggucuucgugacucacaaaucaggccuagugcuuugucccagggaggacauuaccuucacagcuccacuauuugcuucaauguaaaucacaucuccagccucuacucguucuuucugcaaacuuucaaaaauacugggguccagcugaaaagaaaacaagggugacucagagaacugcaaggcauguuugacuuccuuuuaacaugcuacaaagugccucucuaugguauauccagaggacuaacaagugcauagagcaucccccaguggggagcaugucagauaggauaagggugaauaguccaggagaggagggcaagugagcccacaagccagccacaggguaccaagauaucucucaacuuccuuagcuucauaggccauaaaggagugaaaacagggucccuaaggguggcucuggcugcccuuauauggaugacgcugaccacagaaccaacagcccuauugucccuuucuguucuaccuuccuaugcuccucaccugcccucuagaagcccaggcccuuucuaucauagaacuugccagugccagcuuaccaggcuggauuucugauaggcucaugauucuagagccuuguuuccucaucuccuaaauagcccugagacacacaucaggaauauauaaaauuaaauaugagacacaagcuaggacucuccuggguucugaguagaaggccagugcucagggccugccugugggcacaggcagacuggcaagcacaggccugcugcuucccugggcuccccagacccuugcccuuggcuacuggcauucuagaacaguaucuuuuagauacaucucucaaggcuaaacuucagagcuguuacauuugugguuguagugggggaaacuggagcuauauucuaaauaaaauuaaagaguuaagacccagcaccagguagaagccaaacaggaaagcacacccuauggccccauuucugucaacuaguagaccuauagagacaguauauagcuuaaugccugccugggcuaaggguggggcugggagacaccaucaauggcuugagguuccuucuggagguaauggaaauauucuaaauuuagacugugaugauggcugugugacuguauauuaaaaucccuucagaugcauacuuaaaagcaauguuuuuaaauaagcaaauauuuuaaauuugaccucaauggagccuuggaacacuuaccaccucagcugcaaagccaggaaucuaccuugcugcuggguggagaggggcuaccagccagguacugcuguagcaggacaaugcgugccaagugugcaaggcaggccugggagaugacuaagugcuugcuucuugaacaaacugagacaugcccuucacacuagaccacccaccauguuucugguucuucuagacaguaucuacauuugcuccaaguaucuacaaguagacacauuugcaacuuuuuaacuuuccccuuauuuuccuaaauaaacuugucaggguggccuuauggauaggucaaauuaaguugcaggucuuugaauauaugauacacuuaagaauauacugugugugugagucuccucucaaguguuuuuaugcuggcuaaguucccaaaugaauuggcugaagcugauuacugagaaggucacgcccccuccgcuaggacaccuccugaguacagaauggagccugagcacuuggcucgacagagagcucugccgagguaagcuccugggacgggaugaagagccccgcuaggaaaaagagaaauggcucuuugaagaagugacauuuuuaugcucuccauaaaacagugaccaagaaacaaccucacagaaucacagaaccagaaacaucagaguggaguaaagacagaaaucacccaucugaccuagcagcuuccaugaagagcugagagcccugaugacuuguuggguuguacagcaagcugcaaggcagacggcauaauggccgagagcagagccggccugccauugcccugggugggcuaaugcaggcuucucuggccucuaggagcagcugcucacuuaccucuaagagagggggcuuuggugugugcacacacauggacucacaguacgggacgcaucugcggaagcugucagcauaggaccgacacacucucaaggagggugugaugacuuuuaccagucaucguguuaauaacuagugcagagcuacgacagauagaaguuuuacccccaggacucugugggauaauuaauuaguauucccaaacaaacaaagcugcucagagaccaugccacuucauguacaauucccuuugacuuugaaguuuaugcucugaucccaagcauccuggccuguguccuaaggaaugauagaaagauucaagagucagacgcaaaguccuacucaguacacugcaaccuuugagcgucaaccauggaagccuaugaggagcugcaguaagagucuguggcccagcuagccgggcgugguggcacaugccuuuaaucccagcacucgggaggcagaggcaggcggauuucugaguucaaggccagccuggucuacagagugaguuccaggacagccagggcuauagagaaacccugucuugaaaaaccaaaaaaaaaaaaaaaaaagucuguggcccgggagcugucugcaagucugacagauuccucuaggcgcugcucucugugugcaucagauggcuagaccuugguuauggaguaucauauggaauacgggauggcagaggcaggcuccucacguacccaccagcucauucuaauguacacgugugguuuucuagaaggaagagaacagcuaaagaugcugaaucuucaagggcuggguccugcacccucuccuguucugugacuuaacacccuacaaugaccugugcagcuccacagccacagugcacagaacucaggacaccuuucgcagagccacacaccacacagugcugggcaguuaagguaagagcuccacacacucaccuucagcuguuugguuccuuuagcagucuugagcccuaugaucacauggcugauaguuuugccguacccacccaugggguucucugucucacagggagugagcucugucaccuccccuucauaaaccuccuuagucuccuuuauccgcaacccugaaagagaugguaaaugggccaugagaguagaaccauuucucggacaccaccuuuuucucacacaccuacaucccaaaacucuuagucauaaacaucuauggcaaaccaaccuuaauaauauaagcagaaggauaucacuguggacagaaaacaguagagccacaagugcaaacuggagagcaggagaucugacugcucaaccuuaaggauuuaauuguaugugugcauguuuguuuguggaaagauaugcaugugacugcagguaccugcacaggucagaaaagggcauugggugcccuggaauuggguuuacaggucacccugaaugaaaacaggggucacccugcaugaauacagggaacuaaacucaggucuucugcaaccuacugagccacucccauggucccugauuucaaccuaaaaaaaaauuuuaagaacacuuauuuuguuugggcacgaauguguguggauacaggaguguaugugugcaggucagaggacaaguugucugucauuucuuccuuuguaccaaguggauucuggaaguugauugaagauaauuaggcguguaccuuuaaccacugaacuauccuaaccacccuugaguguuggaucucuggaacucaaauggugaaaggaaaaugcucguaaaugcuaaaccaucucuccaggccugaucuuaaacucuuaauccuccugccucacuuccccacuccugggauuauacauauaugcugucacauccagcccugaauuuaacuugaaauaauguuaacagaauguuguacugggaagcuucagcugccugcuggaaccucacugggaaggaauaaggaggcacaugugaugcacacaugcaaucacgcacgcacgcacacacacaccagaagccuuaucuacaauuugcuccaaauaaucuugaaggggacagaugaagccuuuaugccaauccaacuuugagcugaagcugaugacgacauacuugaugauuucuguacauuuucccugguuaaguuaaaaagaaaaacaaauacuacucccaaccuccagccagaacgcuaacaggagaaaggcacgugauaccaagaauucaguucugaaaagcuaccuuaaggucuauguucggccggggggaauguaaauagcaugggaugaucugcugcagccugccaucuaagguacauggccagaagcauggggcucccagcagugagaaggcuacaguuacacguaacaguagagaugaaucuugaacagagaacacacugggaaaggcaccaucagggcagaugaaaauaaaugugaagcccaaagcaagcgugacuucucuacaguguaagaaaucaagaccauccucacauggaaagggacaauggcugagaacauggauguucuguguguuuagaaaguaaagucuaaguaagcagcgcugugagaccuggugagggaggcacagccaccgcugaggagacugcucugcucuucugcuggcucugugaucaugguucucaccuccauacccauuuaggggacacugccguccuucagcccaucuguacccacaccauccucucugcagaaggcucuaaaguuaggcucagcagagcccaguguagacaguaaacaaugcccauucuucuuacaggagugggcaugauggcugcuccugaucgaaggaugccaauucuuggcacucagcuaccugucugauauggaaaucucacagggccacacuggcagggugugaacgcucucuaucaccuccccaucucaaauguggccauuaccuuaucaugggcucagugccagcuuucucccagaaaccuaaucaggacagacacuccaacagcccaguccaccauccaccugauagccuacaaauggaggcauuggaacagccccaagcaaggccacacugcugcuuuauuuacccaauucucaguuccugaguccugggaacagagugcaguggaggacugugacaacccagcaacugucccuuugagugagcuuacaacaaaucuuacacauccccugagagcagcucccuugacugcaacccaaaauucuugcaggaggggcagaggcugcccaucgcucacuggugccucuauuuguuagccgcugcucugugcugacaagcaggcaggggugugggugacagacaaugagaccugcuguuugcuaggagaaaggccgagcggugcuaucucuggcagaaaugacacaaaugacggguuucaucugcuggcucagguuuccgaaccccugacagggaccuucaucacaucaaggaaauagcacagacuccugcuuuucauuucuggucaguauacaguuuccccccacccccucugccauccucaccagaauucaaaggcacagggcagggggaugagcaggccuccuuucugaagacaguugauggccugcccuuucaugauauucaaggauggauaaacuucucuuuaccuuguucccaucaacagauaggcaacuccugcccccccccaccaaacuccaaaccauggccaggcgcuaagguaaauuaauucaucuguauuuuucaugguucauccaaaugcaugcuccuaccugaggcucauuuuuuuuucaaacuuugucaaugucagcaaaacauuuuaaaauaaauuuuuaaaauuugaaacuauccauauauuuaaagcaaauguaauaacuugcuauuuaacuaauuagcgaguuaaaagaaacuacagggagcugggugugggaaaggccuucaaucagcaccaagaaaggggaagcaggaagauugaaguaaggacagggaggcuacaaagugagguccucucucaaaugccaauagaguaggagggagggaaggagggagggagggagggaggaagggacacuagcagcagcacaucacagaaaaaggaaaagaaagucaccggcccaguuuuaguaacugaagugugcuggguaggaugucugaggccccagcugcuugccaggcugcggcaaggaaggaccccuuaagcucagcaaguguggcaaaacggcaacauagugagacccccaucuuaaaaauuaaagggagugaggaagggacaugggggaagggcacaaagaagggacagaaaauacaaacaaaaccaacaaaaacuacuucucagcaagaucugcagcccuggagagcccaggagccacuucugcugcuguucagacccucaugaaguccuggacaaagagcaaagcucagaugcaagagguaaaccaaccagguccugcccaccaacaaaucauucagucuuagcugucauccaccuagcaggaagcagaugggagagccauggguacuggaacccgugugggccaaggggcccccgugagcuccacuucacagcucaguuagguucucacuguucuaacccuaacccuuauuucacuuaugcucucugugucucuggauguacuuacacaguggagguguccugagccacaagagggccuuggaugccccagaacuggaaugauagguggauguggguaagugcagggaaccaaauucagguccucuacaagaacagagauguuccuaaccacugagcugccucucuaacuguuuuguagcuuuuaaaacuauaaaccagagccaggcagugguggugcgcaugccuuuaaucccagcacuugggaggcagaggcaggcagauuucugaguuccaggccagccugaucuacagagugaguuccaggacagccagggauauacagagaaacccugucuuggcgagauggcucagugguuaagagcgccgacugcucuuccaaagguccggaguucaaaucccagcaaccacaugguggcucacaaccauccguaacgaaaucugaugcccucuucuggagugucugaagacagcuacaguguacuuacauaaaauaaauaaauaaaucuuuaaaaaaaaaaaaaaaaaagaaauugucuugaaaaacaaucacaaaaaaaaaaaaaaaaaaggaagcaggaauaaaacuguaaaccaaugucucugacuuaaagugggagucacccaggugcuagauguggccuaguaccccucagaagacguagaaaugaacuuucucauagugcgaauaggaacagggcaggaugaggcagcaucacacagcuuuccuuaaagcuuucaucuuccucaaagccaucugcuucucucaugaaccaggaaaccgagggagcagcacuaccugccaggucuggggccacaaagacucauaccccucugucuccccagcaacuaugaacacccccuuccccccuccucauaguuccccucaucucaaacacaagcacagcagaacucagaggcaucaucugcccccgucucuguacccacaaccaacccuucuauaaacccuaagaaccaacugcaccacagacuucuccugcaucuagucacccaccccuccagcaccaccuccugcucagaccccagugggccucccucugcccugcuccaggaagggaacugcagagcuggacuagagcccaugggcaucuuacacuuaacugccuugguuuaacucaggguaaagcccugacccuggccuauggcagcagacuaucuccuuuccuaccgaccucuagucguccaguacauuuccuuaauacuucuuuuacacacacacacacacacacacacacuauaaaaucuuaaaaagaaaaaagaaaagauuacuuugcggggggggggggucugugcagaugugcugaggaauccagauguuuuauagacaccugagcaugcucugaccaacccauuuuugaacagcaaaccugaaaaucaaccuaaauguccaccuuaccugcgcucccaucagcucugcuacuuacuagucgcgacacuagccaagguaauuagcuuucuaagacuguuucuccaaaugccaaugcagacagagaagcuuggcuagaagaaugaacagccuggcacuguaauggcagugcaggcccuaaguggcuggcaucacaagucucaaagcuuagccagacccuaguguccuugcuuugacaggccacaacuccuuuggcuaccacuaaggaccagauacuauggcaguucagcacaucaugaguggcuugagucaaaaccuauucaauggggugugguagugguacacgccuuuaaucucaggaagcaauggcagguggaucugaguucaggccagucugcuccacagagugaguuccaaaacaguaagggcuacacacacacaaacacacaaaaacuauugaauggacagccacucucaaaagcuagacacaggcgcuaaaaaagccugaugcacauguguacaugcauuuaaaaagauuucuuuagccagugugguaggacauuccagcccuugggaggcggaggcggaggcaaguggcucucuguggguuuggggcuagccuggucuaaauagcaaguuccaggccaaccaaaacuggcucaaaaaucacuguauagccacagcuuucccugaggagguugguguuagauuaaaccuggagcucugccugugaaaccauaccccaccucuaagcuacccucugauacugaguuacagcuacucuuaccacgugaagaagccaagggccauaacuagggaccacauaugcucuacugcugaagcacuuugguuagaacacugaggucuugucauuaacuugcaaacauacugacaauguuaaaagagaaacagcuacaagcugucacacaccaucuugacaaccaagaagcugcaaggcaccuggagaagaaagccacuuccccacacaccacccacuagugaccauccuucccacacucaccacccacccaccacuuaccgacggccacccuccccacccaccacccacugguggcugcccucccacacucaccaauggcccugcggaaguucuccaucagcaccucugucuuuuugaucucaguugaguauaccucgcuacccaccaucgggcagaaagggacuuuacugcccagcuccugagcaauagcaagggccaaggcugucuguggacgacaaggagaagacauuugcuuuagagaugugggucauuacgagagcaucuggcagaaacaguauuguccuauucucuaccuucacaggcacauuccaugucugaaggucucugugcacucuuugcauagcacacccagccugggucaccaucacacuuagaacuauucccuaguaaaggccugacugcaagugcuucacaucuaaguaauuccacugccuuccccacucuaccaaggagggaacgggggggggggguaauacacagcccaagagccacaaccuaggaacaggcacacuuggacugcaguggugucucagaacagguucucgacagaaacagcaccgccuuccugacuguuuucucacaaccucagacagcauccagcccaucugcucaggcuacagugagucccgacacugcuuucuauggucaagcagaacuaccacagacaccaaccucuaggccagcagaaaucagcacucagggaaggcaucacuucauguccacuuuauguuaaguggcccauaaagaacgaaaccuuaggcagacuucugugacacauuagcaagcucugugagacacaaauggugcugguaacacagcuacagugggcagaggcuaagcaaggccuugcccaggcgagagcuguggaagauaugcaggaugaaagacgaaugcugagcgagagcagcugaagguauucacagacgccacagccucucacgcugguggccugaccugagagaacguggaagcagcaccguaagugaccugccaguggugcucuuccuccuuucagucccuuggcgauguuucaggacagcagacucuggcagcaagugaacauacagugacgugcauaaaguagcccgugagacagagcuggccaguagugcuaacucugcugccguucagaggaaccucagcacgggagaccuggucagucacaugaaagacuaaaguacuaggcuagagcucacggagcaaacaagccgccuacagacuggcucuaggugcuucucaucggccggcggcagcaggugccucccuaccacagcccccucagcccucucagcccuagagcgucugagaacacaucuaacuaccacucuaccccacaaacccccagcaggccaucagcuucacgcucuccuuuguauccgccugcucugguuugacauuuuguuuuguugguguuugauuugaugggcuagccugguacuccugccucgacugccugagugcugagacuguaggcaugcaccuuugugcccagguccugguuuguauuuuaagauuaagaaacugaaacacagguuccuuaggccagacagccuggaugcaagcacugcccagagcccuauuuuccacugugugagcaccacgugaccaccacgaagcugcuccagaaagaaggcugagcacguuuccuuccaucucaucugaagggcgauguucuaggguccgagcacccgucccgccgucaauagcgugaggucuucaggaauggagcugcacuggcucaguaaaggugcccagucuccgcaggaagggaagcagccucagcagccucaucuucaggcgcacuagcaaucuccccucagacgacacacgccuccaugcuuaucaagucacaaaugcuuacaaaggccaaggacugagugcuucauacuuccucggagaaaacugucccagaaucacaaagaauaaagggguagaggaauaaaagauuuauacaagagccacauggcaccaacuccacaaaaaccccagggguccacaaagcaccuagacauacaagaaccacggacaacuuacgccaugagagucugcagaguguagcuacugacaacauacaacguuaaaacagaaacuccugaauagaaacagggccacagaggcaaaaaaagaugagccaccagggaaucuaccugagguacaaggcauuaacccauugguucugugccagcuccaagugaguucaaguccccugguguguguggugugugcuagaccccauaguccagaaaccuacagagcagggccacuuacuaaccucucaggaagcccacagucuaaggaaacguaagaagucucuuagauuagccacacccaacuccacaagcaaaaaaaaaaaaaaaaagaaaaaaaaaaugcagggagccuuuuuuccuaaauaagguacauagugucucccacuccaagacugauuuugaaggggaaaaaacaaaacaaagaaugacaaguuuuggggguagaggcaagagucagagagguaccacaggacagccaugaagacuucaacaaagccaacugcucuggauguuucaaaaaugucaguggugcuggcacacacuuuugaucccagcacgcaggaggcaaagacagaugaauaucugaguugugggccagccugucuacagagugaguucuaggacagccagggcuacacggagaaacugggggacauuggagggaguaguguugggcuggagaaaacaaaaugguggaggacagcaacucuucuaaaugaaaggaagguaaagacacagagauguugcuuuuguuguuguuuugacuuucucuuuccagggucacuagacaucuacacagcagguagucugaaguuuauaauaaaagggaaaagcugaaagaacuugaagaacccacuuuucuacauaucauacauauggcaugucuacaugucacugcguguguguguguguguguguguguguguguggccagaggcugacccugggcaucguccucagucacucucuaccuuuuguuuuaauguguacacaugugugucugugaguacacuacauguauucacauguccacagaggccaaagagggcauccaacccuggaguugggguuucagacccguguaaggugcucacugugagugcugaaaccaaacuccauucucugcaaggucagcaggugcccuaaacugaugagucaucuccacuucaacgucagagacagaaucugagaugcaaauucugacccuagcagacuggcugcuccucuuguccuggccuccugagcaccagcguccaagguaagugcuccaauagacccucaagacccucaagcacaguuuccugcugugccgucuccaggccggcugguugucgguuuucaaaagaaaacaaaacaaacaucaauuguguuauuuucaaaggcauacuccuacugagcagcaaggugcaugccuguaaucccaccuacuugagaagcugagacaagaaaacacaaaaaccuaaggccagccugggcuacagaaggaguuucuuaccacuguggggcaagccagugagacccuuucuccgacugguagcucgguguccuggggucaacccccagcacugcaaaacacaucaguuaagcuugaacacgaacccccccaugcagcggacagggcuccccacaccuuccuugaaagguauguuccugagacauccgcuuccuagcccugcuucuaauccuuuuucuuaauuauuuuuaguuuauaaaaacugaaagaaaugcuaacauaaacuucucauuaguaggaggagucaggccagagguaagaugaagaugcugugguaaauagcagggagccccauuuucaaaugguucagaaauaaagaaauagcaaaugucaaaaaaaaaaaaagaaucaucuccccugccauaaggcacagacgagccaaccacacuagucugucaguccuacuccucccacuucucaacuuuaguccaacugacagugugggaaaagauggcuccuuauuaaaggcccugaaggacguucagcaucacgucuggccauuagcacccaggaugccaaauguaggcugaaauuccacauuccaacuucgacuucaaagaaaaugggcaaagggaagagcugaggauguuccagaacagaucagagacagcauacugauguuuaagaaagcacaagucacaucaagacaggaaaaaaauagguauguguguguguguguguguguguguguguguguauugaguggauaaugaauugcuaaaggaaacacaccaaacuucuaaacaaacaaccaaggaagaaacacggacagaguacuguacccaacacaagcguucuucaugucugaggcaagcuugggcuacaggagaccuugucucaaacaaaccaccaccaaacaaggagaacaggaccuuugccacagacaagccuauaaaagacuuccagccaaugcacuuuaggaaaacaacugggcagagagggaaggcagagagcaagacauaagcuaugacaagcagauggcccauggaguggaccagcagaugcugucauuagaggccucuggguucagucuauucacuaacacagcucuucccuuuucaguaagacccugaaagauagcccugcagguggcacgucuuuaauccuaccucaggaagcaggggguggaacucuguguucagaaccagucugaucugcguauugaguucuaggacagccagggccacacaccaucuauucaacaguuaugauuucaaaguaagaauuaguuauucucucaccacugacuuaagaacuguggggggugagguguggaaagaaggcaagagccuauuuuuagcacacacaagccuggugcccggucucugcggccccugugaggaacacuagguacucuggugacucuggugagugucccaccgggucaggcauggugacugacaccuacaauccuggcacuugagguagcagcaggaugagcagcaguucaacggcagccuggcuacacaccaagugugaggccaggcugggauacaagagagagagacccugccucaaaaaaaaaaaguggggugggguggggugagcaagaugccucaguagguaaaggcacuugccacacaagcauggagucugauuuccagacaccacaacggaaggagaaaagcaacuccugaaagauguccucugaccucuacacaugcacuguggugcauaugugcaaguaugugcacaagcaugcacaaacacacacacacacacacacacacacacacacacacacacacacacacacacacacaguggguguccacucaaaaucuccaacacggugucuccugccuagaaaguccuuuccuucccuguaaggccaaucuuccuacaucucuuaaagugcccuccaaggacuuuaccucugcucuggagguaggccaggguaauuuuaauuuuagaccacagauuuuauaugcuaaauuguauuaaaacugcacauugguuuuuaaaccauucauuuaacuauuccagcuagacagagacuaguuaagacaugaauucaauggagcuuaaacaucaauaucaaugucuuggguagcuuaaaaaagagaaagagaaaaugaaugaacaccuugccaguuccaggaggccccgccaacaagacagcucuuccagccauuuucuugcuuuugauuaauucuacaaugacgccacaugccugcacaaaacagaaagaaacagucagucuuaaaugcauaaugguggaaccagcucagggcuugguccacacagcucgcacacucuuuugacacgagacagcugugauaccagugcugugcuguggaguggagcgguggaggugagguagcaaagccacgugcuccagcucacaccguauaguugcugccacgaagagagaaggguaaugagacgcugaguggcuaccgagggcugggggugggguggggguggagggggacuuucucauacauuguauguaacauuugaagcccugggcagaagucuacauuucagccgggcaguagugacacaugccuuuaaucccagcacuugggaggcagcagcaggcagauuucugaguuugaggccagccuggucuacagaguaaguucuaggacagccagggcuauacagggaaucccugucuugaaaaaaaaagaaaaagaaaaagaaaucuacauuucagacaaaaauugcaaacucaaaauaaccaaagcauaaguuugguaugucuaagcgacaacaugcugcagcagccaaaguauagugaacagaauggaaaaggggagguugaggcaagcagggaccagcacagaccuaguacuuaacagagucugcagggcugugcauuccaggccaguuugacuacagcaacauuaucuaaacaaaaaggguauguaugcuaugaauccacccaauaaaagaauuggcaagggcuggugagaugguucagugggugaaaagcacuuguaguguaaaccugaggaccugaguucaaucccuggaucccacaguggaaggaaagaaccucugaccucuaccagagcaccauggcagucacaugacugcacugcauuugcgcacauuuugucaaacaggaaaagaaacaaagaaauaucagcuaaggaagccagguguaauggcccacaccuuuaaucuuagcacucaggaggcagaggcagucggaucccugugaacucaaggccagucuggucuacagagucccaggacagccagagcuacauagugagacugucgugaaaacaaacaaaaauaaauaccggcuaacauucaaagaauaggaaggauaagauauggaguaccagaggcugcuggugugggugcagaugcaggucuagagcagccucugaagucacauacacagaaaugucacauggacagaaaugaaauaagaaacaauagacucaaagcugccuggccaauagaaagcauuaaacugcuacuaccugcuugcaagaaaagaugcaagcaugcuagggucaaacauuucccuuuuuggauagaugaugcucuuugcugcuggcacuuucugugugcaagaggcugagaaagcagucuucaccacauguaaaaaagcaaguuuuuguagacacugaaccucugcagaguucagaguggaggaggcugaagaaaugggaagaauacugauuugauggggguuagggggagggagauaccagccucauuacugcuaaacuggcaggugguuaagcggccuaacccaccuuuaacuucuucaugugcaaaacagaaccgauagaaagaccuggcaugacuuuaggaagacugaccuggaaaagcuggagugcuuggauggggaauagaucagacaguccucaccgcuccacuuaacagaucagcucccaggcccaaagaacccauaucaacucugaaaacguagucaauucuauacuuaaccgcacagccuuccacugcguuuccggugaggucuaauuugcgugccgugacccgcaaaggaugcagccuuugcucgcuagugugauccuuacuucuuagaucuuaguggauccuggucccgccgcccacaccucgcgcacaagccccacgcccaccucucucgcguucuccuggcccacgagacccgaagccgccugcuuggcuaggccgcucucguccagccccagacccuucacguggcugugggaggcgaugcgcugcgucuucguggugcucuucaccuccucaaucuucauuuugccgagugucuaggaacacaaccugcguggagugguaggaacuaccgcacgccaggcgccuggguuaccacgcggccguuacuaggccgcucuccuggacccgccccuaucaauaug
